United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 9

SEQ ID NO: 280 - DNA, 430507 bp, Homo sapiens
taatttttaaggcagggtatctttaaattcttcaaatgatattcaaataaactttgtcaagaaacatgattgcatctgtttgtctcgtaatagccatacattccatttgctggatttgattattttatcatattaatgaatcatacgtgatctggcaaagtctgagtgcttatttaaaaaggtagttttggctagacgaggtggctcatggctgtaatcccaacactttgggaggccaaggcagacggatcacctgaggtctggagttcatttgagaccagcctggccaacatggtgaaaccccgtctctactaaaacataaaaattagccaggtatggtggcaggcgcctgtgatcccagctactcgggaggctgaggcaggagaatcacttgaacccgggaggcgaaggttgcagtgagccgagatcttaccactgcactccagcctgggcaacaaagacttcctctcaaaaaaaaaaaaaaaaaaaattaaaaaataaaaaggtagtttataaaatctacatttatagaaaataaactatttacttttttgttttgttttgttttttagacagagtttcgctcttattgcccaagctcagtccaatggcgcgatcttggctctgcaacctctgcctcccgggttcaagcaattttcctgcctcaacctccgagtagctaggattacaggcttgtgccaccatgcccagctaattttttgtatttttagtagaaatggggtttcatcatgttagccaggctggtcttgaactcctgacctcaagtgatccgcccgcctcagcctcccaaagtgctgggattacaggcgtgagccactgtgcctggcctatttacttctaaaagataaatttaaagacagttctacccatgtatctaggtcacagtcagtggtgtgagatcgagaggcatttagagcttttgggtcatagtgttcattggatcattattctcgtagctaaagtaaaacgaactttcaggaggttaaatggcttgaacatacataccacaggctagtggcagagagataacagaatgcatacatacaacttgattcctagctcagtccttttcccattaaactacatggctcattattcagttgttttttattttctggctatgacaaattactaatgaggtcaaggatgtgaattcgattcttttactgaccaattaggcttacaaagaaaaaaattgttaggtggtcatagcagactacatgcctcattctgactggctgatgtgtgtgggataatggtcagaaaaggaatcaggcaagtgagtcacaaatcttgaaaacagccatcatcatgactaaaacccaactcaaagtaaaaggcctgcacatagcatgccagtgggttgttgaagtccacagagtagaaactgaactggaaccacctccttaggatggattctaagcagaaaaaccctattttcattcttcaatggttgtctcaccttttctttgaacctagaacataaatatgaatacagacctgctcatgattacacatctgaacacactttgtttttaatgccttcccctcagaaaataggcacagcatttctgaataaaaaagaatgaaagagtatctactcttaagaaatcatttttgccaagattttttgcacataaatcaaaagtgacaatactgtttcttcagaaacagtagagactctttgaaatcaatatagaatctagtataacccaagcaaagttaaatatgttccagagactgaagtgatgttttcattagtaaaccccaaatcttaagggaatgtgcattctaacaagttagaatagttagttactttttaaaactttcattttaaaatcaagacatttaaaaaacagatgctttggccatttgcttattaaactataaatattaaaccaaaagttatttataggtatgatatactaacggcactctattagcttttttcatttaaatagcaaattcagacataataaacactcataatctttttggtttattattctagtttgcaagattttccatttttaaaaattgtacttatttacatcctgccttgttccaaacaagattcaaggtggggtattcaattaagtttataaaataccataccctccaaattttactgagtcaagaaaaaaagctaaaagctttttatcataaccttttaattttatcctcctgcttgcgggcatgctgtttaagtaaaatgttctcatcatgcaaacgcaaaaatctgtcttccagttcctcacgactgacacgtgacactgcctggcgagacttcattgtccgtgttgttgaagtttctgcaaaaatgccaagataattaattgtgaggttacttaaaatagtctctagaaactcttgatattaatataatctctgatgcactcatctgagattttttcctttgtgacctacagttaagattgctttagaaaatgttgtaccattgtttacatcaattatttaaggtgagaataaaaatctttgctattaatactttatatacagttttaggaatttgaataacaatagtatccattcaaaaatgtattcaagtgccgttctttaagaatataagatggaattctgattcaataaagacttttgaatttacctgctgaatgttgtgacaactaaaagagtatccgaagcttatttttttacaaaggcaagagtaagagtaatttggtaaacataatataactaagatatttttctgtgctatgagtgtcttagaaaacaaactataaaagttgtaagaccaaatcaaaaaacccctaaatttaaaaattttcatttaaaagcttcacaaataatttctctttacactaccttatataaattttaagaacgtttatactctttagcatgtgtttatgatttctttttacagacgcttaaatttggtattttccgagccaggcttggtggctcacgcctgtaatctcagcactttggggggctggggcgggtggatcacctgaggtcgggagttcaagaccagcctggccaacatggtgaaaccccgtctctactaaaaatacgaaacttagctgggcatggtggcggacacctgtagtcccagctactcaggaggctaagtctggacaatcgcccaggaggcggaggttgcagtgagctgagattgtgccactgcactccagcctgggtgagagagcgagactctgtctcaaaaaaaaaaaagaaagaaaagaaagaaaaaagatgactcaataaaaaatgagcaagctgcttgaacaggaacatcactgacagaaaattcatatgatcattaaacatatgaaaagtttatcaatctccctctccctctccctctccctctccccacggtctccctctccccacggtctccctctccctctccctctctttccacggtctccctctgatgccaagccgaagctggactgtgctgctgccatctcggctcactgcaacctccctgcctgattctcctgcctcagcctgccgagtgcctgcgattgcaggcgcacgccgccacgcctggctggttttcgtatttttttggtggagacggggtttcgctgtgttggccgggctggtctccagctcctgaccgcgagtgatccaccagcctcggcctctggaggtgccgggattgcagacggtgtctggttcactcagtgctcaatggtgcccaggctggagtgcagtggcgtgatctcggctcgctacaacctccacctcccagccgcctgccttggcctcccaaagtgcccagagtgcagcctctgcccggccgccaccccgtctaggaagtgaggagcgtctctgcctggccgcccatcgtctgggatgtgaagagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctttgccctgccgccccgtctgggatgtgaggagtgcctctgcccggccgcaaccctgtctgggaggtgaggagcatctctgcccagccaccccatctgagaagggaggagaccctccgcccggcaaccgccccgtctgagaagtgaggagcccctccgcccggcagccgccccgtctgagaagtgaggagcccctccgcccggcagccaccccgtctgggaagtgaggagcctctccgcccggcagccgacccgtccgggagggaggtggggggtcagcccccgccaggccagccgccccgtccgggagggaggtgggggggtcagccccccgcccggccagccaccccgtccgggagggaggtggggggtcagccccccgcccggccagccgtcctgtctgggagatgaggggcgcctctgcccggccactcctactgggaagtgaggggcctctctgcccggccagccgccccgtccaggagggaggttggggggtcagcctcccgcccggccagccgccccgtctgggagggaggtggaggggtcagccccccgcccggccagccgcctcgtccaggaggtgaggggcgcctctgcccggccgcccctactgggaagtgaggagcccctctgcccggccagccgccccgtcgggagggaggtgggggggtcagccccccgcccggccagccgcaccgcccgggagggaggtgggggggtcagcaccccgcccggccagccgccccgtctgggagggaggtgggggggtcagccccccacccggccagccgcctcgtccgggaggtgaggggcgcctctgcccggccgcccctactgggaagtgaggacccctctgcccagccaccaccccgtctgggaggtgtgcccaacagctcattgagaatgggccatgatgacaatggtggttttgtggaatagaaagcggggaaaggtggggaaaagattgagaaatcggatggttgccgtgtctgtgtggaaagaagtagacatgggagacttttcattttgttctgtactaagaaaaattcttctgccttgggatcctgttgatctgtgaccttaccccgcaaccctgtgctctctgaaacatgtgctgtgtccactcagggttaaatggattaagggcagtgcaagatgtgctttgttaaacagatgcttgaaggcagcatgctcgttaagagtcatcaccactccctaatctcaagtacccagggacacaaacactgaggaaggcctcagggtcctctgcctaggaaaaccagagacctttgttcacttgtttatctgctgaccttccctccactattgtcctatgaccctgccaaatccccctctgtgagaaacacccaagaatgatcaataaaaaaaaaaaaaaaaaaaaaaaaattggtattttccatatcattgtgaagaaggtcgattttcaacaattctccaatagaaacaaagaacaactgatagagactaaggtcctgtgataggttactgagcacaagaattgaacttatagagtatcaaaacccaataaatcactttgcacacttacaagttatttgtataatacttgatactccctgaaagatctgcagagcaaagcttacacatactttttacttctaacaataaaatctgtgtagccaaaaattagccggcatggcggcgaacacctgtaaacccagctacatggcaggctgaggcaggagaatcgcttaaatccgggaggcggaggttgtagtgagcggaggtcgcgccactgcactccagcctgggcgacagagcgagacttcgtctcaaaaaaaaaaaaaaaaaaaaaaatttctgtgtagccaaattttatctttttcaataaacaatacattgaccacttttctggttttcacagtggccatttacactgttctgattgaaaagtgtatgtagattcctaaatggaatgtatcttaaatccctagccttctcaggctagagggggattttacgttttctatgagctgttgataatcgatacatgcatgacagcatagctgacacaatggacacacaaagataaacacagctctctgttctaaattgttctttaaagtagtgcttttctttctcaatttgaaagtgctttttagctctacagcaactactaagtgataaaaggataaagaaaacctttaatccatattaattcgataaaaaagtcactatcatgtgagatattccacttaaaaggcaaaacacttaaaatacggcctttcctcccatataaaatttaaacacaaagaaatgttttaacactgaatgtaatttaaaccaggcaattcagtttggaggcttgatactctctatgtagtttctactgatgtgaggaattttaaaaagatgatttatgttaattctttatcagaacagaggggggactgtacattttctatgagctgttgataactgatgcatgtagtaaaataccatatgtgttctaaactctccatctttttgtttagtccaatcaaggactatatagttacttaaatggtttggtttgtatgagtataagaaatactttaaattaaaagtagtcagtgatcaaagttcataactgtaataaataacagctggccataccttgtaaccctcccattccaaagaggtttagacctgtatctttcacaggcaagtctcctgcagtctcatcagttggaccagacatggcctagctgtggaaaaaagaaaattcaaataaactctttccaaattattacattaactatgcaatggaatgaaccaaataaaacgaaaaagggactagaactttaatgggcatcttattgtccacatgtgctgcttggagaagatgaaagcttctattctaatagtactactacattcagtcatggagacagtgttcctttcaacagtgtatttcctatagtttgcttaggaaatgaagtaagattatcatttaagaaatacctcctctccatccctttcctctccccagcctccaaaagaaagcagatatcttggaaaaaactcaggtcaggaacttgattcaaatggttgctctatcattaacaaactagtcaagccacctaaactctctgagtttcagtctctcagttttaaaaatggagaaaataatacctatctcagagagttattctaagggtaaatgggatgagtaaattaaaagcactgatcacatgtgcctgggatgtcaatattactcaaatattgtctgcttgatgtacaaatgagtgggcagttctgtgcattttgtgagttttgtgaaagaggtttcgttgcataaatttaccaactgggtttgtgtttttttgtgtgtgtgtcttgcctttgttgccatgaggcctaggtctcacccagggttcaactacttcaacatataggctctctagctaattctagtatttttgtagtttctattctttacagaaatacaccatagtaactctattttgagtatggatgtgagtggtccacacaatatctagtatgcaaaaataaaggattttatattttcatttcaatctacctagtaagctacatgcaaactgtgaatgaagatactctaaagggcagagttcttaagctctaggatattggttctagaatgtaaagaccaagacagtagcaagcttcattgtcttgttcagctctgtattcttggaggctagcatagagcgtggtgcattctgagagcaggcattcattaaatagttgttgagtgagtgaatggagtccatggggtttcagggtctgtgaacccagagatggtttaccaaattttgtatgtatatgtatatatgcaatatcttttaaagagggttcataacttttattacaactcgcaaatggtggagaaccattgcattttgcttttacagaaacagctaacagacaaatccttgggagatcatctacttcttttggaagtactcctatagaaaaggtcaatttttaggatcctgttgacacataggcccgtgtatgaaaatgattagttttccatgacagagttaaggtcactttaaaaataataatgatgatgatgatgatgatggtgttaacattcattgaacgcttactatgtgccaggtactgttctaagtgttctgttataggaatgaagtgtctcaccatatccttgtgaggctgttactcaaatgattcctgctttacaaatgaggaagctgagacacagattagttaactcacttaaggtggtagttgaaagtattaatagttgtgtctggtgatatttttggttgtcacaacaaggaagcgggatgctactggcatctagtgagtagaggccatggatgatgctaaatatcttacagtgcttaggagacataataatgaattatccagcccaaaatgttaataatagtgtagaagctgaaaaaccctgcacaatgctgcaatgcctctccaacaccatcttatgttatccttctttgctcactatgcttcacttacattattctttactttcctcgaaccccccatacccttgtcttgctcaaggcctttgtattagctggttccttaatctttggagctcagttcacttcctcagacaggttttccctgaccatcctatgttagagtagtcttccttacatttcttcactgtttatttcttttcttttcttttttttttttttgagacagggtcttgctatgttgcccgggctggccttgaattcatgggttcaagtgatcctcccacctcagcctcccgagtagctggaactacatgtgcgtgccaccaagcatggcttgtatctcttatagcaactgcctctatctgaagttatcagataaaattattgtttgtctccactaaaaaaggataaacatcttgagacgggtattagtcttgttcacaactgttcaggaacagtgcctggtacagggtgggaaccaacattaatatttattgaatgattggctgtgcgtggtggctcacacctgtaatcccagcactttgcgaggccgagacgggcggctgacttcaggccaggagttcgagaccagcctggccaacatgatgaaaccctgtctctactaaaaatacaaaaattagctgggtgtggtggcacacgcctgtaatcccagctactcgggaggctgaggcagaagaatcgcttgaacctgggaggaggagtttgcagtaagctgaggtcttaccactgcactccagcctgggcaacggagcaagaacctgtcacacacacaaaaaaaagaataaagaaaaaatatttattgaatgaataaatgaatatcaggtactgagattaaaatggcaagcaaaacccccgcctttatgaagctagcaagttatggaggtaatcacatgataaacaaataatatataattaagcaaacaatagaccactcaggaggtttagggtctaccaaccaactcctaatccagggcaaatgagcaaactgtgttagggacctacaacttgcaggatctggatagagatggcaattagcagcatcaactctcaccttcatggctgggatataacatttcaaattggtcctggacgtggggataaagggcggcctgtgattcaggcctgaggatgtggaggtgtcttgggctgggctgctttcacgccagcagaactccagggccaactccagggccttctccaggcggcagagcggaccctaggaccccggcccgcgctgcagtggggagggtcagcaacctccacccaccctcatcctcccccatcctcccgggtactcaccgtgccactggccctgcagctagctaccgttgctatagcgccgacagcgtggcgggcggctggccgagaggagcacgggagaaacatggcaggctcccgtagcctcctgggaaatgtagttctccttggactctagcctgtttgctcgcggggtagcggactacgctcttccagctgtcggacctgggaaattctcctgtgctaaatcccgtggcgctcgcgggtgtcgccgcggtgcatcctgggagttgtagttttttctactcagagggagaatagctccagacgggagcaggacgctgagagaactacatgcaggaggcggggtccagggcgagggatctacgcagcttgcggtggcgaaggcggctttagtggcagcatgaagcgcaccccgactgccgaggaacgagagcgcgaagctaaggtatgtcgggctcccggggcctggagatcttcgtgcgctgtgagcaaggatcagggaaccggaagggcttggtttgatggcgagcggatgcgcggtgttaaactaagggatgacagggccttgtcagcaagggacctggagatattagaggggatgttacaaattcgtgctcttcaggatgcaggccgagtcttgttggatcggctcaaaaatgagaagcaagatacccatttccttgtccttcttctgcatctattccttggttaaatttgtcgccatccctgtgcctcagtttaccggattctcagatgactgtgatcataccagctgtgctttctcataatggtctctgaggactgagatcggcttagatgaaatatctgtgcagtcagctgtgtttctttggaacaattgtctccgtgaccggctgataacagtttgtgtcttttagcgctgtggatatgaatctttaactacattgctcctctctacctttgatgttcagcttctggtagttgccattccatgggatgaccataataatggcaacagagattttaaaaagcatttattgtgggtcaggcactgtattaagtgcataatatttaaattatttcatatcattgtcacagcagattgcaagatagatattatacagatggagtataaataacagcccagcttcacagatgaagaactgaggctcagaagcattgagtgttttcctttctctcattcccaaactcagatcctgttgatttgtctacgtatattgggaatatgcccactttttttttttttcatctccactaccttggaccaagctaccattatctttttaatagactgttggaatagcctattgattggcctacactcactctacaccctaacttaactcttcttccaccttctctcccttccctcaactaccattctcttctgcacaccatagagtaagatcttcgtgaaatgcaaatataattatgtccctttcctttctccttactctgccaaccacctgtttaaaaatattccatggctttctgttgctcttaggataaaggcaaaacttcacattgcctacaagatcctgcatgatctggaccctacctgctttcacaaccccattggatatgacactctgctctctgcctaccagtcactttggccttcttaaaagtcactcttcactatactttatcgggcttcagggcctttgcacatgtcatttgctgcctactctatgttaggcaaatattggcagtgaataacagtgttaaataacgtagacacagttcttgctttcatagaatttcatcttacacgtgagtctgtttagggcaatacacctaaggatttaaaatataaaatctgctctatattgacctgagttattgcagtatttcgtaagggaccagaagttttcatgcttgagtctgcatatgatgtggataatatattaaagataagcacaaagagggcgacccttctgctttagtctacacagtgcaaagaaacaaatgtcacctcatggtgttgtgcatgatgtctttctcatctttcaggtttatttttaaagtatttcatttattctgtgaagatttgttgagcacctattatttgccataagttgggattataattttggctgaaatagaatcactgcaccaaagaagctcttactctattgaaaccataaccattgcctgtgagggagttactagtgtcatccatattttagagatttagaaactgagacttgtaggtaaatcgtgacttgcccaaggccacttggttgctaggtgaaactagtgctctgagccaggtcttctgactccaaattcaaggcttttcccattttctgcttgtgaaacatgttgaattagtagagcaaattgtcttccttttttctttaaaaaattggctgttcatttaaaatttgtttgcttaatattatttgttagaacaaagtataagtagttgttttaaatcttaaatgtaaagtgtccaatggctcatgaattatcttctctttttctaatcaattttattgaggtataatttacatacagtcatttgcaaccatttttgtgtacaatttgatgccttttgacaaatgtatatacctgcaaaaccaccacagttggcatagcgaacatttctctcctaagttccctctcgttaatttgtggttagtctgtccctccaccttggcccccaaacaaccactgatatgttttttgtctctgtagatgcatctgtattttctagatttcatataaatggaagcatacagtgtatacttttgggtctttttttcattcagcgtaatgatttttttttcaaaatagagatggtgtcttgctgtgttgcccaagttggtctggaactcctgggctgaagccgtcctcctgcctctgctacccaaagtactgggattataggcgtgagccactgtgcctggccagcataatggtttttgagattaatccatgttgttgtatgtatccataatttgttcctttttatcgcaaattagtggcccactgtatggagataccacatgttgtttattcattcacttgttgctggacattaggattgtttctggttttggactcttatgaaaaaagctgtttttaccattcatgtatgagtctttccattttcatttctgtcaaaaaaagctgctatgaccattcacctaagagtctttacatttttatttctgtcgggtaatgcccaggagtagaattgcttagttataggggagttctttgtttaaccttatgaagaaattaccagttttccgaagtgatttgaccatttgttttagtttcttatggctgctgcaacaagttaccacaaacttggtggcttaaaacaacagaaatttattatcttacagttctggagatgaggcattgaaatcaaggcatcaatagggccatactccctttgaaggactctaggggaaactccttccttgcctcttccagcttctagtgtccctggtgttccttggcttgtggtagcatcacttcataacttctctgcttccatcttcacatggccttctctctgtttctgtgtctcaaatctctctctcctttctgttaaaaggatgccagtcattggattaggacccgtcctaaatccaggatgatcctgagatccttaagagcctcaacttaattacatttgcaaggacactttttccaaataaggttacattcacacgtgccgggtttttggattcggacatatctttttggggaacaatattcaaatgcactgcacccttttacattcctaccaactgttagtaggaatgtaaaatgagagttctacttgtttcatatcttttcatcgcttgtcagtcttttacattttaaccattctagtaggtgtgcagtgatatttgattttaatttgcatttcagtgatgactaatgaggttgcatatctctctttttgtaaatctttattgagtgaggtataatttacataccataaaattcacctgttttcagtgtaggactcaatggttggtagcatatttgcagagtcgtgtaactgtcaccaccgtcttattttagaacagttccattccagaagaaactttgtattcatttgcagttatttctcaattctacttcctccctagggaaccacgaatctactctgttctttagatttgccttttctggacatttttatatagatggactcatacaatatgtggtcttctttcacccaggatgtttttgaggttcatccatgttgtagcatatattggtactttgttcctttttattacacagtggatagaattccagtgtcaggccgagcatggtggctcatgcctgtaatcccagcactttgggaggccaaggcaggtggatcacctgaggtcaggataacttagatcaagaccagcctggccaacatggtgaaaccctgtctctactaaaaatactaaaattagccaggagtggtggcacatgcctgtaattctagctactcgggaggctgaggcatgagaatcacctaacctggaaggcagaggttgcagagagcccagattgtgccactgcattccagcctgggtgacagagtgagactgtgtctcaaaaaaaaaaaaagaattccagtgtcaggatataccatattttgtttatctgttcaccagttgatggacatttgatttgtttctacattttgactattatggaaaatgctactgtgaacatttgcaccctagtttttgtgtggacgtgttttcattcctctttggtagatacttaggagtggaattacaggacttatggtaaatctatgtttaacattttaagaaactgacaaactgtttacttgtgtggctacaccattttacatttcccatcagccattttgagggttacaattttgtcacatccttgtcaacacttgttgttgtctgtcttttctattgtagccgttatagtgggtgtgaagtagtatctcattgtggtttgatttgcatttctctgatgggtaataatgttatgcatcttctcatgtgcttattggacatgtgtatatcttcttttgtgaagtgtctgttcaaaatctttgcccatttttttgttggattgtttgtgttcctattattaagttttatgagttctttatattttctagatataaatcctttgtttactatgtgtgttgcaaacattatcttccattcatctaggttacttaatagtttttaagaaaggtccactttatcaatgtttatttttatgattcatgctttttgtgtcatatctatgcagtctttatcccaaagtcacaaagatttcttttttgctttttaaattaaactttgtcatccccataatgggcacttagtttttatttttcttttctctttgaaataacttagatcatattttctctcttgtgattgcttatgctatggacttttatgctgtttccaagtctggagggtgaataagaaggttggaccacatagctttctacgattaacatttatttaatttgtgttaagcacatgagaatactatacggtattcatgcatttttaaaatgaacttttcttctaaggcatataatagaacagtccagataagtatttgatggtttgagttagaaccatggcgtctactatttccttactgtagggataggggattcataccccgtgcctcagtttctccagtcattaatgaggttaagaatagctgcttctgtgggttggtgtgaggacccagtgtgatgaggtctagctactattccaggggtagagtagcatgcccttgattgagtttggtggcctgaggggtcctctgctggggtggggctggccctatgcattttttcccagatgttataatttattattttgaaatgatttaaaacttattgaagagcaagagtagaacctagagctctcatagacctgtttgtccatattcacaggttaacatcttgctgtgttcactttattgctctctttctcgccatatatatccacatgaacaatttttttaatgaaccattgcagagtaagtcggagacatcagtcctctttacccctaaatagttcagcatatatttcctaagaacatggacattctcttgcatacaaatataaacacaatcaattgttaatttcagaaaaagttaacattgatataatgctattatttcatccaaagtccatattcaaattttgctaattgtcctaataatgaattttatagcatttttttcctggtccaggttccatctggattgcatattacctttcattgtcaggtccctttggtctcttctcctttaatctggtgtcctttcatgtcctttaaattggttcctcatcctttttctttcaagacattgacatttgtgatgtgtgcaagctatcttttatttatttatttatttatttatttaatttttttgtagaatggccctgtattcttatttgtcttatgtttccttatgattagattcagattttgcctttttttttttttttttgagaccaagtctcgctctgttgcccaggctggagtgcagtggcgcgatctcagctcactgcaacctccacctcccgagttcaagcgattcttctgcctcagcctcctgagtagctcagactacagacacgtgccaccacacccagctaatttttgtatttttagtagagatgggtttcaccatgttggccagcctgatctcgaactcctgacctcgtgattcacctgcctcggcctcccaaagcgttgggattacaggcgtgagccaccgtgcgcagcccagattttgcatttttgcatgtatatttttgaggaaagatggggcctctagaggtcacatatttataatccacatatgcctcctggctgtaggtaagttttatttggcccaaacaaactaaaagttgtttcagaattattttctaatatttaaaagttgagggatttcacataaagatctgggtgtctgactctcttgaaaaacttaagtatctggtaacagtgggcatgcattttcctaactagaattgaatagtggcttcccttttaggtgggaaatgtgctttccattttgctgtcatccagttttgccccttaagttacaatatagtggtgtagtgtggagctttagatgcagactcctgagattgaattctgctccctcatttacttgcgcaagcaatttaacttctctgagcctccatttcctcatctatcaaataggagtgatatggttctggtagggattgagatattatatagcacataaaacattgctggcatacagtaaaaataaacattgttatcatcatcattatcaccatcatcaccaccaccttcactactgcctatctgaccccagtagatatatattctgtatgtatatatatatatatgtattctgatcccaggacgtttattctgtaaacttatgttgagtgtctagtcaagtggattttctcaaatggggttccattaacttatttcccatgcagccagaatggtactagttttgtaccacctttcagaaaattgagaatatagtcactcaaaccattttctgtgttctgtggttcagataaggaacctgattaagtgtcgagtagtgtactcagcaccagggtaaagatggcagacacagtcccatggaactggctggctgtccatggaaggtaagtaagtaccaacagcagagtggtgagttttatcacgggaggacacggtagcaaagaggatctaacatggcctagtagtcatggaattccttccttagaagatctgtttaaaggtgtatccttatgagaggcctgggattccttacggggtttttcagaaacattaaaactgtttcattagtcatggaataaaaagctatggatgttgaaatccaagttagcttcaaagactcttatgctggcttaggttagataatcttttaaactattaaaaatagaactagtttattatggaaatggttatatacctaagaacatttaataattttgtttgagtaatgtacatttttatcaatgaaggaaaatatccagaatatgtaacctaccgttttaagtaacatgatttaaaaactcttctgcttttggtgatagttgtcttatcaactttaaatgataaggtttattgagttataaaaataataacttggccaaatgcagtggcttatacctgtaatcccaatgctttgtgaggccaaggtggaggaggctcacttgagaccaggagttggaggttacagtgagctgtgattatgccactgcactccaggctgggcaacagagtgagaccctgtctctaaataataataacaataactcaacaaaagaaagtttgttatttatgtttttactgactgggtatttttaccttattttatatttcaaatttggcattttattgaggtcctgagaaggttcttttggagtctacttttattatgggccattctagattatgtcaccagtttatctaaagtggacactaaatataggacagttttggtgttaggccaaagaccaggggacttgaaaaatgaaaacctcacctgacagattctactctgttttttttccttcttcccgaaatccattattattttttgcttaatctctccttcaatatatgggtaagcctttaatcactgtttcggaggtttagttgacttctgtaaatagaagaagagttagtgtatttgatcatagtttccaaaccacttttaatactgtaccttacttgaaaattaaccagctaaactatcgagtaacagtgagttcttgttgctttctgttatttccaggctgtttcctaaccctcctagtactggttttgaaaactaaattagccattcaaaaaaactcttagacactttgagcaaacagtagcttccttgaagatagcatttgtgtctaattcatcttttcatctctccattgtacctggcaggatgtcttccacaaaggagacattaataagtatctggtgaagaaagattaaatggttgagagagtccagcatctgttatgtgatatatgtgacccttcataattatgattctggatccttggctgctaatgagatttactgtggctgagtttagtgatacagattttggcatgtagatgatagtctccaaaaaagtagagatcatgtttttttttttttttccgttttgtcattcaccattttatccctagcccttaagattttgccagacacatggtagatattccatacttgtcaaacaatgaatgaatgaattcccaagagcatcacttgttattggtcagtagactttctaatagtgagagatggaaccggaatttgaaagaagtaatggaaaatggttaagtaccttatgaattttaaattaatataccataggtgtgggcattaattttgagaaacaagactcttctgttcaacacatactttagcaactgtcaacacttgttttcaagtgttctcttccaattttaaaatgccagtttacctttcagatttagagtattttgttgttgttagtttattatggcagttttcttgctaaagttatatttaaagtgtgactttctaacttctagaggagaggaacttttgttaaggtggtacttttggaaccttaatgaaaaacacaccttagagaaggtgaatttagagttctgctaagcacattcatttactcttctattataaactggttttgtaatattttataaaattgtctcactggttgatttcacaatgtaaactgggaggattcttaggattccttgggttggattagaacaggttcaagagatgaagatttgtgttggtaggggcttgtttccaaacgtttgtccttggcatgctctttgttaagccatcacatgtttgaaagttaaaccttgaattggtgccatggtttgcatttaaaaaaatgtattttattatggtaagaacacaacataagatctactctcttaccacatttttaagtgtacaataaagtattgtaaactgtaggtacaatgttgtatagcagatctctggcactgattcatcttgtataattgaaactttatgccgcttgattagctctttcccatcctcccagccctggtcatcatctttctactctctgattctatgagtttgactattagacgtacatttttgtttttgctataagcatctgtcctgttgctatgctgatcatttatttactctgtagttttggaaatgacctgcttacaagataaccatgcctccccttatgttaaaaaactgccatatggataaagggcagttaagacctttacaactggtagaaaccaagtagaaaattcagtttgaaggaccaaattatgttgcagctgctctgaggaggagatttgttgccagagcatgagtgttttcataattgtttgtgatcagaaaattcagagctctgatttctgcattagccctaagtctgccctttggcaccttcatttagtgattggatcattcaaggctgagcctcaagggccagcatttctccagtaataatataaaatgggctgatgttgcaaccttaactcactctgctgaattgggcatgattaaagtctcaaggctgcattaatatggattttctatttctatgtacagccgtccattatctcactattttccagtttgccattttttgaaaacaaagatggaaaattctgctgatgaaattttttttttgtctgtcagcacaacagcattttttgggcttaagaatatgagaatagcaccgggcaaatgaatgcaaacattacagtttatgtggactctagcctgttgtcatgtcaatcttgttatttaggtaaatagtgtgcaatttttcaccaaatcagcagccaatatgctgcgagccatttttgttttagttacattattggctggtaacactattaatgagacaataattgggaaatagtagtcattgttctcataaaacacgatccttgtgttggaaccacagccaggcagaggagttgcatatgcagactgcaagggaggaaaggatgagtagccagtgttcccagcttttaaaatcatcagacccctgctgcttaaattgccccagctgttaatgctggaaccattacagtaatggactcagcaaatgaaggagaacgaagacacgcacactttattaccagaggggcaattttctcttcatatgtaatagcagcggtgcctcatattgatcagaccatcaagatactaatcctctgtaaaattactttttataactgaaaatgtgttaatccaaatcagtctgtgtcctgactgtctacttactattgaatacggactattagatgctttatttttcatgatttaaaggctttgccctgaaaatggttggcttttcccttgcaacactgagtgcttaatcttagctatagcccagggttgtctttttgttttaaacagaacatcacccacttaattaaggagtgagtgtctgtcttgctgagttatgctggtgttttatgttcctctggatttattaagcatcttgttttacattcagtctgcggtttgtgctgtaaataaaaataggcccatcttgcacatattagaaatttgcaggtagcaaatgtcaataagtaccagggatgtaaggttctttgatttatacttcaggcaccaggttgtggtttgtcgattgaacccataggcaggatgcatcttggtgtcttctgtggagcagatgtgtttttgcatcgttgtctgagaaagtttatgtttatttctgcatccttggttcagtagattgcttttcagacaatgaggcatatccgctccgcctcttatgtcttgtgagaaatgactacagctaaacattattatgagaagacccattaaaaactgatttctatcttcctgaatatttggaattttgggaactttgtaaaattcccatttttttcattataatctctttccacataccttatatgtttatttgtatatagactcaggtgccctcttggcagtatatttattctaatatgttgttatagctgaaagcatttgtgtgacattctctgtagagttcattcagaaatacttaattagtgtaccctttgtgtaccaggacttggattacaggctggagacttgaggaagtgtaagatataatctttgctattgaggacctcagtttaggaggaagacaggcatgtaaacaaataattataataatgcagtatagtaaatactagtctactgtgaatgtgtacttcttgggagcatgggcgcaatagtaaaatcagcctcattggttttttttgctgtgttatcaaaagcagaattctgacatccactttgagacttgtttctgaatgactcgtagctgtttgaaagaaatctcttccttcctcactggagacatgtttaccaccctagggggatagtcaaaggaaagttttccaaaaatgttttgatcaatgatcacatctttggatatgtatagagtttcccaaggaggctacttgaaaggagatagtgcttatgttgtttatgttctggcatttatgtataaatcagtcttattgctttagagtatagtttatgaggagaaactgtagcctgtggtggttaagaacgtggaatcctttagctctatttactggctgagtgatcttgggcaagtcacctattctccttgagcctcaatcttcatctgtaaaatggggatcataatagttgtgaagattaaatgatttaatatatgtaaagcatttagaatattgttggggtaagtgctatataaggttattattattatgcgtgtgactattaatgaaattatttttcatatgtagcttatgaaagtcagcttcgtaaatatagaaccacactgtatatataagtatatggtatgtgagatagagaagcatttcttaaatttcttaatgaaattttttttctgattacataataattttttattttagaaaaactaacaaatatggaaaaatatgaggcagaaaaaagtctcatactcttcagagataaatactgttactttatattagtgtattgcttagaatattgttattatgcttatatataatatatacagtatgactaattttaaatatatttatgatctatatttatataagatatattttaaacaaaaattagaaagataacttgcatattttttactctgcttttttttaccatccagtatattatatttttttcatataattccaattgtatagtattttatggatttttttccatcctatcataggttatcctttagtgaacattcttgtacataaatctctgcaaatctttggaatgtttcatagggtaaattaaaaggagaattgtatgggctaacttttgttaagatttttggttctcattgtcaagttgccacctggggaggtaatgccagtttccaatttaaagaagcaatatgtcagaatgcttattggtacatccactctaacactgggaattatcagaaaacaaaaatgtttgctgatttggaggagaagtaggaacttgtagaactaatttgtattttcctaattattatatttggttgaatttcctcccaccatttatattggccaaatatagttcttttgtgatttgtttattcatataggctttgttcattttgctaacgtgttcgtcttttcttactgatttggaaaaatattttgtagattagggatgttatttactaatcatgtgatagaaatatttttccagtttgtttattgcctgacttttatatttttgttattcaaaagttttcctttgtttttaattagaaaaacattttccctgtcagtattagattaacagtcatgcattcttctggttattaatattttatgtttttttcatgtaattgttaaaatgtgtctagaatttagttggtgttatggtatggagtagatgtggaaatttttcttccccaaggccaatcagatatcgctgcctgcatttattgacttatcttttacgtactgatttgaatgcttaaataatcagatctgctttttatcctgtttgtttttactttgacacatcattttaattgccatcgatttataatatctttctaaatttggcagcatgaggcccctataattagtctttactttcaaaaattctgtggctcatctcttgctttgagaagacaacctaaattttttcccaggtaaatttaaaaatcaccttttcaaggtcccccatgtgccccaccagtcttttggtattttaattgttattgcattaaatttatacattaatttggaaataactgaaatatttgtggtaaatcatttttctcattcaataattatctgtctctacatttatttaagttttatgatcttcagaaagctttgtaattttgttcaattgggcaccatttattactttatgtaaaatacgtgggtattttatatttttgattactattttttggttactattgaaaatgggatatttaaaaattgtgttttttaaatgatacttaagaaagttttttatgtgtttgctatttttgtatttggccacaatacagaatgcattcttatcattctaatagttttggatgattttcttgggttttctggatatttacgaggttgataatctacttatctgcaaatataatttgttttttcctctttcagtaattatactctcctctcctttttttttcttctattattaccttgtctagaacctccagttggtagtggttatagcagatagtcatgtcttcaacagttatacttcgggattctagtattaagtaaagtggtagttgttggcagttatctttgattcttactttgtttttttcagggactgaggttgaattttattgaattttaggaacattttttggacatctctttagatggtagtatctttacttctactgataaaatgtaatttattagactttctaataatggttccttgggataaagcctacttggttatattatataggtcttttaatatattgctgaattcaacattttagtatatttcaattaggaaagtaagatgggtcagtatcagggattcttatggaaaccgcagagtggtactccaggggttgagggtatatcagaatctttgaatggggcatatataacatacatgttgaacataattcaagctacagtttgtaaagcctaataaagcatttttggctgatggggataagatcacagtagaagaaggtaaagtgaataaaaatattgagaaactcctttttgtgctttcttttgtcaaatttggtatcgtattatgctagtatcataaaatgacttgcagagttttcctcctccctgtcttcttgggaaccatttacaaagcattaggattatttgcctgttggaagtttgaactttacttcttcttcttctttttcttcttcttcttttttttttttttttttttttgagcagagtcttgctgtgtcacccaggctcactgcagcctctgcctcccgggctcaaacagttctcctgcttcagccccccgagtagctgggattacaggcgtgcaccaccatgcctggctattgtctatttagttttcttcttgagtaaattttggtcattatatcttagaatgggagagttttacatttattgacatggcattgagcataacattctctggtttactagggtagaattgtgtatagttttataatttaaaaaattccatattcactttttccatcttcttttaaattataactttgtacattcttgtcttctctttaaaaattgactatatttgctggtagtctgttttttttttttttttttaaacaagctcttgaatttgtttatgctctaattcattaatttctacctttgtttttattgttttctttgtcctgcattgcctaagcttcttttggcaacatcttgagatgaatgcttacttattcatttttattcttttttgtttaatatggaaagtatttcaaaatcttaaaatagttttatctttttggtttctgtagcaatttgtgcatgtttttgtagcacttattcagtattctaatgatttttttcattttctttctcataccttagttatatagactatactttatttttctttgtaccccaatgtccgcagagtcttgaacacaataggtactgaactaatgtttcctaaatgaataccctgaattcccccattcccctttcactccacacaaatagtaagtagcctgctatagttagtggaagtttagctctccaactaccagtgcacatcactggtggttggagggctaaacttgtagtctcacattccaactaccagtgcacatcactagtagttggaaggctaaacttggagtttcacatatgccacttactacgtattaccttgtatgagtcctccaatctctgtgatgtttcatctgtaaaatggggataataactcccttccctgcttcatctgagatgtcatcaataagataataaatgtaaaagaactttgaatactaacaatgttatgtagatataaatatgatttaaaataggtttttagcattcttatctcatccaccacttctccccctccccaccatgtagaaattatcaagttcttaggaacagaaacttattttgaaatagacaatattgtacatattcatggagtacatagtgatgttttgatacatatcgtgtatagtgataagatcaggataattagcattttaatcatctcaaacatttattatttctttgtattaggaacacagaaacttaaaaagatatatatatatcttttatatatataaaatatatatatatcttttatatatatataaaagatatatatatatctgtgtcttccgaagtatctagcacagaactttgttgacagatatacagtaaatatttgttgactggatgttttctgagatgtacttttctttttctttttctttttttctttgagacagagtcctgggtcctgctctgtcacccaggctggagtacagtggcacagtcataacttactgcagcctcgacctcctaggctcaagcagtcctcccaccccaggctcctcagtagctgagactacaggtttgtgccaccaagcctggctaatttttgtacattttgtagagactgggtctcactatgttgctcaggctggtttcaaacccttgggctcaagctatctgcctgccttggtctcccaaagtcctaggattacaggtatgagccactgcacctggcctgagacctacttttcaaacatgaagtactaagtgatcctcaattggaccaagacttaggagccctgccccaatcacgttgcttctcccagtttactcggggtgacctagacagctacatcaacacacagtctggtgaaatgcacatgcgtaacttgaggatgtcaaccttttggcacagtctcatttcctctgcagaagagcggctagagacattatactctgttcccgaagtatatagactaataaaatagtggagttgatttagattgataacaaattataaaattgataaaaaatattttctatttttataccatttagaacagctattaatatttttaaaatttttttctcaattggatgaaaaataaatgtatgattattccttccctttcaattgcagttacattacattttcattgtttctcttgcactgagatttattttttatttttagtttattttgttcattgctatggaagggtgataattgtatcaagtaagtctcttttacttacctgagagttcccatgttctttggggaaataaatgtcatcatataagtcagtcttaggttaacaggttgttttaaaattgctaaccactatccaaatgcagagtgatagtattttctgggtaggtatttcatactctcttttcgaatattggtcaccgaaggatttcacaaaccactgacatttcagcattatgacagtgcaatgtgctcctgtcaccctctgaccccatattttttttaaaccattcatttcaatcggaaaaagtataattttttgaaaaaacagagatacttaccctttgcgctgcttttaaagattactgggagacttcatatctcagataattgatggtaaattctgcttggttgtttataagctcaaactttggagatctacaaaaagagtttcatctgagaaataaaaactattttaatgattgtatgatccaccagactgtgaggtcttttcttcagtccctcctctttcatgaagcgtttgaggattattccattcatctctttccttaccgactttatttcctgtgtcaaaaagtatgatactaacggtaagtttgtgtatggtacatttactggtgtatggtaccgtatgtggttgacgttaggtcatattaaattttacattttgagattgcttatacatagtagtgttttatacacagtaattctcttttccctatggggattataagatccctctggctgacaacactgctataaatttgttttttgtgtctagtaagatgctacaaatgtggttgactctcagcatttcttgtcaaatggaaacatgtatagattggaagttaagctttttgttttttgtttttttttactttactgaacagttatttaaccttaactcttaatctgctctccatcaccagtagaaaatattttgtttagaaaatgttttgtgtaggctaggtgtggtgactcacgcctgtagtcccagcactttgggaggacgaggcaggtggatcacaagatcatgagtttgagaccagcctggccaacatggtgaaaccccgtctctactaaagatacaaaaaattagccgggtgtggtggtgtgtgcttataataccagctactcgggaagctgaggcgggagaatcgcttgaacccgggaggcggaggttgtagtgagctgaggttgcaccactgcactccagcctggatgacagggtgagacgccacctcaaaaaaaaaaaaaaatgttttgtgtaaaaccatatgacagaatagatctgaggaaactgcatttgtagccataggagaaatcatagattttggtggctctttacctatcactgtgttttttaaaagagttatgtctgaaccacctatgtgtcccgattcattttgccatttcatctactgctcttcctcctgtttttatttaagactatgaagttactttagtgtaactgctgctgtcacctttgcccttagctaatcaaatagtttaccttgagggaagcatttatctcccactttcattattattatttttgtagctgtaaagatatatattttatgtctgcagaaggctgtaacagtgaaacgaggtattgatctgctgtatttagcaatttctttccaccttgccatcaatagcatgtcagcatctgtctgtaccgtggttgacctcacaaatagctctttatgctcccattggattcaaatgatatagtatgctgaaaactaaatcaatgaatgattataaagtttttagtattatttcatgacctggaggcaactggtactccttgcactgacagttcagtgtacaatgaatatggtaaaatgagtgtgtctggcctttgttctactgaaaggaggaaaacgggtcacctggttgggtcagctcatacttctaatgatctcaaagcacttaggcacttcagttaaacatctcactttacagaatcaggcagagagaagagcaagactcctatttaactttattccccatgcctcatcacaagtatgtagcaaatgtttctaaaattatttgagctataatcatataggcttttgccttcatttataaaagaaagacaaaaacccaaaactagatgctttgtcactgtcaccaaggacctaacgaaaaggcacatggtggaaggagggagagtggtaacctaggtttaggtctaaggggactcttgcttgctgtcagcacctggtacaaataccaagatagggtttttggggccacattttccatttgagggagttcctactcacctccactgatctgtggaacactgaaatagcaggagtcactaatttgcctgcttttggatgttgctgaattcagcatcgtcttgaaaagttcttgccgaatcatacattcagatgaaagatgttttagatattaaacttgacatttgggatatatggaaagatagaaccaggtgatggtgggtgaacagggaaagtagaacccagcagttgtcatcctgatcttttgaggatatgaatcaaatctatttatttctaagaaatgccatcctgatgtactcctttgtccatcagcccagtaggaagtttgacaaggagtattggggagttcacatactaattcattccccagacatttgttggatgaataatgtctgaaaaatagggtatcttggctgtattccttacagatgacgggttatctcctttccccagggtcacttaaggaagagtggatgatagtgatcagagcttaaaggtgttggtctacaccagtgctgccacgaagtcaggagtttgagaccagtctatagtgctggtgtagaccaacacctgtatataatgtttattttcaagttcatttgtaccactaaatactgtctctgatgggggccactagggctctatttgtgattagaaatcctattgttgagaattattactgtgtcctgggttagagagaatagatatgagggctagctcctcctcttgaatgttcatgggaaactgtcatgcttggctttagcaaatccagaatgtgtctacctgccttttttggccaattgccattattccccccagtaagatatttgaataggggaaataatgggtggattttatgaccatttcatgtctggtcagtttcttttcctacatgaaaggatgaagtggggactcttcatgtaaagccacagagtcggaagccccgaggaagaaattcagcttggtcctctgaatctgggattgagaacaacaaactgaggcaccataccctctatttcctgtagtataggaaattgctgataattaataattttagcattgaacttattcaagtccagtaaaattttcttaggatctgctcagggatctgcctctcctaaattcttgggttacttttgttattcattatggatatgtgactgattaatcagctaagctgtttttgaagtcattttaacttttgttctgtattatcctttaggaatatgagtaccattagtactttgtgatgtctacaggagtacttccttttcatttgtcctgtggtgtctgaaggagaactttcttttatctttcctgtattagttcacgttatactgtgaggtttgcaactcaggtctaaatacaggatttgggaaagatgttcctgtctctcaattcagtctttgtgattttatgtacatatatgcctgaatattagataaggaattttcccactcagattatgctgctggaaagagaagtcacttcatattcaaatctttctcaagtcttttgtattgtagaatgatcttcattgtgaacggcattatttggtcagctatccaaatagtatgtgagtgtgtacttatggcttggaatatttttctggatcaaaactatatgtagtaatctggatttatgcaccataatttctattttttgcctaagagtggaaggttgctacatgctcatatagtacttaaaataatttatgttttgctgtctgcagatatatattagaaactagctatattcttgttggtagagaatagggcaattagttgacctttgttcatataagctttgatagtgggatgtcttggctttgttccttgtagatgatgggttatttcctctccccaggctcacttaaggatgggtgggtggtagtgatcaggaattaaagagtgactagtgttgcctctggtgtagacccacacttttatataaaatcattttcaagttcaaacctctaaaggctgtgtctgatgagggccacttaaggctctgtttcttagaaatcctattgttgatgaaaaggctgtaagaagacctgtccaacttaattcttgatcctagctagtcacttaatgacaatcatgtggcctgtaaatgagataagacatttctttttactcaattaagataaagaagaaacctctttacaggttatatgttaatgcacacacatcttaatacaatcatgtatttctactacatagaaaagcaataagagcccgaacttagaattgtataaggaggtatttgtgtcatatactggactctgaatcatttgtggactacgattttataaacactctaaaaaaatataaaacgtgtcgatgaactactgtgtacctaaagttacattatttttcattaaataaaattctatatacacacactaatattcacagttctcataatagtatggttatattatgttgaaactcgtccttcttaaagattattttgttttgtagacatgtaggaactttcctagaaaatctgtatccagtttttttctgtgccattttgaattagaaactccctaaagaagaataaattaactttgcattttctttcatttttttaggatctgagaatgtgtatgtgtctgaggctacctctgtgtctaaaagcagagcatgcttaaaaccatggctgaggagttatgcttaacggtatactttgcatgcatttgtgatttgaaataggaaaaaaagtcaaatttgagacagcttgaatggcatgctgtcagtttggagcttcatgaattggcaatggtctcatttaggaccttcagatgtgtctctgcctggacagaatgagaacattttgcatgttcagaaggagacagccactccttgctgcttcacaataggcagtggtgcatgacagttgcccttcattgctggcttcttggagcttaacctctgaccctccacttagtcactgtgcagcagttggagcaggttggagatgttggtgaatgacaggcattggcctgcaacatgcttgtcattatttgactgtcaaaaggagcctgccattggtttccatcaaggtttgaaacctctgtgcagcagtccatattacttaacttccaaggctgtcaacaggatgatcaaatgtgcataaaaaaatcagagtgctgaatatatcttcaatcaggagaaagaagtttcccctcttcttttctttctttctttctctctttctctttttatttttcttttggctaaatatattcagatgactttcacagggccaagaggttgaatctgttgctccagtgagaaaagtgaactgttgtctcaagtggtctaagtttcaaatagcacaatttaaatctgagcagctctgctggctaaattctctgacttgtctggcatattctatcagctttcagctgttagtttaagggactagatgctagtccagtggtgcctggtgttagctcacaggataaaacgtttactttggtctctatgtagtgttgcaaagggatgcagacgtctgtgtatgtgactgcgaatgaaagggatgattttggatgtatgattactatctcatttaagactcttttttccacatggtagggttcaaactggaattttaagtgatctgatcaagtcttagaaacttaacaggtcagtcttatgcaatttattttttagacatagaaaaatatgacagcaaaagccattttttttcttgtaaatttgaaactttggtttgaaaagcatcttgaagtggaagaggatgaacctaacagtattctggaagtgtatggaaagtgttggtttgcttctaacattgtgcagtggatggtgtgggagtcacgagacctgagttttagttttgcttctgccattttccagcagtgtcactgtgtgtaagtcactgaaccccttagtctcagttcttcatatggaaaaatagagatactaatatggtgaggatggaaggaggtactgtttgtaaagtacttgcttttgttaagtactgtagtcactcagtaggcattccctgatctcctttttatccttttcttttacatccagtgttagcaggaaagacatcaaacagtagtaaggggccaggtacagtggttcatgcctgtaattccagtgctttggggggctgaggtgggaggatttgaggctggaagttctacaccagcctgggtaacatagtgagaccctgtctctacatgaaattaaaaaattagtcaggtgtggtggtgtgcacctgtagtcctagctacttgggaggctgaggcagggggatcccttgagcccaggagtttgaggttacagtgagctatgatcacgccattgcactccagcctgggcaacagtgctagaccctgtctcttaaaaaaaaaagtcagaagacaatacttgagctgaataaacattccagagcctgacacagtcaatcgttgtgttccaactcttttcttctcccatagttctgattcttgcttatgacatcacgttttagtcaagcactcaaactaccaatctgagtaggctgcctgccttccttttttctccttcccttccttccattcattcattcactcaacagatatttatagagctcctactatgtgccaggccctggtctaagttctaggatacagccatgaactagataggtatcatttggctatcattaggtatctggagagagagacaaaaaataaacaaacaaataatgactttttgatagttctaaatactattaaaaaattagtgtaagaggataaagagttattttggttggtcacagaagagctttcactgtagagttctttccagcagagaactgtttgaaggaaggagagggccctgggaagatggggacagtcttccagacaaaaggggaccatacttcttttttttttttttttgtcagggagtctcgctctgtcacccagactgaagtgcagtggtgtgatcttggcttatagcaacatctgcctcctgggttcaagtgattctcctgcctcagcctccaagtagctgggactacagatgcccaccatcatgactggtttttttttttgtatttttagtagagacagggtttcaccatgttggccaggctggtctcgaactcccgacctcaagtgatccgcccaccttggcctcccaaagtgctaggattacaggtgtgagccactgtgcctggccaggaggctgcacttctgtctcctgctcctcatccagttagtcacctttgtcctaatgtctttccttctttcatctcttcatcttcaggccactgctgtgttcagcccctttagatttccgtaggctcttggcctgtttccattccacccacttctaccttgccatcttaaaaaatgtaaaatgggccaggagccgtggctcatgcctgtaatcctagcactttgggaggccgaggtgggcagatcacaaggtcaggagatggagaccatcctggccaacatggtgaaaccctgtctgtattaaaatacaaaaaattagctgggcttggtggtgcgtgcctgtattctagctactcgggaggcagaggcaggcttgaacctgggaggtggagatctcgccactgcactccagcctgcgtgacagactgagactccgtatcggggggaaaaaaaaagtaaaatgaccgtgtcactccactgttcacaatttcgtggagatttgccactggctgcatgttaaaattcagactcctgggcttgctgtataggttcctgttttttcagccttatttattgtcagctggtaaccacgcccccaacccccagctttcacccccataatttataccttatactcctactgttggaaagtggtgacccctgaacatatgcctctgtccttttctctttctagactcttctcctcccttctcattggcacctagagaatgatgtatctttcaacaatgtccacaaatgccacctcttctgagacttctgtgattctgccatcctcaatgttgtgtacacttccttagctttcccctcactatagctgtttgtccattactttctcagtccctgagctctttgaaggcaagaactgcgcttttattcctctcttgtaattgcaatatctggctgagtgtctggcatacaacaagcactttataaactgtcacctgtgatagcctaatctttagaaatatttagggatagatttatcatggacttcaaatgtagatataatcagattggacagtatacattttgaagagctcttcagtcaaaatattccatgattgatagagagacttctttccttaggcctaatttaaataaatatcatattgaaaggagagtgatgcatgaaaacattagaaactaatagaaatattatatatactaacttcccaagaacaccaggatatagtgtcactgagcaagttagcttcagataaacttttatgttgctttttttttctataatccaacatgtgatgtatcttttttcaaagaagatagtattaaattttgtatttcaattcagtaagtaaatttcatattttttctatccatccatttatctctacatttttccaattatactgtatagcattgtcatgattttttttgtagttttcattattttagaaggcttttttttttgagacagggtctcactctccttgcctaggctgaagtgcagtggcacgatcatggctcactgcagcctcaacttcccaggctcaggtgatcctcccaacacagcctcgtgagtagctgggactacaggtgtgcaccaccatgcccggctaattttttgtatttttagtagagacttggtttcgctattattgcccaggttggtcttgaactcctgggctcaagcgatctgcctgccttggcctcccaaagtgcttggattacaggcatgagccaccgagcccagcctattagaagcaatttaatgccaaaccacagtagatttgtcatatgaatagaataatttatttaaatagtttcctctattgttgaccaattagcttgtttcatttattttatcagcataaataatgctgtgttgagtcagtgggtttaaacatttgtatgtgcatttttaaatgaataaattcctagaaacagaacaacggagttaaagatagggattttttaaggctcttgatgcatattgccaagttgccttatggaaaaggtgtccagatgtttgtagagataggttgtaaaaaggatcctgcattagaatgtgtttcttagattacttgtatgtgaatttgggatctaactgggaattttatatttgagaggacattggagagttcagtaatgggcataaagagaagaaagagatagaaggaaaggaagaacaaaatctagttttgaacttctcaaatggtgtgtaggctgtggtttagtgattttcagactgtgtcctggctacctatagggatctgcttctccaggtgggggcctgagaacagcttagcttctgttgatgtatttgtttatacttttggataaaagttccttcatattaatacttccaaatttgaaaagtttgaaagccacttggtaggtctctatgtttactactatcattttcagacacatgattcaaaagggaattatcttgttcatgcctctgttgtttgagatgtcagcctcctagttcattgttaccttctttttttaaaatttaatttaatttaatttaaattttttgacatggagtctcactctgtagcccaggctggagtgcggtggcatatcggctcactgcaacctccgcctgccgggttcaagtgattctcatgcctcagcctcccgagtagctgggactacaggactacaggcctgcgccaccacgcccaactaatgtttgtactttttttttttttttttgagacggagtctccctcttttgcccaggctggactgcagtggcactatctcggctcactgcaagctcctcctcctgggttcacgccattctcctgcctcagcctcccgagtagctgggactacaggctgtttgtactttttgtagagacagggtttcaccatgttggcccggctggtctcaaactcctaaccttagataaaccgcccacctcggcctcccaaagtgctgggattacaggcgtgagccaccgcgccccagccctcattgtggccttatttttttttttttttttttttttttgagacggagtctcgctctgtcgcccaggctggagtgcagtggtgcgatcccggctcactgcaagctctgcctccgggcttcatgccattctcctgcctcagcctcctgagtagctgggactacaggcgcccgccaccacgcccggctaatttctttttgtatttttagtagagacagggtttcaccatgttagccagcatggtctcgatctcctgacctcgtgatccacctgtgttggcctcccaaagtgctgggattacaagcatgagccaccatgcctggcccattgtggtcttcttaaaggaaccatgttgctaacccgaatgagagaggagtaacctcctgaattaggagttgttactgcactttacaaatatcctgttacctccttcacctctgtatggttaaggaaatgtggtatcaagtcactttccagttcctacttcagtgtgggaactgtgaagtatcttttaggcaaagtagaggttaaggcaccttaagggcaggaacttcttatcttgcttttattagcagtcgtgtcaacatgcactaaaatgtgatgacccactttcccttctgataaaaggagaatgacctgcttggcatggatggagagaggtgcctgaggcagattacattgttaccgctcataataacagtaggcataaaggaggggggtggtggaaaggccagcagatttctgtttacccatggaaatgtttgacgtttttggcttctgatgaaatgtgctaagaagagggggaaaaaggagcattgtagcaggggaaggaatgaatgagtaaggaaaagaaggaatctggcatcagggaaggaatgaatgagtaaggaaaaaagggaatctggtgtcatgtgagacatgtgaagccacgaagggccttaaatcccagccctgtagccatctattggcagagccttaagacctcaaaccatagagggagccccccttttctgtctttttaaatttaacctatatttgtttagagccaagatctctgacatggcttggctgacttttctaaagatgaactgaggccaggcacagtggctcacgcctgttatcccagcactttgggaggccgaggcgggaggatcacctgaggtcaggagttcgagactagcctgccaaacatggcgaaacccctgtctctactaaagatacgaaaaattagccaggtgtggtggtgggtgcctgtaatctcagctactcgggaggttgaggcatgagaatcacttgaacctgagaggcggaggttgcagtgagccgagatcgcacaactgcattccagcctgggtaacaagagcaaaactccgtctccaaaaaaagaaaaaataaaaaagaagaagaagatgagctgaatacagggcgacctgtacagttgataggctctgaggagatatcaacacggaaaattagggacgtaattacccactcctcaatgaaggaggattcttctcagttaagtttatttacttacttggctttgagaccagagtctgataactctgggaaaaagttgtagttattttgagatggtcgatataatttaaggcttttttaagagagtaattgtgtggtttaacctgtcatcttgaaatatgaattatacagagataacattaaaaaaggttatatgtgacatttctaggtgtctcagaaaaagatttgagtttgtctcatgtctaccatggcaacactcttgagttattataaagaacattatataaggatttcctctagaatttttaaatcttaaaatgtaacttactttagccagaataaaaagaggtttaaattaatggaaaactgactggaaggaagatataaaacaagaaacaataacacaacaaaacttcactaaagtacacaattctacaaattatgcacacaagcacacacattttacaaattgagggtatttgtagaaattcaactctcatttgaatcaactcatgacaaaacgtatttacaaagtaagtagaatggaaaagtaccaaaaaagcatttcttgggttaatggtattacccaggtcaaatccattaaggaaattctctgccagaccttttcttttttcttaagacatgaagttttgcacttgttagtataatttgggagtggtcaagaagctaggtgatagaacaacttcagattctggatttctggtctattatttggttttttttatgaataagagattcactcttttctttaaaggaagtaatttagattcctagcactgtcatttctgttctgaatgttataaactctctgtacaaaatttgaaaggaacagacatgctctgatgatgtacagaatcttaatgtttcaaaaacgatagttctcttcccctagaatagaaaagtatagcgttcacctgattgcagatcccaaatgtctacatctgtggttgggtggccaatatcacatgaaagagttttgtgcctttttgctcaatatataagtttgaaaaatgttggctgcaagtaacagaatttccatgtaacagtggattaaacagtaatgacatgacttttcccacatcataagctgtctggaaggaggaagttctcatggaacagtggcttaatgatacagtcaaatgcaggtactttccagttttctgctctgccattcttcagcacgttggctttttcgtcttttgacttgtaacctagtgatcactgggttataacagtgccaggtatcatgtcctcatgtaactgtgttcagggtaggaagaagaggatgggaagataaaagagagtttttatattaggagggaaatccttcctgtaagtcccctagcacactccttattatgtcctattggccagatctggatttgttggtcattcctagttgcaagggagactgggaaaagaagtgtctggcaaaagggaatgcgattcctacgcttggcttagagagctcatgatccattccttggaactgggctcatggctgcccctgttagcagggaagcagaatgaatagctgttgagtaggcagccaatggcttctgccatactcaattaatgtgtgactggaaatgagatttttatcttttgttccacactggccaagggatatggcctctgttaccatgtaatataaccctttgagacaaatacatttaagaccagaattggaactttgaattatccatccaatacatttaattagcactgacagtgttctaggttattgctagacacaggagatactgcagtgaataagatggacagtctctgaactcatagggttgatagtctagtaggactgagagattaggaagtagtttcagtagatatggggaaggcacagtttgctgtgcggtgaatgcaaatcagctaacatggactcggagagtcagggagggcctcttggaggaggctacatcctcgctgactccagagacacaggattcagctaatctcagaaaatgatgagttgatcaccctccttttttaggtattcttggaaatccaagcaaaaacaaatctgctcttaatgtggaaactgtggcaacttgagaattttatgtgcttcacggagtgagtaattccagcagcagctcaggaagcagcatagcagagtgtaaatggcattgtctttgaagcctagttggataagctttctgcctcaatctatctgtgtaaggaacagggtttctctgaaggtatctttgaaatactctaccatcagttcatatttctactttcacctaagtcaatattgaatcctctttggaaatcttggggtcatccttcctttctgtcaccttctatcttcagtcaccaagtctttctgtctgttagcagctctaaaatctgacccttccttctccttcttactgcctctgctttagtttcttactctataaaatggagataatatatcactgtgtagatgccataatacaaatagcaagctcttatggcactaataattttttaatacatgttaaccatatgaataggtcttattattattatgtccattttatggatggagaggttaagtaatgtgttcaaactgctccagctagcagctggtagagttgagggtttgaatataggctgaacatctggctcctgaatctgtcctctgcattgtactgagaaccctgtatcgtaccgaggtacgtcatctgtgttcttctgtactctcctattttgggctaaaccaggtcaaactcctatcttagtgtctttgaaatgctcaaacctgcacgttgtgcacatgtaccctaggacttaaagtataattaaaaaaaaaaaaaaagctccaccatcaatctgtagtttctgccctcacccaagtcaatatcgagttctctctggaaatctcggggtcatccttcctttctgtcacctatcttctgtcactcaccaagtctttcaatctgtcagcagatctgaaatctgacccctccttctcatttccactgcctctgcttaagtttagggtgtctcaaaatacctccttccagcacagttgcaatagtctcagaactaatgttcttgcctctatttttcccttctccccaacatcctctctttttgccaatttctgtttcacattgctgacaagtggtttttcttattatttaactctggtttgactttgattcaatgtaggtcttaaatgtatcccttttggctgtaggataaaaggccaagtgccacaggtttccagagcactatctgacgtaaccagcgtctcctcccagttctgacactttccatctccccgctaccagctccatctatttgctgtgtagtttgtcagggatgctgtcttccatactcattcccctcccccagatttatgtgggggaactcctttttaagatttagctctaaagtttctgcctctgcaaatccttcccttccattgtgcccatttatcacttcagcttctggtcactttgtacttggccattgcgttggtatacttggtgtctctttgatggtgagtccttggaaggcaggaaccctgtgtgcgcctgtttctgcagagcacagtgcagtttctgctaacagagggcctatcataatacttatggaagggttgattgatgtcctgagagtatgtttttaattttgcatggtggacacattttatatatttatctgtgggaaggagattcatgaataagtgtgtatatatctctatatacatacacacatatacaatcatgcattgcttaatgacaaggatacattctgagaaatgcattgttaggcagtttcatcatgtgaacgtcatagagtgcacttacacaaacctagatatggtatagcctattctctactgcatcagtacagttgctgtttcgtacagtaacttgctatacaagtaacttgctatacattactgtactgaatactgtaggcaattgtagcacaatggtaagtatttgtgtatctaaacatataaaaggtgcagtcaaaatacattattgtaatcttatggaagtactgttgtatatgcggtccgttgttgtctgaaataccattctgcaatgcaagactgtgcatatgtggatgtaagaaggatgctccttgtcacccagcagtaatatgagccatcacttattttgcctgtatagtgccctcttgggaaacatgtttattggctcccttagattaactttatgacgagagagtatgtacccttcactctactcctccccccagcctacccaattaaagatgactagtcttttaaaaatagcgttattgagatataacttacatcatataaatggaatcataccgtgtgtggtctttgtgactggcttcttccacttagcatgatgttttcaaggttcatctatgttgtagaatgtataagttctttctttcttttttttcttttttgagacaaggtttcgctctgtcacccaggttagaatgcagttgcacaatcgtagctttttttttttttttttgagatggagttttgctcttgttgcccaggctggagtgcaatggcgtgatctcagctcacagcaacctccgcctcctgggttcaagcgattctgcctcagccttccgggtagctgggattacaagcatgcgccaccacgcccagctaattttgtatttttagtagagacggggtttctccatgttggtcaggctggtctcgaactccccacctcaggtgatctgcccacctcagcttcccaaagtgttgggattacagacatgaatttcttttaactttttatagagatgaggtctggctatgttgcctaggctgttcttgaactcctggtgtcaggcagtcctccctcctcggcctcccaaagtgcacggattacaggcaatactttatttatttttatggctgaataatattccattatatggacacatcccacgttatctcattcattagttgatggacattgggttgtttccactttttggctattatgaaaaacgcttctataaacatttgtaaggaggtttttgtgtggccatatgttttcatttctcttgagcatatacctggaagtggaattgctgggtcatatggtaagtctatgtttggcagtttttgaggaactgccaaactgttttccagagtgacattcccactagaaatgtattagagttccattttctctacacccttgccaacacttgttattgtctatataacaccatgtcacattcccactggcagtgtattagagttccagtttctctacatctttgccaatacttgttattgcctatttaaaaaaaattttttttttgagatagggtctcactctgtcacccaggctggagtgcagtggcaagatcatgattcactggagcctcaacctccggggctcaagcagtctttccacctcagcctcctgagtagctgtaaccacaggtgtgcttttaaaaaattttttgtagagatagggtctccccatatgttgcccaaactggtctcaaactcctgggctcaagtgatcctccagcctcggctgcccaaactgctgggattacaagtgtgagccatcgcaatctggcccttgtctgtctttttaatctttctcatttgattcttataattctattagccaaagaaaaatattcttactattactatttatttatttatttatttgagacggagtctcgctctgtcgcccaggctggagtgcaatggcacgatgtcggctcactgcaagctctgcctcctgggttcacaccattctcctgcttcagcctccccagtagctgggactataggcgcccgccaccacacctggctgttttttttttttttttctatttttagtagagatggggttttaccgtgttagccaggatggtcttgatctcctgaccttgtgatccgcccgccttggcctcccaaagtgctgggattacaggtgtgagccactgtgcctggcctactattactttttagatgaaaaccccaaggcaacagacagattaaatgagatgcctcatatatgtgtgaatggaaagaaagaagtggtgtggataattcaaaaccacagattatccaaaagtaatttaaaagtttttgaatcaaacactaaagtatgtttgatgttggagatcatatttcccactcccacgttaaaagacaattagtatgattgtatcttttttgtctgtgtttttttttaatcattgaggtataattctcctaatataaaatgaaccattttaaagtgtttgaaatgattactctgaggatgcctattttttagtgattgtaatagttatattgtcttcaaaaatatttgcatgtacttaaaaacacttaaaaaatagaagcagtataaagtttgatctcccaaggagccatcatagatctatagagggaacaagaatagaagtaccacgaggcaaactggaagtcacttgttttaaagtaattaagataaccatgttgacttttatccatactttatgtatagccttttcaaaattagaaggctgtgtcttccttgttattctgacatgaatatttagcagtgccatctgtaaccctaggatcatatggtaaatgttaacaagaagcaccagaacttgtgttttccctgtcctattgtttttctacaagaatgctgacagctagagtggctttgtgacattgtgcccacaaagctgaatattacatgtgtagttacctgggtaggtgtagagtgtattttttttaaagagcaggacatagtgactggatgtcatcagttacatctgttttatcgtactaaaaattttacgtatattttgaaaacagttgcaaattagaattttctaacttgtatcttcatgttacgttcctgctaagtgaagaaaatattttctgaaaatatgaaacttgtaatgtgcatacaggattgaaaatgtgctgatagaatattttctggtttttcttgcctttctgctcagtgtgtcataatcttattttttgagggaaaacatgcacattttacagtaggttctccccatctgtttcaattcttcatcttgtaatgcttcctttcaaatagctacatgattaccttccagtttaggggcactgaaaatgttatctctggctcagttgacagtttttattgatgatctggtgggaaccaggtctgtggctttttcagcacatttcaatgtcccaataccacacaagaagcttttctctctcccctgcacaccccagatgaatacaactttactgtatattctaataataaaatacataaccataaattaagacaaggctgaaaggtttaaagaagaaagtaaaagtcaaccttaattttactttccaaacaacataatcactccggacattttggcctgtaacaggggtcagcaaactattgtctgtgggccacatctggcctgccacttgttttttaatcgaccttgagctgagaatggtatttacatttttgaatagttgaaaaacattaaagtaacagtaacattttgtcacatgagaaaattgatatgaaatttaaaattgtttccccaaataaagttttattgaaacatagccatgctcattcatttacatattatctagactgctttcatgctaaaatggcaggtttagtagttagttataggccttcaaagcctgacgtgttcattattactatctggacctttatagaaaaaaaatctgctgacccttggtctatacccttcaagactttttctgtgcatttgcgtgtgtgtgtttacattttgaaacaatgaggttattctatgtgcttttgtaatttaccctttttgctgaatagtgtttacaagtaacttctattgcattgtttgtttattccattggattataatctgtgaaccactctgttgctcttttatttgtattgtacaaacccattagatgttacctaggaacagtaataataatagtagtagtagtagtacttactatatgaattaaaattgattttaattgtttaatgaaataaaactttatttttttcacataatctgaatcatgacctaggtagtggtcaagctgcccaagaaggtcattgaggaaccaggatctttccagtgtcctcttctgccattctcagcatgcaatttcatagagagagggtgactaaactctgttattgttgtgtatcaagttaccacaagtcttagcaatctgaaacgacaaatattaattaccttacaatttctatgggtcatgagtccagatacagcttagctagttgtctctggctcagggtctcacaaagctgttggctgggaaatcgcttatttcaagacttgactggggtggaggggatctgattccaagctcactcatgtaggttttgggaagtgacagacccatactggctgttggctggagaatcaattccttgccacgtttctgtctccatagggcagctcacaacatgtttgttagtttctcccagagtatctggggagagtggggggtaggttacagactttttgtaacctactctgggaagtaatattccataacttctgcggtattctgtttgttagaagtgaatttctaggtccagcctatactgaaggggaggaattccaggagggtgggaatatcaggaggcagggattattgagggtcttcttggaggctgctttactatgtggtttcatttaaatgtggtgggtagaccttcaggcattggcctggcaggaagggtcaataccagcccttccagtttttcaattagaactatgccatatggccacccctagctgcaagaaagtctgggaaggcaagttttttttggtgacacattgttgcccaggtcaaaatcaggattttgttgataagaaaaatttcgataatagacactgggtggacaacagaaggtatctactatccctgccttctaaggtggttataaaggttcagtgaggcaatccagcactggtctggcttataatattcactcagttaaacaggagctatgattattgctgttacttaaaatcacataatatagctttgtaaattagcttgtgacaaaacaggatccctatgtgttgatactaaaagaagtagcataaaaggaagaaaaaaatacattgattgggtgcatagtatgtaccaggcattttatttacatgcagtatctgagttaatcttcatcataaacctaactgggtattgtttgccacactttatagataaagaaaagaaagcccaataagattaactaggttgttgaaggagcgctttccactagtgtgccttgagtgggttatagtttgtggagatattggttcctttagttcttggaatgggcagatggggacaggggtaactggagcccctggtctcttcatctctaactctgggcagcctcttctgattactccagtgtgccttaaaaaatataattttctgcacactccatgatgtggaaaaggttagagtgtataactctatccatgagtaagtgaatccaggtatgtataattccagctgcctgtctcctttccactgtcaggctctcaacaatctatagaagccttgaattttcgttagcctaaaatttgaaatgccccttcatttgctacaaaaatattatatttctacattttcttggattataaagtgatttaagttaacatgatttgaagcttcactgtggtcggaatgaaagcttgcttggccactaggtggctccttttggttctttctcccagtcgatggttgtggctttgtcctgtgccacctcttagaaggaacctaaattggacataaggaagcctagacaacaaggagatctgaaatgaatgggacatgcactctgatgattgcagttaccttttcatcctttactttccactcctgttcctcctgtgctcatacgctgatgtttaggtaacagatctagtccctggagcctcagatgagtctttgatatctctttctcacttataaaagtgggaaagtggggtaaagaacttttgtcctcatctagtatgttaggtaataaaataattgtaacatgtttgcagataattttaggcacaatttttaatacagcttattatcgtgggaatacttgtgttactacgcagataatgattgcactattaatattaatttccctattctttaatttaataatacaagctttaacttacatgtattatctcctataatcctcataggaaccctgcctagttaccatttttttccccctgattttagagatgaggcaattgaagcttagagagataggttaatttgctccaagtttaatagagtttggttgctttcagattttttcctctccgtttggaagttgttaattcattatagttgtgggcagagttttgacttaagtcaatatatttaaaattcctatgaaataattcagtagaaagtacttctggaaccatagtttggttgcaagtacagacatcattttctccagtcgtcttgtagaagtgagcagtagctggaagtgggctcccttcaggaaggctacaggctctttgcagaattacaaattgtatacactcagggatcacttcctttctcttgcctacaaatgcagcacccattatcatagaaactgcagggcatttgacagcttaggttcagactcggagctcatagaatggaacattcttcttcttcaattagagacacactaaaaagatgggaaggcacctaggcctagggttttctttgagactgctgactgatgtgttctcttttacccaaatttagattctgcattaatttccaaatttctctggttgccttgaaaaaataaatcggctcatgctaggttttctttagtcacgaataatttaactgtgcttagtatctctagttgactccccagttgtggtggtgatttctgcagaccataggaaaatgtataacaaatgtgagatgagagagccttgtcaggcagggggcacttactctgggaagtcagagctggcagtgggagcagtccccagcactaacaggtacacccacaagatctgcctcctacactgtcacttctacctctttgttccccttcctgactcacttcctgccagtgatttgtgacatatttcgtagctgatcaaatgagcccctgacacctgattgccgagtgcttcttgtttacagttgctttccaaggacacctagacaagatggaaagcttaacgtgaagtaattaaatttgcatctgctctgtgacaggactctaaggacttttcttccccccccccatatatgaatctcattgtagagctcctaccgtctttgaccatacaacatctaaaaaagggaggatgtggacaggtaaacaaacattggttcagtctactgcctgtcattatcatgataaatattaaataagatcactgatatccctttcttatttggctttctactctttacctacttgttttgccagattggtaactgattttcaacataagaactgtagcttggaggtgatttaaaaagatatttttaaaggaaagcaaatattgccaaacaatctggtttggtttaacaccctttggattgtacatttctcacaaatgcttatgaataattcagcaaagccaaatgcaatctgctggtggtatctagtgttattcacacttgctaatgaataattccctttggcttttatagggcggctctaaggaatgacttctgagactcagatgagttattattgggctatttgtcagtgtccttggggcattgcgagccaaagcccaacttggctacccactccacataccttctgcaattcttctgggaaacatgcagctctctctgtcccagctttttagccccagaacgttgctatgaaagagactctaacagaagaggaaataaaaatgacagaattcagctccactgtgattgcattggttcagttccttcattgtttcattcatataaagaaatgtttattgagcaccttaaaagcattgtatgtccacaaagataagatagatttttatgtgcaatgtcctcaaataaactagaaagtgtagggtgtataggagaggcataggatcccagaggaggatggtcagggtcttttgtcaaagtgatcagttaccattttctcatcatgttctcaggtatgcacttaaatgcatatttgccatttgtggtgttgggtgagggttccgttgctttggataaacctaagatttgactaatcttgaaactgcttaaaggataagccctataatgtgatcccagatatgactaagtggccgttgttcatttctgttgctctgaagtcaggaatgtggtatgacctggctttaccagcctgggcaatctaaggatggtgaacgtggatttatttatgcttgggtggttatatacttataccttagcaatcatactgcataatgtataaccctgaggtcagtgagtgcattcagccttggtgaggttgtttctggcagcctgtatccatttcagttttctctatgcaactcctaagttttcctctagaggagtgtaatcttcctctgagcacactggaagattacagttcccagcttccttgcagttaggtaggatcatgtgattagttctagccaatgacgtggaagtgatgggtattatttcctggtcaagacattaggagctagtgtgccacttgcattctttccctttccctgccacagtgactttgggggccttgtgtttcagatggtggggtctccattgggctgatccaggaaggactgagtggagtagagtccattcccttcccccatcaacatattagacaggtaacttgagcaagacaaagacctttgttgcattaagtccctgagatttgggggtttatttattaccacagtgtagcctggaccattgtcactaatatagagggattagtacaggaatagctgtgtgcttgttattcaacatgatttagccagctttagagaatgtagtttcttttttttaaatcattttttattgtaaattgccaaatcatagttgtaaatattatgggatgcaaagtgatgttataatttatgaaaacaatgtggaataattaacatatatatcaggtcaaatacttaccattcctttgtggttagaacattttaaatgaactcttggtgattttgaaatatataatatgttattatttactatattcatcacactgcagtatatctaaagtagaaaaaacctcccaaacttactcctcctgtctaattgaggctttgtaccttttggccatcatctccccaatcttctaacactcctagccttgggtacccaccattctattctttgcttctttgagttcagttgtttttgattccacatgtaagtgagaatatgcagtatttgtccttctgtacctggcttatttcacttagcataatgttctctcattccatccaatgttgctgcaaatgacaaaatttctttctttttaaaggctgagtggtatttacgggctgtgtatatatgtcacattttctttgtccattcatctgttgatgaacactttggttgattccataagttgaatagtgcatagtgctgcagtgaacatgggagtgcagacatctctttgacataccaatttcaagtatcctgggtaaatatccagaagtgaaattgctggatcatatggtaattctattgttagtttttttgagaactccataattgctgtactgattcacattcccaccaacagattgcaggggttcccttttctcaacatcctcactaaaacttatttttatctctttgacagtagtccttctggctggtgtgaggggatatctcattgtggttttaatttgcatttctttaatgattagtaatgttgagcatttttttcatgtatctggtggccatttgtcttcttttgagaaatgtctattcaggtaccttccccattttttaactgggttattaaatttttaatgtagaggtatttgagtttagatattaatcagatgtatagcttataaatgttttctcccaatctgtaggttgtctcttcacttttttaattgtttcctttcttgtgcagaagctttttattttgatgtaatcccatttgtctattttgcttttgttgcctttgtttttaggggtcagatataaaaataattgctcagacgaatgtcctgtagtttatctactatgttgtcttctagtagttttgtagtttcaggtcttatgtttaagtctgtagtccatttgagttgattttagtatatggtgtgagataagggttcaattttattcttttgcatatggatatccagttttctcaacaccgtttattgaagtgactgtcctttccccaaagtatatacttggcacgtttgtcaaacccacatacatgcatgggttcatttctgggctctattctgttcattggttgatgagcccatttttcactagtaccatgctgttttaattactattgctttgtaatatggttggaaataaggtagtgtgatgcctccagctttgttctttttgtgcatgattatcttggatattcagggttttttcttgtgtgtgtggttccatatgaattttaggattatattttctatttgtatgaaaaatgacattggaatgttgatagggattgaattgaatgtgtagattgctttgggtagtatggacattttaacaatattaattcttctagtctatgacatgggatatcatttacttagttgtatcatcttcagtatctttcattaatgttttattgttttcagtgtataggtcttttacctccttggtattaaatttattcctaagtattattttttcacaactcactcttcatagaactattttttatagctattttatttatttatttatttagagacagagtctttctctgtcacccaggcaggagtgcagtgatgtgatcttggctcactgcagcttccacctcctaggttcaagcaattctcgtgcctcagcctcctgagtagctgggcctacaggtgtgcaccaccatgcctggctaattttttgtatatttagtacagacagggtatcgccatgttggccaggctggtcttgaactcctgacgtcaggtgatccacccaccttggctgggattacaggtgtgagccactgtgcctggcctgtagctattttattttattattttattttatttttttgaaacggattcttgctctgttgcccaggctggagtgcagtggtgcgatttcagcttactgcaacctccgtctcctgagttccagcaattctccagcctcagcctccccagtagctgggactacaggtacatgccaccgtgcccggccaacttttttgtatttttagtagagacgaggtttcaccatgtgggccaggctggtctcaaactcctgacctcaggtgatccacccgcctcggcttcccaaagtgctgggattacaggcatgagccaccgtgcccagccttgtagctattttaaatgggattgttttcttgatttcttttttatatagttcactgttagcatatagaaagactactgatttttgtgtgttgattttgtatcctgcagcttaattgtattcatttattagttctaacagtattttggtggaatttgtagggtttttaatatgtagtgtaagagcatatcatcagcaaacagcaatagttttacttcttcctttcctatttggatgctttttttctctttttcttgcctgattgctctggcaatactctaatactatattccacttctgtactgaatagaagtggcaagagtgggtatctttgtcttattctgaatcttggaggaaaagattttaattctttttttcttttttttttttttgagacgaagtcttcgctctgtggcccacgcgggagtgcagtggcgcaatctcgggtcactgcaagctccgcctcccgggttcatgccattctcctgcctcagcctcccgagtagctgggactacaggcgcccgccatcacgcccggccaatttttttgtatttttagtagagacggggtttcaccgtgttagccaggatggtctcgatctcctgacctcgtgatccgcccgcctcggcctcccaaagtgctgggatcacaagcgtgagccactgcgcccggccaagattttaattctttaccattgagtataatggtagctgtgggcttatgtatggcctttattgtgttgaggcacattccttttatacctaaggtattgagtgtttttatcatgagaggatattgaattctctcaaatgctttttctgcatctaatgagatgaccatctggtttttgtccttcatgtagaatgtaatttcaattgggaatcaaatggcagatctaatttaggggcagaaagagagtttgtttcatcagttatcaaagaatctgtgcaagaaataacattggtgaaaacagagtcatggaagtaaaagaataagtagtaagaagagacagagttgaattgaggctatcataactgatattaatgaattttaaattgcatttggcatgtttaattggtaagattatgaacctgtaatttttctctttgcttataacttatatcaaagtctggcccttgagctaagaatggcttttttctttttctttttcttttcttttcttttttttttgaggcagagtctcactctgtttcccaggctggagtgcagtggtgcgatcttggctcactgcaacctctgcctcccaggttcaagcaattctcctgcctcagcctcctgagtaactgggattacaggtgcacgccaccacacctggcgaattttttgtatttttagtagagatggggttttgccatgttggtcaggctgttctcaaactcctgacctcaggtcatctgccctccttggcctcccaaagtgctgggattacaggcatgagccactgtgctcggccaataatggcttttaaatttttaaaagattataaagaaaaacaaagaagaagaagaatatttaataggggccatatgtggcctgcaaagcctgaaatgttactagttagtcctttacagaagaagtttgctgaccttggtaagtttgcttaccatctctacaaactattatcaaaaaggatcacacttaaccaaaatgtgagttcctggagaattgggaactcattgcttttattaatctctgtgtctttcagtctagcatggtacatggcaacacagtagaagatcacagcaattttacttgattgaattgcacacagaacatgggcaatatggaagacagtttagaggatgaaaaccaaaaacaaattacgaaggttgtaggtctaaagaaatagaactgttcttcctctgtgcttgtgggtggtgacattcctggtttgtttaaacctaagtatggacgtttatttaattttcatattcatcttcaaataaaaggaaggttttaaaacagatgtgtccaatcttttggcttccctgggccacaatggaagaattgtcctgggccacacataaaatacactaacactggtcaggagtggtggctcacacctgtaatcccagcactttgggaggccaaggcgagagatcacttgagctcaggagttcgagaccagcccaggcaacatagtgagaccctctctctattaaaaaaaaatttaccatcctggctaacacggtgaaaccccgtctctactaaaaatacaaaaaattagccgggcgtggtggccggtgcctgtagtcccagctatttgggaggctgaggcaggagaatggcatgaacccgggaggcgaagcttgcagtgagctgagatcatgccactgcactccagcctgggctacagagcgagactccatctcaaaaaaaaaaatttaaaaagaatgaagtattggcacatgctacaccatggactaatgttgaaaacattattctaagtgaaagccagatatggaagactaatattatatggttccatttatataaaatgtctataacaggcaaatctatgaagatgggaagtaggtgagtgattgcccaggggtggggtgagaatcaggagtgagggctgatcggtgcaggggtttctttttggagtgataacaaagttctaaacttagaatatggtgattgttgaacaactctgtggatatactaaaaaccattgaatcatatactataagttggtgaattttatgttacgtgaattacatctcaaagatactaacaaaaataatgatgcagtggattgcctatttcctagtgatgttgctggttatttttctctctgattcaagctgcagtcaggatttgaatcgcttacattttaccttcttgaagtaagatcttctaaaaacaaaattgacttatagtcaaatcctctttgacccagctatgttctacttacatgaatttgctccattttttgtactggcacatgggcacaaagacatatgtataagaatattcattgtggcattatttgtagtggcagaacacgagcaatctaagtatccatcagtagggaacagtttaaatacattaagggagatgaagctagtgaagatgaaactgtcttcaagacaattaaaagaacaaggtgtagaatactgttactatttgtgtaaaatgcttgcatatagacagaatatgttgtaaagattcaacagtggctacctctttgggaggcaaagattgggctgatctagtaataggagagggacagcctattgcagggttgcactttaaaaaaaaattatactttcttttcatggaagcattattcataattaaaaagtggaaccaatgcaaatgtccaccagctgatgaatggataaaccaaatatggtatagccatccagtcacgtaagtagggtcaaaggggatttgaatataaatcaatttcattttgaggaaatcttaattcaaaagggtagtgttcaaatattatctttaaaattaaaaaagttgactcctagactatatctcagcaatcaatcttgcatatctttttgcatacttcttttcaatccatatggaataatttgtcttaagactcatcccttcaattcaccctccaaccactaatgatgcagcaattatgtggttccactgtaattttaacactgtcttctaacccagctgtgtggcagcagtgtatctgcagggcaagaatgtggcttgcaagggtcaatatcacactgcccacaattattttaatgtctcctctgaaatgataaatgaactttatagttataataaaaagtaaacccattccccctaaggtataaagggtgtacaatttacatagtcagatatgactgcctttttttttttttttaaagaatccttcgttgagggctttaaaaaaaaacagggttagggataggaataggtggctcatgcctgtagttccagcactttgggaggctgaggcaagtggatcacttgagcccaggagtttgagaccagcctgggcaacatggtgaaaccttgtctctacaaaatatttgctgtgcatgatggcgtgcacatgtagtcccagctactcaggaggctgaggtgggaggatcacctgagcctagggagttgaggttgcagtgagccgtgatcgcatcactgcattccagcatgggcaacagagagagaccctgtctcaaaaaaaaaaaaaaaacaaaacaaaacaaaatgcaaaaccagaaaaaccagggatgggttttcagtgtgggcatttatttgatccagcccaataaacatgattaaaatatgaaaatgttataggatttatagctgctcctctaggaacttacactttttttttttttgctgttgttggcataattggaagaaattcttccaagttttgcatctgcattgcttgtcttataacactaacttcatgtaacttacaaaatatttgctggaagttttcctggccctaggaggacccataatttataactcctgctttttattatttggtgccacttgtggctcgtgtccttcctaattattgcaaatcctctagcctgcccccacattcactcagtaagactgccaccttgagacatgagctgttggtgtttgcagtatttaacatagcatctactaccatcatttagctatctctgacaaagagctcattgggccctcttgcaccatttcctcagctgggaagtgtgggattgtagaagctgcttcccttctccccacatctgaagctttgtcctatcacatgaagctaggatttccacgctttctttctagctgcaggagaactggctgctcaggggtgctgcgttttctaccttctgacccacagccagaggcagctcccactgcactttttcatttgcattagatggcactttgctttatacaattgacgtctccatttaatttttatatcttgcctgtatcgttagagaacggggtttggaggtgttcatgacttatagaagccccacagttagcccttttatgatccctcttttagctaggccctatttacaaattttgtaaatttagatggcttcttattaaatgatgtaaacccatccatttgtactgttaaagctgtcatgaatggtatggcatttttgagtcaggccgtcctatagcacagctgaagcacactgaggcccagagagtttattggcttcttcaagattacaaagctacttaattacagagctgaatttggaatttagaattccaggtccagaactttttccataaactgaactgaagtaaaagctccaggctgggcgcggtggctcacgcctgtaatcccagcactttgggaggctaaggtgggtggattacttgagcttaggagttcaagatcagtctggccaacctggcgaaaccccatctctactaaaaatgcaaaaattggccgggcacggtggcggatgcctataatcccagctattcgggaggctgagtcaggagaatcacttgaacccggaaggtggcagttgcagtgagctgagatcgcaccactgcactccagcctggatgacagagcgagacttcgtctcaaaaaaaaaagctccatgataccttgaatttaagggaaaattaatggtgagttaggaaaggcatgatacacaatgcaccaaacaacactccatgaaaatacctcaacaacgaagtactttggaaagagatgacgctgaggtatttaaaattttatttactttcatgattatccaagaagtaacaaatctttttttagattatttctgatagtctttacatgttcttccaggtacttctgtagcaacttaacagatcgtatgacaatatgctgatagtgattcttccttttgataacggtattagagaagacagacagtgctaggacaactgtacaaacaccatttctcatcgctataggcaagccagaagccacatgtttcctagggaaaagggctgacctgttaccattgctagttgtgtgtaaaacatgtgttagaagaagtaattatgtttagctgactgactatgaccaagattaatagctcttgaaagggctgtaatgaaaggctgccccaactggcttccacattattctttatttatcccgctctcatccctgtcacctttgggcaccagccaaatgtcatttatgtgagatttgccccttggatgtgaaaggcctctctttcttaatgatgggaggcgattgggctgcagggctggagagcttggacggttgacatgacccagaggagatgctccaggtctgtgggagtcagaggcctaggactctccctcctgagggagaaagaacatgaggatattcagctgtctgatcccgtccattgaggtgtacttgagggattacagggagtacttcaaacactctgttgtcaagtccatatatttcggtggctcttcagtttggagcacttggaagtttcttattttgaagaccatttgtttgaatgaaatcatcaatcatttctagtttcgtaaaacttggaagtctccttgtggtagagactgcacagatcccttcttgcttctttgagtcatggacttttcaggctggactgctgcccaaaatgcagattgcatttccccagcctcccctgcaacggggtgtggccatgtgactgagagaaggtgtactatgggagtctctgaggtgtttctttaagagaaagctggtgtatgccctttgccctttgcttcttaggcccttgcttctgtcccgctgcctggaatgtacatgctggacttggatcttgaaggtgaagcccaagccttatgggctaaaaggggccgggcctctgagaacttcaggagaaccactgtcccagcctggttaagccactgttattttggattttttgtcacttgtaggcaaatctaaacttagataatacactgtttctacacttgcagaagatgaaaacgccaaacccttggattgccttttcccttcctaagtattaatatcaaaacttaaacaggttcctttccccttctttcaactcctctaaattaaaacaacctacaaaaagatcatgcagtaatttatttaaaaactaaagacatgagagagatctcagtaagagagatatatgagagggagattaacaagaaggctagaaaggaaaataacacatttaggaaaatgataacgaggactggtcttcatggccttctgtaataggtcagggagctctcactcccttccagtgttggtggcagcaacagcttcttttcttagattattagaggccctagggattcgatttcacctgctttgttaaggccataggaagctttttaaaatttcagatttcaaatgtcaagtctctattcagtgcttttgggccccttgcatcagagtgtttatattttgcctgactctttggtttccggccataaagtttgcatgttgtcatcttttctctaacattatgtgtattagataacatgtactacaatagctatagtgggttacaaaagattcttaacacaacccttttaaaagagttgcagagatgcgtaattatttttcatgattttcaaaacttttgaaagagaaaagcagctgtttggttcactgttctcattagcatttatatagtaaactaagagagaggttttctgtgcagtgtttttccttgctgtttcttgccttttaatttgaagaatagcaggatcttgtcttttgttcacatgagtagaagtccattcagctggaaaaagaacagtgcactctttgtgtactcagagcatttgaatgcttttggtcacacactagttgctgtttaactacaataaaattgtgaccaaaggagataaacatttaaaggataaatgacaggcctgttaatctgaaagcaagttttgtagcgttgttgtttttagctaataggtgtatagccaggagtcacggtgatgacttttaaatctgaaactgagtgaagtctgtgttttcaaccagtttaaaaaatgttgccactggacctttttaaaaaaatatttttaaaaatacgacaaaaattttatgtatttatggtatatactatgatattttgacatgtatacattgtagaatggctagatcaacctaattaacatatgcattatctcacatacttttttgtggtgagaacacttaaaatctactttcttagcaattttcaagtatataatacattgttattaactgtagtcaccatgttgtacaagagatctcttgaacatcactgaacatatttatggctgatcattttgtgttttaacaatcatttgaacatgtctaaactgtctttagaaactggtagggatttccttgctgtgtttgctaagcttggccatgtcatccacataaatatctgaatatattcatatatgaatacatactgtatataatatgtgtgtatatatgaatacataatacctatatttatatataatatgtgtgtatatatgaatacataatacctatatttatatatataatatgtgcatatataaaatgcccaagtatattatctaagaaaagagccactggggcttttataagtctatgatttcagaactatgtccatctttacacctctaaagcgttatgatttacctgatttggtggaggaaaggtatttttggtaattttctgtccctatgggaattcaaaggataaatttcaatctctttttctttctttctctctctgtccatcttatgcagctgaaaactggcatatgactctttgagaagagctcaaacagttgtggtaagggtgcttagatgttgagtgctatctgttttctggggtgtgaaacatacagggttttaccagtctgttgttgcagagtgctgggtgtattttgctttagctgactgttccgttggagtattcagcctttctttaggataacaaaaaataaaattaatcaaaggcataatcaaggacgttttccttttgtacagtcacatctcattatacaacattagtcttaagctttgcccacctgccagataggtgtaagatgattaatgaaagctgaaactctcagtctagaggagacagcagggactggtggtgctagtggtgaagtaagaagtacatatgctgcctaaagggactctggttcagtgtgtgaatgtcagcccagtgttgcaaatattctgacttttcaaaagaagcaggacatctagatttttatttgaaatctctttattttaataagccatcgactaattgaaatttaaaacctgtgtagtccaaatagaccatatctacaggctggaaggaatagagggcctgccttttgtgacctctgttgtttggggaggttatgtaaccattgtaaccagggaaggatacatgaggattcctcttcagggaagctgaccagcccaataaaaaatatataggttgacatttggagatatcttaaaagacggccaggtttccatcatatcgctctgtagtgaggcccaccagttgacaaactaagcttctgcacattcagcttctgatctgtttcatattccctcactggaaattatgaactgatgggcaaagatcattgaacatccaggaatgcctcaaataggaatgacaaaatacagagcacagaaacagaagaaaaggaacccagaggaacaggaaaatgtggagagcagaaaacaatttcaaaacaaattataattaatattcccagagagatgagagaaaatacacgaaacaggaacaagatgctaataaaaaggaaccttcacactgttaattttgttagttgtgataatgtattgttatacatttttaaaaatcttatacatttaaaaaaaagttgtccttagttattagagatttatgctaaataattacaatttgaatattgtgatgtctgggatgtgatttgaaataattcagaaaaaaggatagagtcgtgtgggagatagataaaatgagattggcaaaatgttggtaattgttgaagcatgctgcgtaatgggcgcataggggttcattatattattatttgtacttttgtgtgtttgaaattttccattatacaaccttaaagaaaggatcatttagaaagcaagaaagagcttgcaaattgaaaatatgatagcagaaattaaattttcaacagaagtattagaaaatacagttgaagacatttgtccagaaattagcccaaaacaaagcaatggaaaataagaaaggaaaaatatgaaattagaggatcagtccaggtggtccagtatttaactctgggagttacagaatgagaaccaaaatatcagaaggaaagagattatcaaagaaataatacaggctgggcacagtggctcatgcctgtaatcccagcactttgggaggcccaggcaggaggatcagctgaggtcaagagttcgagaccagcctggccaacatggcaaaaccccatctctattaaaagtacaaaaattagctgggcatggtggtgggcacctgtaatcccagctgcttgggaggctgaggcaggagaatcacttgaacccaggaggtggaggctgcagtgagccgagatcgtgccactgcactccagcctgggtgaccgaaaaagactccttctcaaaaaaaaaaaaaaaaaaaaaaagaaaaaagaaataatacagggtcatttccttgacctaaaagacatgagtttccagatcaaaagagcccagtgaccgcccagcacaacagatgaaaaatgatcccactatggcattttatcatgaaatttcctaaccccagaggaaaagagaagattctaagagctctcatttgcatcctgagctggtctaggatccagggtttccttgggccaatgcttcagatagttaaactcatcttttgcttggtcagggatgtggtggttgcctggctgttgggattgagagaaagaatctagggtctaacctctgctcttgacttccaactagtcttcctgttttcagcttcatggttgaaatgcaccttccttcagaagttcctggttattgtattcctgagcctttctgtagatggtggcatgggagctcacttcttattggtcttccccttttctccctcaatcctgtctaccagttagtcttcagctttggtgtgtgtgtgtgtgtgtgtgtgtgtgtgtgtgtgtgtgtgtgtgtgtgtgtgtgttttttggagacagggtctcactttgtcacccaggctggtgcagtggtgcgatcttgggtcactgcagccttgacctctgaggttcaaaatcctcctgcctcagcctcccaaatagctgggactacaggtatgtaccaccatgcccagctgatttttgtattttttgtagggatggggttttgccatgttgcccaggttggtctcaaactcctggactcaagccgtctgcccgcactggcctcccaaagtactgggattacaggcgtgagccaccacacctggctttaggattcaggttttgctgttacattacttgccattcctttttcatcttttaacatctctcatctgcttgctttcttttttttttttttttttttcctgagactgagtctggctctgttgcccagactggagtgtagtggcatgatctcagctcactgcaacctccgcctcccaggttcaagcgattctcctgcctcagcctcccaaatagctaggattacaggtatgcaccgctatgcccagctagtttttgtatttttagtagagacagggtttcaccatgttggccaggctggtctgaaactcctgacctcaagtgatccacctgccttggcctcccaaagtgctgggattacaggcgtgagccactgcgcctcatctgctcttatctttcacattgactttgacgatttatttttattgttgttattgttgtctccttttcttttttcttttcttttctttcctttctttccctttccctttccttctcccttcctccctccctcccttcctttcttccttcctcggttccttttcttccttttctttcttttctttttttctggagacagggtcttgctctgttgcccagtctggtgtgcagtggcacaatcatagctcactgcagcataaaactcctgggctgaagggatcctcctgcctcagcttcccaagtaactgggacatcaggcgcacaccaccacacccagctcattttttttttttcagttttgtagagatggcaccttattatgtttcccaggcttgtttccaactcctgggctcaagagattctcccaccttggcctcccaaagtgctgggattgcaggtgtgaaccactgcacccagtatattgttttaatttctttacaggcgttccagtgaggttttgggaaggagccaagtgcatgttttgaatccaccatgttagaatggaagttaatttgttgtgttaatcattaatttgtatgtcagagtttcttttcctgaggtttatttgaaaatcaacgtaagaaaacaaaatttaatatggagaaaataatttcctccttcttaaagtctcctttgactatcctcacggaaattggtttgtttctactttctctgaaatactgtggccctgggagactcctgctcagtttagcaaagaattctctactgttttgggtcttaatctaagcactggatgtgtgcttttcacccaactagattatggagtctctgtgaacctagggagatatcttagtctgctcattgattaccttacggctccttatggatatgaattgaataaatactttgctgatcaaagtatactactcaaatttgtattactttatttttatatgtgttatatgtgattcttttaatgccttctcagcctgttgctcagagattagtgggaaggaataaatgtaacaagtagactttgggggtaatactgataagttaaaaatgtcattggtttatagcttcaagggtattttactgaaattgcaaatgttctattatatttagaaagagaaggaatggaaacctgactagtcattatactgaggttgggaaatctggaacttgagttctgaatcagttttctgtagatagcctgtttcacagtggatttgcttaatgttttaccggtaaacaggcactcctgtttattttcagctcttgcctttcagcacaggatagctacaattgttcagagtatgcctctcttgtataaataacaatactgtcattttctctaaagtcatcctttttattaaagaaaccctttaatagtcccacatattctgtagttatgcatttctgtgagtgcttactgaccccagcacagtgtttaataaattattgaactttgaagaacctttgagaagcaagggctttatgtgactgagcagcagacatgaaaaaacgttatcctccagagtatctaacagacagaaatagaggcttgatcagacaatataagcaccgagtgaatgatggtaataccatgaaatatttacacccatagagcatgcgagggtggggaggagagtgtgggtttttatccttttgggttgaacctgatgccatacaactcaccactctatgatcttaaaagcaaaacagaaagagaatgagagaaagaaaggaagaaaggaaaaggaaaataaagaaatgatgaatattgatttggtgatattttgttgtttgcattatcttatcacaaaagcaaggctccttttgtagacaggaaccttactaagagtcaagttttaatcagtccttaacagaaactgaagatatctgaagtgatttcttgccactacaagtttaaagttttaatttaatcaatatctcatgatttaccatgcctcaaaagctgtcattttattatctgtaataaatagagatttgaagagtaaagaactgaatatagcctgatacgatcttacttttaaacagaagatgcaatttatttattttttcatgggatgctattttaaagtgacttgtgatttctttaataatgatccacagagaaaattaacataaaggaagaagtgtctaattatttaggaaaggtttggaagatgtttatcccggctaatatagatagagagtgtctaatatcttacagcatagaaaggggctaaaacaaatgtgccaaccaatttgttttgcccctgtgcccagtattttatatatccatttttttaaataaggatgaaccttttaagatttcatggtgtcatctaacattattaaaagtaattattgttgatgataaataaaggttgacaatgatgtgctttattgaatttaattttactcgtggtttattttaaaaacccgcagattgtgtttgggagatattttaatgtagtatgtctgttttttgctttctagttgtggaagaaagaatcaaattatgtattaataaggaggctcagattgaccatagacattggcctttcaaggggatcatctggttttagaggctttagtctcctttgagtaccctggatgtttgctatgtattatgctaaactaacgcatgattacattgaccctatgattatagtgacctaaattggcaagtttctgtcacttataaagtcaaggtagtaatgttggaagggaaactgtagtgagactctcctttgcaactgtaatgttttgtctgtagattgcaaatgagggaattttataaaggctttattatttgtaatgtaggaacccattgcatacaaagaaatttttagtctaaggacccagtattagtgaaatgtgacatagatctatttgtgaaagggtgtacccagttgaaacagcaggggcaagattttatttgtatgtttattatttttgttaccaaagcgatgccctggaaagaatcgggatttttgagtgagtgatgtgatgtggatttaaatcctgtctttgccacttagttctttcacttccagcaagtcctgaacctaagactcaattttttctctcaaaatggggctcatgatgatttacttcgcagatttgttaaagcttgtaagcattcagcacggcacccagagtgtgggaggcactcaatgaatattagctcctttctccttccttttcagctaaaccaaaaaggctttatctaggaggtgagacttgtagaaactcttgattgatggaaggaatgagtcagtgaactagaagaagggtattcgaggcctgtggataaccatgtgagaaggtgagaagtgagtgtgtagtgatgggagagtgtggctggacagatggacagataaagaaaagagggtgtggctgggcgcggtggctcatgcctgtaatcccagcactttgggaggccgaggcgggcggatcactaggtcaggagatcaaaaccatcctggctaacatggtgaaaccccatctctactaaaaatacaaaaaaaaaaaaaaaagaaaagaggggctgaattaactgacttgtagaggcaaatgtgatattggtgttgggacacatcatctgaacttccactgtcattatctgcttctcaaaattggagttgagagcatgtgcgaacttgagaatttattcttcttgtctacttgaacatctctcttttaaaaaatgcaaaatgttagaaatgtttgatccaatatagggcaaataaaaattggtctgttctttttttttaaatttttttttgagacacagtttcactgtagcccaggctggagtacagtggcatgatcttggttcactgcaacctctgcctccagggttcaagcaattcttgtgcctcagcctcccgaatagctgggattacaggcgcatgtcaccatgcctggctaatttttgtatttttagtagagacagggtttcaccatgttggccaggctggtctcgatttcctgacctcaaatgatctgcccgcttcggcctcccaaagtgctgggattacaggcatgagccaccatgcccaacctgtctgttgttaaattctacctctgatcgtaatacttcgatggagaatacattgctattacttttagcatgatgggtaccaatatgagatttccagttgcttcccgcatgttcattttgcagattttaactgaggcttatatatgctcagggctgtactgtactctggggattcagtagtaacagacgagagtccctcttctcatggagattaatattctattagaggaagaatgctagtaaataagtaaacagtggctgggcatggtggctcatgcctgtaatcctagcactttggaaggccaaggcaggtggatcacctgaggtcaggagttcgagaccagcctgggcaatatggtgaaacccggtctactaaaaatacaaaaattagctgggggtggtggcaggtgcctgtaatcccagctactcgggaggctgaagcaggagaatcgcttgatcctgggaggcagaggttgcagtgagccgagagatcacgccattgcactccagcctgggcaacaagagcgaaactccgtctcaaaaaaaaaaaaaaagaaagtaaacatatttaaggtcgtaaataaggccatgtctaatagtgataaacagtatgttgtgttaatgactgaggggaggggactgctttagatacagtggtctgaggtcacctttgatgtgaactccaaaggatgacaagggcatacatttcagcctcagagacaaagctctgaggtgctaaagagcttagcatgtagaaggaacagaggtggtcagtggccagaacttaaagagaaggaaacgaaagggcaaaggaatgaggccagatcatgagggtagggactttagactgcggtagatttcgattttattccaagtcccattggaaatcactggagtgttttaaggtagggagcgtgtgtgtggagtgacttactctgatttgatttctataaagatcactgtggctctgcgtgaggaatattggaaggccagagtagaattagggagaaatattgggaaaggaatgttctgatggcttggcccagttggtgactgtgcagatagactgaaggggaaggatttaagatacattttgtaggcaaagctgccaggatttacttttagacagcataagaagtttgaaagaaaagaacaatcaaggaaaatttccaggcttttagcttgagtaactagattggttttgtttgcttgttgtttctttttggagatggggtctcactctgttgcccaggccggagtgcagtggcgcgatcgtggctcactgcagccttgacctcccaggcttcagcgatcctctcaccttagtctcctgagtagctgtgactacaggcgtacatcactactcctggctaattttttcgttatccgtgaagatgcctcactgcattgcccaggctggtctccaactcctgggctcaagtgatttacccatttcagtgctccaaagtgctgggattacaggtgtgagcctctgccctggcctgagcaactagattgtgaccatttactgagataagaaaactgaggacgaagcaggtctggggtgaatcaggtgctatccctttggacagtcacatgactggtgtctgttcagcacccaagggaccatcaaagaggctgttgtggagagggaatccgaaggtcagggccagagatagaaatctggggagtcatccactatataggtgatgggttaaagccttagaactcttcttttcatgaatcattgttgttctttaggttgtaatgaagttttaggcctcagcttccctgaactggagtgtttttccttcaccttttccggtctctgggttgcatcgccagactgtctctaagcccaacaaacgcgttccttccaggcaaaagcaggagatgacacacaccatgagccagattttccatggcagacttgtaaggaacaagataatctcattgttcctcctgctacttaaaataaaggtaatattgattttatagtagcagttcaggtcctaaggcatgatattgattaagtgtctgatgagaatttgtagggtagtctcccagacctgcagctacagggcatctccccactgggccaggcctctgtgctgacctccactgttataagtggtgtttttcttaggaatccttagccctgtttagtctacgcactgtccagaagcatttatttaacctgatggatggctcaatccaacccatcaccttaatctgaccttaaagatgggaacctaatgtttttgttcttagtaaatgtgaagactaattttgacactgtttagaattattttcttattagtagcagtagatttcatgaattttctgctgtgaaatttcctattaaaatactataatctaatgttaaatgacgagttaatgggtgcagcacaccagcatggcacatgtatacatatgtaactaacctgcacgttgtgcacatgtaccctaaaacttaaagtataataaaaaaaataaaaaataaataaaatactataatctgacttttttatttttacttttttactttggagcctggctttatgaattttttttttaaacaggggaaggtacctcttttcaaggtgtcattattaagcccatgggactcttcaattttaatgttatatcaaagagagtaaatttcttgtgattattgtgatatgatgcattcaacttgcaggtcaggttttatatcatttatagatcagattctgaagatatcttcagtcaaatttaataacaatcaaggaatatattattcaccggcctgaagtatagaaagagttcccagaaatcatctaaaaataactgtttcatataaaacattttgactttctattgtaataagattaatatatttttctcccatgtctaattctggctggattgttcatggggttgatgtgaggattcagtgagttaatataggctaaggtgcataatataatgcctgacacatagtagatgctcaatttatgttaactactgttagctgctttagcctgttgttaactgcaaactccttttacattacctagcacaggcctgggcacaagtatgatatttaagtagatgcttagtgactgattgatgtctccaaacatttgggatttccttccacatttgccatagcacagcttgttttatgtcttttctaaaatggtctaggtacctgacatcctttgatccttcatatggttacactcaaaaggagccatatgaattttgaccatttgcacatctgcctgtctttttggttagctgccagatagagctcaggttttaaatcctttgcagttaaaagagataataaatgttaacattcctagtacagtgcctggcacagaatgtgtaaatatcatttgattcggaaacatgactgctggtcaattcggcctccagggagacaaaactaaggggtggggttgtggctttttttgaggtaggggatggaatagatatttcttacccgagtagaagatgatgccgggggatctaatgcttcttttaaatttcccttttgatgcacaaaggggcaactccgtgtagcaggaccttggtgggatggataggcagctttgtaagtggagaaatggcctctgtttagcttatgagcacagagtcattttgggggtggtttatgagtcatctgaaatatgcatttaatctagatttgtggcctgcttggtgaggctgctgcttttttatgatctcaagtgtcttgtccatgtcaaaacttgccttgtttttttgtttactttgaatcagaaaaatgttcacaaccacccttggaattcctcctcaagtgtgcgtttggtcacatcacccctggctaccaccagtacatgactgtttattttggatgtccttttctgatgttcagctaatttaacccacaatgaagttaatccttgcttctttggaaaagtacagatttacttattagctgccttccagagacatttgcattttcatgaaagcgagtatataattacattgacttttggactcatctacccacatatgtggtgggcgccttttgaaagtcaggattcagagtaaatcagaactgtcttgagttagctgaagttctctttaaggttaacaataaatgtatctatgacaaacatggggatgtggtattgcatattcgattatgtccatttatctttccttcttctgggtgagaggggagatgaaaatggagctaccttggagttcatgttttcaccttgattctccgcatttatagcatactgattgaaagcatggctgccagaaccatattacttgggcttgagtactagctctgtcacttactcattgtttaactttgggcggggtacttaatttctctgtacctcagtttcataatctgtcaagtggggataattatggtaaccaccactgagcattgttatgaagatcaaataagttaattcatgtaaaatatttagagcagaacttagtatatagcaactgcgatacaagtgttagatatcatttttattagggtttagtaattgcataaataaaagagatgaaagtctaaattattaatcagggccatttatctatgagacactacaggcattgtgtctagccctgtgggtttacattagttagggtaggttattgctgcaacgtaccctaacttgatatgatttttgctgcaaaaatcatatcaaaatagtctataatggcttaaacataataaaatgcatttcttgtttatgtaacagtaatgagtaggtaaacagggtggtaggacattttcctctctgtattcatttagggatctaagctgaaggaggctctgccatcttccacacaaggtttctaaggtcaccttaggttatctctattccagccagcaagaaggggaaaagagctgcagaaatgtgtttaggggttttttatgggccagacctggaagtggcactcatcacttctgttcacattccattggccagaactcagcaggaagaggaggaaaacagctgccactcatctcagccacagagtttttcaggggtctctaaaaatgtatgagacttgaaaaaaatgtattgactccaaactccagacataaaattgcagaattgaaatgaataaatgtttaactaaatgcttataaaatggagccttatatcagcttccaaagttgttacagtttgtatggaaaaaaatgtaatttcttcctaacgaacctccttgcttctttccctgccttctctactatatttgaaaagattttgtaagttggaatttggaatttccaagaattcccaagtactatccagtgattgctgagaaattataattagtcataaatgagtttctcaaggccaaataaattcaaacgaaaaatcttctcaaattattttgcattgcagagaaaccttttaatgtgaaatatgaatacaatttaatatgtttattttgatgttgagtgaggccttcaaaagtagcaggatcatggcctacagaggtcttaacattcctattgtatgcagacacatttcaattgctttgaaaaggtgtatgttgaaggtaactaaacacattttgcatttcaagctcagaaaatttcccctttagattcccttttcttttctccttttattttctaataaaatatttactgctgtgatatccaagaacatgaatgatactgcattgaataacccaggtgcttggtctggtggatgccagtgccagagaagaaaagtgccctattttttcagttatcatgtttgaaggcgaggctttggtctgccttctgagtcattcttggcttcttggatgatagatttcttaaattcttctattctcctaactcaaggcacttctgaatgggtgtttgcgagacgttgtttgaaaaaccacttatcgtgatggatttttgttcttctattttttgctctcttacacactttgctgttgtcctgccaattggaatttgatttgttaattacaaaagcaaactatccaggatggctctaaagggacttcgctataggttggggctatgatagagactttcgcgaaagggattggcaattaagaaatatagcaactgcttctgatgattaaacatttcaagcaactctgaaggtagaatgtggggaatctccagagaaggaaggaaatagagagggaactaatatttatagttactcctatagtcatctccatctcagtacaggacatcttcatccttccagttgttcagaccaaaaaccctggaaacatccttgacttcgtctttcccattccacatttcacccatcagcaaattctgttgcatctgtcttcagaatatattcagaatccaaccacttcttacaacgtctccttctgccatccttctccaagccactagcatcactctcctggatcatcgcaatttcttcctatctagtctccttgcttctttccttgcctttccctacatagcaatcaaagtttagtcttcaaaacacaacaaaacaaatctcttttctgttcaaactcttttatgtttcctcaaaatgttatacgtagagttaccatataacccggcaattccactcctagttacccaagagaaatgacaatgtatgtccacacaaaacctgtacatgaatgttcacagcagcgttattcatgatagccaaaagtggaaaaaacccaaacgcccatcaatgatgaatgtacaattaaaatgtggcataaccatacaatggaatattatttgtcaataaaaagaatgaagtactggtaccatgctataaaatggttgaactttgaaaccatatgctccgtaaaagaagccagtgacaaaaggccacatattacatgattccatgtacagaatagacaaatccatagagactggaaatagattagtgattgccaggagctggggagagaggaatggggagtgactgctaatggatgcagggtttctttttcttttgtggtagtgaaaatgttctgaaattaagtagtggtgacgattgcataactctatgaatatactttctggcttgtatacttttttgaaggggaaaattgtgtggtatgttaacgatatctcaataaagctgctattacaacaaaaacaacttctttggctttctttctgatctttttccctgaatcgtttctgacctcttcccctactcttcttctctttctttttaacccactcagactggcccctattttgttcctctaacagggcaagtgcttcctgccatgggcctttgtattttctcttctctctttttgtagaactttcttcccccaggtatctgcgtggctggttcacttgcttcctttagctctctatttaaacatcctattctcaggagactttctctgattacccgaaaatagtactccctacttcatggcctgctggcgttctctgtttctttcatcctgttttatttttctctgtatcatcaacatgtgatacactgttttcttgtttgttttttatctgtcttccaacattaaaatgtaaactccatgaggcagtaactaggctttgtttgtgactgtatctgcagtaatacataccacacctcttttcactagaccattagcttgaggaagacatggatttccttggcactggtgttgaattgggactaactgtatttgcaggaggaatattcagtgtgtctattagatgctacattagaaatcatcagcttggaagcagtctccatgggaaaagtaattttgattcaaagggtagaatggaactactcaggttacatggtcttttattgtcatataaatctttgtacagagttcctactttttaaaccattagcattatgctaatatacaaagtttgctacttttcatatttgtcttacagattcaaagcctttagttcttttcagtcttaatttaccacctgtctgctctctccttttctcccttggaatgttcttaagatttaattttgaaggaactttctgtcagatgattattggtaaagtaaaatgtatttctgggaagcagctgattacttgggcctttgatttatttatttatttttttttttgaggagttcatattgcgatatacctatttggtggttatttagaaaggccaaggtagggagaaaaaggaaagaataaaatatatgtatgctttaaaaaaaagcaagcatttagtttggggagccctccaaatgtgatttcttctactcctgttttcctgcttccaagcataggtggaagatattgtcagtttctctgaactcctaagttgaaatgtgcaagtcactaggtggcactgaagtatcattctccacacagccacgccatagaacacttttgttatcttgctccagctgactggatttctaggtgtcagggaaattgttttattggtacagggcatagtgtaatatattcctctccaccctaggcagctacttaacgccctgaaacatgcacctcttgtggtcatggcctgttaactatgcttatttggtgtaataattagcagaatttctcactaacaggggtacttaccaacacctcacatcttcactgtgtttttgtacgtgatggattgtacattctgtggagaaagttgggaaggtcaaagcttaacctctgcctaacaggactagttttcgcacatttgttcagaataggtttatattaactggcttttgagcttcttcagaccagaattgtgtgtaacgtaaacatatttgagcttttatgtaaggacctagtgaaggtttgtaaacacaacactgttaattttccaactcatagaatgacagaaaaataaatgaatagctgctggaataattggacgacacttgttactcagaactgtgagtgttggaagcgtgtcataggaacagtgggcctgccacaagcaccacattttaggttaaaatcggagaagaaaattacacatggaattttaattttttccatggtcgtaagttcggccccatttaattctttgtggtttttacaagccctcttaggctcctaatatttctatagcaacaatttcaacgtttattttagaatgtggtcagaattaaccgacagaagaccaaacaggataaaataggtttaaagcaggaaatactttagctggaccactaacttaccctctatgaccttaggcaaactgtttgccgtctctgtgctttgattctctcatttcttaaaatggagattataatacgcacccttgtgtgtctcctccaccaggtaaaagtgaaacaataacttctcaatatacctttgcttatattcaaagctccaggtaaatataagatgttgctataattacctaagaaagctaggaagatttttctttgttgattccaaggtgagttgtagaaattccagaagatggattaatgtagtctgagggctcagacttctgcatctgtgtagatagtacctattttcatatactgtggcctggctctgtttctggcctggctctgtttccaaggtttaagttccattcttttaactgtgtatcaactattttcacttggttgttctacttttacttaaaccctttatatatgtctggatttagttgtaggaaacagaaactatgtgagatagggaaataggttgatataaagtcatcaggaggaccagagaaatgggctgaaggtggagcctccagagatgggcttctgaaacaatattacagattggcttgccagggtagccgctcatctgtcacactcgggaagggctaagaatcaggagtcattcctagaactgttgatttgtaagaacacacaaccatagttgtagttgggatcaggaaggtaccaccattacaactggcatttgagaactacaaagtgaatggccagattctggaatgttattgcctcatgactatgttgcctgcagaaaaagttgaaacagcaaggtgatggcctccattttatttttgacttctgattctcacatgccgccattaaattggtgaagcttatttctcatccagaactcctagctgcaaaagggtctgagaaataatagtgtttaccttttcatcctctgcaccataggaaggcacaataagaggagattggaagggtgctgagtgccaccatatctacctcttcccccagcatgtttaaaataaaatatctttacctccaactcatattgcattttctgtccagcacagcaactagcttagtgggccctcagtagatgtgttaatgacattgacttccttatttcttatatggccccacctttcctagtcacgtgtcttggtactatgtgagatttcagatccacctgcctacctgtaactcttgattccttttcatttccattgctgtctccttgttcaggtccagctcctgtctgcctgggcttttgcagtagtctccttatctggcttttggtttctttcaccgtaaccatattataagtagattggtgtttaaaaatcagaacaacaaataacaaacatccttccactgtgctcctgtccttctcaaaagctttctgaggctcctcattacatgcaggatagaatccagactccttagcttgactttcaggaccttccataatcagggtgcaatctatcattccaggcttatctttcattttccccctgctggaactgaattttagccaaaaggtctaatcactgatgtcagagtgtcttgtcctttactaacttttcagctctgctatccttttgcctgcttttaatagtctgttttctttctcatttgtttattcctttgatcacttaggcacagagtttttttctcctttcttcatacttatagcatggtttactaaggcattttaattttattacctatatcgttagttttctttttatgactatatactctccgctcctttttatgtcgacaatgtaaatatttgttgtggattgatttgttgatttttcatggtttagacatctacttgcttgggaaaaaggggatggtggagggtcaatctgggggctgaagcggtactctagctgtgtgattttgtctttttgattactactgaaattaactatttgctttgagcaaactaatgctgagttttgtggatttagtgtttgaaaagggccctgagagggaaaaccctggagttgagctccttatccccgtttgccaggctggatgagctccatgtccataccactgcattgcagtttgctgaagtgtgtgttgtgaaatagcaatggaatttgtctgtggtttcttgccagcgaggaggaggaagaaggattctgagtaaatcagacatgtaaattagtaaggcccatgggccttaagcgaattacacaataaagcccaaagaaattcactttggcttctttctgctttttgtgtgtgtgagaaggcagctattatgtgtttgctttaggccagaggttcacaaattttttggcttcagaacccttttatactcctaaaaattgttgaggactcaaaaagcttttgtttatatgggttaaacctatcaatatttactgtactgggaactaaaacaggaacttttaaaagcctttattgatttaaaaatagcaaaaccccttcattacaagttaatgtaacattttttatgaaaaataactcttttccaatgtaaaaaattagcaagaagtgtgccattgttttacttttctgcacatctctttactgtctagcttgatgcttgattcttatacttttttgtttagttgttgaaatatgttgttttggttgaagtatatgaacaaaatctggcctcagacattaatggaaaaagggagtattttaattgcttcttcagctattaaatgtagatattcttctttgatattattccaaaacttgtcaagtgatagcttctattttaaaacatttttgtttttaattgacaataattatctatatttatggggcatgctgtgatgttccatgtacacattgtggcatgattaaatcaagctaattaacatatctgtcaccacacatacttattatttctttgtggtgagaatacttaaaatctactattttagcaaatttgaaatatacattactgtttactagtcagcatgctgtgcaacagatcactagaacttaggtctcctgtcaaactgaattttttaccctttgactaacatctcccctttctctgctctatcccaccaaactctggcaattactgttctgctctctacttctatgagtttgacttttttagattccatattttagggagatctgtacctggcttatttcacttagcataatgccctctagattcaagattcatccatgttgtcacagatgacagaatttccttttgtaaggctgaatattattccattttctttagacaagtgataatatcttaaagcttacttgcagtgtggaatccgaagctatctcaattaacttttcttactttgttatattaaaatctgttgatctcttttgcactttgaatgcatcttttacattcaaatgattttgtaacattacgttttgatcatttggaaaattatcatgtcactgagttatacagatcttccaaatgttgatgcatttcattatacagtgtaaaaaaaggtcacactcatcagtatcaccactgatcttatacaagtttttaagtattgaaaagccccaagctcaaggtagcaaatacaaattttctaaatttctgatttttcttgacaacctgaagtttatcattggcagcaaatatggtcagttgtttttcttgaagtggcaagctcacttgattaattgttgagaaaaagtctgccaaatactcaagtccgattaaccagaaaaatgtcagtcagctattttttcaagtaaaaatggtgttccatggggcaaattcagcccagaactcaaatcacacatgtacttttgtttgagacaaccattttactttagtatttatcagaagtactttatgtatgtttactattttgtcacacagtatagtaaaaagatagctacttaaagctcaagatttaatagaattaataatttttcctgcttcaccaaggacatgcttaagtgaaactaacttcctttttctttctcttttaaatggaatgcatggtaaagaacatagcaactagtaagtttttgaggtctattaaaacagcctgctcactatagttaataataatgtatatttcaaaattgctaaaatggtagattttaaatgctttcaccacaaagtatgtgaggtgatggataagttaattagcttgatttaatcattccacaatgtatacaaatgtcaaaacatcacattgtactccataaatatgtattacttgtcaattaaaaatagatgttaaaaaaactgaatactagtttagtttggtaccgctggcttgattagtgacaaggcacctgcagttttacccagcattctttaaaccgtcagtggaaatgtccacacggtgaaaaaagcaagtaatagtattattctgaaaatagtattgatcttgtggaacctttgccaatctactgcactatgccaattaggaagatttgagtagctaaaaattccaagagtggaataatagttttattagttatatcttgaaggccaatttccttttttaccctggaacttaggctaagtgaggcaacctggaggagaaaatttctctcctgtcctgagattgctgttagcccagggtcggaattcctggggcctgattttttgagtttaagaagcacagggaggatttttttttaacctgcctttggtgataataaatgtttaacctaaatcaatgtgattgtggattttttttttttttttgaattgttgtttctgttagaaaaataatgaatgacaagtgccgcagagatcagttgtttgtgagatgactgagaaggtaataggacctcctatttgggacattaaggaaagccttctctaaaaaaagaacccattttgagcaacatgcgaaaattctttgagtcagttggcctcatttgtaagcctttgattgctttatttgtttgtttgcttgcttgtttatttatttatatttggaaggcaatctttctgcttcctgactggctgtcagatctcccaaataacatcatccctttgctggtgtgaatatagcctagacttgaggcagcaattaactgatcatgtaatagaagaatcccaatcttccagtttctttttttaacttcttgggtggttggggcacatcattgcaacaattattacatttactcaagagtttgtcttttctattaaaaaaaaaattccatctaagtgccttacggtgaagaggaggagattgtgtaactggagtctccccttaactggtctttattgttaaagaagagtgatccctttgtgtttcagcttggcacacagaaactgttttaatttaacagtccagctcctttaatagatcaattctctattgtggtttgaatttggtgcactcccaatttactctaaacttctacgggcttccttggagaaactggggcagagatgccgaagactcatttcgggtacaatttagagtttgtttatttatataaatgtaaggggtaccagtgcagttttgttacatggatatattgtgtagtggtaaagtctgggtcagcttttagtgtaactcatctgaataatgcacattatatccattaatttatagttttatctcaaacctcttattaattaatgctagccatggaagctagctagcgcttgtaaatgcctgctgtgtgttagatgctctagtaggtgttttagacaccctcatctaatcttcatggtgattttctgatatatcctgaacctgtacaattttctccacttctgtcactactactacaggccaagccaccatcatttcttgcacagacttctgcaccctcaatgtggcctccctacttcaagttttaacagtcttctccctctcataatccactttccagacataagttggatttattttaaaaatatatatcaagtgatgtcacctcactgcctataagactcttcagtgacttaatgacaaacagaatgagatccttctcctgctctggctgacaagaccagaacaacctgggttctatagctctgagagctcaccagccactctgtccttgctcgttcactgtgctccagactcactggcttgctttctgtccctggaagccaccagactggttcttccttagggcctttgtaccagctgttcttcctgcttgggacactctctccccagatctttagtctgggcctggcttcttgtgatttgtgtcttgcctaaaatgacacccactcaatgtgccttccctgaccagctgagctacagcggtttccctctaccgcatcactagattttactttctttctttttgtttgagatggagttttgctcttgttgcccaggctggagtgcagtggcatgatctgggctcactgtaaccacctcctgggttcaagcgattttcccacctgtagagacggggttttgccatattggtcaggctggtcttgaactcctgacctcaggtgattcacccacctcggcctcccaaagtgctaggattacaggcaggagccactgagccaccacattcagcctagattttattttcattaaatcgcttgatgcagtgcagagtgagtttctgctattagactgtctggatttcaatcatggcctcgtcatttactggctgtgtgattttggagaagttacttaacttttcaggactttcatcttcttctttataaaatggaaatattattatatccctccattgtaagaattgaataaggtagtacttagcatcttttatggtttctgacacattgtacataatcaaaaaatgttaaatattgctattttaatgtaatgttattaaaatcattgcatattttatagcttatttatttggctatttttctgtctcttctaccaggaatataagctttatgagggaaagaatcttatgtgtcacattcccaactgtgcccctagagcttagaacagtgcttagcacatagtaggcattcactaaatctttgctgattattaaaatctgagatataattatccctatttttccaattgagtaatcagggttcagagaggtaaagtaacttacccaaggctacgcagctactaaatgctagtagttcctggtatttgtactgaatgctgattacaaagaccatgttctttctgttatgccacaatacataagtggatctttatttcagattctgtcatttatagcagatgattttcaggttgcctttttatgtaaatgtaacatgactcatgaaatgtaaacagccatttgtgtgaacatgaaaggtcagagccaagagttaggccacaggcaagttaggaaagtgagatatagcacacccaccacattcagtggtggaagaaaagttacctgattcctgccttggagatgtgtagggtagtgaccttggggttgggctgcctgaggaggttcctatgctttgatttctgaatggacaggatccctaaagtcatcgaccctagtttgggctcttgtacttcttctatcatcttattctagttggtggaggcagaggttgaaaaatcaaaatgttggctccttcagcctctaaaaagtaataggcttgaatttgcttttgtcactaacatgattatggtgcttggtctgtgggggcttcactgatgcattctttttaacagccctgtttgtttgtttgtttgtttgtttataagtgagcatagcacagaggaaaaaatataggttttggagactggcacatcagggttcagatttctgctgtgctacttcttggctgtgttttggcacgtgaacttctctacacctcagtttctttgtttatgtaatggggattcatatgacaattaaagagagagcttgtctaaagtgtcttatgtagtagtatccccagtttgacccttttgagaatctgatgacagttatggaaccctctccccagacaagtgcccgtatacccagaactttgtatttaatttcatggggttcatgaagcctctgaaactcagcttaagagtccataccaaccaaggtccttataggaagagcttgtgtttttgttttgttttggctttctgcagtctcttaataatgtttattgaatgagagaatttaactaatttccggtttccataatcactttaaactcggtatttgatttccttttccctgggacctgtgacagtgccagcttcatagcctagtctaggcatgccagttgcccactgtggcaatcaatatctgagcctgtggtttttgccttaggtaaactgtagagatggactcatggaatgcttggaaaatttttcagtttatgataatgtgtaaatgtcgagagccaattattgaggaatggcacctcaaagtatttgggtactctagatcagacatgaccatcttggtgtgtgaaattttgctaatgcatctttcctaatagaatatacaatctcagggctagaaagtcttagagatcatttaatttaattcctccagattgattaagtggtttgtccaaggtcattcaactggtatagtggcagagctcaggctgtacaaatcaggtgagtattcttcagctcctcagaagccagtaacttccactcacttgtgtgtgtctgaaattcattaaaccttcgacacaaagtgcagccattttaatgctgaatgatattcatcactgtctgaaatgggcttatttatgtacgaatgtttattcctatctcttcctccattctcccaaaatgtaaaccccataagaacaggaatcttgtctgtcttagtcacactcagtatccttagagccttgtgtgtagtaggtgtgtagtgaattttggttgaatgagtggcagttctaataatgtcagaagaattggaatttctttacagaaatctttatcagtaatttaacaaacatcgattgaacctattatgtatcaggcactataccaggcacaggtacgaatgagatatggtgctcagcttcaaggagttacagtctaaataccaaaataacagaatcaagagcagcagactaaattgggcccactgtattttttaaaaatttaatttgactgctgggtgcggtggctcactcctgtaatcccagcacttcgggagcctgaggtgggtgaatcatgaggtcaggagtccgagaccaacccggccaagttggtgaaacactgtctctactaaaaaaaaatacaggccaggtgtggtggctcacgcctataatcccagcgctttgggaggccgaggcgggcgggtcacgaggagatcgaggccatcctggctaacacggtgaaaccccgtctctactaaaaatacaaaaaattagccagggcgtggtggcgggcgcctgtagtcccagctactcgagaggctgaggcaagagaatggcgtgaacccgggaggcggagcttgcagtgaaacgaggttgcgccacggcactccagcctgggtgacagagcaagactccataaaaaaaaaaaaaaaaaaaaaaagtaaaagaaaattagccgggcgtggtggcacgtgcctataatcccagctactcgggaggctgaggcaggagaatcacttgaacccgaaaggtggaggttgcagtgagctgagatcgcgccactgcactccggcctgggtgacagagtgagactttgtctcggaaaaaaaaaaaattaatttgaatgcatgctccattatatcctatgtcttttaccttcctgctttgctcatttaactgcctgatttctgatgacatttaagttcaggtcttaggttctgtagatcagtggtttctaaacctggttgatcatcacctcacctcactggccttagaaacaatacagaccctacttctggagattctaaaccagggctgagatgggcccttggaaactgtattgaaaaacagtaactctatagtcacttacaatgagcagccaaatctagctagatgcccctgctttatgggtgagtgttgagcatgagggtttcgtcttaaaacctggacttgatattctatattcatagcatctttcatatccttaaagattctatgtacttttcagcacattgttctgtttcaaggggctctgcaaagtatacttgctgtctgtacatttccactgtgaaaactccttgaaatcatgtagacaaatgaaagctaaacatcaaataaataacctaaactggtaatactcccatttggctctccttgtgtcttttcatgtgggttagctcttcaaccagattcagcatataaattgagtatgtatggttatatggtgactttcaaaagtaaatactttttctgtggaacaaaagagatggatttgtggttttccaggattccttttccctgacttggtagaaagatagccaggcatagctcagcagacctgaaaataggtgagctgtcaaggtgttggcagggagaggctcctctgggtgggacttggggcatcctaccagcgaaaaagagactaagtttaagtgatttcacatttgggctttacttactataattgctgaagtgctaaattgagtgtgacaaatctaacaggtaattgccaagtaggtttcattaccagtcattgcatagataaatgatgttccttatgttaaaaaataaaaccaaactaaagaaaaaaaattggactatatttggaggtagaattcagatattgcagatatgttcatatacatcaaagctgtttcaatgtgtcaacgaactcagttcatttacctctgccaaggtggtatagtgtatgtgggagtgcagagtgggggaaagtgaggaggggttgtgatttatgagaaactgtaaaagaggttagaattgggaaacaagtttttttcttagaggagtggcaaatagtaagtagcatttggacctcactcagctctaatagttaaagctaagctttttgacattatcattatatattaataatatatatgtgtgaccagcctcaatagattttattcattagtaacttggttgatttaatgaaaatagttttaaaaggcatactgaagcacagtaaaacctaaggctcacatcactgtctggggagtcagtgaggaacagggcagagtgccagtgcatatgaagagggatttttttgccttcttggttcactgcatattcccagtaattggaacaatgcctgacatgaagtagacataaaataattactgaatgaaagtggaaaggaaagtatacttagtctctgctttcatggagcttatatgctagtgggagagagacaaaaattaagtacaaataaataaacagaatatatgatagcaactagggtgagagtgctgtttttgataggatggcagggattgggccatttggggaatgaattgatgagaaagagaaagttgtgcaaagctgggagaggaaacatcatttgaaggacagaaagaaggcctacatgatttgagaatggtggagagagagatttgagggacagacttgctatgattaagaaagatagctgggcgcggtggctcatgcctgtaatcccagcactttgggaggatgaggcgggtggatcatgaggtcaagagatcaagaccatcctgaccaacatggtgaaacccggtctctactaaaaatacaaaaattagctgggcgtggtgacatgcgcctgtagtcccagctactcgggaggctgaggcaggagaattgcttgaacccgggaggcggaggttgcagttagccgagattccgccgctgcactccagcctggtgacagagcgagactccatctcaaaaagaaaaaaaaaaaaaaaagaaagtcatgataaagagtgtggattttattttacgcaaagtgggagctcattaagaaggtaaaagtttttaagcaagggaatgacatgatttgacctactttttaaaggaggttgctctgacggctgtagaggatagaccataggcaggggacaatagagagaccaggaggaggctgttggagtgtgttaggcgagatatggtgagtggtttcagaggcttgtgtgagaaagttgatacactgcccctaccccatgcaaacacacactttcttttcttatgatgacctttctttaaaagcatttgttggaatatgagattataggccataagtgagaaaacaactctttttgagctgtgaggaatactaggagaggagaaagtgagctgtgtgtgctgcccatggtggtacgctgctatggttctacagttccagtcatttttgacagcatggattcaatgcaaaatggcaacacacactctgtatcttttggcagatcagaacataatgaaaataaaataaaaaaattcaaaactggctcttgaatgaaataggattcagaagagatgatctcaaatctactttatgagataatgtcctttttaaaaataaacactaacatcagttatgcatttagaatgtctgaattattattctaggttccttgcgactgctgtgaattttgtgatgcacttggatagtctctgttactctaaagttttaataggtaacagtcagaaatggagtgggagagcataaaagcaaactgaaatgcaaatagctggtaccctgaagccattaactttaagctggttattcctgacctactgtttggacataagatggtagagaggctgagtgtgacttgaacatttgttccttagaaacaccatccttgggctgggcgcagtggctcacgcctgtgtttccaggactttgggaggctgaggcgggcagatcatgaggtcaatagatcgaaactatcctggctaacacggtgaaatcccatctctactaaaaatacaaaaaattagccaggtgtggtggcgggtgcctgtagtcccagctactcgggaggctgaggcaggagaattgcttgaacccaggaggcagaggttgcagtgagccaaggtcgcaccactgcactctagcctgggcaacagagtgagactccttctcaaaaaaaaaaaaaaaaaaaaaaaaaaaaaaaagaaaaagaaacaccatccttgtaaagagagcgcatacaccttcaatttctagggcagcagcgtttgctttacaacttctatgtcttggtgggagtagcactatctatcaccttatgggccaaagggaaaaagtccagtgaaaatggctctgatgttgttggaagtgggaaagcaggttaataggttcttcttaatggaaaatgcagccaatattggccaacttactttgatttcggtagtcataacaccaccctggaaggcaccctagatagaggtcacttgctaccactcattttacagatcaggatactaaggattttcctgattttaagcattaagtatggatatccctgttggttgaagttaaattggtcaactagaatttaaaagcaaaaattaaaaaaaaattattttgtattaggtttcaaaggaattgttgtcagtaggagaagcctgattgttccttttacgctgactcatacagtttcagcagattacatttgaggcctaatgttgaaatctcatctgtaagtctggtatatctaactaatcatataaacatctttcatcttagactgtgtagcatgtccctagtagaccaggtgggccaaatgacattatagttaaatcaagccaataaatatatgagaaagaaggcaaatgagcgtagactccatagtgaatgatggaggttccgacgagtcaaagacactgaactattcattgctattggtttatggaagagcaaacccagatatgtgttatgctgattctgtgtgattggctacttccaggattgaccctgttctcctgtcctgctcaagtctccttccttcacttaaccatatattgtgggtactcagaaatgccatgcttttgtttagagtagcaggattggtgttgaagatcaacaagaaaaagcaaaatgggcttgtctgtcccatcaagtgatgtgctgtcaacatatgtagaatatgtgccctgaattaggagaaaaaagtagagattcctgagtttaggaaattataatctgatgcatcttcttcagactcaagccttacctaaagtttgtaaattctttctctttcgtctttattctttctctactcttaacatttttttcccccacctctttggctatatgctgttctgcttttgatacagaattgaccttatttggccagatggggtggctcatgcctgtaatcccagcactttgggacgctgaggtgggcggctcacttgaggccaggagtacgagaccagcctggccaacatggtgaaactccgtctctactaaaaatacaaaaattagccggacatggtggtgggcgcctgtaatcccatctactaaggaggctgaggcaggagaattgcttgaacccgggaggtggaaattgcagtgagctgagatcaggccactgcactccagcctgggcgacagagctagactctgtctcaaaaaaaaaaaaaaaaaaaaaattgacctttttcatgcccaacctctatctccattatctcctagctttttggaaaatatttagtactggcatttcttcttcactgatttttcattctacctgtctttagtatcataggggtagttacctcagcgggggtagggagaccttgggtgtctcttacttgtacatactctgtcctctataagtaagtgtgtaaatacactgtattttcccattcagacatattgtgtaagtaataggaaccaggtgtttgaataaattaaccaagtgccaaatttcattttggaaatgaaatattttagtttaagactctaggacatttataaagctgaaatacattgcaaagtgatgaaagctttcttaaattctgttatagtcatgcaccttaaaattattcattgttacttatagttattatctgtctgtatatgctcatctacatatgtaaaacatgaagatattctctcaagtgaggacttcatgtgccagatttttcagcctggattgaattttatggatgagagagataccctggaaatggaaccattggcataaccttgtgtctaatataataacagagctctaatgaactgcaacatgagctcagatctgcaaaatattcagaggatataggcaaagagcagttttttcctccttatgagctaggttgttctccaaaagcaacaagtactacttgtcttttcagagcgctgtcatggagctgtaagtctctttgtggtttagacttaatgtgagtaagattcctctgcattctcagcctagaaaaacttgaccgttctcttggaatttggtgaaagtttcctaactttgaagctagagaatactctcatttcagattaggcaattattaacatttttttctgttctaatttcatgatgccaaaaaatcatgtatggttgatctatttggagaacaatatgtagcctcagacacttaagatcatatgtagtttagaaataatgtcaattgcatatgaatgttttgatgtttttcccccagcctttctgaattttttgatttcttcaaattgtacctggttttttatttttgtttctgtttttgtttttgactttcacataaactgtttatagtgtctggaacatacatatatatatatatacacacacacacacatatatgtatgtatgtatacatgtgtacatgtatataaacatgtatatgtatgtatattccagacaaattatataaatgtatgtatatatatacaaattatatatacatatacgtatatatatacaaattatatatatacatatacgtatatacacaaaaattataacacaaattatatatacatatattttgtacatatacaaatatataatatgtttgtgtatgtatagttatatatacacataaatattttgtattttgtatatatgtatacatatacattttgtaatatatacgtatatattactatatgtatttttaattgtaaaatacacataggataaaatttataattttagtccttagccattttttttaaccatttaacaagtggtattaagttcatcctcattattgtggaacccatcaccactatccatcttcaaaacttttccagcagcccatactgaaactgtaccaattaaacaataactccttgtttctagcttcccccagcccctggcaaccaccattctattttctgtctctacaaattcaactatttcaggtaacacatataagtagaatcatacagtatttgtccttttgtggctggctagtgacgacattaagattaaaatcaggagaaacagggtgggcatgttggctcacacctgtaatcccagcactttgggagcctgaggcaggaggattgcttgagcctaggagtttgagaccagcctgggcaacagagtaagacccccatctctataaagaaaacaaaaccaaaataaagcaaaaaaaaaaaaaaaaaaaaaggagaaacagatttaagacagtcaggaaagaaaaatattgactttgattttggtcttattgaatcttaggtgctggcaggtgaggactttcatgttgtaatatcctgaagacagtttcaaatataggtttggaatggagatgaggacttcagagttatcggtaatgaactcattttaagaagatgagattgcctaaaggaagaatgttttgtagagttagaagagtgggatttacctgatgatcttaggaattctggacatttatcttaaattgctctttaggaagtttagtagaaaaagaaaggatgcagatagtgtctgctattaaaggcagaggaagaaagacctgaaacagagacagagaagaagggagcttaggttataggaataaaagggagaggatgtcatagaaacgaagggaaatgaggattttgagaaagagatgcaagtgactgtgcccagtgtttccctaatgaccaagaggatagttctgggttttagcaagtatgagttggccattggccttgggaagaatagtttcagcagaatggtagtggttgaagccagatcctcataggggttagggccaaaagaaacagtaggaattctaggcatttatctgaaattgctctttaggaagtttggtggggaaagaaaggatgcagatagggaatctcaggcacatagaggttaagtaacttgctcaaggtcacacagtaaccttaagtaggcaggataagctctggttctggagctggtgctcttcatcattattttaggctgtactctcccacctttttttctttgtggttgtaggtggttgtaggctacttaaagagatacctatacacctgcagttaaaatccaagtaactcagtggagagcctggtccttcgttattatgtctcagattgaagttttatattttacagcatgatgaaattacatatatgatggttaggttaggttgcaagtcttggaatatatgcagaggaataactttattacaatgactatttactttttataagacaatccagcaatggtaatttttcattagtgatataattgcaagaggaaacttgagaacagaaaatggacatattgaaataagattaaatacatgctgatgaagttacagagttttatgcaacgtttcaatcaagaaagcatgataataaagcgtgtataggccgggcgcggtggctcacgcttgtaatcccagcactttgggaggccgaggcgggcggatcacgaggtcaggagatcgagaccatcctggctaacacggtgaaaaccccgtctctactaaaaatacaaaaaaaattatccgggcgtgatggcgggcgcctgtagtcccagctactcgggaggctgaggcaggagaatggcgtgaaccctggaggcggagcttgcagtgagccgagattgcgccactgcactcccgcctgggccacagagcgagacttcgtctcaaaaaaaaaaaaaaaaaataaaaataaaaaaaataaagcgtgtatattgactttccagaatcttgagaatggataaatggaaacaaagagaaatacctattttgtattataaacctctaaaatagttactaaataagttattcttttaggtatttttctttcacttttcatcgctattaggcaaaactgatagtcgatgtagctgtgtcagtagctaagggatttttgttgttgttgttaaactaacatgtcatatcttgtataattcagctgtgactatacaggggaaagtatttaatgtctgatgattatacagcctgtgctttggaaacagccgaaagccagacagcgacagtagagggcaaaggattattaaatggatagtcactgaggtcacttatagtgactttactgcaacaccgtgtgcatctcctttcccatggcaggttgtttgatcatggcttaatggctaaagctttgtaaaattataaaaaaagccagaaatcctgctgatctcaagtgttatttacagttggatgcttggcaggaaagtgctaagtctgatcatactaatgctaagtcaggcagaacacgtggtgaaatctcatggagctctatcctctgaaccttgagaagactaccaaagtataagatttcagggtggaaagtatgctgcaatatgattgagagaatttggctttttcatctgaacaggtgtggccaagtggaggagtttctcctcttggaaatgtcaaggggtgtatcattaggtccttggagctagaatgtaggtagaatggcaaggaaggaattttaattagttctgttatctttcttttatggtttggaatggtattttctttggtcatctattcacttacaaaattatggacagtatttgattgtgaggaagaatcttgggtaagtgttatctttgttttcagtagaattacttggagctggctcaaggaaattatattagtagtttgcaagtgagttacagctaatggagtcaaaagaagtttgaaaagggtcaaaagaagttagaattgttccatctgagtctttggcccttagtaaaggatccagcattttgttttgtttttgcttatgtctttgatattaatatatttttcagaatattataaaccacccttccccaaagttttatttccgcaatcactccctaatctttatttcttttttgcttcgcatcatatacatttttctcttcaggacaccttcttttcccttttgaaacttggactatgttcttaaaattgacgattataggtaagaagaccaagtttgtgagacaaatagaatttgatattcaaattatctgaagaactgaagtacattattttgtacttgtttttatttattaaaaaaaatttcccttggaaaagaaattggtgagattaaggaatgctatagctaactttgtaggatatttggaaaactatgagttatagtgaaaggtgctgtcttagggagtacattttaaaagtgctagaaaatataatattacagcttgaatcaagagaagtgaactctgctagggactaagtactttgttagaaaggtgctcataatagaatggcgtgaacgcgggagacggagctttcagtgagccgagagcgagactccgtctcaaaacaaacaaacaaacaaacaaacaaaaataaaatagaaaggtgctcataataaaatgagaaataaaaaaaattctaactgatcaaatgggacaaaacccagattcacggtctttatatgcaaataaagtatagattcttagattcagaacagtaaaagaaaaatacctagaaaacaataaacaaaaggcatgaacaggcatttcacaaaagagctactgcaaagtcacaaacatattaaaagttactcatcctaactaacaatcaaataaatgtaaattagagcaagcaaacttgtttttccatttatgaacttgccaaagatttaaaagtttgataataatgaatgtttgagtatatgaagaactgggtattatttgttgatggacatgtaccatagcatttttctggagcgtaatttcacaatgtgaatcagaagtcttaatagtgcatacgttttgacctagtgaatctcctgctaagactttttatcctaaagaagtcatctgtgccttcttgtcaagatggtactgtaagctcacagtttgtacataccttctgctctaaattcataggaatggcagatataatgcattaaaagaattaaagaaaaaagtcgtagctgggcttacagacaagatagtgttgtagacccgaaagctaactaaacataaagggctagtaagctggattgaagcgatggtgctgcagaggctctggatggagaaacagaaagctagatttagctcccatagagtgctaggactgaaagtttaccacttgaaatgggaccataactaagctcactgcttaaagccaggggcagggatgaagttgtcaatcctataaaaggaaactaaataaaggctccacatggaggctccagtttatatggagctgtgggtcttgaggggcaggaggagatagattcaatttcaagaatagcaactgaatcaggctgactgtgaggagacaataatgagaaaatgtggtgttccatgttacaattatgaggtttggtcctggacagtagcacagggatcctggtggaggcagctgcagaaacactatggagggaaaggtgagcacaggtggagagaaaggggagtaagagaagcaaagaagaaaagcctttcacttagaattagccttcaaaatgcaataccaaaatactggaagaaaataaataccaagaaagatagctaacaaaatcaacaatgagaacaaaaatttatcccagatgagatgaatttttacagaaaagtcagtcaaaaattaaaagaatcatgttcagaatactcaaggggataaataaaggcattacattgatgaaaaatgatgtttaaaaatactcccaagatatgcagaaatggaagaggaacaacgacatgaaaaagaaccagttacaaattttggaaatgaaaaatatggtcatagaaataataaacttaatagaggggatggactttagacctcacacaattaaaaagagaattgatgaattagaagagaatactaaggaattcattcagaatgtatcataaagagacaaaagattttttaaaaggcatttaggagatttgaaggatagatggagttccaacatatgtctaataagagaacacagccttgaacttttggcctcaagtgatcttcctgcctcagcctcctgagtagctgggactacaggcacatgacaccagaccctgctaatacatttgtgtgtgtgtgtgtgtgcgtgcgtgtgtgtgtgtgtagagaccagattctcgcgatgttgcccaggctggtctcaaactcctaggctcaagccatccacctgaggtctcagcctcccacaagtgttgggattacaggcatgagcctctatacctggccaagaagcaaaatgtaaagagccaagaattgagaattttcctatttaaagaatgatgagtttagatatattgagtagtatcatcatgttgacgttgtagaatttaagggatatagaggaaaaaacatttttgagatacaaaacaaaaaaatgccaattacctacgaaagaaagattagcaacaatagatgctagaagacaggagaataatatactaatatattcaaaatgctaaggggaagttatagttaattttgatttttaaacccagttagtctttgattcaaaagtgaaggaaaaatacagatactttcagatataaagaaagaccaagagagttaccatccatggaatctcaccagggaaactgttaaatgctgctctttagcaagaagaaaagtgaaaccagaagtaaggttttgttttttttctttctttctttcttttttttttttttttggagacggagtctcactctgttgtgtaggctggagtgcaatggcgcaatgctgactgcaacctccgcctcccaggttcaagtgattctcctgcctcagcctcccgagtagctgggattacagacatgtgccaccatgcccagctaattttgaatttttagtagagatggggttttgcaatgtcggccaggctaatctggaactcctgacctcaggtgatcggcccgcattggcctcccaaagtgccgggactgtaggagcgagccactgctcctggcctagtttttaattaaaacaagtgaacaaacaaaggtgggcatagagattgataaagtgtattggaaaattcactaagttattggtttaaatactactttttgttctaaaatgaatataaagctaaaactctggagaatgatgagaatgtaagaagggagaagtaaattatgtgtgatccaatattagggacacaaaaagggacatactacatgaattactaatatctaagaaaatatgatacatttgagaacttagatgaagttgatacatacctagaaagataggcattacttaaattgcttcaagaagtagaaaatctgaataaaacaatgaacgaaattgaatgataatgaaaagtccatctgtcaaatgacagcaggcccagttttataggcacgttaaaccaaatttaagtaatccttacttactcttcttccctttttaaagagttttattggggtataattgatatagaataaactgcacatatttaaagttttgacatacgtatatactggttaaaccaccaaaatcaagattaggagacatgttcattatcactcctaatttgtgtccctcagaaatccttttctccttctctcccctagtggttctgggcagctactaatctgctttctgtcactattgactagttggcattttctcgaattttgcataaatggaatcaatcaaacagtatgtgcttttgcactcgctctctctttctctctcccttttaaaaaatagattctggttttttagagtaggtttaggttctggcaaaattgtgagacaggcacagagatttcccatatactccctacctccacacatgctctgttacacacactccactattatcaatatctgccattagagtggtacatctgctacacatcattatcacctaatgtccataagtttaataaaccattagggtttacttttggtggtatatattgttgcttgggacaaatgtatagtgacatgtacttaccactgtgttatagtatcacacaaagcagtttcactgccctaaagattctctgcactgtgtgctcttttttggaggtttagggggaggcctgtcttccgtcactcagcattgtgattttgagatccatcatgttgttgtatgcttcactaattcattcctttttattgctgattggtgagttattatatggatataccataatttctttttctttttttcaatatactgcgatttctttatctgtgcacttgttgatggacatttgggttgtttccagttttgggtaattacaaatgaagctgctgtgaacattcatgtgcagatttttatgtagacatgtgcaatcatgttgtaggtgtttaatatatatatttttatgaaagttccagattgtcttccaaagtagttgaccattttgttttcatgagagcagtgtataagagttctagttttgagagcagattttcttaaatttcatgaagtttatcctttttttcttttatggattttacttctgggttcatttctctgaaatctctgccttgtgtaacttaaatactaaaagagtttcgtatgttttctaatactagttttatagttttaaggttttatattaggttttatattgatgtatttattaattttgagatatttttgtgtatgcacaaggtgtggattggagttctttaaaagatatagatatctaattcttcaagtactatttgttaggactcttctttctccatttgaatctttgtcaaaaatcaatgaaacataaatatctgggtctattgtggacctctattttgttccatttatctgtttgtttagtattatatcaatacagcactgtcttgatttctgtagttttatactaagtcttgaagttaggtagtgaagtccttcaactttattttactttttcaaagatgttttgtcactttaagtctttgcgtttctaagtgaattttagaaatagaatgtcaatttttacaaaaaaaacctgcagggatcttagtttgagattgcatcaatttggggacagtgaaatattttatcgagtcttccagtccactaacatggcatatctctttgtttaatttcggtagtgttttttaaattttctttgtataagtgtggaaaaccttttgtccagtttatctctgagtactttataatttttgttaaggtacatggtatttaaaaaaacttcaatttcagattgttggttgctagcatataaaaataatttttgtatattgatattgcagtgtagctaaacttatttattagctctaatagctgttttgcaaattctgtagaattttctacatagatgcttatgtcgtatttaaataatgacatttttaccttttaaaaatttattctcaatccggatacttttcacttctttttcttgccttgttgcacgggctagaaccttcagtacaatctggcatagagggggtgatgggaaacatccttggcttttttcctcattttagggtaaaatcattcactcttttaccactaggtagggtttcattgattcctttattaagatgaagaaattccgtagtttaccgagtgtgtttatcagggtcattgttgggtattgtctaatgctcttacatctattcaggtgaccctctagtttttctttcttagcctgataatatgatggatttatgtagatttttgaatgttaaaccaacctggcgttctgggggtaacacttggttattatatattgtcctttttatgtgttgttggattcagtctgctaacattttgttaatactttttacatttatatgcatgagggatattggtctgtagttttcttgtaatatttctgcttgcctttgggattgaaagccattaattttctggattaatttatgtagaattattattatttctttcttaaatgctttgtagactttatcagtgaaggctttggatttggagttttgtttgtgggaagtttttgaaatacaaattcaatttcattaatagatataggactatctatgtctactaaaaaggggctatccttttctttttcttttttttctttgagagcaaggcctatgtcttgatcaccattttgttccaagcatatccctggcatatagtgggtcaggagtaaatgtttggtgaatggatgaatgaatgaggcaaactcagggagaggaagtggggactgtgtctgttcttggcccagtgtggggttgtttgtggatgacatctcattctcatcctgtagtagagggataacacaaaagtatggagtctcagggctccagagtcctcatcctctgagctacatctcctacttagccgaggtcttttcactctctgggcaagtctcctcactttgctgaaatggcagcgttcctggtacatgcccggtttagcctaggctaacctcttcttgagtgaacctaggtaatttgtgtctttcaaggaatttgtctattttatctaagttctagaatttattagcataaagtttataacatccccttattatccttttaattggtatgttgaaacttctgtgtgtatttttaaatcattctggctagggattttaaattttcttttctcaaagaactagcttttggcttcatttttttttaacttttctgttttctatttcattgatttctgttgtggtcttttattattttctcctgtgtattgtatttgttcttctttttcgagtttctccaagtggaagctaaggtaattgatttgtgaccatttttcttttttattataggcattcagtgccataaatttccctcagtttactagtttaggtgcatcctacaaattttgaaatttgtattttcatttttgttcaacttaaaatactttctcatttctcgattgttttcttctttgactcatgtattatttaggaatcaattatttagttttcaaatatttggggattttctagatgtatatctgttattattttaagtttaactccattttatcacagaatatattttttatgatttcaatccttataaatgtattgagacccagagatggtctgtcttagcaaatattgtatgtgtatttgaaacaaatgtctattttgctgttgtttggtggagtgctatctacatgtcagttagttcaagctggttgatggtgttgttcaaatctcttatggtgcttttgtctacttgttctaccagttattaagacaaggatattgaaatcttagactattaattatggaattacctatttctttttgttctttcagtttttgctgcatgtttgaagacctgttattaggtgtatatatgtttaagatttttatgttcttgatgatttgactcctttatcattatgaaatgactttttctcttgtaatattttttgttctgaattccattttgtctgatatcaatatagccacttcaactttcttttaattagtattactgggtaaatttttttccaactttttacttctttacaaatctttttttattgcagtagaatgtacataacatataatttatcattttaaccattttaaagtatacacttatgtggcattaaatacaatttcacaatgtcttgtccatccttttactttaaatcaatttgtttctttacatttgaagaatattttttataggcaacctatggttgcatactgcttttaaaaaaatccaatttgacagtttctcccctttaattgggttatttagatcatttacagttattgtgattgtttctatggttggatttaattctaccacttttgtctattctttgatccctttttttcttgatttctgccttttttggatttttttataattccattttatctcttttgttggcttattacttgtaattttttggttttttttttatgttggttttagggtttctggtatccatctttatcgtatcggaatctttcttgaagtattactgtgcttcacatgtagcataaaaatttttaccacaatatacttttcatatctctttggccattgtgatgttgctatcatacattttatttctacatatgttatgaatcccagaatgtactactcttgtttttgctttagtcaattatcttttataaagacttagtgagaagtcttttatatttcccatatagttaccatttctgatactcttcattctcttaagtattcagatttttatctattgtccttttctttccacctgaagatcttccattatcagttcttatcttgaagatctgctggtgttgaattctttctgcttttgtgtgtctgaaaaaatatttatttctcctttattgttgaaatacattatagcatttccccactgtcttctgtcttccggcaaccattttttttttttttacaatgagctatttggtgttattcttttttttctttttttgaaacagagtctgactcagtcacccaggctggagtgcagtggtgtgaactcggctcactgcaacctccacctcccaggttcaagtgattattgtgcctcagcctccccagtagctgggattacaggtgtgcgccaccacacccagctaatttttgtatttttagtatagacgaggtttcgccatgttggccaggctggtcttgaactcctggcctcaagttatccacccgcccacctcggcctcccaaagtgctgggattacaggtgtgagccaccacacgcagtcttatttggttttatttttatagtttttttgggtacatagtaccttcatctcttgctatctgtgggggattggttccaggacccctgcaaatataaaaattcatggattctcaagtcacttatataaaatggcatgtcgcatttgcatataacctatgcacatcttcctatgtactttaaatcatctttagattacttatagtacctaatacaatataaatgctatataaatagttgttatatttcattgtttagggaataatgataagaaaaaagtctgcacatgtttggtatagctgcaaccatccattttttttttcagcaatattttttatctgacattgtttgaatccataaatgggaaacccatatatatggagggccaactgtattttcttttgtctgactgcttttaagactttatctttttcactggatttaagtaattcgattatgttgcgttttagtgttatttcctcttgatttttgtgattgaagtcctttgaacatcttaaatctgtggattgatggttttcatcaaatttggaaaatatttggccacttctttttctgtcttccaatctctctcctttcctttggtaactccaattacatgtattaatctgcttaaaatcatcccatagctcactgatgctctgttaacctttttctcctgtctttttcctctctgtatttcattttggataatttgccttgctgtgtcttcaggttcattattcttttcttctattataactaatttgtgttgaattattattatccagtgtatcttgcctctcagatattgtggatttactctagaagcttgatttaacgttatttctgtttctctacttaccatgctcaatcttttctcaactttttgaacttgtgaactatagctatacttactgtttcagtgtacttgtctactcatttcatcatctgttctgtttttgcaccagtttcaattagttgatttttctcttcattatcagtcatattgtcttgccttgtagtattctcttagaaacttccatgccttgttgcttttgattggatgacaaacattgtaaatttttaacatttaagtgctggattttgtgcttgctgttcctttaagtaactcatttatgttacttggaaacagttgaatcttttcaggtgttgcatttaattagaaaggaacagtgtgacattgagtctagggctatcgcaccactgctgaggtgaagtccttctgagtgttcttcctgatgttttctaaattatgacattttctatccaggctagatttttttgtatgttgtagtgttggctcccattattggaaacagaacaagacttgctaagtattaattaaaaagatctcttttgaaagccttgtggagctaccaaagcagccaggacttgagggtccaagagcagtggctgtaagtattggttttaaaaatttataagtaggattgattttaattaaaaacttttaaaaaaatgttgtgtatgttgtttttcagttaaaaattaaacaattcttaagagagatgatttctcttgcctcagggatggtgtggtgtagtgggtgtggccttgtacctgggaactaagaatgtgagttgtgattctttcataagcagcagtatagtctcttgccagtcacttcatagctctggatgggccttagtttctttatatgttctaaaattatgcaattttgtcatattaaaaagtaggtgatcaccacaacatagttaattgacacattttatatatgtaaacttttatgggaagtttttatacatttctcctgtagatcactgaggctaattaatatctggattcttattaatccagtggcattaatctgtggcctaaagtataatttgatgtggtacacatagattcctgtataagtaatttataactaggaaataaaactgtcctttccagacatgagtaaataacaacaacgaatggttgccaaaatgtattgaggggctgtttatgtgccagacactgttcttagagctttatgtattaatatcatttacatctcacagggagataagaaactagttgcaaatcatgcacctagactggtagaactggcattggaattcaagagtttggctccttaggctatacacacataacaaaggagtttgctttgttatacagacccctgcctcactgtttgaatgctatttgcctaatatctgcatagtttatagtttgcaaaaggcactaatatgtatgaataattttattttatcatcacaactctatgaaacagtgtccttacagatgaggaaattgagaatgagcgagtttgcttccgatgtggtaccgcatcgaggaagtgaaagagtctccattcaaaattctactttcgcctccaaatccagtttacttttactgtgccatattttcatggagagggaagtttttcgtaggacaaggaatgctaaatttgttgaaatggttgaaatactttttttcttcttatctaaagcaaatatggtatatgtgaaatatttacacttttttggtttagctacttcttattgatcttttttttttttttttttgagaaagaaccatgctgtgtcaccatgcagcggtgactcactgcaacctccatctgccaggttcaagcgattctcttgcctcagccaccctagaagctggaattacaggtgtgcgccaccatggccggctaatttttgtatttttggtagagacggggttccctttgatggccaggctggtcttgaactcctggcctcaagtgatccgtcttccttggcctcccatagtgctgggcttacaggtgtgagccaccgcgcctggctcttaatgatctttctagtgttagtttagatatgtcttccttgcccaccaagcaccctgcttaaggactaggtcattttcccacttaaaaccctcataagatcatgcagttattttcacaatgaacattcattagccattattcatcactgtattttgaaaagactcaggtaacaaaattaaatttttactgaacctgacacaataggatgcatagttgaagaagtattatgtggaaaatgataaatggataaagaataagtgtcattagcagcataatcttgacacggctgaagagtcaggagtgggatgaaaaatacacttcatttgtaggtgagatacacccttacatgatgagtcataatccacttaatctttttatgtaattactgtaagactctcaaaccatatctctatgtgacaagatatacaagctcagatacagcttaactttttcacagtaaagcagaggcttagggctggtgtagtttctgatatctaactttaaacccttatgagtttgagttgtggttttttttttttttttttttgagacagagagtcttattctgtcacacaggctggagtgcagtggcgtgatctcggctcactgcaacctctgcctcccaggctcaagtggatcctcctacctcagcctcctgagttgctgggactgcaagtgcacaccaccacgcctggctagtttttgtattttttcgtagagacgggtttttaccattttccccaagctggtctcgaactcctgagctcaggtgatcgtcctgcctccacctcccaaagtgctgggattacaggtgtgagccactgcaactggctgtggtgtgtttcacataggtcttttgtcctcttttactttgctagagctgtggaaatgggtggtagcctgtgtgcaggggtcttcatctgcccctcctgccaggtaggagagctgaggcttcacgctctctctggctctccgtgtggcatttgtgagcagcttgatgtatttgacacaagtgtgacagcaaagaagtgtgtgagcagagcagtgtgctgcagggcccagctgtgtggatttatctgtacatcaggctgaggagcagcagttagccagatctgacagtcaaacgtgagctccttctacctgtgctccagagcgcattttaatgttgtgtgtttttactgtggttggcatttgacacaaagaaaattgtcagagctgtttttttcctctcctctttagtgtgctagtctgcaatagttttccaaataaatacttcattgtacatggacaaaagaaggcactttctaaaacaatgccaaaaatcatgttgtcttcatctttatactgaatttcatgtgaggaattagtaggttagatgtttgaattggtaataggtaagacgtttacatagtgcaaaaatcaaaacaatataaaatggaatattttgagtagtcttggctctgccttgctcctttctagtcatttcccacctctattgacagataatcactttaatagtctgtcatttatcctttgtgtttctgtatgcaaatacaagcagagttttgtgccttgctttttacttcccaatatcttctggagagctttttagttcataaacagagagcgtccttgtttttgtttactgttgctttatacttcatcatgtggatgtcctgtagtttattccactgtcccctgtggctggagatttgcattgtttctaatcttattgttttattgagataataatttccatatcataaaattcaccattttaaagtgtacagttcagtggtttttagtgtgattccaagctttttttctacaagtaatgatgtaatgagtatcctcatgcatatattcttctgaacatggtacaagtgtattagaaggataaatcagaagtaggatcactggctcacatgggaaatgcatttgaattttgaaaggagttgactggttaccctctctaagtatggttttgttttgccctcctgacagcagagaatgaaagggcctgtttctcttagtcttgcccatagtgacctcgcttttcataaagcaatcttaatatttgtttttttataaagcagttaagaatttttaattttgatgtttatgagctaccaatttactattgatatctgattgatttcaccgatgtaagcatgaccaaaacttctctttatgtttgtaaatattgttatttaatacttgatcttgtcagttacttcgtaaaattgcaagtactgagtgttggtgttcagagcagatttttatctgtagggtcttaagctggatgattttctggtccccattctctgctgtcatgtagatacaacagtactcacaggattaaaatgaaaattcctagtggaagatcaattatatgctgcttgctctagagtaggaaaaatcttgtcaaattttatccttttgatacagccttataagttacaatgttttatacctgtctgatgctcagttccgaaatgaactgagaagtggtggttgttacaagaatttagctgaagcattaattataagcagaggttcagcctacattggcacttgtcgacctatgggacaggtctgttgctgtttcatctgatttaggtggagtatgtaattacttttgggaatccatgcttttgtgctcctctttatatgtagattagctttactgatggactctcatgaagagatcttaaggtggtgtttgcaaggtggagacatttcaaggtttgagaaatgtgtgtttgaattattcaaggcttaccttttttggcatttataaatattctggcactttgtgtctataaaaaagactaagaattgataaaatattcataggaaaatggaggcttttctgagcttgaagtaaaaattgaggtatagattttgattaaatttatgatggagtggagaaatgtacaagtatggcatggaaatatcattggttctttctatggcccaaataatagttaatactgaaaaatagataaatcaattaaccaatagtgaattatccaaactggtttgtcgattatctgtaatggtgtgtgttacattagtattataactataaaagtatcataatttaggccaggtatggtagctcacttctgtaatcccagcactttgggaggccaaggcgggcagatcatttgaggccaaggcgggcagatcatttgagcccaggggtttgagaccagcctggggaacatactgaggcctcatctctacaaaaaaagtaaaacaaaactagccaggcatggtggcattgcacctttagtcccagctacttgcgaggctgagttgggagaatcatctgagcccaggaagtcaaggctgcagtgagctgtgattgggccactacacttcagcctgtgggacagaatgaaaccctgtctccaaaaaaaaaaaaaatttctttgtttaactggtaagtcaaccttttcgttgtaaatgagaaaacacctatagtcaaaacaaaggctttgactaaataaatataatagaattatgcctaagagtagaatttggttttgtgtctctcagggtcaattggttgctatacttctattccctttctctttcctcacttttaggtaatgatacaaaaaaggtccagaaagaatttgtgttttacccaaaaggaagtttcctctgactactctgattgtgatgggtttgtgagagaaggctgctatttggggtgggagagggtagtatgcagggctgccacatctggttaagtaggttgtgcactttataaagacattgggcattggagcaggtggagcctgaaatccagtttgtgtttaccaagctatattcttattgagtgggactatatcggcccagagcaaagtgtaccgttatctaatttttataaatgtgacttactggctgacagtagctttggtgatgcatttaattgcatttttatttgaaacccagttgtttctgctgtttttgctttctttcttacagataatgtctgttgtatgtacctgtctatgtgtatatgtgtctgtgagtgtatatgcacatttatgccttttatatgccacgtacacacgaaaactccatatattcttgaatgtaaggtcagatattctttgaaaaatatccctcagaaggacggaggtgccctatatgtatctgatttcttataagatactttataatatgagatcgtctttcagttactttgtttgaatagcacagtactgtttggggaaaacatagtctcttgaaacagcctcagacaatgctggctttgagtgcttaaaaaggctgcttcatggaattggaaaagagaagaaacaaagatgtttaacacagatttattaattattgtagagatgatagatcactctaaaaaagcaataccgtaagtggatatgatctcaaataaatgtttacaagatgaataactcttccacatatgctgacattatgcaaatggatacttgtggcttggtttggtatttccagtgatagtaccataaaaggatttacaagctactatgtctcaagcagattatacagacaggcgtttgctctggaaaactgtgttggatgagttgtaagctgactctagtgatgaaaaagacccggttgtcaacaatacatgtgaagagtgaatcaaattgtctcatgaaatgtgagagtgaataaaattatttctaaatttatgcttcataccgtgtgtaatttagtatatatgtaattgactgggtgccatgactcatgcctgtaatcccagcactgtaggaggccaaggtgggaggattgcttgaggccagaagtttgagaccagcctgggcaacatagcgagaccttgtccctactaaaaataaagacaattatccaagcatggtggcaccgctgtagtcccagctacttgggaggatgagatgggaggatcacttgagcccaggagtttgatgttatagtgagttgtgatcacaccactgtattccagccaaggtgacagagcgagactctgtctctaaaagaaaagaaaaaaaaagatgtatgtaatttaattaatatattttataattgagatttgactaatttctatctctaaaagattataaattcaaagttggctaaaatttgtttgtattctcttattggaaaaataagagagtgtcttactttgggttattgcatattcacttatatgtaattattattttcaaacagaaactgaggcttcttgaagagcttgaagacacttggctcccttatctgacccccaaagatgatgaattctatcagcaggtaaggtattttaatatttttatcagtttcagtgatgtgttctgatcaaccttattttacctatgaggaagctgggctagagaggttaaatgacaggtgaaaaggtcaaattagatcacccatgacttctcatggcctacagagcatgtacatttcttcagaatcggctttttgctgtgaatttaatgctttagcatagtgactgtttttatttcctcggacattccacacttccttgcctctgctcatgctgtttcttctgcctagctcctcctccttccttttgctccttatcctgttgcagatggctaattcttcaagagttcagttaaacatcacctcctttgtgaacattttcccagcttaccctacctacaagtcaagttgattgcactcccggtaaataactctataccacctagcacatggtattgcaattacagaattccgtgtctctgtctctgaattagacaccactgtttcaattacaaatgacaaaaacccaaatcaaactcacagtggcaaaaaataaggggaatttattgacttgccttagaagtctaggagtacatggctaaatccaactttacaaaagatgtcacccgatcactgttttttcctatttttcttggcttagctttcctcagtgtgatctcatgctcaataggctctcatctgagagcatagcaggactctgacagcccaaggggtatgtggcctttggcatctgggatcttagaaaaagttagtgagttctttttccctggttccatcaaattatccaggaagtaatcctgttggcctggttggagtcatgtgcttattactgaactagtcatcatgttcaggagagtcaaatgctcctgtttgcccagcctagttcatgcacctactcttggagtggggttggagtgagagtactcccaccaaactgtatgcactatgtgagttagacatgggtggctctcccaaaggaaaatcagagtcctgtttccaaagaaggaagagtaggccctctgggcatgtaaaaataataaattttcacctcttttttcctactacaatgtgaagtcttgaagcagagggttgccgtgaaaatcagaataggaattaggtcacagcatctttgtatctctagcacctgcatgtacatagctgaccatcagtaaccaaggaaggaagagaggaaggaaggactttacccatctagaatccaggtcaatatgatttctgtgacttctagctcaatattatttctaggccactgtctcttatctccattcccatttgatctgcaccatctttcctcttcactgtcagtcctcttataggtctgtctagttttcctctttgccccccttcatccttgaagctatagtattttctaaccaagatgtaaatctgagcatggcaaccctctgcttcaaatcccacatcattgactggctcctacattttcagcctcatctcccctgctcttacaccttttatccacactggatttttgcagtactttaaatttgctatgagtttcatctttggggccttcttgctacgtcctctgctgacgtacctccttctctttatctgtctcttctttttttttattttttgacagaggatctcactctgtcacccagactggaatgcagtggtgtaatctggattcactgcaacctctgccccctgggcccatgcgattctcccacctcagcctcccaagtagctgagaccactggcatgtgccaccacgcctggctaattttttgtatttttgtagagacagggtttcaccatgctgcccagactggtcttgaactcctgagctcaagcgatccacacaccttgggctcacaaagtgctggggttacaggcatgacccaccatgcccagcctgtctcttgtttccttggtgaacttctgtgttacctgttagtaacagctcatatgtcatctcctgtaggaagcttccctgacacctctacaaccagagagttgtctctgcttcctctcatactttatctatacctttatcagcacttaatctcacttaatttttttttttttttgagatagagtctagctgtgttgtgtgcaggctggagtgcagtggcgcgatctgagctcactgcaccctctgcctcctgggttcaagcaagtgcatctggctaatttttatatttttagtagagacatggtttcaccatgttggccaggctggtctcgaactcctgacctcaagtgatttggcgtcccaaagtgctaggattacaggcatgagccatcacatctggcattaatctcacttaattgtaatgaatttttgtgtgtgctggcttcccttatcctctgtacttcgttcagtgccgggtacctatcaggtgctgaatgagtttgcttcaatgcatgcacccaatagttaatttggaaaaccagttatatataataataatgagtttagtatgatttgaattttgcttctacacacgtacacacttccccagggatttggcatctggaaagatttgacagatgtgtacagaaatgtcatactgcatagtgatagggtgggtgttctcttttgaactttcccagttttccagattatctgcagtgaaggtatattcttttgcaatcagggaaaaaataatttttaaaagtacccttaagacaggtaaacccacaaaaatgcaattagttctgaaatgcttactaaattttcatagctataagccttctggtgcatgattacatgcattgtcacaaagcaactgccaagccatttcagcttttgtcgtgtgaaaatggtacaggaagaatgagatacaaaaggttatcagcccactgtgctctgaaccagccatccactgagggataaaaggaaacccaaatgcaaacagaacaactatcaagacttctctgttatctttccaaggcccgcaacaaaccctgatactaatatctaatcactctaagtgcaccttgctgtttttcttttctttttttttttttgagacagcatctcactctgttgcccaggctggagtgcagtggtgcaatatcagctcactgcaacctctgcctcccagattcaagcgattctcctgcctcagcctcctgagtagctgggattacaggcacctgccaccatgcctgcctaatttttgtaagtttagtagagatggggtttcaccatgttggccaggctggtctcaaactcctgacctcacattatccacctgcctcggcctcccaaagtgctgggattagaggtgtgagccactgcgcctggccaaagtacaccttctaggaaggcttagtacttcaataaaaccttagtaaaagtaaacctcttctcttaaaagatgaagtgaaaatactttttaatgacatgagtaaatagaaagttcagacctgacactgggtcccttaaacaggccctcaccacaggaatgccaatccagctgccagtcataaacacaggagtctgttcagcttccattttgggtctgtcgattgatccttacagtgtgctaggctttgtgctacatgttttatgcatgctctcacatgcaatccccacaacagcctcattcattgtattcagcaactacttttcttcaggcttgaggtacttgaggtaggtatttctgttttagaaatcaagagaggaaccaggcacaactgtaagttccacctacttgggaggctgaggtgggaggatcatttgagcccaggaattggagttcagcctgcctctcataacaagattaaaaaaggaggaaatcaggagagactaagttagttatctgagtgggagagctggagttcagcccatatttgtctgactctgaaggcccatgctctttctgctgtattgtccacctcttggtctaccatgctccaattcaaaacaccttcagagaagttttgcagtttcttttaataggaccgtagagaaaagcaaaaccaaaccaccaagggtcaaagcagaaaagcagagagaacttctgttagctcatcatggaacacaaggaaacgaggaattacatagtcagaaaacaaactctgacttccagaaatatgaatgcagccccttttatccaaagaaaatgagaccatcctcagtaacccccttgctgtcactgattgtgtgctagctgtgtgccaggttgttctgctgctactttaagtgcattacacgtgtgagctcactgaaatcttgctatatgcttctgagacaggtgttactaaaaccctattttagagatgaggaaaccgagggacagagaggttcaaaaatttgtttaagacttatgtgcaggatatgttgggactaggatttaagtctgggctgttggcttttgggtctccactcttaagtcctatactgcttctctcttcccttgtgtctcttcatccttctgagataactctgctcttgtctcaaaggttccagacctctgtccccatcccagctctccctgtgacctccagctctccacttccaactgcctacggagtggctctacctgaaagtcttccagctacatctaactcaacatgattcatattcattaagttacttactccattaaacaaatggatttcactccccgactctgtgccaggtactgttttaggcattagaaatgaagttgtgaaaactgacaagagattcgtgtcttctttgagcttatttcttgtggggcaggtgatgtaggagcaagccatgtagatacttgttggaagaatgttctgggcctacagaacagcaaagcctcaggtatacttgacaggaaaagcacccgaggccaacatacctggagcagagggagacagctggtgagagcaggggagacggtcagagagagagagagagagagagagaggcccggttatacgagaacttatagtctgtaagttctgtaagaagagcattggcggttactctgagatgaggaggcatgagaaggcttggagcaaagcgtgacaggatgtcacttacattttaataaggattctttctacaaggctcttcccattcagcctcttctctaacggtatcccctagtcccattcttgagattagaaagctcaccaccctcaacttctatccattgctttcttccctcatttagtcactgggtccctggtggttttacctctttagaatctctcaaattgttttttctttttccatcccacagacactgcctcaactatgtaggccacattgatcactttctgcctccgcagttttagcatcctcctgattagcgttcctcatgccctccccagtgccatcagaactgacttgtacctccttgttttataaattttgttgagtcgcctttgcttccaagatcaagttcaaattcctcagcatatccaccctataaggccattgactttcttgttttttttttttttttttttttttttttttgagacagagtcccgctctgtcacccagactggaatgtagtggtgcggtcttggctcactgtaacctccgcttcccaggttcaagcgattctcctgcctcagcctcccgaatagctgggactacaggcgcgcgtcaccatgcctggccaatttttgtatttttagtagaaacagggtttcgccttgttggccaggctggtctcaaactcctgacctcaagtgatccgcctgcctcggcctcccaaagtgctgggattacaggtgtgagccactgcacccagctgccattgactttctgaccctaaactacctctctggtgtaatctcatcccatggcctaaaatggcgcccaatcataaactctcgtcatagggagttcttggttccaccctgactctgctgtgccctcttatccttccttgcctttgtgcccactagtactctcttcccttttctgtctggtgagcatctactcttaaagactttacttaaacactacatgttctgtgaaggcttcagaaaatcccttctgttctaaaatgtatgaaaaatctgactgcttctcaccacctctgcttcttacaccgtggccaaaactgccatcatctctgttgcaacagcctcctgactggttctgcctccttcccctggtctagtttaacacagcatccggaatgatctttgaaaacataaatcagctcattacactttcttgctcaaagcccttgaatagcttcccatcagcctaggacctgacatgcacccacaaagctctacatgcttgggttcctaactgcttccctcacctcatttcctgcccctgcccactccccaccccccctcacacttttcttcctattctggcactttactcttcctggaataaaccaagctcactcctgccccaaggcctttgcactgaatgttccctcaacctggaactctctcatccccccaggcatctgcagatattgtatccttgtttcttgctttcttctgctctgatgtcactgtatctagaggccttcccttaccaccctgtggaaagtaggcatacttaccccagcactccctatcctactttctcggctttatttttccccgtagacttatcatcatctaaaataccgtatattttacttatttatatgcttattgtctggctcaccttgctaggacatgagcttctagagagaaaatagacgtttcgctctcttccatattctcagcacccaagtgctttgcaaatagtatgtgctcaatacatatgtattcagtacctaagggttttccagcttttccttcccaattattccctgctcccacagcagtatactcacacttctattgtaggacattcttctcttttggtttccattttggtttatactgttaaattatgagatgctgtcaaataggacctatcttcttttaatccttgtatgtctggcactttatacagtgcctggtacataggaagtatttgagaaatgttaaataaacaaaatgaaatgaagtattgaatgaatgaatgaatgaatgaacgaggatctctgtgtcattttgtagcaaagcacatgttacctcaagtcttgtgatagctgtggcagagtctgaacagtgactccagaagtgtatcccttctggagctctagtttgcatcatgcaggcagagtctgggtcagacgagtgtttagcccgttagtcatcggatggctgccaagtcgcaagcattttacaacaaaaattatatagaaaatgagtgatagggtgcaaattgctgagtgcaaaatagaaagtgttaggagcaaaatctattaacagctagattagaaatacagtcctctaaaatcagaatattctagtacttctaagtgaagggtatttcccaagttacttgaatatttaaattttttttttctctctacccaaggttgagttccactgggcttcatttaagtgagcctctggtaaactggtatcttacttgtttaaaaaccatatctgacttccctgtgtgatgaaatctttcagaagcatctcttgatatgggaggaaaaggtagaatttttatataatggcttaaaatagacagaaaatgaagcctgatctccagagagcttagctttccacatctttcagccattgacaaaggcctggcatgctggcattttatatctaaaatacctttccaaatacttattaaactatataatcatcatttatgccacaggatcatttgtgaatctcaagaaatacagtatgtgaccagacaactgctaatataaatttcatgactgcatactcattggaaaaaactctaatgggattaaatgaaaaaaagcctaacatatttgaaaatctgccaacagctgttccaaattattgtgtgatatctgatgttctacatgtacctgtccaaaatggaaagtgaacttatttgtttgacagaatgaattaatattaaattacttaatgttcacttcttctccaaagttacttgttctttttttttttttttaaagaaaaattgaacaaatgcttcatagtacgtttatgtgtcaggcactaatttaattactctataaacaataaaagagggcatttaggttgagatttttttctcttacattttctttgagatagtgacaaaattagccagttattattatttgttttcactgtggtagactgaaaattcctcagtcttgaacaacagatttaaatagtaccagaagttctcttgaagatttttgaccatttagagccatcagaaagaatctcttggcaaatataagaaatgtcatgaaaattaagaatttttttagtgcagcatcttcactctgatttttctgattaaaaatattttacatttatattgggaaatttgaaaataatatagatgtctaaagaagaaaatcaaaatgatgctcaagtacattactcagggataaccaccataaacttttggctatctttttatccaatttttttttttttttctgtgagcttttacatatgtactgtttttcttttaatgaaactgagatctcttgtctatcttgttactaatttcttctatgagtatagtttcctactgacttccaaacagttaagtttgttactttaatattccatcacgtggttgtaccattttcccttctaaacccttcttgggcattttggtggttttcagtttttaattattatcaatagcagtatgatgaatattcttataatcttggtgtgtttaataacttccttatgacaaattcctaaaagtagaataactgcatgaaaagatatgggcatatttaggttctgatagatcttgtccaattggccttaagcaacattgtaataatttgcattcctaattgcacgctatcagaatattgaattttgccattatcaacaatatgtattactattataaaatgttttaatgcaaatttgatagacagtaactaatttaagtataatacaaattatatattttccaactttgatacagttaatatttatttatttatctatctttgaaatggggtctcactctgtggcccaggcttaggctcacttcagcttccacttcctgggctcaagccatccttccacctcagctgcccaagtagctgggaccacaggtgcatgccaccacacctggctaatttttttgtattgttagtagagaggggatttcaccttgttgcccaggctagtctcgagctcgtcagctcaagcaatacacccgcctgagtctcccaaagtgctgggattacaggtgtgagccaccacgcccaggcagttaatttttttatgtgctaagaggcttctctattaatttgcttgtgaatgggtgtgtgtgtgtgtatttaaatttttaatggttctgcattaatgtttctgcattcctgccatataggttgtactttttttttccagtttgtttgccttttaattttatgatttattttatacaaaaatttaaattttcagatattcacatctatcaatcttctttttcaaaaagtttattgattaactgtatatgtgtataatttacataccataaaatgcacgttttgaaattgtacaattcagtgatttttggtaaatttccagaggcatacaaccatcatcacagtagttttagaacatttttagcaccccaaaaagatctctcatgcctctttacatttagttttctttcctgccccagccaagatctccactcatctgcttcagtcttttaaagcttttattcttagaaaggagtcttgagcacttatgtggaaccaagtgatgtggctataacagatactaatgctattttcttcttcttctttttttttttttttgagatggagtcttgctctgtcacccaggctggagtgcagtggtgtgatctcggctcactgtaacctctacctcccgggttcaggtgattctcctgcttcagcctcctgagtagctgggattacagatgcccgccaccacgcccagctagtttttgtatttttagtagaaacagggttttaccttgttggccaggttggtctcgagctcctgacatcagatgatccagctgcctcggcctcccaaagtgctgggattacaggtgtaagccaccgctccaggccactagtactatcttcttttaggagcttgtgatcttacaggacagattattaaactaataatagtttaaataaatatagttacaaatagataagtgctacaaaagagaagtaaagcgtggggagtgataacagagggcacctatttgagggtggagattcaggaaaggtttcctttttttttttattatactttaagttttagggtacatgtgcacattgtgcaggttagttacatatgtatacatgtgccatgctggtgcgctgcacccactaactcatcatctagctttaggtatatctcctgatgctatccctccccctccccccaccccacaacagtccccagagtgtaatattccccttcctgtgtccatgtgatctcattgttcaattcccacctatgagtgagaatatgcggtgtttggttttttgttcttgcgatagtttactgagaatgatgatttccagtttcatccatgtccaggaaaggtttctataagaaaatgacccagggatgggaaggaccatccaggtgtggagttgggggaggagcctgggggaagtatttaagagctggacacttgaggactgcaggaatagaagcacatatggtcagagagaaaggggacatgatctgagtgggaaaaaaatggaatattttcccatgccattattttctttttatgctgttttttatgtcaaggtatttacagatgatatttatgtggttatatgtttttcctggtctatagggttataatttccccatattaaatatatcttatgcagtgttgagacccagtgtatgttgaataagggcagcagaattttaatggggggtgggcaggcgtttgtgcatatgagtgcattattttcagtattcctttcttagtcccagaggggagtgtgttcagaaacagagttcttgggaattaccatacttttctttattgttttatactaaggaccattcagagagtactggaggtgttaagacagtgtgaagaaattaccttcttcatcacttcttcatcattgctttgagtatactggggcctcagggacttgctaagaaagtaaccagtatagtgatagaattagagttgctgctcatggcttcagaatatttggtctctgcttacaggattgcattgctttcttcataagctatgtaaatagaaagtacgatatcactgtttctgttttccaatggggataactaaaatatggaaactcaatccttaatggatccctgacaatctcaatgacaatccatagtggtatgccacatgactcttctctttgtcactttcaattcatggtcaacacctcagataggcattttgagaagcagggcagtcctaccacacttacctagtaaagtcattttttcacattcagacttgactcattcatttttcttctgcatacttcctcccactttctgcatgtcttctataatatctcctgcactctgcctcattcagaacaggctagattatgctatagtaactgataactctcaaatctcagtggctccacacaataatatttcttgtccattttatgtatcatttgtgggttggcacagagtcactacccattaaagtagctcagagatccaagcagccaccagctggttgctgtggcagaggggtgcagagtatgctggagggtcttgcagtgacaatgacatgttccaggctggaagggatggccatcatttttcactggacagaagtaatcccatgtttcatccatcctgaggggaccaggaagtgtaattttacactgggcccaaaaagctgggtggcagaggaggaatccagaactatttggcaaacagctctaatgaccagcatacattcttagctagtgattcaccttaacttcattgagaaagtcagagcattctctaactaccacccctccaaaagaaaccctagaacgtactcatctgcctactattattacatttatcatcctatctgaattcataccttctttttccttctagcctattccaatataagaagtatcttctctcctatccacatatttttgatcacatactcttatcagtagataagcacatacagtgacatcctagaaagtgtttaacaagtggcctgtagggggaaagaaccagccttgatttttagtgttttttgatttccgcagtgtaaatactctcactgtggacagtttcaagccaccgtcacggtgttactgaatgtgcagttggaaagagatgcacacagtgggctctcatgagccagtgtggactgactccagcacaccaccagtagtgtgctggtggtagtactcatgtactcgtgtctgttttataataatattcatattaaacctatttgtgtgtatatgtgtgtgtgtatatatatatatgcatacatattttaataatgcttgagttctttcattttatattaaaaataaagcagttctacctctcccctgtgccccaccactcttccagatggccttacaaagccttgcatacctgacttgggggctactgctctagacactcaaggtctcgacttctttggttattcactctctctgcatcgtcagcctctttctcttgtatcattctcatgagtgtactgagaaactctggtgttctctagcgtcttccatcattagagattgtcccttagtctagccttcttctttatcaaaagctccatttttctactccccttcatagcagaaccattcagagacatctctacatgccatctcacttcctcctctttcattccatcttcgcctactccaatctgactttcacccccagcactctactgagattgctcgtgtcattgccatcagtgattttcatgctgccaaatctactggatcatctgtcttcatctcacttggcctctcagtgtcaggtgacatagttgagtaccccgcccttctagaaatgctctcctcttttagcttctgcaataatacactctgctggttctcctttgttgaggcttctgctgcgactcaggaaatagctttggtctccttttgatatttgtactgtttccctaggtgatctcattcatttctaggcctttaaaaccaagctgtgtgctgatcactcccacattgcgttcctctgccctgctttctcttctgagctccagatgtgtacatccaattcccctccccccgcccaccatattttcacctggaggtttcataggtatcttcaaggctgcagctctacagtgaactcttcatttcccccttttcttctttctactatttctcttttgcctcagttttccttatttcacagaatagtaaattgtttatttagttgttaaatccagaaatctggaatgtattcttaacttctatcctgagcaacagggagaaaccccgtctctactaaaaatacaaaattagccaggtgtggtggcgcatgcctgtaatctcagctactcgggcggctgaggcaggagaatcacttgaacccaggagtggaggttgcagtgagccaagatcatgccattgcactctagcctgggcaacaagagcgaaacgccatctcaaaaaaacccaaaaaaccccaaaagacttatatctttttttatcccttacatctaattcataagcacatcctttagttctacctacaacgtatgtatttcatctgtccacttatctttgtctctattttagtccagaccatcacttttcttccagatgattgtaatagcacattccacgctcacatgtgcctctttccaatctgtgcctgatattataactaagagcgattgtataagatgtaaatcaagttatttttctcccttctacatcctccagtgcatctagagttagcttcagattccttaccacgacctctagggctatgtgtgatctggcctccgccttcctctgcctcctcgtagcatgccactctgtctttggctcttgtgctctagtaaaacaagcctttttttgtccctagaataggttggtctttttcctgagtgcctttggcttctctggtctgtctttctgggaagcactttctctggcttgtcatatttctggtgccttcttttcctgaagatctcagcttaaatcccgtctccttagagaattcttcctgttctaataagatttcctgctggtttgtttctgtcttagtacttaacacaatttggggttgcttttctttatttatttacttgatttggtagaaagctttgtgagaacagggaccttgtttccatctggtggtaggtgctcaataaacagatgctgcatgaaaaaaaaaacgtttggaagaatactggtcttgccctgcctatcatgtgaatggtaattactaaatgaagacagagaaggaaggtatcttaacaatggtgggcaacacaatacagggaggacaggttaatgtgttgatcatgtctgactctttctttaagacagcctaaaactagggaggaacaaatcagatcaaacgttacagaggtaaatgtaaaatcctgtgatttggttacaaataaatcagttgcattttacagaatcaggaaactccagtctgacaccgattcacatgccaagtcctaaggaaagtggtagccgaaaagctaatgcagccctaacctacattaatcattccatgtatttctgtattagggaagggaattgaccaatattactctcctccagtgacaccagtagaattattagaattttgtagaattacaatgtaataatacctcattcatccatgcacaaatccatttattcattcctttaccatttactgagtaaattctgggcactcatattatagtcatgagcaaaattgccatggcttttgtgttcatggaacttaatgtctaactcctgaagagaagtgagttctctttttgtgaaagtgttaagcagaaaccagtttgtcatttattgagacaatgcattctcatggttaagaactcgtgccctggaagccaggggttggtgtccaggggctttaaattccagctccagtatttgccagctgtgtgactttgggcaaattaatgtctttggtcagattaatgtctctgtgtttcagtggtctcatctataaactggagataataatactatgcctagagttaaaatgagctaatgcacacaagtaacttacaacagtacctggtacgtagtaagcacttaataaatattttagataataagcagttaataaaatggtgttgagatttagggtgagaaaaagtggtcacagaataatcctggtgtatcaggacacacattattattttttgttttttattaaagattgttagtaatttgagcttgaacttgaaaatcttgactttagagtttgatgacatttgttttatttggttttctgttttgggctaggaagatgtgactcctatttagaaatagccaccaggtagtccccccacaactccccaaatgcttacaaagaaacacacctttggaaataatacaattgtagctatatatcaacgtctgtttttgctttggttttgttttagtggcagctgaaatatcctaaactaattctccgagaagccagcagtgtatctgaggagctccataaagaggttcaagaagcctttctcacactgcacaagcatggctgcttatttcgggacctggttaggatccaaggcaaagatctgctcactccggtatctcgcatcctcattggtaatccaggctgcacctacaagtacctgaacaccaggctctttacggtcccctggccagtgaaagggtctaatataaaacacaccgaggctgaaatagccgctgcttgtgagaccttcctcaagctcaatgactacctgcagatagaaaccatccaggctttggaagaacttgctgccaaagagaaggctaatgaggatgctgtgccattgtgtatgtctgcagatttccccagggttgggatgggttcatcctacaacggacaagatgaagtggacattaagagcagagcagcatacaacgtaactttgctgaatttcatggatcctcagaaaatgccatacctgaaagaggaaccttattttggcatggggaaaatggcagtgagctggcatcatgatgaaaatctggtggacaggtcagcggtggcagtgtacagttatagctgtgaaggtacagtctgctcttggaaaaagcagccctgtatgtaataatatgacccgagttgtttaggctctggagatacacacgcatatacatgaacatgtttgcatgtgtgcttgcgtgtgtacatgcacatgcgtgtgtgtgtatcatgtgtcctttttagtcttgtcacacctgtatgtctgcagaatatgcctctttctcatctggccatgctagctggctcattgttatactgtactcagaatattttcgcacgtaagcactgctgtcatttgtctctcttgtgcccaggagagcagcctcttggtttcatacagccgactgtcttctctacagctcagaggagattgtacagttgctataattaacttgctgataaagagctgggaaaacaaaaatctgtcaaatctttccaggttcccacaggtgcacatttccagacctgccaaaatattttattatggttgacatcactatcttgatgggtgtgatttgtcaaatatggacttgttcttggcttcctatagtttgtaactactgtccttccttgccagaagcagttgaggtaggttttgtaagcagacagtcctctattttcaggaaactccctagctctttacccaattctgcagttttagaccttgttgggtggctgtggtagacttgttcttgcattttctgatgtataatccccttgaaacagatcgtaggctacctcttagtagcccacccacatttctcttcttctattattgtttctgtgtgtttatggccctcatttttccttagaatagaattacaaaaatggtagttgaacagatggaggagagcatgacctctgttgactttcttttgtgtctgattatttggcaaagggatacaagacatagtattagctctcctgtctgatttactgaaagatgtttggaaaaccagaattctggatatcccatcagggaatgactggaactttccagggtcattattttctgacaactctagttatttgattggatttttgtttgttgttgttatttgtttactaaaattactgttttggaaaagagatttaagaaaaaaaagatctttaaagtactctttaaatttcttacaatttcccagtctcaaaaatttcctcagaactactaatattttttctaactttatcttatgtcttcagtctgaaacaaggaactagtttagcatttggaaatttcaccactttctctggcatctcaaataatgatgctgacctaagaaaatcgcttgaagggatttaacgctgtcctaatggaaagaacggagatcctctgatctttaataaggacttgccagggatttaagaactatcacatccaagaactctgatgtgaacgaacaatggagttagtttctttcttaaggagacaactctccaaacctgaagcagtggtatgtgatagtacaaagctctacaaagatgtctttgtgctcccaattactctgagccctccagtttaatagtcctattgtactcccttcccgtgggtgatcaagtagtttttgaaacctagaatatctttcagaaaggaatttaaatgtctaatgaatagtttctatgctcaggagtaattaagactgacaaagtatacaaatataaattacatataaatatagaaatgttggtacttaaagagggaactgtagaatttgaatctgtaagagcggtgtgcaaactcctttgttctcttttttttctttttttcttttgagacggggtctcgctctgtcgcccaggctggagtgcagtggtgcgatctccactcactgcaagctccgcctcccaggttcacgccattcttctgcctcagcctcccaagtagctggggctacaggcgcccgccaccacgcccggctaattttttgtatttttagtagagacggggtttcaccgtggtctcaatcttctgatctcatgatccgcccacctcggcctcccaaagtgctgggattacaggcttgagccaccatgcccggcctcctttgttctcttaactgcagaaattctcagaactccatctaataataatagcaatactgggaatgctcatttattgagcacctactacgtgctacatgctgttataagcattttacatgcattaactcattttgtcttcccaacaattcaaagaacaaaatagtaatgaagtactattgctatcctcattttacagatgaggaaactgagtcacagaaggttgattaacttgttcatggtgatgcagcaagtaattagcagagttaggatttgaggacaaatatccaggcttcagaatcttaacacctaaggctatgtgcattatgagcaggtatttcttatcccagcagtgtagccgtctcagggattttattttattattttacttttttaattttttgagacagagtgttgctctatctcccaggccggagtgcagtggcacgatctcggctcactgcaacctccgcctcctgggttcaagtgattctcctgcctcagcttcccgagtagctgggattacaggcatgcaccactactcccagctaattttttataattttagtagagacggggtttcaccatgctagccaggctggtctcaaactcctgacctcgtgatctgcatgccttggtctcccaaagtgctgagattacaggtgtgagccactgcgcctggccagggacttggatttttaaaatgtccaccttctggaaaggttaaggggacattccacttgctttttctttcaggtcctggtgtcttcctttctccagctttacttctcacccacatctgctgtagctttccagcacatactctcagatgattggaatgcatcagattatcttattcgatgaaacagaacctttctgtaggtgtctggctgtgtgtcagacggcatacaaagcatgtggctctgggtcagatggtgtacaaagcatgtgccttgaaactctatggtgggcgcatgtcttctaagtgacaagtgatatctgtttagttttctggtcttataatccttggcagaatgccagaactatggcaaaggtggacttgaagagaatcatttggtttaaaattttggttgaggttgagaagggcttaaggaggtcatagagagtggacacttcagagaattgtatttttttctgtgtccttgaacttgtttgtcaatgagctgttctagacagtatgggaactccaaagataaatcaatggctttctcactttgaggtaatagggaggtaataggtgggctctcgtgattataattatgaaatgatgaaacattgggtttgaaagagacttttgaaatcacttgattctagcctttcattttacaaatgaaaacaccgagaagggaagtggcttggccaaggtcacattgctacttagtgataagagcagggatttaagttggaaagtgttccttgccactggagaggttcacgtaaaatgcactgggaattcagatacagaagtgattgcttcctgctgaaattaaattcagttgaagcttaagatctttcaagactctgctctcaataccttttcccagggaaatcttcttgtagatttataatgagccagtcatccctctttggtttattttcatgagtagaggtcattgagaagtaatttgtataggatacgtgtaattatatactaaattcattggctttcacatgccgttctagttaatagatatctccagtaggaagattgaaatggtacaatttttaatcaggaatggcttcggggaaccatatgtaaataggcagaatatttgattttcctattccagctttgctggcaattgcttgttactcctagctataaaaaacgaactttagcggggaaggcattaaaaacccaatgtttaatatggtccagcaccttgttctttgactggaacaccttcagaaacatcacttagatcaacagtaactattggctaccatttttgtttctttgtctggaaggaaacattttctgtgaaattgtctttctagaaagaaaagcaattcttaagattttaaactagtgccaagtattgcatattcttgacattattttccagacctcccacaaggagccaggaaggcagctgggcgcggaggctcacaactgtaatcccagcactttgggagaccaaggcaggtggatcacaaggtcaggagttcaagaccagcctggccaacatggtgaaaccttgtctcttagaaatagaaaaataagctgggcatggtggtgcgcacctgtagtcccagctactcgggaggctgaggcagtagaattgcttgaacctgggaggcagaggttgcagtgagctgagattgcgccactgtactccagcccgggcgacagagtgagattccgtctcaaaacaaacaaagaaacaaacaaaaatccaaaacccaggaaggctcacaaaaggaagaaaccgatccatgtttcctgttgagcatgtgataggctggaaagtagagactttgcaataatgttcttggaattctaggatttccattcatgtctttgatttgggaaaaattgcatccccttaaggatggaaatttgttcccgtaattcttgaatctctattttaacatgacttgctctatatttctcagctcatcactgagaccatgaaaagctagtttataattacagcttggagttttggagtattcataaaaacgctgtgatgtttaatgttatcttagcgtcccagcatccctgtctaaaatctcaaagcttatttgacctagcttttttttattgtatcatgctatgccttgtcagtgatttttgaaatcacttatactgctcagtaaaacttgtttggtcttataagtcacatttttgggggtgaccatccagttatttattcatctaacaataaggtctcccatgaagagccaagaaggctcacaagaagaccaaagggggggaaaaaacttatttgatctacaaagttacatttttttcatgcctatgcaattattttttcatttaacaataagcatctactatttgctagtcagttgtctagatgctgagcatgtatcagtgaacaaaacagacaaaaatccctgccctcatcaagctcacattctagcaagggaaaacagaaaataaaagtagattgtgtaacaagggtgagggataatcttacaattttaggtaggagagccaggcaaggccttgttaaaggggtaacatttaagcagattggacggagagaatgagccactgagaaatttgaagcgggagcacataggcgggaagatagaacatgattgggatgtttcagaagcaacaagtgtggatggaatagagtgagagaagaggaaatgaaatgaagacaaagggacaagtaaatgggtggcagaaggtagggctttgtcatgttagaatacaaagtagtaggtttggatttggagtgagatggggagccactgaggagtagaagaagggaagcaacaccagaaacaggagagctcacagaggtgaccaaagtaatccagactagggatatgatggtccagatcagaagaggcagagcaggggagaaatgtgtaaatacagtcctgtaactttttaccaacaaagagagtggcagtgtttcagcaccagtgagaaaggataaccagcagtggcatctcccatttgtcaagagaaggctaagcctgtaagaatggctacattttctcccctctgtgaatggctttattcgggaataactgacatacaataagctatacatattgaacatttatagttttataagtttcaacacacctgtgaaactatccccactatcaagataatgaacatacccattattccagaagtttccttgtgcccctttgcaattcctcttcctgacatatctgttttctttttttattgttttttatttgtttgtagagactgggtctcaatatgtttcccaggctgatcttgaaatcctggcctgaagagatcctccttgctcagcctcccaaagagctggaattacaggtgtgagccactgtgtcagcctggatttgttttctgtcactagatgagttggcattttctagaattttaaccagatggaattatatatgtgcacggtttttttgtctggattctttaacttagcatagttattttgagattcatccatgttgttatgtatatcagtagctcattcccttgtatccttttttatttcaataaaatatacataaaattaatcattataaccatattaactgtacagttgagtggcattaagcatcatcccacaccaaatctctgtacccatttaaacaattactccccatttctccttccctcatttcctggtaaccactgttctgctttctgtctgtattatatttgactattctaggtacctcatgtaagtggaatcatacaatatttgaccttttgtgtctagattattgatatggttcagctgtgtccctgggcaaatatcaacttgaattgtatctcccagaattcgcacatgttgtgggagggaccaaagaggaactggttgaatcatgaggccggtctttcccgtgctattctcatgatagtgaataagtctcacgagatctggtgggttcatcaggggtttccgcttttgcttcctcctcattttctcttgccactgccatgtaagaagtgccttttgcctcctgccatgattcagaggcctctcagctatgtggtactgtaagtccaattaatcctctttttgtttccggtttcggatatgtctttatgagcagcatgaaaacaaactaatacaactattttacttaacatagtgtcctcaagattcatccatgttatggcatgtatcagaatttaattcctttttaaagatgactaatattccattgtatgaatataccacattttgttgattgattcatccatcggctattcataatagccatcttttggctatggtggataaagttgctgtgaacaaatatctctgtatacaaatatctgtgggaatctccgctttcagtacttttgtgtgtatactttttttgtgtatatacttttgtgtatgtacttttgcgtaggattgctggatcaaatgataggtctatgttgacatttttgaggaactgctgtactgttttctacagcgactgaactgttttatattctcgctggcaatgcgcaagggctctaatttctccacatctacgccaacacttactgtttcctgttttttgataacagccatcataatgggtatgaagtggtatctccttgtggttttgatacacattttcctaataattaatgatgttgaacatcttttcatgttcttagccatttatatatcttctttggagacatgtctattcaagttgtttgcccatttttgaatttggctggtttttagttgttgagttttgtgagttccttatgtattctagatattaattccttatcagatatatgacttgcaatattttcttcaaggatagctgaactttttttttttattttttttgagacggagtctcggtctgtcacccaggctggagtgcagtggcgcgatctcagctccctgcaagctccacctcccaggttcacgccattctcctgtctcagccccctgagtagctgggactacaggcgcccaccaccacacccggcaaattttttgtatttttagtagaggtggagttttaccatgttagccaggatggtcttgatctcctgaccttgtgatccacctgtctcggcctcccaaagtgctgggattataggcgtgagccaccgcgcccggcctgaacttttgatgatatattaatgtgatgagcacgggatcagagaacagtggaatagactttactgtccatgacattgatgaggcacttaaattctatactactgaatgacatcattcatattggtattaattagctatgggaccttaagcaagttacttaaattctttgtgactcagttttctcatctgtaaaatagtgatcagagctgtatccacctcaagattgtgagaattaaacacttgtaaagtgccaagaacataacagcagtaattagcacatagtaagcattcaatactgtgttatttttagtttttatcaaaattattcattcatatcatttttacaagtcaaatatttttataaggtttgctaaggaaaaaaaagcaggagtttttacaccttttcttcccattttcatttccacaggcaatcatttctactcttttctttcaggtaatgcttttggtagttgataacatacttacattgttttgaacattatatattggcttcctgatatggaaggtgaagatttacctagctctcttctttctccctgcctgcctacacatgtacacgcttctgattcccattatagatttactgtaattttgattatatcactattcagcctttatagttatcatatatatacatgagaatgccttccaaaacctgtgatctgttatccttttcttttcaacttttttcttgcattaatggtagtcttgctttttgtgtatttgtatagttttctatgtagttatgactaattaaatcccttgctatctaccacatctcctcttaagagcttcagaaccatcagatattctgtccatttcattttcttggagcactgtcttccagagtcttcttgtctgctccaatctggtgttctatgcctgatgcatggggatccctttctgtgacctcttcattgtaatccagcggattcctttacttctctcttttgtgaactcctcacgttcctgcatcctggccttgctctttcctgactgttttcttattttggtggagcatgtcctacaatgttttcttcagaaagatgcttaggaggtaaatttttaagaccttaaatgtcttcaatcatctttattccaccttggtatatgtaggttcttccagtatgaaaaccttgttaggaaataatattttttttcagaatcgtagtgacattgcattactgtcttttatcttacagtgttcattttaagagttctgaatttttcttcagcttttatgtcgctttttttgttggatctttttttgaatgttttacaatttcacagtgatatttttcactcattttactgtcattgtgtagggctttcaatcatgcccttcagttgttggacattttcttgaattgctttgttagttatttcttcctctccagttttctcatctctttggaatccatatgatttagttaaccttctggactcttcctctagttttcttgtttattcccttattttcaatctttatgtttgttttttagtctaatatctgggagattttattaacttccaacctgtctattgattttttttttttttttgagatggagttttgctcttgtcacccaggctggtgtgcaatggcacaatctcagttcactgcaacctctgcctcccaggttcaagtgattcttctgccacagcctcctgagtagctgggattacaggcgcgggccaccatgcccagcaaatttttgtatttttagtagagacaaggtttcaccatattggccaggctggtctcgaattcctgacttcaggtgatctgcccgcctcagcttcccaaagtgctgagattacaggcatgagccactgcgcctggcctgtctgttgaattttcagtattgaaatatgacatatatcataaacatacagcttgaagaattgctgtaaacatatctgtgtacctagcaccctggtcaagaaatgaaacatatcagcgtcctagaagtgctcccttccagtgtctgcttccccacaacagtaaacactctcctgacttctaaggccataaatagttttatgtgtgtttgaattagacttgtaaacttgtaagctcctaaaagaagtaatttgtgtcttcatccttctttgtatccgtatatagtggcaaatgagtattttttgccccaaatctgttaagtatttgttgttcttgaggagcttgtactattcagttacattgtggccactgttcagtaactctttgatttctgcaactgcagtctctgtttagtaataggattcttttgatagcaaataataattccagacccaaagaggcttaatttaaaaaggtaaggaattctctcacttcatcctaagaactggcgtctcactggcttcaagtggaccttgttccaacagtaatgatgtgatcagtttcaaatttcttccccttcctcttttggccattctaaagctcatggcccccaaatgactgcccccagcttttgtggccactctctctttctttttcctgagctttggggaggagagaaactgggtattgggtgtgtactttgaactctggatcaagctttacctgaagctagatgaacaaataatgaccctcttttgattaacccagttcggttctggtttctgtgttatttacaacgtaagggtttcctgtgagtctccacaactctctttataccttcctgaggttacccaaggaattgaaacctctactgttagaagctctggtttggagaatattgtttgagaagtatctctgcttccttacctgatttcatattttacttcagataatatagtgattttgaagctttagctaatggcccgcatagcagtttttctctccttttcatactttcaatttttctcccaagtccgtgaaacatgatgtaatgaggttctcctctgtaatgtaaatatttttatcttaaattttttccccaaatgcttaatctgaaagctgacagagccagacatgatgttgaagggctttagatttttctgtaaagagttttcaatatttcacctgaaatcctagaaaacttataattaattttacaatttatctgtgtcaagggactatgtttgtcttgaattgcttgtttcgaggcatctgagagcggcttcttgttatagattctgagctgggaatgattagtttgtttttttttctcaccccttcagacttttctaaattctccattttttcagaccattcattgctccgtggctgagaaggagtatgtgctgtgtcagcagcaagcttttcttgcaacccgtcaaggaaagcatttctaaactctagaactctggcagggaggcttctccttggctaatctttctttcctagtgatgtagtccatcagctgtgtttcctaaatgctctctggcttatacagtacccatttgttgctacgctgggaacgtgtctagaaaaagtgtagtaattatgcacgaagaagctggtaccttctagagagatcattctgaaaacagatctgactggtgaaaaaggctttagtgtctgtcagtagtctcagtgtaagttctagattctttcctatggttcataaacccatgtcctggtctccacccacctctccaggctcttctcttgcaagtccatgccattcatgtgacactattgcagctgggaattgattgtgctcttatacacacaccatgccatttccctcctagaatgtgccttccctatgtcacactttccccttttgccttctgtctcctttcgttctacaaaatggatttcccatcccagacatgggaatgtcgaagatcagcactggacagatgaggcatcattagactccatggtaccagctggccatctacaacttgtgagtttctcctgcctcaagatctgtgacatggatagcaagggaccagccttttaaagctcctccaggtgtggagttaaggaaacagaggaagtaatcacaagggtgggaatcttcttttttgagatggagtcttgctctgtcacccaggctagagtgcagtggcactatcttggcttactgcaacctctgcctcccaggttcaagtgattctcctgcctcagccttctgagtagctgggattacaggcatgtgccaccacacccggctaatttttgtatttttagtagagacgggatttcaccatgttggccaggctggtcttgaactcctgacttcaagtggtctgcctgcctcagcctcccaaagtgctgggattacaagtgtgaaccaccacaccaagctgagaatcttttgtatcttagctcttggctaaggaaatagaaagtagagaataagaaatagggctgtttttaacaaaaaattagccacgtgtggtggcacatgcctgtaatccccaccactcaggaggctgagacaggagaatcacttggacctgggaggtggaggttgcagtgagccaagatcacgacactgcactccagcctgggcaacagagcgagactctagtctcaaaaagaaagaaagagggctatttaaatgtatggtgatgatgaatatgtactgaacctgtgagggaagttcttgacatacactattatgtatgttattaaatatggtacaaaattttttgtgatatattttatttgagtatcactgtaatctctactgtcatactctggcttctgtctttgtttcctgtagagccgtggttataattagaaatgtaaacaaagtattttgtgctttattaaatagaattttttctcaaaaactagctggcataaaacattgaatgggttaattttggggggaagttttggacaatttaaacttgacttttaaacttaacagtcttttgtatgttgtcacatcttctacttatttaacagtttggttagtgggagctgggagctgggagtgcaccaaacacactgaggtacttaaaatcttttcaattttattgaggcttaaaggcaagtaagaacctgttgcctctgcttgttgccaaaataacatggggcaagagtaatcagttacagttgctataggtaattacaagttgatttcactgagaagtaagaacactatatttaacaataaaaagtttatcagacgtgaaactttcctcctccctacacagcctaaggaggggaaaaactctcaccaaactatcattttactgagcagatttcaaaggtgttggatttttgggagacatcgagaaagactaattgcaattattgtctctaattgtctttattgatgccagcttgagaagagtaccaggatgaaagttagaagggaaagtagtcaagcagactgttaccctatgaagattcccacttattagactgtccacacgcagtggcattaaaacttcataaaaactgttccttacagtttgaaaattatttttttcaagtcattataattggttttctttttttttatttatttatttatttatttatttatttatttatttatttattttaaggtgcagtgtcactatgtcaccaggctggagtgcagtggcgcgatctcggctcactgcaacctctgcctcctggattcaagcgattctcctgcctcagcctcctgagtagctgggattacaggcacgcaccaccacacccagctaatttttgcatttttagtagagatggggtttcaccatgttggccaggatggtctcaatctcctgacctcgtgatccacccacctcagcctcccaatgtgctgggattacaggtgtgagccaccacacctgggcctttttatttctttttaattttgtgtggacttcaatggtagaagttatagttgatttgaccagaaagggacatgtgaaaaaccttcctaaaatatttcctttttttttcttgtgctgtttgctctatctgtaatcattagtgcccccctagaatgaagcagccaagtcttgggttatcacaaatataaacataatttttatatcatattcttttgctaaggtgatctggatatcaattaatttagcattaattattatactgtatgctgtcattagtcatgttacattattaggtattagtcacattacatcataattattttatgcagcctcaacttctttactaaaatgtgcagtagacatcagatcacaaatatcaagactttcgaacaggtgttggcaaattttttttgtaaagggccagaaacaagtacttttggctttgtgggttttatagtctgtgtcttatctactcaaccttgctgtctgtgtgaaagcagccatttatgtaaatgaatgggcatgactgtgttctagttaaactttattttgcaaaagcaggtcacgggactgatttgcctgtgatctctgcaacccagctcttgagtaagggtcacagactttgctgtggttaggcaggtacctcaaatgagtaaagtgaagtggctgtggggactgcgactagcaaaggtcacgtccttgtctaaaatgggcagctacttcttccctatagccactgtgactggctcagtgataccagatcttgtaattcaagggtagctgggaatttggatttttaggcaaagtccttttatcagttggcaactcatttagatttgttaaggaaatatggttgaggtcaagctacacaccttcgtgagttcttttctggtccatgaactccagtttagcaaattctggtattttcaagtgtaacagtatattatgtatgaataagaagtgcctgtagaatgtcatcagacatcgatagcaactatctaatgctggtgctgccactcactaacccttgtagtgcccatgacagacatcagtaattgatcataacactctttcctgctgagctaggagaaagtttcagatttcttctccactagggctctaaaaagccgcaaccagccaatcagtcatgtcccctgatataaaggtatttatcattctcattctagaaggtttataaaaaatgtttttttaattaacctaggaaatggctttggacttttattgttattctgttaaaaaaacctaattaaaagatgttcttaattaaaaagtactggagaaaacatgtattagaatggcaggtatgaaaaaaggtaagatactgttaatatggcagtgttagatttcagaccaaacttaggggaaagagtatccaaagtcagatgtatccttaaaagtcacttagcagcattccttccttgcagagaccatgaacttggctttctgatgtgttcattttcaccatgcctagtgcaaattaatgtgaatgaatagttacaaaggggagtttctttttttccttcctttcactgcctttgacccttctgcacatttggcggtagagtacgacattcagaatttagggattctgtgtgtgccatctgggatgcatgtattttttaaattgtttatgtgatatatacatgatacagcccagggaaaacatgctttattgtgcattttgaaagctttgcatctttttgtcttcctgcattacttctcattttaccctctgccagtctaaacactgttgtctttcacgtttgaccttctctaagagttctgctctagttctgtcgttgaacctctctcctctctaaacttctttagtactgaggactgtactagtttagcagcaatgccatgctttcttatgtcctttggttgtaaatttgaggcatttttgtttttttcttccaaattaacattttctttccctgccatctagcacaaggactgtgaatggagtgaactaaaagaacattttgtttaagcaagccatggtgttcattgaatgccttctctgtgccagtcactagggctataattgtggatgaaatagaaaaacagactctgccctggaagatcagagtctagtacagcagtttaaagtgtgatggaatttcaatttaaaatgtccccttcatggtaatcagtgatgcacatttacagctccactaaaaggagaagctccagtggggcatagctctttgtttcagtcactgacatatcccacatgcctggtgcaatgaccagtaaatagtaagtgctcaataaataattattaaattaacttttaaaagtttttatgtagagttattcctgcagggctgtgattataggcaaatcatagtgtgtataccttctaccttttttagtgtatctcccactcttgtaccccagaaaaactagtcttgagtatccttccagaaatgttgtattccagtcttgtgtatccttccagaagtattataaatattatattattatccttccagaaaaatcagtcttgagtatccttccagaaatactatatgtgcttgatatttatttatttatatttattttgaggcagggcctcactctgttgcccagaatggagtgcactggtgctatcacaactcactgcagcctccacctcccaggctccagcaatcctcccacctcagcctcctgagtagctggagccacaggcacgtgccaccatgccccactcatttcttttactttttgtagaggtagggtttcaccatgttgtcctggctggcctcgaacttctgagctcaagcaatcttcctcccttggcctcccaaagtgctgggattagaggtgtgagccactgcgcccagtctgtactttgttttctatatgagtatagcctatttatttttttctctgaaaatatattagatagttccatatctgtatatagtcatattatttttggtgactacatagtattttattgtctggagagatcataatttatttaaccagaaacctactgatgaacatttgagtaatttctgatcttttgctcttacaagcaatactacaataaatatacttgctcaacagtcattttacaacccctgaatgtaggacttttagtatacattcttaaaagtgtaatttctataagagtcaaagagcttatgcgtttgtaattttgatagtattgccaaattgtcctctacagagagtgtgagtgtgccattttactgtactcttactaacactgtgttgttttcaaactgatgttttctgttttgataggtgaaaaaatttctctcttttggctttaacatgcatttcttttatgtgaataaattggaacatatttttatatgtttatgagctagttttatttccttttatgtattgtgcctttataacatgctcagttttaaatttgtctattggcctttatcttactgatgtatagttgctctttatatatttagaaaaacattccttggctgttcttgcttgtttatatttccatgtgtattatagaaacagcttttctagttactaaccccattcatctaaaaaatgatccctttggtctttttatttatattatgtccaatttctagatgaatttagaaagtactgacatttctgtgatgttcagtcttatttcctaagaacataatttctctttacatctgttttttatttttaaaaagtaatttttttttttaatagagatgggggtcttgatttcttgcccaggctggtcttgaatgcccgactttaagtgatctaccaccttggtctcccaaagtgctgggattataggcgtgagcctctacacctggcctatttaaggtttcttgatgaaaaaattaatgacatgttaaaaataacctagaatatctttttaaaaatatgacataaagggaagatatatttcatttaatattcatattttattaaaatatcaattctttctaaaataacaattataaaattcagaagcttagattaaacatttcctttctgatcattttcttctcttttggcaggccctgaagaggaaagtgaggatgactctcatctcgaaggcagggatcctgatatttggcatgttggttttaagatctcatgggacatagagacacctggtttggcgataccccttcaccaaggagactgctatttcatgcttggtaatctttggaaaatcaaaattatattgaaactctagtgtctaaatttagattataggatttatattttgagtatgtcttatgaaataaacttttggagtattttatattaagagcgaaacttctttataagaacatgtaactaggtttttcttttttgagatattgctgattttttgagatggagcttcactcttgttgcccaggctggagtgcagtggcacaatctctgctcattgccgtttccacctcctggattcaagcaattctccttcctcagcctcccaagtagctgggattacaggcacacaccaacacacccagttaatattttgtatttttagtagagatgggtttcaccacgttggccaagctggtctcaaactcctgacctcaggtgatccacctgcctcggtcccccaaagtgctgagatttacaggaccatgcccggcccaattaaaagttgtttttctttttattctacatagatgcagagttcctcaaatatgctaaacaattttctggattctttatcagagatattaaatcatccaagtcaaattataactttaaaaaatactttcctgtccgtattagtttttagtagtgagagttttttttttttttcttctagttttgaatgttgtttcttctcaggaacagctgacctgacaatggggcctttctctcgacttgtcatttagttctttgggaagcagtttctcagttgtggttaggccaactgaagctgtggagtttgtgaggctttgtttttttcttctttgctgtaagtttttaattttatttttggactttctacttgttttctaatgcgcaatgtgtaaacagtatcattttttactcacaaagcttctcagggtttattctctacttggctcttgttcctgattatttggggtttatctcactcctatctacctggagaaatctactcatatgttgcttttggagccaggaagaaccagggctgaagcccagtatttatgataacagttgattcccagttaattgggtattttagagtctactatgttccaggtactgtgtaaggttccaggggagatattggaggtggatgaatcttggttcttgccttttgggaattcggagtacagaatagctctttaggccattctgccactaagcattttccaaattttagctcattgcctatgaacttcaaggttttggtcacaatcatgtacttctgcctaaataaagtaacttttaatctttcactgaattgaatttattttaaaaggagattttacatcactatcttaaatgggaatccagtatcactaggtataattagaagggctttagaaatataaatatagagaaaccaaaacagtactaagggcctgctacttttgtttgccggagatcctgagtctgagtcctattctgtgtttgttaaaagaggagattagtaacagagaggtgttaactgtatagtggtaccagtctgagactttctccttaatgtctgcaggaggattgggagatcattatgtagggtctctttcaaatagtgtgatttaatggcacttaatgtgatgtccctttacctcttaaattcttctcatggggagattcctgcatttcttgaacactgatctaagtatgcccttcatctcttgccttccatgtgaacattgctttgcagtttacacatcagtttcacacaagcagccccaatctcctgtcagctttgtgagggagatggcagagattgttctttttttaagtgatcttcctaaagtcacttagttatgaggtagaacagggaccagaatgggtggcaggcatcttatgcagtgcttttcctactctaaatggggctatttcaacctgatcccaatatactgaaatctctatgtgggaatgttttcagtgttaaggttctctcttccccactgtctctcctgcctgatctcaggaagtaagtttattttttaaagtccctaccccatcattgagtgtcatttgtaggtaaacattgtttcatttttttttgtaccacgcaaatacagatatttggcctgagtcttaatagatgttagtatcagccagtaaatcactttcctttggatactttgttcagaagtttctattagcaatgtatatctttcaaagaaataagagccagaatgttatcttttaaaatagcttttactttttaaaaatataaaagtggctgggtgctatggctcacacctctaatcccagcactttgggaggccgaggcaggtggatcacctgaggtcaggagttcaagaccagcctggccaacttgatgaaaccccccgtctccactaaaaataaaaaattagctgggtgtggtggcacgtgcctgtaatcccagctactggggaggctgaggcatgagaattgcttgaacccgggaggtggaagttgcagggagctgagattgcaccactgcactccggcttgagcaacagagcaagactcagtctcaaaaaaaaaaaaaaaaaaaaagtaaataagtactctaaaaattcagctatattccatatatttaataacatcttgtgtgttcttttctgattaaaaaagcaatatgtgcttatttgagagaaaagaaactctggaaaaaagagtctgaaatgaagaaagaatataaaaatcaggttaatgcctgatttaatatatttcttttcagtctttttctgtatatgtatgtctggaattatagtagtaatatgaataaaaccagatttactgggaattaatgacaaacattcttttaatcttctcagcaatcctgagaaacaaatattagctatactgcaaaagaggaaattgaggttaaatttatgtagttacttaaccgtggctgcacagctagtaagaagcatggattgtatcttgtcatcttatcccactcggggtctgacatcccatgtcaggccagccctccttctcccgtagggatgccctcctcaccctactcagcgctgaacgctgctcagggttcctgtgccttcttcttcccacctggcatgatgcctccgcctcacctaatggctttaagactaaattgttcaggaagggaagaaaagaagttaatgatattctgtttgtttcttttctgttcttcttaaggttatgggtttctcagggtttaagaactggattataggccaggcgcagtggctcacacctgtaatccctgcactttgggaggctgaggtgggcggatcacctgaggtcaagagtttgagaccagcctggccaacatggtgggaccctgtcactactaaaaatacaaaaattagccgggtgtggtggtggatgcctgtaatcccagctactctggaagctgaggcaggagaactacttgaacccgggaggcagaggttgcaatgagccgagatcacgccattgcactccagtctgggcaagaagagggaaattccatctcaaaaaaaaaaaaagcgctgtattttaatgaaaatattaaataatgacattattcattggattttggtgttataatgagtatacactgtaaaatatacattgggtcccttgagctattgtacatgataaacagaagaagttagcattattttataggagctgatatccaagacataatataaaatctactcttgatttcccatgtcttatttttagatgtaggtgatatagttggtatcctactgaactgtgccaaacacagcacaatatatcccaaagtctgcacttagaatatatatttttattaggatttattatttttattttatttgatttctgaaatgaatcttccttcatctcttttttttaaaaagtcaaaagtaaaagcaaccatggtctaatgctgccttttctctttacttttaaatccaaatagcacaaggagccccgtagagggagggacttcggccccgtgctgatatctgaaatctgaacttcatagcacttatgaaaaggaaacagtttagctcaatttataataatatattggtctgcagaggaagtgcaggctgaaccctgctgtctcaagtaaatactccaggggtgtctgatggggaacgtgtcgggtgcctgtaataaatccactgcccatggaagtgagtgaaggccttgttggcagtgcctgaggacatgcttaactaaggttgtcacggttttacttttaaattggaatctttgccctaatctcagagttagacatgaccagatttgcaaacagatttacaattttcactaattttccaaccaggacttcaaaacacactcagagaaaaaaaaatacactctggtctttctcagagtaggatgatttactttgccacagatgttttccatagactgaatgtaaccagggagttagggacttaaaagtggcttggagacaaaccatgggtttgttttttgtggaacagattatacagttcaagggacatcaacacaattatgtttattaaccaggagctgggtgtggaggtgggatgtttcaggacaaaggtgagtgctaggtaaacatttggggcaaaaaccctctcttcctcccttaatttgttattgttattctttacatgtcaccattcatgactctgttctctctgctctatttacatttgtttcttaagcacaactaaatctcactttcaagtatttgttgttactataccaatcagcagtttcaaaacttaagttgccaggtaaaaattccactgcaaaaaaagaaaactgcaatagaaatgtaaatgcatagcccttcttttttggtttttctttaccttgtcaacagtttagggtagagttgtgaaaggaccataggatttctatcaggtaaccaggtcccagactcaccgcattgtcaattgcctgtgtattgctagtgcctctcttagtctctgccttcactgtaaaatgggagcttaatgatacttccttctcagagtttttgggagtacaaataagaaaatgtatgggaataggctttgcaagctataatttgtaagtgcagacttgtgaagagtgggaactggaccatggcatattggagaaccagtgagacgactgggtgatagaagaatgctgaatgctgtgttcgtatcctgcttcatgcccagagttttgtcaccttcacaaaataccattccatacgtatatttgctacatataggaactacaagaaagggaagttttaccaatggattcttgagggtgaggagaattaatatctggtccattggttatcagagccctgtagtaatcagtcttactttggtggaggccagctttacttttagagcctggccagtagttttttatagattaagttcaccttccttgaaatacctatggcttagaggcagcaagacccagagcacagaaatatttgatgtggtctaaactgtaaattgccatgcttctgttttttgactcaacatggccactcccactggagtctgtagccctgtgagcaggaagaacagaggtctccaggagtttagactcttaagcgggggctcccttgggactgaacatggaaactgtggtatctttgtaaatcctccaggtgtccctcagttttgccctgatttagacattttattcaaaggaaaaagcttttgttatttctttctctgaccccattcccttcctcaccaacctctgaatgaccagctaaagtaaaaagtacacataatttatggcttaatcataaatttaaaataattatactttattacctctcatgggtcttgaaatgtaggtgctatgttctgctttctgccgaggcaagggaataatacagaaaccagtaataaattataacttcaggctgcagttggtaagctggaggaattgctatttaagtggaaagtgcttgaacagccaaatgagcacctgtcatgtttattttcactttgaaaagtagaaacatgacagtatagtttccactgcctatccaatatgaacttctggcattcttgttatcttctcaggaactgcactgtttgcttcttgtgttcaatttttttttttttccagggatgaggatgtatctctcctcctgaaactttcactctaaaatatgcccccaaatactgacattttcaagcttgtgcttttttacttgatatctgattttttttaaatttttatttaatagggagaaggtcatgacttatggaatttactctaaggatagggatctgagcaggttcctgagtacttgaaaggctttatttacctcttacacttttttgttacatccaggtttttgctcatttctctatcatttgtgtcttgaactttacctgaaatgcatgtcttgagtgcctactaaggtccaggcattgtgctggcagatttgatatatttttgtttattccttattacaggactattacatagtagactctcattctgacactcactttttttttccagaaaaaaaaattaatggagattgattgctaatgggtacagggctgcttttaaggctatgaaaatgctctaaaattagtttgtggtgatggttgcacatctctgaacgtactaaaatacattgaattatatactttcttttttcttcgttttgcagcttttgctcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacggatctcttgaggtcaggagtttgagaccagcctggccaacatggtgataccccacctctactaaaaaaaaaaaaaaaaaaaaaaaattagccaggtgtggtggcgtgcacctgtaatcccagctactcgggaggctgaggcatgataatcacttgaacctgggaggcagaggttgcagcgagtcaagattgcaccactgcactccagcctgggcaacagagtgagactccgtctcaaaaaaaaaaaaaggaaaaaaaataattggagaaataatacatgaacacacatgtattctcattcaaactttgtggaactatatgaaataaaatgtagacattctctttccccttgctttcccatctggtcctttgtaagtgttagcgtaaagatagttatgttgacatatttaaatatatgttgctgctgctgtatttttaaaaaacataaatgatactttattataaatattactctagtgtttgttttttgtacataatatgtgctggaaatttttttatgtcagtatgtcattcatattattattgttattataaaaatactacatgcacaaggaaataaaaattgaaagatttaaaatggaaagttgaggaagatctaaaatggaaagtgaaaaactccacctatccccaagttccatcccttagaggtaactgcttttcactgtatttgcgttttattctttgattacctccctaacccttaaacatatatatacttgtacttttatttctttaataactttaagcattcttggttgttgatcagttaagaatgacagaaacaggcagattgctggagcccggaagtttgagtccagcctgggcaacatggcaaaactctgtctctacaaaaaatacaaaaaaaaaaaaaaaaaaagccaggtaagccaggtatggtggcaaacacccgtggtcacaactacttgggaggttgaagtgggaggatcagctgagctcgggaggttgagcctaaagggaactgtgatcgcgccactgcactccaggctgggtgacagagcaagaccttgtctcaaaaaaaaagaaaagaaaaagaaaaaagaattatggaattagtgctctgatactacctctcactcttgccaaatttggctagttaacctttacttttaggggtttatttccttaattactttccttagaaccagtttatagatactttctcttgaattttagtgtgtaatgtggggaattaaagttctctttcagccatgtcattactttgacatgattgaggtttacaactttacatacagatctgtaattttgataagacaagcacgcttataagttgatctgaaattagaaagccagtacataatgatgttgatgtaagtgttgtttattgcaaaatgagatagagtgatggaattaataggtagaaaatgtaatctactgtaactatccaacctgcgccaatgaatgaagaatactgcacatgtcaggtcaagattttatacttaatcaaaagctcaaaattatgtacattttagcttgctttgtatttgaatcatgactttgttgcatagtttccctctccccctggagacttatattcgtctttttttttactcttactgatagaagaagcatgctataatgattgctcaatatcactagatgtttcgtcatgtgacttgttcagtgtttgataaacactggcttcttcataccccacctaccacagttatcatactgggatttcttctcattggacacctttgccaattccattaaaaaatcattttaggctaggtgcggtggctcacgcctgtaatcccaacactttgggaggctgaggcgggcggatcacctgaggttgggagtttgagaccagcctggccaacatggcgaaaccccatctctactaaaaatacaaaaattagccaggtgtcgtggcaggcacccgtagtcctagtgcctgttttagttactggggaggccgaggccagagaatcccttgaacctgttaggcggtggttgcagtgagccaagatcgcaccattgcactctagcctgggtgacagagcaggactttgtctcaagaaaaaaaaatgtattttaaatttcagtagccttagggatataagcagtttttggttccatggatgatttgtatagtgttgaagtctggtattttaatgtacctgtcacctgagtagtatacatctgataagtgttttgttttttttttcatccatcacccccctcccatcctcctctcttctgaatctccagtgtccattgtaccactctctacaccttcatgtgcccatagcttagtgcccacttacaagtgagaacatgcaatatttgtttgtccattcctgagttacttcacttagaataatggccttcagtttcatccacgttgctgcaaaagacatgatttcattttttttaatgactgagtagtatttcatggtatatatacatgccacattttctttatctactcaacagttgttgggcactttggttgattccatatctttgcaattgtgaaatgtgctgcaataaacatatgcgtgcagatatctttttgatataatgacttctttttcaggtagatacccagcagtggattgttgggtcaaatggtagagttacttttagttctttgagaaatctccatactgttttccatggaggttgtagtaatttacatttccacccccagtgtataagcactcccttttcactacatttctagcaacatctattattttttgactttttaataatggtcattctggctaggataaggtgatatctcattgtggttttaatttgcatttctttgatgatatgtgatattgagcattttttcatatgtttattggccatttgtatattttcttttgagaaatgtctattcatgtcatttgcccactttttagtgggattatttgttttttttcttgctgatttgtttggattccttataggttctttgtcagatgcatagcttgcaaatattttctcccattctgtaggttgtctgtttactctgataattatttattttgttgtgcagaagctttttagtttaagtaggtcccgtttatttattttttgttgcatttgcttttggggtcctattcataaattcttgcctagcccaatgtctagaaagagttttcttctagaatttttatgggctcaggtcttagatttaagtctttaatccatgttgagttaatttttgtatatggtgagacacagggatccagtttcattcttctacatgtggctatccaatgttcccgcactgttttgaatagggtgtcccttttccagtatatcctttgtcgaagatcagttagttgtaagtatttggctttatttatggcttctccattttgttccatcagtctgtgtatctacttttataccagtaccatgctgttttagttactacagctttgtggtataattttaagacagataatgtgatgcctccagatttgttctatttgtttaggattcattggctattcaggctcttttttggttctgtatgaattttaggattatttttttctaattctgtgacaaattacattggtattttgataggaattgcatcaagtctgtaaatttgtttgggcagtatggtcattttcatgatattgattcttccaatccgtgagtatgggatgtatttctattcatttgtgtcatctatgatttctttcatcagtgttttatagttctctttgtagagatcttctactaccttggtcaagtttatttctaggtactttattattattattttttttagctattatcaaagggattgagttcttgatttgattctcagcttggtcattgttagtgcattgcagtgctactgatttgtgtacattgattttgtaacccaaaactttactgaatttgtttttcaaatctaggagtccttggaagtgttgttaggattttctacctacacaatcatattactggcaaacagagatagtttgacttcctcttttcaatttggatgccctttatttctttcctttgcctggttgctctggctgggacttcctgccaattccacttttacttggatcatttgtatttctctttcttagaattttctaaaaattctgttatatttaaattttctaaaaattataccatattttagattcttccaggcaaggactgttttagctttgtatcctgtacagcacctaacacagtactttgaatatggctggtgcttactaagtatttgttgaactaataagtgaatgaatgaaccaagaactggcttttttttttcatttcatggtagtgtgtcttggttatacaagcaaaaggaagtattaattctatccttgaaagcccctgcctgggaaaggttttgaaattccttctcaaacagatggccattcacctaatgcttggagattaccagagacagaatttagaatcttccatggcagcctattctttttcacagtaactcatgcttcttttccttacatctagtctaactaaccacgtgacatcacagaactttctaaagagacacagtatctggatccatctgtacattcccttctaaatttttttataagaaaaccatcaaagataaaaataatgtgttggtttcttttaggctgaggaggaatgttttactatgcattttgaaatttttttgttctctcatatttcattcaattagagtcaccctgttttggggtaattctgcatctgagtttggtggtggaatttttcccattggctaacagtcttcatatgccctctttggccacctgtctattgaacataattcccaaaggcatgagctatagaaaatttttttttttaggcctttatgtaggttgtatatcctgtgtgtgttatttgccactcctgtaaagacagtggaagaatgactgtgaatgatgccattatttttttcagtcgatctttattgaaggttcgaatttaggactaggccgggaatgagtttgactttcctcatctagtcagtcccagcagcacgtttcaaggtcagactatatacctcatgctggaaggttccttagactttgtaatctaagcccaataaacatctttttttttttttggggggggatatttatttaccaaataaataggacagcacacagccatccgtgaaggtgataagagctttgactagttttataaatcttcccctaaatataattttctatgggagtgaaaactcttttataaaaacaattgagagaccgaggcaggtggatcacttgaggtcaggagttcgagaccagcctgggcaacatggtgaaaggctgtctctactaaaaatacaaaaattagctgagtgtggtggcgtgtgcctgtaatcccagctactcgagaggctgaggcaggagaatcacttgaacccaggaggcagaggttgcagtgagctgagatcgcgccactacactccagcctgggtgacagagccagactccatctcaaaaaaaaaaacaagcatggaggtgaagatgatctcaaggtacataagatacatacctaaaggtacaaagatataaatcatagtccttggtcaattcattatagtggttttgtagtctgtcctacagttggttggggtaacaacctcttttcttatttttgttcacactgctctctctaccccctcatctaggtatgtgtatagctcatttatttaggggtgatgttaaaaaattgaatgcccttaatggcaagggaaccaaccaatcaatgtggatgccacaactttttcccctgttgactgttgttattggtatggaagtattttttttttctcccagcttttatttcaggttcaagggatacatatgcaggtttgttacatgggtaaattgcatattgtaggggtttagtatacagattatttcatcacccaggtaataagcgtagtacctgatagataatttttcgatccttaccctcctcccaccttccaccctcaagtgggccctagtgtctgttgttcctttctttgtgtccatgtttactcagtgtttagctcccacttataagagagaacgtgcagtatttggttttcttttcctgcgtgaattcacttaggataagggcttctagctgcttatgtcacctacttatgtcacctactactactaagctttttgagaacctggtctctctctctctctctctctctctctttctatatatatataggaagtcctggattctggggcttcgagggctgacctggagcctgagtccacaagggcatacctggtgctagagtaggcttggagccttcgtctttggaggccaccctatcactggggttcactggggtggacctctgcttggtttacagagaagttgggtactcacttcattctccttcccccacacaaagggtatccctcttgacactgtgctgctcaggcttcagggagaggtgacgtaggtaatttgaaactgttcttcctactcatcaatgtgtcttttcttatttctgtgctccatccaggcaatgtaatctttaacctggattcctttgctcttataaaggtattctgtgcatggatagttattcaaattgatgtttctacaaggagacaagtgctattctgacatcttgcttgaaagtaagggattaatttttaaaccagtttttaacaattattttcaagaactgtttagtgataagaaaacaatgctcaaaatataaaagtatcagggaaaaaagatgcaaaatgtttgtacaacatgatattaattttatataaacaaaggataaacatattactaagtataaaaaaaaactagaaggaattagaccaaataattataaataatattttctcttctttacacttttctatagtttgcaaattctctacaatgagcatgtaccctaattcatcagttccaaggtagacattttttcttcatatttaacatctctgaaattggaatccatcttaaactgatgccttctttgactggatgatatattattacttttaaattaagcaatacaaactttaaaaataagtatccttatgttttaaagcttcaaacggaaatgttcaataaagagattctcaggaaagaggtattcattcaccaaataaataggacagtaaacagtgatcagtgaaattggtaagagctttggctagttttgtaaatcttccccaaaataaaatttttccatggaagtgaaaagtctttcaacaaaacaagtatagagataaagataatctcaaggtacataacttcccctctccttctcccctttttttagaattaacttttatggaatgctcagtttgttgatgggttttgaagagaatagattcttgaggttaataattgatttttgctttgctttcttttctttttttttcctttttgtgagacggggtcttgatctgtcacccaggctggagggcagtggtgggatctcggctcactgcaacctccgcctcctgggttcaaatgattctcctgcctcaatctcctgagcggctgggactataggctcgtgccaccacgcccagctgatttttgtatttttactagagacggggtttcaccatgttggccaggatagtctcgatctcttgacctcatgatccgcccacctcggcctcccaaagtgctgggattacaggcatgagccaccttgcctggccgatttttgctttctaaataagcaaaaagatctttaatccactttagccagggctacctttctcctttattcttccaagttgtaactcttcccaggagactgcagagtatagcgagttggggaaaaggaaagatgagaagggagagaggttagattgacagaaaagataattaaatggttttctccattttcccctttgtatgtgcagagcccatcacttctgcccacagttccactaaactgtgaagaccagaatctctcaaagttaatgaatgaaacagaagaagccacttcaacctccaatttctgtttctatgtcttctgacctccttctttacacatcctatctcatatccaattttccattagcaattaagaaggatagctatggtttctggctaatacctggggagagaaaaaggatgttctctccaaatatgtggtaagtttctagtatgtgcaaggttctacatgctgtgtgtagtataaaaatatatatcactatatatcatatcaatgatatatatatttcattatatgatttatatatcatataaatatatatcactgtatattaaatatattttaatgatatttatatatatatcatatataactcataaaactcaatagcaggttaacaagtaacctgacctaaaaacgagcaaaggacttgaatagacatttctgaaaaggagacatatgaatgctcaacatgtatatgaaaatgtgctcaacatctagtcatcagtgaaatctaaatcaaaaccacaatgagatattacttcacacttgttacaataactattatacaatagacaatagataacaagtgttggtgaggatgtggagagaagggaacccttgtacaccattggtgggagtgtaaattggtatagccattgtggaaaactgcatggaggtttctcaaacagttaaaaatagaactttcatatgacccagcgattctactttggtatacatatccaaaggaaatgaaatcagtatctcaaagagatatcttcattcccatgttcattgctgcattattcacaaaagccatgatttagaaacaacctaaatatctgttaacagatgattgaataaagaaaatgcagtaggtatatctatatctatatctacacacacatacccacacatatccacacataatgaaatattactcagtcttaaaaaagaaggaaatcgtgtcatgtgtgacagtgtggaatatgttatgctaagtgaaataagcaaggcacagaaagacaaataccacatgatcttacttatatgtggaatctaacaatgttatactcataaatgcacagagttgaatgtggtttccaagggtttgagggatgttgggtagatgttggtcaaaaggtaccaagttttgtttatgcagaatgaataagctctagagacctaatgtacagcatagtaactgtattagtctgtcacattgctgtgaagaaatacctgagactgggtaatttataaagaagtttcattggttcacagttccccaggctgttcaggaagtaggacgctggcatctgcttggcttctagggaggcctcataaaattatgttggaaagcaaaaagggggagccagcccttcacatgcccggagcaggaggaagagagagtgaggggggatgtgccacacacttttaaaccacctgatcttgtgagaactcactgtcatgagaacagcactgagaggatggtgctaaaccattcatgagaaaccgccatgatccaatcacctcccaccagaactcatctccaacactggggattacagtatgacatcagattttgtggggacacagatccaaacaatatcagtaattatatttattaatactgtattacatatgtgaaattagctaagagagtagatcttaaatgtttttaacacacacacacacacacacacacacacacacacacgtttactgtgaggtcatgggtatattaattagattggttttagaagtcatttcacaatgtatatgtatattaaaacgttacattttacattgtagatatataaaatgtttgtcaattatacttcagtaaagttcagaaaatgttttaaatcacaaaataatcttctactttggttattcaagttttttgatattatatatattgctacagtgaacatctttgtacatatatctttatttccataggaaaaattgctagaagttgaatgccttggtgaggtattatggtgtggacatttacacagtacatactctgttgtcagactgttacttagagagattttcattttcattcctacctgcaatgtatgaaatgtgatcatcagttacttccaccaacctcctttaccctactgtatacagtgctaagtgttccaatttacaaatatttttgccgatttgatgggtgaaaatatgctattattttaaatgtcatttatttattcatgaggttgaacactttgtatttttgttggccattcttctttctgttattcattggctgatcgtattttgctcatttttctgttgaggtgttagtgtttttcttaacatttactttatcccttctgcctttaactttattgctttaacccttctgcccacttcccagatattttcttatacccaattttcaattttgtatttagatttttaatatttattttaggtgaaacatctttccatttaagtcttaatcgcaatagttgcattaaattaaataacaatatttgaaattatttaactgcgtttatgcttactgctagcctttttgtactgtgatttaaaaaaaattcttgattgttctcttggtcagccaaaatgtagtttctaataatatttatgaagactaatggcaggggagtggtcgtggcatattctttgagtctttgcattatagaagagtgacttcctatcctttcacttgtgaatatctgcttgattggctataggattcttaagtatcaaacttcccccttaaaactctgtagaggctgggtgcagtggctcatccgtgtaatcccagcactttgggaggtcgaggtgggcagatcaggaggtcaggatttcaagaccagcctggccaacacagcaaaacatcatctactgaaaatacaacaattagccaggtgtgatggcacatgcctgtaatcccagctactcaggaggctgaggcaggagaatcacttgaacccagcaggcagaggttgcagtgagctgagattgtgccactgcactccagcctgggcgattagtgagacttcatctcaaaaaacaaacaaacaaacaaaaaaaccaccaccaacaactctatggatatcgttctgtgacctctgatatttgatgttgggagatgtctgaggtgatctacattatggtttcattttggtaagctgtattttctgtttggacatttgtagtattttatatttaattttttaacagaatatgtttatgtccttgctcaaccattttatagtgcagactctggtcttttcacaaccttggaaaacattcttctagtgtttctttgattattcttatatctttctgtatcttacttttttttttttttttcaagatggagtctctctgtcgcccaggctggagtacattggtgtgatctcggctcactgcaacctctgcctcccaggttcaagcaattctcctgcctctgcctcccgagtagttgggattacaggcgcctgccaccacacccagctaattttttttttgtatttttagtagagacagtgtttcaccatgttggcagggctgatcttgaactcctgactggccttaagtaatccatctgccttggactcccaaagtgctgggattaccggtgtgagccaccatgcccagcctgtattttacttccattctgtgattcctgttaagtacatttggatctccaggatctgttcctcatgtctaaggttttccatcactcatttcttgtattttccctgagttataggagaatctcttgagttcactcatccagctcagtaatttggtttttctgcagcatgttttctgctgttcactccatctattgccgtgttaaatgaagaaatgctattaaaaaagtcagttgccagtggttttttctgatctcatactgtttcagcttcatgtctgcttaccgtattttcacagatgcagtgccttcttgaatcaagtgtcttcttgaaaaactgagaattttctaaaattttatcatgtcagttcgagtaaacttttttcagaaaagacagttttgatcaaagtgcctccattcctttgaactgtagtaattttgcatagttctggcaattactccttgcctctttatcctcatagaaagtagactagtactggctgataggcaagtagctgagattggttctgtgagagattagtatggattcctggccaaatcctttacttgaaggtggaagaagatgtgtccttacacagtcatgtagagattttataaattggagtgtgcttaagaacttgtttttgtctttatgtggatgcttgcagtatgagcaaaccatggtaggttttggcccactcctatcattgctgattgctccagttccttgtttctgcaatgcctggtactcagagtcatggcttataacagcagcacatccaggggtctgtgagtatcacaggttatgtgcacagaattctggctacagtgagtatcacaggttgtgtgcatagaatgctcgctacagaggcaagagccttgctctctgagtgccctgtaagcttctcttgccctcctgctctttgctttctgagttaagaggtgagcattttgctcaggatttgattggtatatttatcaggctcgctgctcttttggagagacaatcacctgtcagccttctttgcccttctttaatctaattccacctatactatattcagcgcaatcatttgcacttctggcatattgagcacctttctctaatatatagtgccaaaagaggttttgatccatttttatgttccattgattgtctcattgagaatctaggaatgggacggggcctgtgtctatactggcatcttgccaggaaccttcccctccccctttcattggctatcaaattctgaaaatgttttcagccatgggtggcccacatctaggaaaaacaaggtcataaatattaagattgagagatgagaatggacaggtaagtaagaatgaaaagcttcagtgattgtttgaagctgggaagactggatttcagtactgggcttatttaccccaagagtgcctttagcaaaagtcatgattgtttctctaagaaatttgggtgaaatggccctggtaatgtacgtgacagcaaacccaaggaagtaagggctggggtaaatttagggtgaccaactgtccttttcgaaaagtctgtgggcaaggggatctcaggatgcaggactttcagtattaaaaccaggaaagtcgtgaacatgaattggttaccctagcataaattatagcattgcttctgtggtcttttatatatgaaatgagatttcatgctacagtgaatgtccagagctctcttctccactgccagggcacgcagcattcagccagcaaagagtgagagcgtcttttctttttgtgtgtgtgttgtcacatcatctacaaactcttactccagttggatacagtgtcagtcaagtttcagctgtattctgagatagctgtggtaaatagacattctttaatttattttttctaaaaattattaggaataatcttttaaagctgggagggtcttaagtatatcctttgagatgcacaatccatgaagcttgtgtcgcttttatagatggagttttcgataaattagaagctcttaaatgaaaattacaagtttctttttttaaagtcataaaggattagatacagttggaagcaatttcaaaagaattgtttgattagagagttgccaaggatttaaatgaaggtggaagcctcaaagtataccttctagtgttgtgtttgccatttggcctgagtcactaggtgactcagtgttcccctcagtggaacaaaagcacttaacaaacctactcattaaggtggtgatttttcccctaattatgactgtgggtcccagtattaatagcataggagtaataaggcttttatttgggtagatgagactggcatttatgtatttcctagacattgtcccagtcttttatgggaatttatcctgggaagcccccttcaaactccactttttattattttgcttgactctgaaacctcctttaggcaacatagtcaggatcaaccaaaactgctcaggaatgtcctcagagatggcaaacgggaagagagaatggccacttagccttcctcattaggccttacagccacacttctgctttttatcctctatattgttgtgtttatatttggatttaaaactccaaatgtatcactgatgttttcatcctcacctctaattgcattttgtagttattattttgcaatgtcctaaggttttgtgacttattcaccttcagtcagttgttgctgtgaaaaccccaagagttgttcttgagtttattttttcctgacttgactcatccagttcattagcatgtcctattgtcttttcctagaacattctgaatctgttgtctgcttatcgtctcctcccctgtctctgtagttcaagtcactgttaactcctgcatgacttactgcaacagcttcctgactggccttctgctgccattcttgtttcccctttagttcttcctctttcctatgaaactgccagtcagattagattattgattcttttgaatttgctacacagacaataatataatctgtgaacaaacatactctaattgtttccttctctatttgtataccttttgttttcttttcctgtcttactgtgtcagccaggtcttccaatatgatactgaaaaggaatgttgagaggagacatccttgtctttttcttactctgagcagaaaagtttctagtttcataccgctaagtatgatatttgctgcaggtttccttacacattctttatatgttgaggaagttcttctctatttctagtttactgagaattttttatcatgaatgggtatcacattttgtcaaatgtttttctgtacctattggtatgatcatattttttttctttgtagcttgttggtgtgatagattatattagttgatttttgtatgttgaatcagttttttatacctgtgataaatctcacttggtcgtggtgtaattctttttatacattgttacattcaatttgctaatattttgatgtggatttttgcatctatgcttatgagagaatactggtctttagttttcctttttgtaaggtctgtctgggcaatgctggccgcaaagaatgagtttggaagtattccctgtgttaccttctagtaaagaatgttaagaattagtataatttcttccttaaatgtttggtagaactcaacagtgaacatatttgggcctggcgctttggaaacatgttaattattgattcaatttctttaatagagataggcctattcatattattcatttcttcttgtaagagttttggcagattttatttctcaaggaattggttcattttttataggttttcagatttttgggtaaataactattgacatcattttaaaattatccttttaatgtccatgggatctgtagtgatgtcatctctttcatttctgacattagtaatatgtttcttgtctcttttttcttagtctgcctagaggtttatcaattttattgatcttttaaaagaaccaacttttgctttcattaagtttctttattagttttctgttttttatctcatcgaggtgcattaacttttattgtttcttttcttctgctttggattaatttgttctttttctttaatttcacaaagtagaagcttagcttattgattttagatctttcttcttctaatataagcagaatgctatattaatgctatacatttgtggcatttaatgctataaattctcctctaagcagtgctaatgttgcttccaacaaattttggtaagttgtgttttcactttcatttagttccttttttttaagatttttttgacccacagattattagaagtatattgttctatctccaagtatttgggaattttccaactatctttctgttattattttctagtttaattccattctggactgaggtcaaatattttttaaaaaaatgtttcagacaaataaaaattcagggaatttgttgctagtagacgtgtattgcaggaaatttgtcagaagaagaatgatatagatcagaaactcagatctacataaagaaaggaagagattttgagatggaataagtgaaggtaaaataaaaaccattatttttcttacccttaattgatagaagagataacaatttattcacaataataacaacaatgtattcaattatgtacgccacatatgtgtgtgtgtgtgtgtgtgtgtgtgtgtgtgtgtttgtgtgtacctatgtatgcttatttgtaagtgaaagtaatgataacattctcttaaatttggtaatacgtgttttatcgcccagaatgtggtctgttttggggaatgctccatgtgagcttgatactagtgtgtattctgctgttgttgaatgaaatagtctatgtatgtcagttatattcaattgactgatggtattgctcagttcaactatgtccttaatgattttctgcctgctgtatctgtcgttttctgatagagggatgttgacatctccagttatagtagtggatttgtctgtttttccttgcagttctatcagtttttgccttatacattttgatgctctactattaggtgcatactgttatatcttctgggagaatttaccactttatcattatgtactacccctttttctctgtgataatttatctttgctctgaaatctgctctgtctgaaattaatataggcactccagctttctttagattaatgttagcatagtatatctgtcttctttgtttctttaagtttaatctgtgtgtttctttgtatttgaattgagtttcttgtagatagcatatgccttgttttttatctattctgataatctcttattttttaatgtgtgtatttagaccatgggcatttaaagtgattattgatacacttggattaatatctaccatatttgttaatgttttctatattttgtcttgttttttcccctgtttttgtcttccactctttttctgcttttatagttttgagtatttcatgatttcatttcatctcctttcttagcatatcaattacatatgtatttttttactttttaagtagtgacctagaggttgcagtatacatttacagctgttccaagtccactttcaaataacactatactgttacacagatagtgcaagtacagtaaaataaaatattcctaatttttttctctcatctcttatactcattgctatcattaatttcacttacaaataagcatagataggcacacatacatatatatatatgtggcatacataattgaatacattgttgttattattgtgaataaattgttatctcttctatcaattaagggtaagaaaaataatggtttttattttaccttcacttattccttctcaaagtctcttcctttctttatgcagatctgagtttctgatctatatcatttttcttctgacaaatttcttgcaatacaagtctactagcaacaaattccctgaatttttatttgtctgaaacatttttttaaaaaatcctttctttctttctttttgtttttttgagacagagtttcactctgtctcccaggctggagtgcagtggcgtgatcttggctcactgcaacctccgcctcccgggttcaagcgattttcctgcttcagcttcccaagtagctgggattacaggtgtgtgccactgcgcccacctgatttttgtatttttagtatagacagggttttaccatgttggtcaggctggtcttgaactactgacctcaagcgattcacctgccttggtctcccaaagtgcttggattacagacatgagccaccacacctggtctgtttctcctttacttttaaagggtagttttgtaggatccacaattctaggttgctgtttttttttcctctcaacaccttaagtatttcacttcacttttgtattgcttgcctcgtttctgaggaaacgtcagatagctttttttttgctccgttatagataagctgttttttccttctggctttttcaatattctttatctttgactttctgcagtttgaatataatatgcctaagtgtaggtttttttcctgagcttcccgagtctctagtttggtgtctaacattaatttaagaatattcttagttattattgcttctaattttcttctgttcctttccctctttcttcgccttctgttattccattatacatatattacacctattgcagttgtcccatagttctgtttttttttttttttcagtcttttttctctttgcttttcagttttggaagtttctcttaatatatcctcatgctcagagatctttcatctgccttgcccagttctctaatgagcccattaaaggcattcttcatttgtgttacagtgttattgatttccagcattttgtttttgattctttcttagaatttccatccctctgcttacgttccccatcagttcttgcatgtcgtctacgttgtcctttagggtccttagaatagtaatcatagtttcaaaaacatttctgataattaatttctgccatttctgactctgggtctgatttttgctcagttttttcaaattgtgtttttttgccatttagaaggccttgtacttttttcttgataggcagatgggatgcactggataagaggaactgcagtaataatgtggtggtaaggtatgttgggaggggaagcattctataatcttatggttaagcctcagtcttttagtgagtttatgcctgtgaattgtgaacctcacaagtgcttctcattttcttttttctcattcttagttccaataggatggctagcaggggctaggagttctaggtggcattgaagtatgttcatgccactacactccagcctggatgacaagtgagaccctgtctcctgagaaaataaataaataaataaataaataaagtcgctattttttcccttccttctgccagaagcatgagaagatgtttttggatcttcactgtgagaacctgttagagcttttggagataaaactcacaaaagtgtgggagttccctaagatggagctcccctggactttttaactctcagtcccgtctacgttgaatctccagcaattcagtagttacagttacggtttttctatcctggaactggttcccatgtgtgtttctgcttcttgttttttactctgataaattgtcatctctgtttccagtgtgtctctctctccagagtgaggaatgacaaaattacatctcattgaaagccactgctcttggttttataatatctttacatctttgatttaccacaatgtaactttgaatgttgtaccacttttccttccatcctcttttgtgctttttcatgtgttttacgtctgcatatgttataaacctcagaatacattgttattattttggatttaaaaaggcatttattctttcatgatatttgttacttatgttactttttattcctttgagcagatctaaattccttctgacattatttttcttttgcctgtagaatttcataactattcttatagtgtaaatctactgaatataaattgtttcattttctttctgaaaagtctttatttcacttttattttggaaagggtgttcactatgtatagaatagtagattgacagttttttcctttagtattttgtcaccagttgtcttctgagttttataacttctgatgagaagtctgctgtcattctaatctttgtccctctgtatttaatgtctctttttctgactgcctttaacctttccactttattactgattttaagacatttcattatgacatgctttagtttagtcttatatctttttttgcttagaattcgttgagcttattggatctctgggtttatagttttcatgaaatttggtgaattttggccattgtttctataaaaatgtgtgtgtttttgtcactctttcttccctagaattcaaattaaattttcattaaatggcttaatattgtcctggctgtcactcatgccctttcatatttttgtagtcttttttgtttagccactttattttgcatagtttttatttttcatgtgttctagttcactgatcttttcttctgcagtttgtaaattgctgttcatctcacttagtgtgagttttgtttcagatactgcatgtttaacctttagaagcttcacttatatatatatatgaaagggcagatatgtacatttagaagaaaagagagatgtgactacctcgcatattttgtgtgtgtgtatgtatctttcatttctctgttactttttgaatggatgttgggtattgcacatcgtatttgttgggtgcctgattttgttatatacttttacatacttttggcttttgctctaatgaataattaaattactaagaagttggatcctttttttttttaaattttgagatggagtttcactctcgtttcccaggctgcagtgcaatggcgcaatctcggctcactgcaacctctgcctcctgtgttcaagcaattctcctgcctcagcctcctgagtagctgggattacaagcacctgccaccatgcccagcgaatttttgtatttttagtagagacagggtttcaccatgttggccaggctggtctcgaactcctgacctcaggtaatccacccacttcggcctcccaaagtactgagattccaggcatgagccactgtgcctggccagaagttggatccttttgaggcttagttttaagccttgctaggtgggactagagcagcctttaacctaggactcatttagccctacttctgcagtgatgctttcctaaggattttctagtatctcatgtagtgggagccattttggctgctgggatcatagaatactcctggctgtgtgtgaaatctgaaattggttccacctgctgcattctggtgcttctttttttggcccttgggaaatttttattcatacatgcacaggtcagtgctcttccaaatacttgagggaaccttcctgcagtctgtttgctgtctctctgtatagctgtttctgttccagcattctgcctttcgaggccctgtggccttggcctccctatactccagtctttgtcttctcaacttggcaagaaagaaacagagactctgggttttgacttcctcttctctattctgtggcattgaaactgtttccatggagtaagttagggcaattgtaggcatctctcacctattttgtttctcttctccatgggattatatcttgctgaaacctttgattcatatttttggcttgttttgtagttgtttaagacagaagggtaaatcttgtcactgttacttcacaatattcataagcagaaatcctgtcttaatatcttgcatttcttttctatgtttagagatgatattgtaggttgtttttgctgatacataaggggcctggtggcatttgcctcttggtttaagtcattatcttttttggtatcttgataaaaatcttgtgttgcctgtataggatgccattgctggaaacattacaactctctttttttgtaatagaggaagtcatgtcctgagcagaggttgtatagattttgcctgacttgtggtatcatttcttaggatatataacaacttggtcattggtttttctcccactgcttgtggttttaggaatattcttcaactgatgaattcaccacctacttcattcttgggttgtgaatccctacacttgagttctgttctaagagccaaacatgcaacatgctgagttggttggtttattgcctggaaaattgttagggcaaaattgatactttgattatggagggaaagaggcagatttttcagatgaaaggtgtgcaactccaaattctggtttattctaaagataagggtagaagtagatgtgtcatgagaaagtgaaagaagctcaattcatatatagtgaattttatagtgggtgggcataataggaccacaaataagtagagtgaccctatatctcatttgctgaggacagtcctggtttatacttgttgttctggaataattgttaatagcatcccctttcactcttcaaagtgtcatactttgtatgatagaatatatacatatttagttatatacatatgattatatatatctacttatatatacttgcatatgtataagtatatataagtatatcatatttattgtatacttatatttatattattatacttgttatgtatctacatatatataatgtctacttataagtagatacgcatataatggaatatatatatatgtagtcacctacttataagggattgattaaagaatacaaggtaagtattgattccttggttattgttatttcttggaagatagatttactgtttactttgtgttttagttaaataatatatagtatatactgactaataaatatggttttatacatttctggtgtttttcctgtagatgatctcaatgccacccaccaacactgtgttttggccggttcacaacctcggtttagttccacccaccgagtggcagaggtaagtgtaaataaaaatgtgattcacacctaattggatgtgacagaagtggttgaatgagcaatttactatagagctttggaagagtatttgatgggaaaattgcttccatctaacttgactttcgtctctgtttacttgctttttgagctttggattgtgttggatacagttttagaaagcatattcatgccatgggataagtgtgttttgcttcttggggttatgtttcttggagaaggaaaatgccgttgacaagtgtttatagttagaggtttatttagagggttgtatctgtcaaggtcaagggcaggagatgaccagaagaattggggcagatttttatgcttgtgcatgtgttagctgtggctgggttcagatgttgagaattttcatttcccttaactttttggtcagacttctgggcatgtgaatgtaaagagaaagttacagggttgccaaggagtttctgagctccacagttgtgttcataacccagactttattgctaaattctgccaccacttgcaatggcccatggttagctgttcagactagttcagaatggaaaactaagaaatgagaaaaactcatattagtcatgttggggtcccatgtactcagttaagaggggttccagagagcaaggcatgaaagggattacaagtgaccttctacctaagcttgctatccatgctttgctttatagcttgacctttcatggaactacaggggacaagtgtgagaaaattgggcggaagtggtacaacaaagtgagaggtacaggtgcaaggtcttccagtggcagtactgcgtgagtctatacggcagtgttgtgtcttttggtcattaagtagctttaccagtggaacgatcatattgctgtgtggcagagagagaatgaatgagtatttaaaccaagatgccagcaagcccatccagcacctctttcttcctttctcccctttcttctcttttccattcactcattcatttaaatatttgagtgcctgttatgtgtccaaaactgtaggcctgggagatagagccgtcaacatgcccatgatgcccaccacttttgtgaactttagttgggggggacaaattttaaacaaataaacacagaaataattgtcttagagacctaaagggagttctgttagaaaagagggaagcgagggaggaaggtaggtaaggacgaacagaggaagaaaagaagggagggagggaggaaggaagagagggagggaggaagggaggagcaagtatttatagagcatctaatatgtgccttgtattatacacaaggatttcatttccccagttataggcatctgtctttctagctataaccctcctaagaatccctttcttgtggatcacttgagtatatggctacttaagtgcgcccttctacgtctttcctaatctaatccagaagagtggacagtctcattagtgctgggttcaaagggctgtacaaaatgataaataaaaagcttgggaaatatgttcatggggataagaatcgtacctaatcgtagtgttcttatgaggattaaattagttaatacatgtaagtctttttagaacagtgactggtatacattcaaagaagtttgccactactattattaaattacttctactgctactactgtcttttcattttattctgttgaaaaactaataggagatgggaacaactaaagttcactgtgtggaaggttattctgtcttcatttgtacactacagtgtacataataaagcaagagagattaaatcatcagcaagttttgattgtaggaactactattcagaagggatttcagtttgttctctcttcaaacttttattgaactttatagtgttcaaggtattcttgtagggacttgtgaacaggaatggttatattcagtgtcttcaagatgcttatggtctaaagagtatgtacagtgcagaatagaatgtagcagatagcccggctaaattttgtatttttaatggagatggggctttgccatattggccaggctggtcttgaactcctgacctcagtcgatccacccacctcggcctcccaaagtgctgggattacaggcgtgagccaatgctcccggcctagattttagtttttgataattgtgtcagaatattcttgggattcaatacagaatgtctttttaaagaaatttacattttatgaataattatattttgaataggtagttaatgcaaatggttcaaaattaaaaaaaatacctaaaggtatacagttaaagtctctttctcctcaggccaaccagcccctcattcccagaggcaaccaatgtttaaaggttcttgttactcttttggtgatatttaatatataagtaaaaatgtatgtaatttcaaaaatatttttaaatataaatggtagcctactatatatatggttctgtagttttgtttcagtaaactttggtaataattactcatcaatatatagcacttagcgaggagtaggtaatggctttttagatatgacatcaaaagcataaacaactgaagaaaaaaacagataaattggccttcatcaaagttaaaaacttttgtacttcaaagggtaccataaagaaagtgtagaggacccatggaatgggagaaaatatctgcaaatcatatatctcataaagcacttgtgtctcaaatattccaagaattcttagaactcaataattcaaaagagaaatgatccaatttaaaatggcaaaggaatcgaattaacatgtcacaggctgggtgcagtggctcatgcctgtaatcccagcactttaggaggccgaggtgagtggatcacttgaggccaggagttcaagaccagcctggccaacatggtaaaaccccgtctttactaaaaattcaaaaattagccaggtgtggtgccacatgcctgtaatcccagctattcagcaggctgaggcaggagaatcgcttaaacctgggaggtggaggttgcagtgaggcaagattgcaccactgcactccagcctgagcaatagagcaagactccgtcttcacacacacacaaaaagaaggtatacaaatggccaatagacaaatgaaaaatgctgaacgtcattagtcactagggaaatacaaatcaaaaccacgacgggataacatttcacactcactaggatagctagaataaaaaagacagtgacaagtgttggtgaggacatgcaggaagtggcacccatgtgcactgccagagggaatggacagtggtgcagccactttgggaaacagtctggcacatcttcagaaggttaaatccaaaggtaccctatgacacagcaattccatgcctaggtagtttcccaagagtgatggaaacttctacaggaatgttcataatcaccaaaaagtggaaacaacccaaaggttcatcacttaatgaatggataaataaaacgtggcatatccatacagttgaatattattgggcattgaaatggaatacagtaatgatgcatgctacaacatgaataactcttgaaaacatacgaaatggaagcaaccagtcacaaaagatacatattatataattcatttatatgaagtgtctagaataggtctctctatggacatagaaagtagattagtggttgcctagggttggaaatgttggtagaaatcagttggggttgggggtgactgccaaatggcacagggtttctttttggggtgatgaaaatgctctaaaattaattgtagtgatatttgtataactctgtgactatacgaaacaacattgcattatatgctttaaatgcttgaattttatgacgtgaattatagctcaataaagctgttaccaaaaaaaaaaaacctatctcaaactaggcctgattatagattatttacataaaacaaaacactatacatccagaaaaaaattattccacatcccacccctctctctttttgttttctgcaaccatacgtcattaaactagttttcctattgttaagaaatttaggttgtttctaatcttgcatgaaaatgcaattaataacctatgtagctcactccatacttgggaaagtaaaggtgcaagtagggaaactttctagatagaagtcattttaaaaagatgttgtaggctgggtgcagtggctcatgcctgtaatcccagcactttgggaggctgaggggggtggatcacttgaggtcaggagttcgagaccagcctgtccaatatggtaaaaccagtctctactaaaaatacaaaaattagctgggcgtggtggtgcacatctttaatcccagctacttgggaggctgaggcaggagaattgcttgagcctaggaggcagaggttgcggtgagccaagatcatgccacgccactgtactctggtctgggccagagagtgagaccccgtctcaaaaaaaaaaagtgttgttgtagaggttgctgtgggacaaaaatgagtggtcattcacctttattctttgtggggttttttttggcaggaaattggagctgcctgcccttatgcacccagcactctgggatcttcatattaaaatacattttagtcaagcttctgtttcttggcacagaaactttgtttttcccaggcttgttgatgtcgcattgtataaaatggcagtaaatgtgcaaggaaattttatatcagaggattagccttcaaggttatttacaagggctcagtttaaattataaataataaaaccaaaatattttagggatacattttcctcattgggactgaagggtatttatagctgactttttattattctaggaaatcattttaatatcaaaacaggcagatgcactgcccatgtgcattggcctcttttccaacatatgatcatttataaaaaggagtttgtccatttgacctctgttttgctcccacggactcagagagggatgaactagttatctgtgtccttgctgaggcccaggtactaagttatgcctttgaatgtgccttgagggcttaagccaaatattctccattatttgaagaatctattctgccaaggactgccactgcctagtgtatgctttttgcagaaaagagaaatgagttctttgccttgtgattataactgcatttttccccgctgtcattatagaaccatttattgtgcttttgaaccagctttgcagcctggttacctttctttcctatctttagtctcagggcatttgagataaaaagtcagtgtccttgacttcttggttaaccagttattcatccaataattatttattaaatttcttccagttttcagactcagttctagatgttgtagtatatatagaaaatgtatttaacatatataaatagggcgttagcctccgggacccaaatgtttagttagagatatgaggcccacgtaaaagaaaaccagcaaactaagtggcccaagtgaggccaaactggcagcacagagcccagtggaacaggccactctagtaattcttgagttcgtgagtataggccgggcacagtgactcacacctgtaatcccagcacttttggaggctgaagtgggaggactgcctgaacccaggagtttgagaccagcttggataatatagcaagatcctgtctctctctacaaaataaaaatttagaaaaattagctgggcagagtagtgcctgcctgtggtaccagctattcaggaaggtgaggtgggaggattgcatgagccccagaggttgaggctgcagtgaaacattattacaccactatactccagcttgggtgacacagcaagaccctatctcaaaattaaaaaaaaaaaaaaaaaaaaaaggagtatagactgagccatggggcaacaggtgaattcacagccagggacaaatatgaacaatcctaggaaggatggtagagtaaacttagattttgcccataattgtgattgctggttctgtctcaacagtgctcaacaggaaccttggattatattttacaacgctgtcagttggctctgcagaatgtctgtgacgatgtggacaatgatgatgtctctttgaaatcctttgagcctgcagttttgaaacaaggagaagaaattcataatgaggtaaggactttctttttttttttttgagatggagtctcgctctgtcacccaggctggagtgcagcggcatgacctcggctcactacaacctccatctcccaggttcaagtgatcctcctgtctcaagctcccgaataggtgggactacaggtgcatgcgccaccactcctggctgattttgatatttttagtagagacgaggtttcaccacgttggccaggctggtctcgaactcctgacctcaagtgatctgcccgcctcagcctcctgaagtgctgggattacagtcatgagccactgtgcctggcaagactttcaagaattgtgaaagatctgagattctaccctacttgcaagctaacaagttaatctgccacaatttcatattgttataagacgtgagactcttaggtcacagatggaggacaggttattacgtatatcaatagcagtcaccagagtctccgtatttttgtgttagttcacgaacttattctgttcaggctgcagtaacaaaattgcataaaccaagttgcttctaaacaacagaaatttatcctcactgttctggaaggtagcaagttcaagatcagatggcatcaagttcaagatttgatgtctgctgaagacttgtttcgtgattcatagatggcaccctctcactttccttagacggtgcaagggccaggcaagctccctgtggtctcttttataaggctactaaagtcttttatgaaagcagagcttcgtgatctctcacctctgaaaagccccacctcttaatgccattgcctcggatgttaggatttcaacataagaattttggagggacatggccgggtgtggtggctcacgcctataatcccagcactttgggaggctgaggcaggcggatcacgatcaaaagatcgagaccatcctggctaacacagtgaaaccccgtctctactaaaaaaaaaaaaaaaaaaaaaaaaaatacaaaaaattagctgggcatggtggcgggtgcctgtagtaccagttactcgggaggctgaagcaggagaatggcatgaacctgcgaggcggagcttgcagtgagccaagatcgcgtgactgcactccagcctgggcaacagagtgagactccgtctcaaaataaataaataaataaataaataaataaaaataaaataaaaaagaattttggagggacatacacatacagaccatagcattctcccagcttctgtttctatagggcaatgcaaaggaggctagataacatgtacatattgaggagttacattataggagaggaaccatgagctatgggaacctagtctttttcaaaggatagtaagcatgcctgtcttttgctgtaggtcaagacactgtcttcatcttccaagcctatatgcacacctgccctttgttctagagggagaaactctctctgtcaaggttgttgctatgtaaacatccttgcaatgagagtctgtaacacaggacagtcattgcttactcacaagacacgcagaagcacaagagactcatgaagaatagtctcccagcaaagactgctgggaattgagggtaggccctgggagcaagtgtcactgccttgcttttcactgatgaaatcagttgcaattctgcagtctgtgagaccagcaggtctggatcccatgggtcaaagtttcgcaaactctacttttcccactaataccctctcaatatttgctttatctttggactacatacattgtttagttacttaatattttactttaaatcaactcttttttaacatgtatacatttctttaaaaagggagctttatattgctactttaagtggaaatccagtatcattagccaaaagaaaaagtatccagaaaaatagatccaatgaaaacagagtaatgttattacattccagcagatattcttgtctggaggaggctctgagcctcaagtttcctttcttcatgttaagaagggagattagtggtaatggttgcacagctttatacattttctaataattattggattctgcacttacaatgtgtgaattttatggctgataaattatacctcaaaaaaaaccattaaaagaaaaaaaggagacactaaaatgtggttgagaactgaagttcattcaccaatctgagactttctttttgatataataagaaggattgatggggaatttggagttaaaaaatgttctcatgcatcctttctataattaattactgagcacgtgccagacactcttctgggcgctttagaatatattggtaaataaaatagacattctagtacagggagatgatggtaagtaatacacttaacacactggtaaattatacagtatgttagaagttgataagtgctacaggaaaaaaaaaaaaaaacagagcaagatgatagaaattgagagaactagagagcctccctgttgaaaagatgtcctttgagcagagaattgaaggacatgagaaacagccatgtggatatctggggaattgcattttgggcataaggagcagccactgcaaaggctgtgtggtgggggaatgcctggagtccgtggaacagtccaggaacagtatgtttgagtgaagggagtaaggctgctacttgtaggagaagaggtcatagaggtagttccatgagactggggagcagcagattgtataggtccttggaggcccttgtaaggacaaggcctttcctttttactctgcaggaaatggggacccattgaagagttttgagcaaaaggagaaataatgtcgtctcccatggcaacatataatatcttttcaatgcctttataagttatttaatatcttgtgagctgctccacactttgtgaaacattgtcataatctccagaaccacaggggaagcaattctgcctttcaggggagtagtaaccacttttgatgctgagctcaagtctgacttgctgcccttcattgtgcctgatgggtgttctactttctctcttattagtccctgctggagacattgctgatagccagaacttcaggaaagaatacatttatgggcctgatgacctccctgaattagagcaaagttatgtctttctccatatttatagtatagaaattctaatctcaaaatgtagttatttccttcgcaaaaaatctcacaattttcagtgtcagactagcagaatgggtgctttctttaacatgcatatgggctgttgtatttccctatcctttctcatctcttgtgactgactgtgatgttttttaccatcaatggatgggagaaatctgtaaaatcacactgtgtatataacagaatatcgtcatctaagtctgtctgcttcaggctgggtgcggtggctcacgcgtgtaatcccagcactttgggaggccgaggcggtggatcacctgaggtcaggagttcgagaccagcctggccaacatggtgaaaccccgtttctactaaaaatacaaaaagttagccaggtgtggtggcgggcgcctgtaatcccagctacttgggaggctgaggcaggagaatcgcttgaacccgggaggcagaagttgcagtgagccgagattgtgccattgcactccagcctgggcaacaagggcgaaactctatctcaaaaaaaaaaaaacaaaaaaaaaaaaacaaatttgtctgcttcagaaagtgactggctgcttttgatattatgtgttagggaggtggggcagagatgtactgtatcagaaacctcggccccctggggttgaatagagagattgatcttgaatttaaatagcgtgtgtgccagtcttcaccatccccccaatctctgattcttcaaggtcatctccttactttcacaattaattccatatgtcagggcacattgtcagatattgttcttttgccatacaagttggcctgggatttagcagttgcatgctcgctctctactttgtcctgttgttcaatgaaagcccacgtgtctgtaagagttctcccagtttctttcttgcttgcctctttctgcaaggccatgtgtcttttctggacaaatcacaggatgaagcccttggttttacatactgcaagctctcagtctgtgtgggttgaaaagtggtttgttttccttgtctaggatggtttctaactaagcagtttcggaagtttgggcatatgttttggagtaccttatgggagatagtttttccaatttaagatgcttaggaaaggttcttgtttaattataagcagaatcttcttccatgttattaaatggcccactttcctttttaaagatagtaaaatgtggaattcagcctcttctcttagtaaatgtcccctagaagaatggaatgtttgatggtattgtttggctctcattttcttctgatcagacctgtggcttccttataactactgcaaaagggccttcatagggtatctctttgtaggcagagccttaccatgtcttcctggtctaatttctttctcagtgaagtaacttctttccgttattacagtgagacattaatcccaaggggcgcagtcacacatctcataagggagctctatggctgacttgggaccaaatcaagagcctaaataaacttggtagaagaaaagtaggtgacgtttgctgacccgttggaatgatggatatgatttacaactatatggtgataaagtggctcagaaatattcttttgaagtcttattagctttgctctccaatgcctaagtgcccaatgactgaagtccagatatgtgggttgattccatttctttctcctcttctaggcttatttccattaagtgcatgttcaaaatcagggagtttggtttgtaagtatcatgaaaactttgagagaaccctgagagctcctgcaggttgtttccctgctattgaggtcttcagggatgtgtcacccgtggaatgttccttggccccaagtcagcatttgtcctcctgacggcttgcctcttatttctgctgtgttagctatgagcatcctttggcggcctacaactctggagaagggaggaagacccaactcctgtcatggttaccacttcatcagtcagtcaatatggttagacattgatgtttgtttggttttttagccccaaagtaataaggactcactgtattttgcgttctgactctttggttttgtgcagtgtccatgctgtagctttccttcctaatttccagagtttattacctcagactctgaatcaagcaggtggagattttttttgccttcttaattaagtttaaggagagagtcagctacttctttctcttggcagtggggaaactggtaaacgtggcatttgattaaaatcctgtaatagtttttacccacaacattgaaatgaaaaagtcaggtcatggagttgaatagaaggcatgccagtggacttgatgtccagagattgtatctcatgggcagtacttcaactcatgaataaaattgtgttgggagaaggtcttcagtgctgttgaacgtttctgactggcattagtgggaaagggtgggcatgaattgacaaggacattaaaacttttcctggtcagaaaattggtaagattgtgagatgcttgaggacaggaagtccaaagccttgtggtcttgtttagtatgcattcttgacatctagcaagtgcctaacagatagtaggcagtaattgtttctgtcttacagatgacatagctattctgtagtggtacccacttttgaactgactccagaacccatattccttttttcttttagagacatggcctcactgtgttgcccagactggagtttagtggcgcgatcatggctcactgcagcctggacctcctggctcaagtgatcctcctgcctcagccatctaagtagctgggagcacaggcgcgtgccaccacaaccatctaactttgtttatttgtttattttgtagagatgaggtctcactatgttgcccaggctagtttcaaactcctgggctcaagtgattctcctgccatggcctcttaaagtgctgggattataggtcagagcccttatttttaaccatgatactatctgcctcaaaacatggttgggcatccaagggaagatgaaggcattatttattaaaatagccagggctctctctttgctctcttgtccaatagcagagcccctagatatagccttctccttgcttccaagttttaatttactgaaatccagtttctagtgtaccctgatagactggataaactaattacatatgataatctatttccagagtcaccatggttggcgagccttatccattctgtcctcttcaacaggcataaccagcccaaagactggaaaatcttttaaaccttttcaactctttctaacatagggcttgatgttttgctaacaggctctttccatagtgtgaacaaattttatgtgaaatccatcaaaaagaactcatttttttcttgaagtaagtatgttgttaaaccagtatcttcacagaagttgaaccacacttgtattaattcttctttcaaagtactcaaggttacatctgttaaccactgtcttttaatagcacagataagttttagcaactgttgttttaatattgtctacattccttttttgttttgttttgttttgtttaaacaactttaactgaaatcagtcctacatagcaaacaaacatttagttaatgtaaactaaaaccttttcatacaacttggtattctcaggttacttatttgagccatttccaccatcgttaaatcttcacaagttgcttttgtttgcctcatgaaagttcaatatggataaacacacaaaaaaattctttgcggtaacaggtgaagattataatagctccatgtctatatatggaacatgatcaccttagcaaagccagacaatccagcctgaagctgtggtggctccacgtttctttagcgggcagtggtaaaaagagtatttaagatcggtagcattgtaccttgattttcaagttgatgaatgatagaagacttagaaaatggatagaaaacaattttatatatttccataggttaactcagcctctcatctaaatatgttgggattattttagttgcaaggggcaaaacgttcaacctgaactagcttaagtaagaacagcttcaggaatagttcgatcaagggtcagttgatgtcatcaggatgtggtttttgtcttttcatcttgcagctacccctactatgttggctccattcttcccattgctggcaaaatagctgcagagtcttcttcctgtagtttctgatagtcttgagactcattctgatgggacatattcctattcctctcaatcctagttctgtgactagagaatctagtgggctgattggcttagacctgggttgcatattccacccctggcattggagctggagcctcctcagaccacatgggctgtttgggggaagggatgggtgggatttgtctggaataggaggactgccaaggtggcaaacagttgaagtttaccatagtagattcatcggaaggaaagtcaagttacttgagtatttctgatctgaaaatctgaaatctgaggtgctccaatattcaaggctttttgagcataaacatgatgctcaaaggaaatgtttattggagcatttcagattttggatttgaaatgcttggccaataagtatataacacaaatattctaaaatcagaaatacttttggtctcaagcatttcagataagagatattcagcttgtactaatatgattgctactcttgtttttaacctattgtcacctgccctgagttgacaagtgacaatttgaatggctttgtcggtttaatgtatgcctccataattagttttatatatataggttaagattatcaccagctcctcctggcccatgggtaagttattttaatttattgtaatttaagaaacttataattaatatttcctaatatatattggtgttttgcttgtaataccagccttaaataaagacatttaataaaaacgtattcagtttatgcctttcccatcaaacatagtacagcctgctttataattaggatctcagtatttgttgttgattgacttatagtttcctcacatctgactaataaatgtgtttgaaaacccctctctggcgtgagctgggttgtgtaagagaatttcagctttttaattgttttattttattttattttgacacagagactcttgctctgttgcccaggctggaatgcagtggcacaattatagctcactgcagcctcaaactcctaggctcagggaatcctcttgcctcagcctcccaagcagccaggacgaccagcacacaccactgccaatttatttttaaaaataaaaataaattggccaatttattattaaaaataaaaataaattggccaatttattagtagcttggccaatttatttttaattgttttattagtagcttggccaatttatttttaattgttttgtagagacagcatcttgcaatgttgcccaggctgggcttaaactcctggcctcaagagatcctcacgtctcagcctgccaatctattaggattataggcatgaaccaacacgtctggccagacctcagttttaagactactcttttcttagctttgcagatatgctctggagatgccagcttacactgggaactggttaggctgacctttctcaccttttctcatcctatggccatcaagttactggaggagaattaagagacgaagtcattgtcctcgcttgtctatcacaagggtattaaaaccaccatcttctctttatggtccacaggtcgagtttgagtggctgaggcagttttggtttcaaggcaatcgatacagaaagtgcactgactggtggtgtcaacccatggctcaactggaagcactgtggaagaagatggagggtgtggtaagtccatcagacctgggaccgtgttttctgggctgctgtgttatacaaatcctccactgcctcatttgcttaggcaaatgtagatttaattattcctaattatcaagttagattcttcttggtaaggtgatgggtatagccaggattttgtcagtacaacctcagtttagttcaataagcatttattgagtattttctcctcatagggcatgtgctggacatatactatgaagtggtgataagaggataacaattcgaaaataatatttaacattcatttgcatttttatatgcatcaggtgctactctgttttctcagtattaactttaaaaaatttttacagcaatgctaagaggtatagaaacttttccaggccttaatttgtggatgtgaaaactgaggggcagggaaatgaagggcctcccccagggtcactgagtaagtggcacagcaaggtggaaactcaggcaggctggctccacagcttatgctctcaaccactgtgtcccaacagttgaacaaggagaggggcacgaatatcaccaggtatgacattagctaaattgaaatctggtaatagatgtgaaacgttaaaagaaaatcatagttccagaggagggagtattacattcagaccacttgagccggctgggatggtggtgaaatggcagatgtggtttttggggcccttggatgctgaggagtatgatgggatgggggatctggggaagaacattagaatccagaaactaaaaacaaggccagaagtcaggtgtgaccagagcaagtagtgcagatgatgtgggaggaaatgtagctggaaggcaggttgaagccacatggaggtcttgcattaagtcttaatttaaataatagtaataataataataataacaaacacttacataatacttattaagtaccagacattattctaggtgttttctgtaaaacttctttaacttttatgacaacccacaacataggtgtaatatattccccatttttctaacgaggagaccaaaacacaaagggtttgtgtaacttcctcgaggtcacccagctaataggtgagggagctggaatctgaactctagaaggctgcctctggggtccttgcccttcaccacctcactgttctgccttcaaacaattggatttggaatgtagtagaaaagtggtaaaagcctgcaaactctggagatagtacctctgcacagaatttgaaatgtactggaaacaatgaactaatctgcaaaaatggatagctattgctaatccctattttatttttttaaagccattttattggggtatgattgccctacaaaaagctgtacgtatttaatgtgtacaacctgagtttagagatacatgtaccttcatgaaaccatcacagcagtctatgccataaacctatccatcacctccaaaagttttcttctgtcttatttattataattattattattgtgataagaacacttaacataggatctaccctaattcctactttataataatgaaaatgtcaagtcacaactttgaaggccccagtttaaaagtctggatcagaatccaaaagtccttgctttccagacatctcaaatctttaaatcataccttttcatggatatacgtctggggaaggaatgttataatccttttaatgtattaatagtatcacaaaaattgatttctccaaagacctgaatcgatgcaaaactgagcattgtgaaactgaattggagttaatgaaaagtctgtgcctaaatctccttagtcagttctgttcctaaactaagcctgttatgagtactctccatttttatgggctgcttatataaaggcagcttcaatttcagggcaacattttttccccctactgtgtaattctgattttgtccatttacatatgagttagaacctcttaacttgatgaaccttggctctaagacatcagcttgactttgaagttgtaatttgacaactctgtgaattagagttgaagagcaaataagaaaggagctcttattgatttttttttttttttgagacggagtcttgctctgttgcccaggctggagtgcgatggcgcgatctcagctcactgcaacctccgcctcccgagttcaagtgattctcctgcctcagcctccctagtagctgggataacaggggcccgccaccatgcctggctaattttggtattttttagtagagatggggtttcaccatgttggccaggctggtctccaactcctgacctcaggtgatccacctgcctcagcctcccagagtgttgggattacaggcgtgaaccaccatgcctagcccttgattttgttttttaaaaaccaaattaaaaaaaaattgtttttgttcaagagcttttttttttttattttttttaagtaaaatctggcccagcatggtggctaatgcctgtcttctcagcactttgggaagccaagttgggaggattgcttgatcccaggagtttgagactagcctgggcaacatagtgagactttgtctctactaaattaaaaaaaattatccatgtgtggtggtgcatgtctatggtctgagctacttgggaagctgaggtgggaggatcattggagcccaggagttcaaggctacagtgagctgtgatcgcgttactgcactctagcctgggtgacagagtgagaccttgtctcacgtacacacacacaaataaaaaataaaatatttggtattgtgagcttacaagtgatattcattatgaattcatttaaggaatttagttatatctatgtaaatttgtgtataaataatttgaaggtggtggcacatgcgttaagaggaaatatctgttatttgttttgtcgctcttgtataaaaaatactaaaaggaaaagcaattctgcgaactctctggtgctggtttcccagaagttggcgtgtcatttctaagtgttctgagggagatcagtggcctcagtgtctctcctcagcgtgtcttgggatgatctttatcagcagagtgaagatttaggtccagataaaagggatgtttcttccaaattaaatgtaagcattgcttcaagccttttacagtgactttttacaaattcatagtgatttcttttttctattggacaagacagaacagaataattgttggatgaatctacggttctgtggttctgttcgtttagtaccatctggtatttgtatactcgggtggaattggcagtggctggttagatttctacttggtaccagcccacctcatattttctcagttgcaagcagtagggggcaatgttgagctaccagattgaggccccaagatgttagcctttcaggaaaacgcatacaaaaataccattaactgtcaagaattatccctgttgcttcaagttagctgtaatctccaagattccatagcacaggatatcagttgtgggttaacaaattcaacagcaatttaacataaaaagtacagtgtttggtgcacatttggattctatagcattagactaatccaaatggaatttctgagtgtcctcactttgcttccagggactatcttactcaaaattattatcattttagacaaatgattcttttttatctttatacttttttttgaattgtaaaatcgtgcgtgttgtggaaggatttctttaaatcaatgcattttgtctgttctgcaaaataacatcgatctcttttgctgagaaaataaaaaacctcagggaatatgtgcattacttttccccttttgcttatgagtaaagcaacctttatcggccctcgtaccagggaagagacttgcgctgtgatttctgtctttgtgctcttttttcactttgtggctgcaaggtgtagtctcaggaaggatatagaagaatggaaaatgagctttgaaatcgcttttcttccattaatggtaattgcttcacatgtcataaccagtcacatatttcaaaaagtttagtcagctgtctctaaaactcccccatcctccacttcccatttcctgtcccagaaaacaccatttttatcacactgtttattcttgccattttttctcccagcggatagttttactccatccatgctcttgtgatgtaaatgttaaaccttatatttgaatgacattctgataaaatatcacattttccctgaatattacctcatgaatttatgagccattaagcccaaagcaacataaccctttcttataacccaggaatttagtctggcctttcccctcctctttgctccctattgaggatggcattataacactataatactattcaaatatttgttttttattttaatttttttaaaacccgatgcacttcctacccccaccgcccctgccatccaagatgattgtattatgagaagactcttcaggataagagagagttaccatttgaaagaaactgtacagctgctttgctttctgggtaaagagaaatatgaaaagctgaagtctcctgtgaggtgggcaagtcttgctgtagccagagattcaatggataggccatttgtctctcagggtctggtatcgctctttgcaaaactgacatttattttacctataaaaatgttttaacactatcaaattcacaatgatacagaaaagaatgctaggtgcgaaatcctctaaattgatgacatttattcatttcctattgaccttaaaaaaaaaaaaggtcaatttggtataatccagtggaaatattcgacaatcgtttccagagtaaacattttcgaaagtagtgatgatttcgatactggagagaaattcttcttgctgttttccttggttttttcttttagaataaaaagtagatcctgatggttttgaatgttttgaattgcgtttcctgttctgacaattccttgtgctgttatagcaatgcatttatatggcagttggccttaataacctttattgactttagtgggtaggagccaagactggattattttaatgtatccgtttggaaacagtgtaaaacacaacatataattatgttaggtaagctataggctacatttaattctatccatttatgttaaaatttggcacaggagagcagagacatgtggaaaatgagtaggtgttttatttaataatgtaaccagtttcttgttgttaaagttttaagagagaaatgtacttaagaaggtaaaggttgtgcctgacaagttagttataatagtttaattttaagatgagtcatgccttttcccctgctattttggcctatgtaaatcatctgggaaggcccttgccaggagcctgcccatggctgtgtggatgagtcttcctcagcataggttacacttcatgtagtttacatagtcatagggaatgactgagccgagcagtagtttgtttatttttggagagattaatgaagttctcatcacagtgctttagattaaattctttaaaactgaatacaggaacaaggctgctttttcatttactgaaatttttactgagtatactggtatttgctattgtattatagttcaattagctaagtttattttaaacttccttctaggattgaagatttttggggatgtgcagaagaaagtgatggaaatataaatatcgaatttttttgtttgcattaatgggaaagtcaccaatttttgtgtgtgtgtgtgtgtataatttttttcacccttcttttcagtgttaatgtgcacattaagttacatcagccaacataatccagtctcccatttttcagggttagcatttctgatttaagagcagagtatattatagtaatttaggatcagatgtgagatgtctagtggttttaaattaaaatgtaaattctcttttttgactggggcagtgctgagtgactcaagataagcacagattagaggtggataaagagtcataagcatccaaaaattcagtttctgaaactggtgtgcaggcactgagttttaggacctttacgtttagctttgaaaatctggaaaaacgaaaaagtcacttgcagctggagcagcttaaaatctttggtttaaatctttggtttttggttatcttaaaggtgttcagggaagctcggttctttccattctccttcctacccacccactctaattccccacccactccaattccccacagctatattgttctattaaaagtaaaacatctggggagaaattttacatgtaatttagcagtgaatttcttataagtttttattccttttttgattatcttatgaatttcagagttttccatttttttccctgagtgtctgtacctttagtaaggaattttacaagaaagtgttgtgtatcctgtctttttgggaaaaaagaatatacaattccaagagaattcaggcttaagcctcaaaaacacagtgtgcttcgaaagcacaaaggactgtgtttatgattctctttgaagtgtttttgcaactggataaggaaaattttagaaaccgtctgatagtgttcagggtaaatacttaaacccctttagagaatttcacacacagatactgtgcagcagaaaaaagggatacttatgtttcttaaagctgctacagcctacagctttgtacttaaagacagaggtgttgaatagaattctactgaggatacatccagtgacagtatctccaggaacatcagagcaaaccagtgggtaggactttctgtttttaacccttacatgagctgtgtgagagttgagctttactggtaccaagtcctaggatgtgcctggtacatctcaggaatgttaagaggatcgttcctagtgcctctgctctgcacacaataggaacaacactaaaaatgctgaagatgctgagacaaagtgacaggagctaggaaattccaagtgacagccttgccatctctcttaactcttagtgtgtggagagaaaaactggagtaaacagccagggtttgtgttttaaccttgtttctgtaggatttggctaaattttgacaaccttcgttaaatatacacacgcacatgtgcacacacacacatacacacatttcacacattctatatgtaaagaaaaaaaagatgaattctgctgctttaaatagttttaaccaccctgaaattcaaattgatgtaaaggtgtgaagatcctgctattttccctggggtgctattttagccttggctgctagaattcattttggattgctttgactagcagactatcatagcatttcagatatgaattaagaaaccctggtgcaagattggaatgtcagaaatttctctttttcctggaaaagatataacataaaacaaattatgtaacttatttcatctagggtttttttttttttgtggggagcatggtagagggattaaattcagctctagtctgttatttactttattataattacctctgaaatatcctagaagaatctcagtctagaagaatgaagtagtgtacaaaataataataataatcaccagacctacagatttgaaaggaaaacaagatttccaaaggatgtcgtgccatttatttggaatattatcaagatgttagaatctttttcccccaagttggttaatgaataatcactaaaactgttgcctcttgaaaaatattgttatgatgatccaatgagaaagtttgtaaaatataaaacatacataaatgcaaggtatcaccagtattgattttaaaaggaagcgtggagagtcttcaactgaggaatccttacttcgaggccggttgaccgagtcttccttattgacagcatccctttcctttcctaattttccttcctctggagctggggttcagtccaggagctaaagggactcacaacaatttggaactcagcgctcctcttgcaatgcgtctatccactgtgggttaaatactttgagaggctgggctgggaatctttccatattgtacagaaatgtctctatggagaaatgtactcccagtgccaaaaaatgacttacagagagccccgggaacacattaagttggcccttccgtgccttatggtaacataaccaccatcctgctccctcctcattgacatctgcaaaataatgacccttttttaaccaaagggaactgtgatctattttttttctgtattcctgaaaggatctctgtgattatttgtagatgatatttttaatagcatgttttccctaacaagttaaatgtgattgacatttttttttgcattttctttgcatgatctcagtccatctggaaccacctgtgacagtctcaattgtaaatttttccttcatatgtataaaaatctcaggcagatcatctcctacttgtttcttttaataccgctcaataaatctcctacttgtttttgattgacaaaattagctttcaactaaaaatctggagtcttcgggcactattcataattaaattttaatgttttagacatatctgcatagccatatctgcattggttataaagacttagagctggtggtagcttgagcatatatagccctcttattaaatattattaattgaaatgacaaattatgaaatatccagaattatgcgtcagatgttctttaacagatgttgggggattaagaggtttcaaattttacttgatgacataaacttttcatgcagttagcagtgacattttttaaaggatgggagtggtggcatataccaatgcttgtaatacattaatatgttcttgatactgaagtctcatgtcctggatacctgaacattgtttgggaagggtgggcagtattcagccatccagtaataaatatctcaaaggtaccaaatccaaaacccaagttttgatttctgtagtccctagtgtttcacagttcagtaatttgaactgtccagttgcccagactaaaaccttggagtcttcttgatgtatctcttgatttatcagtgaatccagttagctctactttcaaaatatactcatgacctgactacccttcactacctcctgtgctaccaccttggtaaaaactaccatcgtttataaaatagcctctcaaccagctttcctgcttctactaccctatgtccatcccagtcagaatgttcctttgagatacaagtcaggtcgtcgtttcactcccctgtttcaaacctactatcatgtttagaaatccaccttccttgcagtggcctaatgccctgcaggatctgtccattcctcgacctccatcagtgctccccctctttccctcccctaatgtctgccttactatgtctagaacatgcccagcccactcttgcccaggatttttgcatgtgccgctgcctttgtctggaatgtctgtccttctgtaatttacatgactctctccctcatttcattcagatctctgctcatgtcactttcttggagagagttgctctgaccaagcactctctcattgtagcagggccttactcttttctactgtactcttaacactttccaccaactgcaattatcctatatatccatttgttgtctgcctctacctgaaataatctccatgagggcagcagggacttggtctgttttagtcactcttatttccccagcctctagaacagcatctactgcataggaggtactcgacacatgtttgttaaaagaaagagttcacgtgaggtctgtgttctagtcctgccttttcctcccacccatgttgatcagtgtggccttaaatctttttttgggacggtcttactctgttgcctaggctagagtacagtggtgtgatcatagctcactgtagcctcaaactcctgggctcaagtgatttgcccacctcagcctcctgagttgctggaactacaagccatcatgcctgactaatttatttttatttttgcagagacaggttcttgctgtgttgaccaggctggtcttgaactcctggccttaagtcatcctctcaccttggcctcacagagtgctgggattacaggtgtgaataacagcacctggccaataaattctttttaactttatacattttcctaaaatattacctcttattacctgcttcacaggaatatttttgggttagttttattcttaaacaaacataactctcacaataataccccaaaacgtctttaacttctttttaaaaacaaaataatactgagggcacagaggacagtcttgttttatgcctctggcatttatagctgagaagattgagcaatcacaggcaaacaacttatgcaaatatggaaaatctttttttttttttaatgagaggcttaagtaggttattagtttcccagagtaccagtgttgctaaaagttagaatcatagtgttttgtcttatttgtgatcatccttcatattttagatttccctcttctggaaaaacttagtaaattgtcacaaaattaaatgacttctccaacaaagcttggactttcttgttacaaattttcaaaattatatagagaaagcagcatggactggacaggttttgggcacaggactagggaagtccctgaggagtaaactgacttcctctagacaagctgaaaactgattaaaatatttatcatcctttgggtatgcaatagcttttgatgatggaaggcatattaatattcatctttgctgcttgtctacacttcagacagatcccaggaaaggatgttcagatgaccagttttctttcctcaccaggagtccttgagaaaccagtacagcttggaaccaagaaatgccttgtgatgtggattgagcttttcctttgggggacgggaataggggaatacaaaccaggggagacctttggactggaaagctttaaaggatgactgctttcacacaggaagtcttttgctagaacaaaggaaaaagtttggttgtaattctataagcagcagaactattattgcttatctgaatacatgaagctgacttcattccttaggtaaagtcggaagattgaagccttataaaagattttgatgtgaatgccactgggggctgaagatttttcttcctccccaccaacccaccccaccactttgttgtaggagagaaatcagttgtgtttgtagccgatgctcaggtcttctgactggttctagagtgccccatctcccttttgtcctgagacagaattcgaatgcatatggcatccacatagcctggcataagtagcacagggtggccttctgggattctcaggatctgtcttttaatttttttttctttaatgtgagaaagagtctggctttattagttgagttaattaagcagtgttgttttttgtctaggttgaaatagccttgattacatttttggatgcaaataagacctctgaaagaactcgatctttatatgagcagtctgaaaaatctgaaagttaaatagaatattctcaaaaaaagggcaatgtgttaagactcttggtttccgtcttttaaatctgaaaattcagaatcctcttctcttgcatttcagtttttattattccacactactgagatattttgatgaaagctagccttaaacattggataataattatatttgaaatctattttaatatagtgacatcagaagtgctctttcttcatcccagtcatttaatcattcatctgctcctttttttttttttttttttttttttttgcagataagtgtggagttatacaaagagctaggacttatgtctcccaggttgataaggcacaaggcagtaagtaattcagaggaagaaaaaggagaagagcagattctgacagaggcctttgggaatacgaaggattttgatagatggagatgggtggagaatattcaaagatggcagaagcagggccatcgcagtgggaaaacacagacctgctcgcaaacttgattagactggatggagtttggtttgtgtgagtccagcagctagagataagattaggaagattagcaaggacctttttttctctaatgcatttctttgcaaggtatggcactttcaccccttaatgactggcttcctatcaaagtcatgggaagcaaagtgctaaacatgtgcaactaaaaataaaatgaaaaccgtttgattatcttgcacttgcaaaggttttactttgaaagcaagtcaaattcagttatttgcactactttcaagacctgtctgctttgtgagtacagcaaacaagcaacaccatacatttttagaatgagaattacaaatgagattaggtaatttttctaccaagattctttgtttttctctgataaattgaataccagcttaataattttggactttggtcagaagcaggtcttcccatgtatgaaccacttatgattctcttccttgttaggaaccctaagtgtatttcatttgatcttttgctattagagttgtggtttggaagaaatgacatcttcattgcctcttgtccaggtgacagtcttgtgaactcaatacttgcataaaaattattttgaaataaagccaaagtgtcattcatgagctatttgatttggttcaagagagtggatgtggtcttctctcacttccactgctgaaatagagtggtttctttcccacacatacctctccactccttggctaacagtcccacattagtgattgtgcactctctgctgtctctatttgccattgcacttcagcttgtcagtcacaccaattgaaagactgagtaaatgttcagaacgtaaatggccgttgttcactctggtctttcccacctttgcacataaatttctgctagaccctcatgttttccctctctatgtgatgctgttattttccaatgactggttttattacttctaaggcacaagatgttaattgttgagtgagtaataactctcagtttgttcttcaaacgtgggcttctgaaagattgcctttactttgattctgcttaggaatctagggtcttggggtaaatttagaggccactattctccttaaatgatagtgacatagagaaatgatactatgggactactgtttcattttaccaaagaaactgaagaaagtcacaccagagggtcattgctcccctagagaacaaatgggcttcaggctttttagaatgccttcttctttgatatctcattattgctcataatgccagagaaacaggtaacgtcggcatagtgatattgggcattgcttaatttctttcaaggcctgaaacatttatcctctcttctttatatattaggtattcaccctaatggtactcaaactgctaggctctgacaagctgaggtccaagtgccatggcattcaggaatgtcaatgttggaagggacctgagaggtgatcatcttctcttcctttttggaaaggaaggactcagaaggatgtaggcttttctggagggcatagagccagataatatagaaccccagatttcccagttcccagttcagtgctttctactactccctaaatatccatggctgtgcttgggatatttctctgatgcattcgccaactttcaacggtgtgccaatagcaaaataagataaactgagtgtttctctggaactttttctctaccctgtgtttggacctggcatatcaaaatgaggctctctggtgttgagatggacactgtttttgctcacccagcattcattcctccttctctggcagcatcctcatgttgccttgtggagccattttcttcattggctagagggtgaggtgcattgtcttattctggctactccatgagcatatgacctgagccagatctttcacatgagctttctcagagctgtttgcttataaatatacatacaatatcatagacacaggatgcagaattcaaaagttatcaacgtggccgggcatggtggctcattcctgtaattctagctcttagagagactgaggggcgaggatcacttcagactaagagttcaagaccagcaacatagcaagaccttgcctctacaaaaaatgcaaaagacttagccaggcgtagtggcacatgcccgtagttccagctactcgggagggtggggcaggaggatcacttgagtctaggagttggaggttacagtgagctgtggtagcaccactgtgctctagcctgggtgacagagtgagaccctgtctcttacaaaataaaaataaaaacaaagttataaaagcctatgctgtgaaaagtgtgtttctgtcccctcaatcctccagccactcattcccttcccaagaggctagcactattcttagttctttccatacctttctagggatattctagttttttttttttttttccttgagacggagtcttcctctgttgcccaggctggagtgcaatggtgcaatctaggctcattgcaacctttgcctcctgggtccaagcgattctcctgcctcagcctcccgagtcgctgggattccaggtgctcgccaccacaccaagctaatttttgtatttttagtagagacagggttttgttatgttggctagactagtctcaaactcctgacctcaagtgatctggccgcctcagcctcccaaagtgctgggattacaggcgtgagccactgtgcccagctaagatattctatgtagttacaaacgtttatgtgttttttccccacatggataacactatgtcttagagattgttccaaatttgtatgttcttttaaattactgtgtagctttttattgtatggttccataacttatgtaaccagacttctactgtctttagtcttctgcttttacaaataatattgtagtgagtatcctaatacataacgtttttcacaagtgagatctatggtaattaatacctaggagtaaaattgttggatcaaaggatgtgtgcatttttaattttaagagagatggtcaaatgccttccatagagtttgtagcagagtttatatgtgtgtgtgtgtaaatgtgtgtatttgtagatatatatactatctatatgtatgtatgtagagtttatatacatatataaatgtgtatatttacatatagattagtttatttacatatataaacatagacaatatacatatatgttatctatatacatgtgtatatgtatctatatttacatatagatatatgtatatacatatacatatatgtacatgtgtacatatgtgtccatataatgccagtttcccaacatcctcaccagtgcagtgtatcatcagacttttttgcaagaatgattggtgaaaaatggtgccccatttccatttgcatttctctcattcctgttttactgagaaagaaactaaggctcagatgtatgaaaagatttgtcaggtcataggagtagggagcaacagagctggggtttgcactgaggtgggagcaactgttctcttaattgctataataatctttacccaggctccattctgttactgcaactgaagaatcccaatacatatagcggttcccatgaggaacacccatctgtccttgactggtaaatgtgggaaggttgttctctttcaccatggacttgtgcgtcaaatcaactgatcagtctgggtgatgggtgcggttagcgtgacatgcagtgatgttattacgtggtggaactgagttccacacgggatgtaggtggccctttatgtaccctgctgagttctaggcctttgtgctataactatttttggcaatggaaggtgaagggagggctccccatccctggaaacatggcactttgcctgattttctgtttaaagttatgttcctgttggaatctgttcaggtctgagtttcagttgtcaccttctgatatgatgagcctccttggcctctcctgctcgcctcgttcttcctccacctgtcagtcttcattaggatcatttaaacactgactcattctctgctctgggccttttcctgcttggctatggaactgcaggttgaagcctttaccttgcacacatagtttgttaggtaagagttttatttcaagaagactttgcggggaactgtgatgactggggagtggttagaacaatattttctaataaagacaaggacgaaaagagatctcagcaggggaggagagctttctttgaccccttactatatttgagtgggtggacactaattctcaggagttgggggccttactagaccacatctcttgctgtgttatctcatgctatgttgtaaagtgagcatctgttgctggctgtatgacccatgtgatcagccactccatcacctttgaagtggtcaggcttagatattcttgggttaagagctttagctttcaagttaatcaaactggggtttgggccctgacttcatcattttgttgtgtatgacagtggcagtcatatggagagtctcaagtttcttcatttgtaaaatggggataataatagtatctcccttagcagatggttgtgagatttgcctgagataatacatgtagtgttttgtccattgcctggcatcttttgcatttttgctttgaatctacttcttttattcctcccgccatcctgctaatttggtgaccccttaactttcacctgagttcctgttgctccttagactctcatcttaggtttgtgcatatgtataatccatgctttccattcagttctctgttcaaaagtcacctcacagtggccctttctctttttaccatgttttatttttttcctgagagtatttatcactgtccgaaattatgttttatgtgttcacctattacctgtgctattctataagcaccttgagagcagggactctgtctcacatactgctgtgttcttggtgcctgaaacaaagtcataacacaacacatattggatgaacaagtgaagaagcaaatgtttcatgggtgtacgctctctctgaggtgcacccttttatgctagtggtgctttgtttgtgatatttgttgaatgccttgctcttccttctttttggcgtaatccatttgaaaaactcccttattttaaaagattcaataattatccattactaactgcagaaatcttatctttttcaccttctctggaatgtaatttctctgcattagactctgtcaacattagcatctatatcaaagacacttcatgcaactttttaaagacataagcaccagctccaggcatcggggttcagtagccatagctctcgatcttggctgcatatttgaaacacctaggacaatttttaaaatttttcatcagttaggtcccacctccagagatacagatttaattggtctaagctgtgggtcccatgtgattctaatgtttcaccaagttgcagtatggttcaaaacctcccaagtaatcctgacatgtgtttagggttgataattactgttcaacaggcacctgacttctcaccaagttagatttgattgaacggacgaatatatgaacagattagcgaatgaacaggaaggctccctcactttaaacgaacagagaggtattgagtgcctgctgtgtttccttcattctgtgggggactcgggagggaaacagctatgtttatgattcttatgtaaggtggaagatgatgttgataactatagtagaaacagactatgaaagcttggaagatggtaggatacatttaggtggatccgatttcaaagcttcacagtgaagcattttgagttgattcttatagaatggagagaattttaacaggaggatggacatgagaaaagagtggctatttcctatggagagaataacgtgtagagtggtagaagcaggaagatgcaggttatataaggcttctaaagtggaccagtggctgtccgttcccccaaactagcccccttctagagttccctaactgaagaagcagcaccactccacatccaggtcttcatgccagaaggagaggaatccttcttgaaacttccctctctccaccccaggtaccctgtgggagaactcttacctttgaaatacctctcaaagttgtctgcttttcatctctcctgctaccagccttcctctgggctattgcagtagcttactctatggtctcctatactcttcacacagcagccagggtaatattatcatatgcaaatctaatcatactcctctctgtgtaaactcattaatgggttccacttgctcttaggataaagactaaaatatagatgctcctcaacttacgatgggtctgtgtcctgatatacccattgaaagttgaaaatattgttaagttgaaattgcattcaatatacctaacctacccaacatcatagattagcctagagtgacttaaacatgctcagaacgcattagcctacccttggcaagatcatctaagacacagcctattttataataaagtgttggatatctcatgtaatttattgaatacagtacactgtagagtacagtattggtggtttgccctcatggtagcttggctgacggggagcacaaactctctgccacagcccagcatcgtgagagagtatgggactgtgtgtcgctaacctggccaatgatagaaatgcaaaattcaaagtatggtttctactgtgtgcatatagcttttgcaccctagtaaagttgaaaaattgtaagtcagacaaaccatcataagtcaaactgtcataagtcagggactgtctgtcctttatcctcagcccatcttttcctcctcacctttcctccaaccccttcactccctgtattcctaccacaatggccctttctcaatcagtctaatcacatcatgctcccttcttcttcagggcctttgcacacgtcatttgttcttcctggaatgtcttctctcaccaagagaggaatatatttctactcacttttaagataccagctcaattactccttcctcagtccagactcccttgatctgtctgactagatcaggtccctgcactatactttaccattactctcatgaaagccatgcttgagagctcaagctttattctggaggcactgagattctatggcagatagagtttgagagtacttacctgtttcgtgaaggtccagtgctgctagagacattaaagttgctgaagtggtttttggtcatataatttgtgaatcttattaaccatcccttgacaaagaactgagaattgttgatcatattgtaaaatagaatgtaaatggccatgcagtttctttgtatagattctccaaattattggaatatgagccaattccatgggattaatttaggtcctattatctgcaataagacatcccttgtcagattttcgttgtcaggggcaagtctaaaatgtccaaccattgcatgcaaactcgtagtaaagccattgtctagttattaacaaatgatgagcaggtgagtgaattgacaggaattattcttttgggatgttgcctctggcagaacctcagttatggcctctgtcattctcccttcctaatttcattatcttccaaatattattgacctcagatgttaagaaaggtccaggttcctgggggtcggcacatcgttccttcttttgccagatataagaaactttggggaccttggctaccagccttttcctgtcaggaaggtctggtgccatcctctttgatattgccctgtgcctgtctaggttggcagtcttgtgacaaatcagtacctgtcatggcccgtgggtactttggcacttcagagccatgcagaatgtggacagtgggtttggaattgtcattgagatgccactttcttattcttcttgtgttggtgcctagagtcacaatccggcctgaagggccaggaggttttctggcccagggtagatcccccttggcccacgtacaagaatcttcatgctgactgagttggaatctcctggtgagaagtgatttgttgtcctgatgagaatgtaaacacttgctaaagttgagtatcgtttctcatgtgagttctattatagccttctgtgtttataaacatgtcttgagcatgagggagaaatgtggtaacctttgagtccccaagaaaatgttcatttgttttctctgtgggctgaaattaagataactcagcatccttctctgagcatcccatatccctcttgcttttcctagcaggcctgggatgatgcccagtttgccatttcctaattgttccatcctcttccagtagagtctgttatcttttgaaaaagtacagttcatattcagcaggcatctaccagcggggctcaaagtccagggaagtcctcagtccagtctaacaaactgttattaaatttttttaaaggtttaaggtgtcgaacatttgagaaaacagagttgctgcccttgtgctgctcacatgtgtgttagcacatgtaacagacatatacatgaataaggcatgatgtgcagtggcaaatgagggggtagaaaatacatgttctgagggtgctgcagagaacagaagtcagattcagaaaactgggcaagactttatggaagaggagtgcctttcaattgtgccttgaaaggtgaattagattttaacaggcagagatttggtgggtgaaaaagagggacagagagccccgccttttttttttttttttttttttttttttttgagacagagccttttttttgagacagagtctcactctgtcacccaggctggagtgcagtggtgcaatcatggctcactgcagcctccgcctcccaggttcaagcgattcttctgcctcagcttcccaagtagctgggattacaggtgcccgccaccacgctcggctaatttttgtatttttggtagagacagggtttcaccatgttggccaggctggtctcgaactcctgacctcaggtgatccgcccgcattggctttccagagtgctgggattacaggtgtgagccaccacgcccagctgagagcctctttttttaaacaattttttttaagggacaggatcttgctctgtcatttagactagagtacagtggtataatcatagcttactgcagcctcgaactcctgggctcaagcgctcctcctgcctcagcctcccaaatagctggaagtatagctctaccaccacacagtctagctactatgcccggctaatttattatttgtggagatggggtctcactttgttccccaggttgggacggagcccattttagacagtacaaacaataggcacaagagggatggctctgtaacgttagtagggcatatttgcagaaaagtatgtggtgccttgtaaccagtacttccggtacctaggtggggtagaactagagaacaagtagaggggggagaatggggccagctgatgaagagctttgaatgatacacttagaaatttggcctttgttctggagacagtggttggagctggattcaaagatttttgagtaggaaagtgatccaatcgacccattcttcaaaattagaactggtagcagcattgtggatagactagagaggagaggctggaggcatggggacctgctgcaaaaattttgctgcaaaattatgaggttctgaaccagggcaataattggagggaattaaaaggggtggtaaattcagagtttttgttgattgttagtttgagactcagtcttactgtgtcacttaggctggagtgcagtggtgtgatctctgctcactgcaacctccgcctcccaggttcaagtaatcctcctgcctcagcctcccaagtagtggtattacagatgcgcaccaccatgcttggctaattttcgtaattttagtagagacgaggtttcgccatgttggccaggctagtgtcaaactcctgacctcaggggatccgcctgcctcgacgtcccaaagtgctgggattacaggtgtgagccactgcacccagcctgttttgtttttagataggtacatagaattcaccatcagtctggatgacagagctgagagatgatgaagtcacaggcaattttacaagatttcttctagtcttagttattagatggatggtgataccatttactgagctacacccaagaaggaagtttaggggcaaatgagtttgagcagccggtataccgaacatctcagaagagctgaaaataccagtttggaacttggtagagacgtcagagccaagcgtagatttgggagtttgatttatgtctgcagtaggcattcctttcatgcctatcatgtgccaggcagtgttctctcatatgttaactcaggcttgaaagcacttagcacatggcaggcatctccacagagacagtggctgagcgattggagtgagtaagagagaatgtagtttcaagagtaaaggagaacaaagtagggtgacctagtctgaaggacaggcgcagaacagtcagtggaacagccagagatagcagcgagagaggtgagaagaggaccaggagtaggtggtagaatggagtggaggaaagtcagcgaatgtaatagtgtcgaaccctgcagggaagttaagaagtggccataccgttgcattcatcatgggaagaatttcagtagaatggtaaggacaggaggacaaggtgggggaagataggtgaatctatagatgcatttgtgtcatctgatctgaggagacatttctcagaaaccattctgtgtggcactgatgtttacaggtcaacctggaggttcctgagaggaagtgcactgtagccagacatgtggtatcccagctagctttactctgttctccagaaatcagcctgtaaacattcagttgcctggtagctgactaaatacaggctaacctaaagccttaaacattttaatttgcaaaacctttgttgtattaaatcacaaatgggaggcaatttagcaatgcatctctaaaattgcactgggctctggccgtggttttgcaatttatgttgaaaacgaaaattgaactctgtggcataaaaacagattgttgattttgtgattaatttggtctctaaggccaaggaaactgttaatgctgtatatcagttataaagttgtggtagtatttgtggagcaaaatgaaaaatcaatatcgtaactacaggatagctcttttaaaatccaaggtgcattttgttgcaaattgcatggaagaaactgtcccccaaagggacaaacataccttccttatttcacaagtgtgtgtctgttgtggaaaaacagaggaaaatggttgggcattattacagtatagctgggggtactaggagaaggatcaaattgttcaatttagagtaaaacctcacttacagttacctgtgtcctaaggcaacctccaggagtaatctctaggagggttgtgagtcagaagtccagatacctgggtaacactttagcctctgctaatcacttgctggtatcagatgagcctcttcccctccctggcgtgttttgtggttttatgtgttaacttcagagatgcactgacatgcgtcagtgaaaaaggagtgtcttccattagcatcattatgaatactacaccaaaggggtttgtttatgttttccattcctagaagtgaatagacttcttttctattaagcttgtgtatttagagaggagtgtggggaaattctttcttgttttgccttttgttttgataaaagcaaatggttcccactcgccgtagaatcatcatcaacagattgcatggggaatgttgaggttggagcctcttcttaatggggattttgagaaccaggacatgacttgttcaccggttcatttctgctggccatgatgcttagatgagaagtagatctctcaacatccaggcacatttgttctgcgattccacctaccattttcctgggtagtgctgggattaattaagtctgatacgccatccagttgaaatttactaccagcttcttagcctagtatatattatccttacaagtcaggcctcaccttgaggtcagaagaagatgcagcttgttcaagaaagaagtgttagtggaaatacgaagagttccttccagtgaactgtgcctcaagtggcctttgtaaactgcttctgttctgtgtgacttataattatctgagagctgggggttttgtggtagattttctttgatgtatgggcagtggtggtaatttgtttctttcttcccccttctattttgctttgcctcatttcaacttaagcaatgaattgtgtggtcttttataatatagagattagtgtagccatttttagccagtttttatcatctcccttaggagctgactctatgcaaaagaaacacttctgtcttgtcagaatgacggtgattaccccacagtttggatcatctccagcagctttgttccctgaaaagcgaatttgatttgatgaataaaagtttggtgtatttgatgagtcagagggcaggagaatgtccttgtctctgatgaggctcttacagtcagacacattgaacatcagggataaaataaaccttaatctctgaaggaaaaaccctggagcatgaaactgttcccactagaaatgctgtaaatcttgcaaaccatgtaggttttctgttgggggcaacatcaaagcccagtgactttagagattaaagtgtatttgacaagcaaaactttccctgtgccttgctctttatgagatttggcctgtctcttgcctttgtttcacctcgctatgacttcctttcttcctgagaagtaggaagtatcacctcaagtctggggtaggcggccatggtttgttcatttaaagccactcgtagacctggcgcagtggctcatgcctgtaatcctagcactttgggagtctgaggtgggtggatcacctgaggtcaggagttcaagaccagcttggccaacatggtgaaaccctatctctactaaaaatacaaaaattagctgggtgtggtggcgcatgcctgtaatcccagctacccaggaggctgaggcaggagaattgctggaaccctgggggcggaggctgctgtgagccgagaccacaccactgcactccggcttgggcggcagagtgaggctctgtctcaaaaaaagaaaaaaaaaaaaaaaagctggtcataggccctggccacagtccctcggccttctcgcattgtcctgccccagtggaggacagcgtcttctcacgatcacttcccagggactctcttatttgtggaagagtttcagagccttttgctgactcgaagaagatcaaaagacaggaagacagtggtttgcctcagcttggactttagcatttctgtttcttttaaaaccatctcctgtgatgtcttagaagaaatacttcttctttctttcttttttctttttttttttgtcctgtttcaaattctgtttcggagttctcagtgctttctctttcacacattggaaataaatgactgcatttttgttgaaataattttttttttgcagataaataattgtttaacagaatagaaacttttcttcagtaacgtctttttttggaaagtaagttacaagattttgctttaaaaatacaaactatttttaaagaattgtactctctaaagtcaaacattcctgcctcctgtcaagtccctataagatctggtctgtggcaacttctcagggtggtcagatagcaagaggaggacagattgggaaggcaaaatggctttaagggtaaaccccacagcgtaaaatctcattactggaaaagcgctttgtgtttaaggataggtattcccgtgtggaaggacggccatggcgaatgcttaagggactcactaaaatatcttaaattgtctccgttaaacatgtagcatccttagaggtcagacagagctgaaacttgaacagctgtacaacaagcatctgagattgtttttaattgtgtttcctttctctaacagcagtaattcttgtttatattgtcaagaacctttccactgagcacaagcgcaccatacttgaaggtcaaatgcttaacccttctgcatggttacaatgaaaatggacccttttgttttcattaatgtataccccagccatgtctacagggagaatgggggccccaagcgttcaccaagctgaagcaacttattgtaaaagagccacaaagagagcatatttttgtttccatacaacagttgtttagcttttgccttgtgcacccaaccataagacggtatgcttacttatcaatgggcagaattttgggggaccattttgttcctttgacctgtgttactttttactgacccaaccaaattgcttaaaaattttccctttctgctgtcagtgtttaaagctgcttaatgtctctgaagtgatcccttctttctttttaacactttacattcctgtttatcacagcacctgttactatagtgaaccatgaaatcacaaatgctatgcagctcttattgaccaataatactttattaaatataaatagagtatcctcccagcttctgtatggtgtataaaggtctcagtatatgaagacaaatgcacatatgtccataggtgcacatgtattgtttggtgggcaacaatcgggaaaggaggatgttttatttatttgtcaggcaagaaatgtttctttttctgctccttaagagttaaccaaaactaaaggggccagttcagcaaacactaaatgtgagcctccaacatgaaggcatctttgttactgaaacaaaaataccacagcaggtggtagactcgaacacaggagggaggaggaggttcagttgttgcccatttttctaatcctttcagaatacccattgtctgaaccccaaagttaacatgttcctgctcagtctcatggagacaatttcagcgtgaaagggctgtgcccatcactggttttcgacaacagtttaatctttgggtatggaatgtgtaaccactcaacaaggcaggagaggcaattgtctgtctgagatgagccaataatatctgcttatcaaagcataaaactattctggatgtggcaagtcagagttaagtaggaattcatgccaaccgcagcagtagtttgcaggttttagactgtattaatcaagacagaaacatgacttttgttgtccttggggcagctcaaagcaactttgtggcaaccacactggctttctaaagctaaggctaaactctgcacagtctgcatctatttatatcaaggtgcttcagtggggatatagcttttaaaatggattcataattgaagttggaatattgttttcattccctaaaactgaatgaaatgtagtttataactctggacctcagagtgccctacctaagtgggaggcattaaaagatgagttaaggggcaaaggcgggctagcagactgatgcctattactgcttatgatgaagggtaccactatccggttcatatgcttgggtctctctgtgttctcattgagccatccacaatcgtttcttttattctaaatcaccgttggaatgatataagaaaatgaatgcagtataatgagaattaaaaaaataaatttgtaagaagtatagagttggaaatcttgttcctataaacgtaagacacaaattctaatgagcttatagatggtccgtaaatcacgttttgctcatgtgaacattgaacattgggtattctttcctaaccagagagaagctacgattctgctgcctatgccacactttagatggaatgatggcctcttttagtggcactaaatgtatacacagagcactaaacatatacacagagcagtatctgcaaacttaaggacttgtgtgatcttctggataatactagcactcagaagttaacatttcatctgacgcattcctttcatatgtagtattcataaatgtgaaaatagccttaaatcattattttcacccttgacctgggacactatagctagggagaatctctgggatatctggaggggagctaaggctcatcaactatttggtggttgtctttctgagtttaaaaaatgatgctgtttactgtgacctcaggtgtctgtctgtgtgtccaagtgagactgtagtcggggagagtccctgattggagtctcagtcaccagaagtccagtcaccacttcttccaccagtggagactgtctgtgaaccctagtctgtcagtgaaaccatggtcaagggcgtagcatcattaaccccaattctgccagccatccttactctgctaccccatgagaatctgggccactcattgaacactccaagcctggattccttcacttggaaaatgagtttgctgaagataccaacctgccgtgtcagtttgttaaagggaatacatgagatgctgcattcctgcctcacagaaagttccttatagtttgtcatttcatagtttaggaggtaagagagtgaactctactacccactgggtttaactcttgtccccactacttatcagctctgtgatctgaggcaagttacttaatatctttgtgctttgattttcttttctgtaagctgggataataataaaaccgatttcactgaattgttataaggatttaaattggggttacatgaaaagtgattaggacagggcttggcacacggtaagtgtaaaataagtaatagttattgttatgtttttgttattgttgttgacacatttctgattatgtgttttaggtagtcattgtgatgggtttttttttcatggctactattaatatgttaataaatgcactgatatttccagttaataggtcctgaattcctatttgagagccataccacaaaattgagtgagtgtgtgtgtgtgtgtgtgtgtgtgtgtgtgtgtccatctgtccatccgtcgtccatctcctctgggtaaatatgtgccgagtagcaggtagttctgacattgaagactctgtagacagtggcgtttaggcagggactgcatttgtcttaggtagatattatctaaggacaagtacagcaactctgcccgtgtgattttcactgaattatccttttctaccagattgttattttatttaagttttaatcgttacaatgtcagtagcatgagcttagtgagacatagctttgacctcaggaatcttaagaaaaataagattattcttatcttaataataatagaaaaataagtttattaagagtgggccgggtttgtggtgatatttgttagttatatctttgttcctacaggtctacattttagttccattgtctcaaaatgaaaagataatagcacagtcatgtgttgcttaatgatggggatattttccgggaaatgtctcattaggtgatgttgttgttgtgtgaacatcatagagtgtacttacacaaacctagaaggtagagcctactacacacctaggctatatggtgtagtctgttgcccccaggctataaacctgtacagcatgttactgtactgcacactgtaggcaactgtgacacaatgataagtatttgtgtatctagagatatcgaaacatagaaaaggcagagtaaaaatatggcatgataatcttatgagaccactgtcatatatgtgatctgtcattgactggaacatcattatatgacacacaactctatttagcgaatcagtattaaatgataacatgaagattatgataggcaaggaacaggacattctagtagagcagagtaactattttataaatcaaaatcaaccctaaaagcttaatcaaatttaacagttattttatgtcccccttggtcatcctccaccctgtgtatatgttgtatttcccagcatagattgtaagctcctagtggccaggtattgtgaccttctggatgtcttctgtatagcagagactcaaatgtcattgattggtttatcacatggcagtttaccttcagtatgttccattccatatgttctgtataaaccgtgctgggcctggagttagaacacctggtttctagtctgagctcaacttctttacaaactttgatattaaagagttacttaatttagctaagcctcagtttccttgtctataaaaatgtgattaatacttgctctacccaacacacatagttagtatgaggatcaaatgagatgaagttaatgaaagcactttccgaactttgtcagtttacgtatatgttagttttgggcacaggcgcctgatgtctgggttagatttggctctgttgcttactaatgatataaaatttgacaaattacttaacctttctgagtctcagttttttcatttgcaaaatggaaatgataatacctttatcttatagacttatttttaggattcagtaacatagtatatgtgagcagcacctggcatatagaaagcacccaataatgttggctgctgtatcattatcatcattatcatgagtcagaaagtgtcgaggttaagagatatcagcttacctgatatcagtgcactctgctaccccatgagaccctggggtaagactgaataggggttggaaaacagtgtggagatgccttaaagaactaaaggtagaactaccatttgatccagcagtcccactactgggtgtctacccaaaggaaaagaattcattatacaaaaaaagatactttcacatgcatgtttatagcagcacaatttacaattgcagcaatacggaaccagtccaaatgcccatcagccaacaagcggataaagaaattgtggtatatgtatatatgtataccaaatggaatactattcagccataaaaagaaacaaaataatggcattcacagcaacctggatggaattggagaccattgttctaactgaagtaactcaggaatggaaaaccaaccatcgcatgttctcactcgtaagtgggagctaagctgtgaggaggcaaaggcataagaatgatacaatggactttggggacttggggaaaagggtgggaaggaggtgagggataaaagactacacattgggtacagtgtacactgctcaggtgatgagtgcaccaaaatctcaggaatcaccactaaagaatttattcatgtaaccaaacaccacctgtttcccaaaacctactgaaataataataattttaaaaagactaaatgggggaaagagaggaataaagaaaggcttcatttttatgactcattttagtagatttaatgtgactctgactggctggtactttagatttatcctaaatctcagtagcaaaattctagggagaaaaaggagctaacacttacagactggctgccatgtgtcaggtactatggtaagggccttatgtgtaaaaactaaatcctgtgagctctctgaagtagctgctataaatatcctcattttacacatgaggaaactgaggtccagagaggataagtaacttgcctgtggccagcttggtcgctaagttggccttcagggccttggttcttccttcctgtgctaaagtcctcaagtacaagggagacctcctgaatcaccaaaaataattttttcttcattgcagccaaaagcagagaagtttatgcatcagctttgctctaatttgagtttttgtactgtccagatcgcagcctacatagggcacatataaagtgtagaatttgtgtgtgtgtatatataattttcccaaatctttcatttttagctatacatttctctcatgttccaaaatgctgtctgcttaatgttccaaagcatctccaactccatgtgtctagtatggaacgcgtcccttgtgactttgcagtggcaggggttggcatgagggatatactgtctttgtgcctcagttttttcatctttaaaatggagatgcttgatatatggtgattgctggatgaagtgagataatgttgatggaatggttgttggcatggcaggtcgtaagcactaaataaacatagctgttgttcttattgccactctggggggaccagttctctaggcctgggggcagtagtaaggtctcagtaggaccttctggcttcactctcctgagcagataaaatttccactagggctttggtttgggtattgctgaaagaggagttgggtgggtaggtgggtgggggtagatatatacaaaggagtgaattataacaaagagccttttctgcttcaattcttgtgtagaaaacatatgttcagtgatgcaggcagcagttgggttaaagacacactgtagggccgcagacaaaaggcctgtgcccttcctgcattcacaatgtttccaaacatattcacttgtctcacttgttagggactgagctgtcagctggatcctcttgcaagtgtgatttctttttcccgtcccctttcaaaggccatccctcccttcccctctcccccagtgttttacacttcatataatccagtgtgcccgacagaccacttcagcctttgtgctgctgatgtttaggggaaggagagaattgatctgatggagatcttgggtaacttttcacttgtccaaggatcggaaagtgctaagccacttttaggccaaacatcatcagtggctcaattatttcgtacttggtatagttagccgttcttcaccttcaattaacagttaggacaacgaacagattagtgcagtggaattcttagaagtagcgtctgggaattaggggcatgtgtgtgttgtggtggggttgggagagttcttgcttttatttataaagttaatagtttttgataaaaagataaagataaggcaaggcaccgtggaagtatttggagagaagtcagctgtcattctagtattaattatgtgaaatgtacaggtatgtccatgtttaattctagattcaggtagtattgctatgtgccatggctgcagtttgagcattttcattttctttattgaaggttttgtggctctgatggttttattttcatcagtgagactttaaaaagatatatttatgtatattactttttgtgatatatatatatagcataacagtattaggtataatacttttatgtataatctaccaacactactattgaggtaacagcgagctagagatttaaagaattagcatgctaagtacttccatcactgattactcttgggcatttcaccctcccaaaatggacaagtgaaaatctgcaaaatgggaattacatgatcatcatactttataaagcgtaccatagtaaaataaaaacagttttatcgatgatggtcaacaacaacaattttcttgtctttgtagagatcttggattgtgtcttcattcccatatcattgagtcagttttaatgctctcatttcctttttttccccaagagttttgctcttgctttctgtttcatgctattgtttattagttgggttgctcatcctgaaaagcagcagcatatcccaaggaaggagaggcagtaggcaggcagagaatttcccattggcttaaagctgtaaatgggttgttagctcattttagcagtggagcaattataatcctgctaatgaatacgcaggcaagtggagtttcccatatatggtgtcttctggtgtgaggataatttcaacacctaaaaatccacagacaaaaaaaaatgtcatataagtattttttaacagaaaatgccaacaaagtcatcctcccaatacgtgtcagaaccgacaaaggaaactactgatggtgttataacttttagtactgtcatctgaaaaatccttgaaaggaaaacactgtggtaacgcatacatattcccctcagactgaaagtaacagcctgcaaagatcttagtagtgggtgaagctaatagactgcaagttgggatgaattgcacctaaggtggcacctttctcttgtgcctggagtggaatgtcacccagaaccaacagtagaacaactgggaaataagttgatattctttccaacatcgaatggattcatttcacagagttggggaggaagtgagggtaataagagtgtgtttctgaggctcttccttccagcagataggttttgttttcttggttgtaaaagaggctaatgcttcagaagctagagtgattcctggactctcttggtaagactaattatgctgtttcctgctcccgtctgtgaatcagctttgttacatagaatgcacgtaatagtgacgaagagtagactctactgaagcaaaccaatctattaggctgcttggaaaacagagggagaaagaagaacaatgattttgtaaactccataaaggccaaaaaaaggctttcagtaagtatgcagagactagaaatcaaatcccatttcctatcataagaagcctgttgtttcagccgtagtagttaatgtactgtatgtgaaagatttaagactggttggaaagctctgcttctgttttattaggctgctattgaaaagccaacagcataacttcgactaggtgctttgagatttcttaatgggctgtcaggggcaagacaccagggctgtgctatactagctctttcctgtacattaaaacaacaggggccaaacgatcacatacagaagtatgaattacttgatgctttctctgttccatatggccagccatgtctttggcaattaatcatgtacaaaatcagtcgagtgctctctgaagcattgaagtcaacatttagttgtacctgtgccagtaggggcagtggggttgcaggcgtaaaatagcaggatgaggggctgctggcgccaaggcccaagcagctggcttctataaacaacacttttttttcctctttacctttctcccccactttttctttctttctatttttttttttctttccttgacaagtacatggggctgtttttcaccatcatctgaaacaccagcgttgccaactggagctctgaggtctagctttcgtacattgccccagcatccgagcttaaacgtatggggcaggccatcttttcccacagcagcctgaacattccagcggtcgcccacatgactgtccccgagagtttctgcagtggcaggcaggctgctgtggctccatggctttttgtcaaacagaggaggcagagtgatttctctactcgtagaaggagagagatgggagatatggtgtaagtgctttggggaaaaaacaaaaataagtagtcattcatagtcatggctgtgatattttaggattttgggttttgtaaatcaatatccatatcttttcttctgtgatatttcccccaagacttcatacacataatgctgctgccaatagtcctaataccaatttctaacatttatcaagcattttgtgtatgctgagcactgtgctaagcactttacatggattatttcatttactcttcacaagagcttcacgagttcggtgctattacttatacccctttatggatgaggaaactgatcaaagaaacattttccctgaattctttcctcatagacattcttgattactctcagctagcccccttagctcaatagtacatgatggaaaaacactaaaatatgtcttactggcacatttttgaggagtcatgtggtgaactctgcggagatgttcagtcaaataaagtgggtctttgagatgaactgaaccaagtgtgtctttaaggtgggaatgaaagcctgctttgttggcagcctcttgaagacttctgcctttgtgccttcctttcaagacagtggagtttatctcctgctttcctgggtgagtagactatgaagggcgggggaggggaaggaaggatgaagacagcagccttaagtagtccagtagacgtggcacccagtggtgacttggtgttatctcttagccgaggtcatccaggatgcgttttctcaaattcaggaaacaggggaaagaaagttttaacattgtgtaaacattggcacccccaaaacctcctccgggagataaggtaggcagaagggctgggaggaatgtttatttgttctgccacgctgtggatccaagcatgctggaaatctttggtggtgcccagtccagtttagaaaatgtgaaggcatcactcagcattgagccaaagaggcctcacaaaagagccatcttaaactgacaatcactaaatgaaggaagacctgagatcgacctttctttgatgggactaaggctatctcagtgggttctgtgcctttcttcttttttttctttctttcttttttttgtaaaaaaaaaaaaaaaaggaaggagagaaaaaaagtgttcctggacttttgaagaggggagccctggttggggcttttgacagcctgtggcaatgttgatgtgaggaaatagctttcccagctgataacatcttaaaccaagtttcttcacaagttgaacctttagccctcattatcagtcagagcatatctttgtaatttgtgtgtgcagaggggaaatacagccctaacatgagacagctatgtatataaaaagtgttgggggtgacatttttcccgtaatgacagtattacttctgtggtggtagtgaggatgggtagatggggaggtcagaaaggtacgcagttctgggatcctggtgtttaaatgccttttgaaattgcaagaacagtagtagattttttttttaatgaactctgaagagggattaccagccatatttgtagaatgccatcctgtttccatgcatttccttagacaacattctttgatttgtaagacggagagattaagtctgagttttggggttacaggcctatcagaagccgttgcatcatatcagagaggaaccaaaaggattaaagacttgtatagaattattagtaaagagtaaatggtgtaagtctccttttaaatttcagagtggttcctctctgaaaaccctacatgcaacaaattctgctatgatacagtggaattaggacatactgaaagttactgactgtagcaatatgccccacaagaattaggtgaattgctgagttttaattgaatccgttcagaattgggagactttttccaagaaagacaggaaacttaagcataaaattcaaggctccttagagttcttggcttttcttttctaatttgcattcagtctctctctctgtctctctctggctgtggattttttgctttggttttatacatgaagttttgagccaggagaaatgaaagactctgggaaattcttaggggtccttaatatgctgtgtgttgccagaatccaaactagttttctctactgaaatggagaaagtgggacttcttcctcctatacataacctcatattaggagggtatatttttaggcacgtccatccaaatgagtattgtccttttaagtagtcacctaccaagggcatatactcatttttcttgattctgttacttaaaaatagtttttccgaccccgttcttagactcatcttcaggaatagtttgaatcaaatcacagatggtttcacatactgtttttgaccttgaatagtgctctctggcctgatcattagcttcactccccagacatgtttcagcatgtcatttggcttcatttattccaaagtatccatcaggagtccacttccgtggcatgttgccatattaggcaccttggagattattaagaaatggtcatggacccttctggtctaatggagcccacactctggaagagaaaaatttaaatgaatatgtaagtgcaatggagtacgacatggtggtgcataaagagaatgatcagctccatctaatttggtggaaggacgtagtttgtggaagacttcacagaggaggtgtttttgagatgtttcttgaagagtgagtagttactggaaagttatatggcaaaggtacaaatcgaagtatagtatagaatagccatgtgtttttagggaattacagttttatatgaaacagaagatgatagaagataaaatatgagaagtaagcaggacctgtatcaaaagggttttttttttccccaggctaaggaatttggatttaaaaaaaaaaatcattttttgtgtgtgtcctccaaatgccaataaccgaagcatatataaacaaaggtgctctggtttaggtgggattttgaagccaaagctccttgtctccttggtgaccctaagaaacttcgtggaagcactggggcttcatgacgaaagcctaaaaaccactattataggtgatgctgaattatttaagaggaagtaacatgtttggacatatacttttaaaagatcactcttgaagcaggaaaattaatgaaaggggtgagatggacacagacagatcagtttggaggccattacatggtccagaagagagatgggcctgaactaagcctatggcagtggggaaggggtaagtttcagtcatattgaagagagaagaatcacaggattttttatgtttaggtataggcagtgcaggaaaggaaagggaagaagattagggtgattcttagggttctagtttgggttattgcattgatagtagtgcagtcaccactctagggaaatacggtggaaggagagcaaaaatagttcaaatgtggacaggtgaaggtcaaatcttatgtttgaggcagtgtgtttaaggaagatagtcagttgttggctgtatgggaccagagcttagtggaaaggtccgcttgaaggtagaagcgtagagatgtccgcagtctacagggaacccttaaagccattggaagggcagatcacccagagagagagcaaaccgaagagatgagaggaggatgaaaggtatgaccttgggataacaacagttcctcatcctagaatgaggaaaggcatacaggagactgagaaggaccagcttagtgtcgggcactggcccaggagagagaggtgtccactaatggagagagatcaagtgaaatcagaacttgttctaaaaataaaacccaccctcaaaggataaagagataaagattttccaccactagggatatgcaaaaagatatgcctctggcttctggtacataaaaattttatggttgtgattgttcagtggttgcctgatttcctttaaagtttttccacttaaagtaatagacattttcaggaatccctttgttaaactagcataacctagcacaaggtagattggcagagtttaagatgaaagtaaacaataataatcatgatggcatatgtaccaggcaactaatacaagaattgtggagaggttctgttattatcaccatttggagttatgggaaagacccacagctaggaggtgacagcggggatttgagcagccagcactctaaagaatatattaatacttagttctttctgatctggcctgcatttccatagatttctattgaaaaaaagtactaataaaatgaaatttagccaccaggacacgtttcctaatgaaatgaaatttagccaccagtgcacgtttcctaaacctgtgggggttttctcctgtattttgggaggaggggagggagaatgtgtttttggtaataggagactgtttaaaaattgttacttgtttgaagacagttctatgttactactaatgggaaaatggtctataaacatttcctggggaagtcaacccttgaaaagccgacactattataaggagtaaaaatatcacattaattgccctgtaaaaagaatgctcttttgacactgaaatttccttttgtgcaatgatttcttttcaccctaaattttagagtttgaatgttcaaagttcacccttccttttctaatattaaaatagttttttgtaacagaatttgtttttgtcgttaagttatatttctttatatttttactacttatttgctagatgtgtttacttgaaacttgttttctgcattctttcttgttttaaaaatgtgatgcaaatgaagtttttgagttaaattaaattttataaaatttacatacaataaaattggccttattttggtatacaaccctataggttttttatggtttttatttgtttgtttgggtttttttttgaaatggagtctgctctgttgcccaggctggagtgcagtggcatgatcccggctcactacaacctatgcctcctgggttcaagcgattctcctgcctcagcctcccgagtagctgggattacagaagtatgccaccacacctggctaatttttgtattttagtagagacagggttttgccatgttggtcaggctgatctcaaactactgatctcagatgatctacctgcctcggcctcccaaagtgctgggattacaggcatgagccacatgtcctatgagttttaacatctgtataaactcacgtaaccaccaccacaatcaaggtacagaatggttccatcatgctcaaaaattcccttatgctgcgtcttgcccaaccgaatccctagcaaccaatgttatgttctctgtccctacagtattgcctgttccagaatgtcaaacaagtggttttgttcactgagcataatgtctttgagatgctgagtgatggcatacatcagttgctcagccctttttattgctgtagtggtgttctgttgtatggatgtaccaccgtgtatttatccatttaccctttaaggaacatttagattgtttccagtttttggtgattatgaagaaagttgccataaacatttgtgtacatgtttttgtttgaacataagttatcatttttttagataaatccctgtaaatgaaattgctaggtcatatgctaaacgtatgtttaactttataagaaattgccaaaccgtttgtcagaatggtagtattttgcattcctcctagtagtgtctcaacttttaaaaacttaaatgctattttagatgctcttgggttggggttggcaaattgtgtttcgcagtgccttggggctttgagaagatgccccaaaacaaagggaggacttctaggtcctccataccagcttcaaagagaactgttccagttttgtttgttgtatatattgggagttgcatgtaaggatacatttggggagaaaagagttttatctgcaaagtgtttaaaaaccattgcagtagggaagtgcacccacaatgtgagatgtggaccacaggtgatacagggtgatgctaggtggcacttggggactctgcacatgaggaccacactgtgaggcagtgattctctcttcagctccatctgtttatgtgattatgtcaaggaagtcttcatttaaatctgctgcatcgttattctccaccacttgttaatatcttcctttacaaagagggagcatgctttagtctcagagccctcagcaagcaacagtatctctctagaatgaaataaatatatagttttgtttatatttacttttatgattatcttcttttttttttttttttttttttttttgagacagagtctcgctcccaggctggagtgaagtggcgcgatcttggctcactgcaagctctgcctcccgggttcatgccattctcctgcctcagcctcctgagtagctgggactacgggcacctgccaccacgcccggctaattttttgtgtttttagtagagacggggtttcaccgtgttagccaggatggtctcgatctcctgatcttgtgatccacccatctgggcctcccaaaatgctgggattacaggcctgagccaccgcgccaggccaattatcttctcatttataagtaccatttttcttttgaagtgaacttatagttttaaaaaatgagccaattatcatagtatcattttttctttttttacttttatctagaaattactacgaaaaatgagtcaatttaaagaaaaatattaaatactgtattacatagttcatatacaaatgtggcaagaattatgaggatgtgctagaataactgaagtttaggaaactcttgaacttctagaggatctggttatttaaagaaaccttagagtgaatccttttgtgaagtgaagagctccttgataaagcacataactatttcttagtttatccattttatgagtttataatttatgtaatagttcttaaaagaagatagccttcattgttctttgtttttgtaatacttatttttcaagtcccttctttattcactgatttgacagatattttgtgggcaatggggatacggtgttgaactaaacaggcgacatcccctttctttgtgaaactttctttcttacatccttcccctcttagaggctgttcagagcctatggaaaacaagggcccctggataaaatgtaaatgatatgaaaggcaaggaagaggtaaatgactttaaaaaataaacattttaatagattcacaggggggaaaaattttgttttgatcatgttagctagctagatgtctactttgtctttcatttgatgcatttttgcattttggtaaaataatatgtatccacagatataaccacaaactatgtgactttttttttttttttttttttttttaagacagaggttcactcttgttgcccaggttggagtgcaatggcgcgatcttggctcactgcaacctccgcctcctgggttcaagcaattctcctgcctcagcctcccgaatagctgggattatagacgcctgccaccacacccagctaattttctatattttcagtagagacggggtttcaccatgttggccaggctggtcttgaattactaacctcaggtgatccactcaccttggtgtcctaaagtgctgggattacaggtgtgagccactgcacctggccgataaagtacttgactttttgaggttcctttcaactttaagaacatgaagtagggtgtcacagacaaggagtagtaccgttgttagaatacccgctaatgctcagacctctctgaaattagacatcttttagattagagatcacaaattggtagctgcctaagttctattcagcccattggtgtttctcatttgacccacatggtatttttttaaaaaattttaatgagtttacaagatttacaaaaatcagtttttacattaaacacacacacacacacacacacacacacacacacacgcacataccagatttcttgtttattttgaaaattcatgaatctagcatcagtgagccagcttttctgaatgtcagagctggctggatctgaatagtgcgtgccttttttaggcagaacatgtgctgtctttcagtaacctctgcttaactcattcatgttatgtgcctggcccagtgagtatttgaatttgcaacctgtggatcctgggtttcatgcactggaattacctagagaagctgaacattcctccttgtgctggagggctgaaaatgttgttgccacagaagctgcttgagtgtccaactgggcatatcttccagcacagtagatggaatactgggataggaggcagaatcagggtccttttcctggctagtgtcaggtggattatccaggcttcttcacaatggaggtactattttctgacttacctgtttgtatcagttaacatttttgatagcaacagaaacagattctgatgtggtttttttttttttttgagatggaacctcactctgttgcccaggctagagtacagtggtgtgatctcagctcatgcaaactccatctcccagatttcaagcaattctcctgcctcagcctcctgagtagctgttattatatgtgcacgccaccacgcctggcaaatttttgtatttttagtagagatggggttttgccatgttagggaggctgatttcgaactcctgacctcaagcaatctgcctgcctcagcctcccaaaatgctgggattacaggcatgaaccactgcactcagccctggtgaatttaaacaaaatgggactttattgaaaggatattgggtgactgacactatcaaaggaaaagcgaatgatctggcctcggaaagttctggaaactagagatactctgaggaccatgggtggaaggaattaagggaattgataaattgcctcagcattttcccccgtttctttatcattcctctcaagagtctgaaatcctggaaaagaatcaatttggtctggcccacatccttcataggggaagataggacaccttggttgacagtccctctaagactttataccatgaaagaaaagactttgtaagaagagatttaggtgatgttgccagacaaaggggatgaggtatggatttaagcaatagaaacaacaaatgttcactactcctcttctcaaggttgtcatgaagatattaaatatgcgctgtcaaatgctatcaaagagtaagggagtagtgtttcaagttacaggagaaccaggttatgggtatgctctttaagtaaacaaatatattggcgtctgttagataaggaatatattgaatgacttagaacacagacaatttcattgaaattgtagtggcaatttcattccttttagcaattgctttggttataaaatctccaaagaagccacactaactttaaattataaaacaacatctataaaaatctaaagatgttctttgagatactcattcaaagaaatggtctttctgatttttgtgttcccatttttttctttgcaagatcttgatttgcaacaggcaaggaaaatgagtgaatcttcccccttcttcccccacaaaacattgctggcatgggtagaaatttaaagtaatgattcaaataagagaggcagagaaagcctcagctgggtggcaggaaacaagagagtgaaagtcagaggctgctcttttttaaaaaggcaaaacaaacaactcacagtgaagtgtacgtgaaaatcatttctaataatagctcatggtaggcaattcccaggaaaaaaaaaatcgttggtgtgctgagaaaattagagtaagaatgcgcagtatcttgatgtgttacttaaggcaatggagctttagagtttaccttatgtgccatgtacattgattaaatacaaaatatatgccggccatttttggccatcatttactgcattgatttgttagcaggggaactgtaataaaaaagccattgatttactgtccttatttgcttatgggcttttttttattattaatttttcactttttctttctctgttttggatcatttcttgtagacaaatgctgtgcttcatgaagttaaaagagaggggctccccgtggaacaaaggaatgaaatcttgactgccatccttgcctcgctcactgcacgccagaacctgaggagagaatggcatgccaggttagttctgttgtgaaatgggatttgttgttcttgacaaacaagaactatatttggccaagcccttccttatggctggcctcatccctttcctttgagggcccatgaaaaataagcacgtttaagatgctttcagctaaagttagctttcctgcccacggcacctacattaattgtaatgatccattgacgtcatcagtatatttacacaatttgttcccaaatataacatttagcataagtgtttgcattttgagcataatgtaatataagtacctgatgctgaagaaccctttttaatcaacagtgtaaaagactagcattgctatttcattagagcagatgtctgagaaatccatatagtgctcctatatcactctatgcagggcagattacttgaaagtatagtcatgcatcccttaatgatggggataggttctgagaaatgtgttcttaggtgattttgccattgtgtgaaccccgcaaaccttgatgacatagcctactatacacctaggctatatggtgtcgtctgttgctcgggggctgcaaacctgtacagcatgttgctgtactgaatattataggcagttgtaacacaacaataagtattagtgtatctaagcatagctaagtatagaaaaggtactataaaaatatggtgttataatcttatgggacgggaccactgacatatataaggttcgccgttgaccaaaacctcaaaatgttgttacgtggcgatgactgtagcctatttatcaacccgatttttagggttgaccaactaggaatgactcttgtttcaacctggtctctttccatagagttgcctgtgcttagaaacggtgttactggtgaaaactttctttaaatcatcagtttttacagaactgatgcttgcatagtaaatatcatgtggtcctattctgttttgaaaaacagttgatatgtgggaggctagaactagttctcgcaaatgttaggattatcttttagatctgtagtttgtaaaaattattgaattgtcatccgtctctaagccagagggagaggaatcaggaagcgtatggcatattttgtctcagagtcttatttggtgcttaaaaattctatgtgcctggaagtcaagaacatttattgatagacataatattctccaaatgacttcatgcaacagaatttataataattgatagctttactagtaataattatcataaaaataagtttgtctgaacaaggctgaagatgagcattttccaagaaaggagacagtatgagtatttattctcattggatatcagaaagctgctttttcaaatatgtattatctttaaattcagacttgtatttaaacagtaatttaaaaattcccaatgatattcaccctccccttcccccatctttttggtggtgtggtcggagtaaatggcagacagtttcttttttttctttttagaaaaaaatgtttataaaaatagacacaggatcttgtcatgttgcccaggctggtcttaaactccttgcctcaagcgatcctcttgccttgacctcccaaagtgctgagattacaggcgcgagccaccatgcctgcccagtggcagacggtttcaactaaagtaatgactaaatgatttccaatttacctttcaataattaattttaaaattttctctgtattataagttaagcatgtatattcattaaagtatacatagtaaggaatggaatatcagtttgtggacatctaaggggtttctttgtctctgtttgatgtcttatgtcgccctcacgatgattccaattaaatagaaagggaggaagaaagaatttccctgtaatatctcctctgcttcccttccgtccaaagaccgtgtggcccagtgagagcataaatggatgtcttttgttgagtgcatttggtttgttaacaataattttttaatacaccaaatcattagacaacatggtcaaagtggcctgtttaaaaggaatctgctttcagcatttctggcccttactgctaacaatttaatcaggagctggagccagtgttgaagttgatgtagtctagcaactgaaacaaaaattctcaagtcctttgtgttaagggaggaggaaagaaagagcttaacagctgacactgtgcagacccccttaaaactaaacacctgaaagaaaatttcaagaggctggtgtcttgagatctcagaaggaaaagtgtcctcagagtattaaataaccataatccttctccccaccacttctccacctccatttgatgtttcccatcttagtgacctatctacagactcatccatgcgatccgtataaacagacggttaccatacacctttcttttcctcatcaaagtgtcatctggctgtctggaattgggcattgcctcgagtagccgtcaaatgggtggtggtgaaagttataaaacatccactgcagtgcttactaagcagcctgtgttttagagattggcctattgtgtacttcggaattacacaaggaaaaatgtgctttgacagaaaataattagcactcaccaaaggccaagcaataggttacagtattttactttcatcaaagctatcaggggatcagttagattagataatagaaatttttttcctctgaaagttaaatacacatgactctaattaccttatattgcacattagagagtgcattatgaattgtacaacttcaagaaatttaggtcaacggagccgccgcagctggcagtaactttagtataagtcttttgtaataaaggtttttacctctctttagcaggttcatttgcgatcatattagggagaatttttaaagtaaaacttgtaacctggttgtaaaatatttgtctgtctctcaggtcaggcgccaagccattgtttgggactcactgaagtctcttaaactgaagcatatgttccttgtaatttagctttttgaggaaagtgtcaattttgcatgacttggggtaaccgagtttgtcacagtgtcacacaacccagcgactctagaggcacatctgagtgctgtgggtttccttctccaagcttcgtaatcccataaacaaccctctccaaataggcttattagggctgtctattcacttccccagagttgaatgatccaaaggacatcgggagaagctgtgtgaatgcagggtaagtgttaacagaagtgggacagaatttctgaagattcgcctttgtttatccagtcccctctgcctgatggacagcttgttatagcttttaaagaactgggcgagccctctgatctgaccccttcttgacctgcgtagcccaaaggtcagtctgcagctaataaactctgaggttcttagggtctactgtaggaaaaggcagaaaaagagcagctgcaaggaccgggtgtcccaggataggctactttagggtcactctctgataatgaaaatgattaccaaattatatggaagtttaactgcaatcgtgagtgagaggagggtggggcccggcgtattaggtttgataaatgaactgtgaagaggcccatctggctctcaacatcttttctccccctctttccctaccaaggggaaacattttaaaataacagcagtacatatagactcaatgacccatgcaaggagctggaatggattaagatttaatggtgacagtggaagaaattatcatttgaaaagtgctccaaagaaaaggtacagttcaatgtccacacccgagttgtctttctaaataaaatataataaaaatcagcgccttgtttattttctacaaagccctggcgtctttcctagatggctgaaaattttgagggtgttgtttattatgggataattattcatagtttagcttcaggaacggaatgggcttcctttgccttgaagaagtcagaatgagaatcaaagattttgttctgcctgcctgcttcatttcagtgatgtaggtaaatcaagtgttagagaaaatgcttttccaaaaaaagtgtgtccatgtcagcatctgaccactgattattgtgcactctttagtactaaatatatgtgtgactcttgaacagagtcttattcctactacaacctggcagtttttctgtaaatataagaagaaagcacataatgttaactgagtagttacgtttggttctttctttgttccttttttcaaagaaacatcatggtgatgctaattattgccaacaatggatggggtcactatacgctattcgtctatttatttatcgctaattgataagattagtctatttaaagctctcccccagtttctcatgaacatagagtcttgatttcagaccagtgatgatggaggccatgtagctctgttcttttgcagagatgagtggcacatgccatgagtccactttctgaagggagaatgatttcattcagtgagcatctttttgtgtattttgtatacctactgcatgagatgctgtgcataatagggagtgagctaagtggccaatttcagggtttatctggggatgagaatgtagaaagttcctagaaagaggctgtggaaggcagtggcagggaaagcagtggaaccatcgttaccacaacagagcggcaagttctctgacccactcaggaaagtatttaatggtagatgtcttggaagactagaattgttgtgttactgaaaaccctttggctgggcatggtggctcacgcctgtaatcccagcactttgggaggcctagacgggcggatcatgaggtcaggagatgctgaccatcctggctaacacggtgaaaccctgtctctactaaaaatacaaaaaaaaaaaaaaattagccgggcttggtggcgggtgcctgtagtcccagctactcggaaggctgaggcaggagaatggcatgaacccgggaggcggagcttgcagtgagccgagatgacgccactgcactccagcctgggagcgagactctgtctcaaaataaaaaaagaaaaccctttatattgaactatactgactcgtaatacaggcctcacccagacaataattatgttaaaaaatcaaaacagaaggcttctaaacattatccaaagttagcatatttttcatcaaggttttggcttgactatctatgtctgggggcatttcgagtgagcagaaagccaggtagaggataattcagggagatggcaaatactttgagaatcaattgtgctttttaactttaaagccatggccctaaatttttgctaagtgaggtgtaaatacaaaaagcaaaccaaaaaaagagatgaaagcaaggtcattagggtttttaaaaaattgaggtacaagtcatatataacgtaaaattgcatataacaaaatttatcgttttaaagtgtacagttaagtgattttttagtatatgcacgagattgtgcaactgttaccactatccaattccagagcatcttccttccccagaaatgaaacccggcatctgttaacagccaccctccattcccccttctccccacagtcctgagcaaccaccagtctactttttatctctacagatttgcctatttataacatttcttataaatgaaatcatacaatacgtgaccttttatgtctggcttctttcatttggcatactgattgtaggatgcatccatgttatagcatataagtacttcattcttttttactgctgaataatattccactatatcgatgtgccacattttatttatccagtaatcaactgatgggcagttgggttgttggacagtaataaattgatggacatttgggtgggttgactttctggctatcatgaataatgctgctgtaaacattcatgtacaagtttttgagtgacatattttcagttctcttgggtatatacctaggaatggaattgctgggtcatatggtaattctgtgtctaactttttgaagaactgtcaggctgtttttcatgtctgttacaccatcttatgttcccaccaagaacgcacaaagtttcccatttttctatgtccttgtcgttacctgttattttcatttttttggactgtagatatcctagtggtatattattgtggttttgaattgcatttccctattgactaatggtgtcgagcatcttttcctgtgctttttgaaaactattgctttttcaatcggacattttaaaacatggcggacttaaggacttacccctcttgttggtgataaagagctcagaagcctgttaagaatatttggcttgtagaagaggtgaggttccaaatggggctgtcattaaattgcagcagtgcacgtttccccgttaccatggtcaggcctggctctttatttatttgcatgtggccccacttatttttttctagagattacctacttatttctcctaccattctcttacatttcattcaacattgcacactggataggaatgtagcctgattaaatggaaactcggtacctttatagctctttagcttttaggctcaaacaggagttactgtactcccataggagacaacttcatttgggtcgaaggagccttaaaaatggtgctgagattcatttcaactaatgtttatggaagtttcttcgaaaagcttttagaactacttgcttctacttaaaagtgactctcttaagatccagataactttatgtaaaaatatcttcctcatattggtctaagttcccatttttttctggactggtaaaacaacggtcttattattagtcatctttctattctctgtgaccccagccatcccatcaccacctacccccagaatggatccactctggacatctttgttaaggctgtaaaatctggttgttggaacctagaatgtgtaatgaataggatttactattccaagttaatcagctttagaactttgatcggggctcaacaagtataacactttgtataagttacttatatggatcaactagcacactgaggtgttctccaccggtatctgtctccccttctgcctcctagctagtcacggattatatgcaaaaccgacaagtcggcaccgtccagtttagcaattaactattatttattgagtgtttgttaggtgcaagtaactgtgctagacactgtggggaatatcaagatgagtatgacgtgagtctcaactgtggaataatttactttaatgtggaggtggtagttaataagaatacaatggctagcacacaccctttaactcttttttctatgaggcactgtgaaaccataaggtaatttagcaatggggtctgccctaagggaacttatattttgatagaagcttaaaaaatgaagtaacctgacattaattatatatggacttgattctgtgtttacatttttatctctcctaccagaatgaaagttttatgaggattggacgtttgtttgtttaccagccgtaaaacatacacctcaggccaggtgcagtggctcaggcctgtaatcccaactctttgggaggctgaggcgggcagattgcttgagctcaggagttcgagaacagccagggcaacatggtaaaaccccatctctgcaaaaagtgcaaacaactagccaggcacggtggcgcacacctgtagtcccagctacttgggaggctgaggtagggggaagcacttgagcccaggaggcagaggttgcagtgagccgattgcatcactacactccagcctgggtgacagagcaagaccctgtttcaaaacaaaagaacaaatttgcaccccagatctttgtaacattaagctatctcttccatttgaataatgccctctatcaaaggacctcattgcctgtttaccacatatccctggcatctagaagaatgcctgacactcagatttgtgaaatacctttcctctcaatctattccagtgtttataagtactttgtctgctttattaattttgaagaggaatgaccacttgtgatattggcctgttgctttttttgctctttttctcaaccttgcctggtgtggaaatcttgaaattcgaagtcaggatggatctctgatattggaagtaagcactggttattcatctaaccttgccaggggtggaagccttgaaactggaagtaaggagaaatctctactatgcagttctctggtgtttaagccccaacatggtaccacaggcccttattccagcatgagcaaagagggatgccatgtgcacaggctgactccagtgtacttgaggaagagaacaccatgggactgggctaagaccaggacaaaaagacatggtctcctccctgagccaccattcctaatttgttgactttcctagaagtgaaatggagctgggtgagaagaggaagaactggcatggcgaggaagaagagagttataaagacagccctgggacatgcctctgaataaagggatgggttttagttcagtagggataggaacaaagctgaggctaatatggcttccagtctgtaggcagctgttttttcctggtcacctgctaatgtcctcgtctgctttagtgatatcagcacagttatgaactttagcgttggtgattcggcatgtggactagaacttggagctgtgttcacaaaaagtggagctcctcaccttgaggatgggctgtgggataatgagactgatgcagttatctgctgagacaacctgtgattgtgtcatcggaccacgtcagctgctatcattcatgctaaagagactggctgcttactccggcacagctggttagttggaaactagaagttgtggcatctgtagttcggtagctgtcagttgctactaggtaaacttgtttgcagtgttggggtgggcatgaggaataaatggaagagattccagggagaagcagggaggcactggcctgctagttgccatccgggtcttttttaagacatctgtcccttcgcttttaataattacagtctctgctttttgctgcccttagcagaagaaagttctttgtgtttctgatccagattactccataaaacctgataactccataaaacctcctcaaaaatgtgtaggaattgaaacattgtataaatttagagcaaagattaaatgagtctagagatagggttacttttttcccccaagatacagcaacttatcttaaggaggcaagtgttgttaatgttattaccattgttactgtcattatttgaacagttttatgggggacaaaagccaattgacttctgtgcatcttatttataaaatcaacacatgggctttagcatgaactctgtttctggcaggtttctgactgtgatcagttgctggctggctgtttcttaggggcagtgcttcttaaactttttgagaaaacattgattcatttatttatccaacatacatttattaagtgtctattgttttctaagcactgttccaggttcacagcagtgaacagaactgatgacagttctttcatggagcttatattctagtggaatgacagatatgaactcttttcctaagcggaactctgaaaatttcttttataaaatgtgcatatagttgctatgccctgtatattcaccagcactcaacagtgaccaaaataaagtcattcagttgagataaagatacacagttctcttttctgagctttgttataaagtaatcacttgttataaaatttacatttcaagttgcagtgggtcatatttgggaagtagccgtgggatgccagttttctgaggaacaccatcctagggaatccgtaacataaattctccttcaattatccgtaccgtggttcccatttacttttccaagacctgcgtcactttaaaggtcttcatttgaaggaaggcttaaattcaggccacattatattgacaaatctctctgaagagagaatgggcaaagccatacctatctcataggtgttgggggattacctgtgataatgcactcaagtacttcataaatgctgggttttgttgttgggagtgatctgtcagtcatgcgttggttctgcaaatatttcttaagtgcctacctggtatgaggagctatcttaggtcctgaggttgtagagatgagtaacatttgattaggggaaatgtattacacaatgtagaatcataaatactatggaagagattgagtcatgattccatagaaacccacatcccagggaagaagacaggctctccttaagtgttctcataagactctcattatgtgcccagcgacagtgagaaatactgctccattccccaattgtgttggctaccagtagataggtagctatttgtctcaaagcatgagtgagaaataggagagaaatttatacgtgaggataggtcattgtataaaagttgtgctaccttctttccattgtataaagtttgtggaggaaaaatggttttctttcagagtaaatttaattaatatgtttgggggcatagattctgaatcagattgcctgggtttgaatcttggatccacttctataactccaggcaagttacaattgtggattgtaactagatgagttacttaacccctctgagcctcaattttctcgtttgttatttgcctaggggatgataataatagaacccatttcatagggttgattaagtgattaaatgtaaaacacccagagcaagtacctgtaacgtattaggtgttcaataaaaatgacctatcatgatcttcagatcaaaacaataaagccaggaataaacccagccacccttatccaaattggcctctcctttgagagaatgcctcatgaagtaaatatcctagcctcctggtaggggcctgatattgcaaaattggtgcagggaagaacactagacagagttggtgctctgtgctcagcagtgtcacacagaattgacaggtggagggctggactccagtttgaatcccatcattagtgactataggactctgggcatgtcacagacactctacgccttagcaactttatgtaagaaagaagcgacttgatctcgatcgccccaaaagtgggaggcatcttccagctctcacaaggagtggctccatacgtgagatccccgggagcagggaaaagtggatgttactcctgatgggtttcactcctctacttccactttccctgaagtctgcaattgtactaattttaacaacaatagcagctgacatttattgagaagtcactgtgttccagacagagttttaaatgttttatatgatgagaaaaccgaggcacagaggtgcagagtaacttgcccaaggcaacagctagtaagtagtgaagatggaatttaagccaagacggcccaggttggccaagagcaataacaaagctttagtttttaatcaaccactgatacgattcacttagtattttagagaccttctaggatccttctcagtgtggagataggcaggtatgtatctttacatatttatttcctctggtacctaacatgttttacactttttagttgtgggtgcatctctataaggaaatagtatccagctaatgcattatcaatctccctgccatggatcttttaaaggaaagttatcacctttatatgctctgtcatttcttttatattggttacagtcttttagaaggtgggagagtaggggtgaaaattagaacaccaaagtttagcctccaagaatctgtaaatctctgtaaatcctctaagtcaagtaattttggggctgcgttagtcaaggctgatttcagtgggtgcccttaaggtgaaagggtagcaatttatctactccataatgggttaatcaccagctgtacagtttgtttatatctaggaaacaatttaccacacatgaagagtagtaattttattctatctcaggggtatccccagtgtattttacaaatttactctgtaatgttatagataaaagtttaactctggctttcagttgaggaagtcatggtggaggaggatgggggaaggggaaggaacagctctactggcctgtaggggacactgttgcatcatttattagaattttccagtctattgtcccaggacaaaaaaaacaaaaccaaacaaatcagaaaacaaaaaaaaatagttgaatcaccttgaaaatgcttattagaattatttgaatcgttccaatgtgtttagaatgttcaggacttctcaggtattggtcagactgttcagtatccatgcgtgaaagaaataggttagtggttctttctgagacaggagtgtttgatgggactcttctgattacctttctctccatagtcaactttggatagggtgctcaggacgttactttttagtttaataaacctttaggtttagttaaccatcttcattttttattaagatatgctcatattaagttgttttgcttccagaatgtatgctaaataaatgtcccaatccttggaagggcgttttggaagttcctattgtcttctttttattcttatattttttttcactgaaaaagttgctgtttactgaaaaaatgaagtcatatctacaaggaaggcttatgtagggcctggtctgaactccaggaagcatatgaccagatgctgtgctacggctctctttccagactgttgacagccattgtatctgtccaggtaccccatggcctggccagcaaaacctccacccctctgcccagctctggcctctttcctaccagaatacgggcctgggaggcaactgcaatgaaccctcggaaagcataggttttgctaaggcagcctgcacagtaatgatattgttagcttgcttcatttccagtttcaccatcaattacgccatgtgtttcatccagttggtgctaccctcccagtgttaattataacctacaagactgttacagttaattttatggcaagcatattgtctcttcaaggctccagagcagctcataaattatcttgaaggtaaaatgtaacttggggaactagttatgaaaattccatccatctcgcttaggagctgcagctgctactgtcagctgccttgctgctgcactgtgaaggaattatggtgggtcaagtttaagagggtaggcccaggctgtcactgaggagaaaggctgtcctggccctgtcagacaagtaccttctgccaatccctggtggtttcactttgcaggcaggaagaggcaggcagcgcaggtggatggtccccaagctgtctgtattcattactttacagaaacttgttgtaggtaggcaggtccagagacctttcctcttctctgttgtcatgatgttaggcatcatctgcaaagtgtgagatagataactctataactaactctgggcttggttcaggagaggaggagaataagggggcggaagctattagtggcagcacttcccagccaccccttactggtctcctacttggtaatttctatcttgcaaaagcccctggcttgaacgagcattttatttgtggtggtgatttttcatataatctgataaagcgagatttcactgtggacgaatgtactcgaaaattgcctactaaataaattaacaggttatcttattgggataataaacacactccttttctatttcctcacacgaagtctaagctttacatttcagccctcggggctttagcattattatttttaatgactgaacacaagtctttcatttagcttgtttgtatagttactgtaaatgatctttctgctgttggtacttcatttgaaattctgcatgttatgctagctttaaaagctttgagggggccttggagaattgggaagctgtattaagcacagcatcttctagtggcattggaaacgggctatggcagaaaagtcagagagggtgtgttaagaaagtacgcctgcatgtataaatcaaagtctgagtttgagtgacgcgtacacaaacagtggtggtttcggtggcaggttgagaactcgccattgtaaagtaagagagccattcccttagctggtgatttctccttgtgtgtttctgagcacttttattgcattcacacatctactagtttttgtacgaagagtgcctcagatcattacactgcggctgtataagagacctggtttggagggatttgaaggacacatggaatagtgaattcatgtccaaagaggcaccgggctttctgaaggaagtattcgtctgagcttttgatgatgggggcatgagagttggatatttgtgagttttctagtgaatgctagtgaactcagaccagggattgcagattcagatgtctgtaggccatggtaatcatgtatgtagataaagccagagaggtgagacactgttaagttcaaggcaaaacacacgtgtgtgtgtatgccagaatctgcatagagtagaacaatgttacaaggtcacagaggcaatacccagattgtcttctggtctcctggccagcggacattcacactttgtctcaagtgggcagccaggcagctgctatccagccttgcgaggaggcaggatctatgttagtaggtcttccacattttcaacagaagtggaacattcatattgtatgtgtatgcttccgaagtctcacagtgatttaaatgttagcatgaattcaaatatttgtaactgttaggctaatcaaaacatgtgtggagcctggacattgtgggcaggattctgctatagaatgaaagtcctgactgctttgaattaaaaaccttctccatcttctcacacttctcaagaatagaaggaatgaccctggctgggagaccagtacacaatctgtgtattgcctctgtgaccttgtgaccttgtaacattgcattattccatgtaggttcttgcgcgtgagtgtgtatgtgtgtacgtgtgtgttgccttgaacttggcactatttcatctttccttttataaacaaagtatatgagagtttccaaaagtgaatgaggtgtatatggtgctcattgtcaccataaaaaggtgtccacaaaaatgttggcagttttgaatttgataaagggtttaattctcagaaaggaaggactgggacttattgctagtgaatcaccatttctcctgttacacccttgagctcctgctttagctcccatctcctccatgggggaacccagctgttctttcactgtagaagtgaagcttgaacaaagatgtcatgtggccagaatcatcttttagtctcaccactccacactgatggtcacatagaggtgtgagttgggaagttgttaaatacaagagggtttgagcttctggagaagaggaaaatgtaaaaatattttttcctttaagaaagataaaaaggtaagcctaaaccttggcggccaccgaagtcagctgttacgcatgtgtagttaaatttcactgtaaatatttcataagggttcttagaatggagccaggttgacatcacagccccaactgtaccaaaggaaccatttcattaaaataagccaacatttccaaagaaacacgaatgtctatggcagagttaacataaggtcagaaaatcctctggaagaaatttcggtatcaatgtttataatctctgcatttatggatttgcagtttgtgcaaaaaaaaaaaaaaaaacccagtgagactttattttggttaaataagactagcttgtgaaatagtctgtatatccagatccatcctaacccaatgccttggcagccttttggataaataatgtcttttccaaaatgtgtgtatttgaaaaaggaagaggaaaattaagtggcaaactgtgtctctgggttgccataaacgaacagaatccagaaacagaaagcaaagactgacagttcattcgttctttaaacaaattacatagctgtacgtttatttactgatgcatgaagggttgcagtgaagagcaaaatgtttaccctaactactttcattttctttttttggggggggaaagtaaaggtttatttaaacatttttttttttttggtgtgtaacacaaaatctatatgaggtttagaggcatttggcaggaaaaaaaaagatattcacatttgtaaaaaaaaaaaaaaaaaaaaaaaacttaatccatgctcacagatggtcctgttcaggtgctattttaattatgaggtaaaaaaacagccccacacagtaggaagtcgtcttaataaatggactggagcttttgtcttcaagcgtcaaaaagcctcgttactgagaaatttaaatactttgtattataggggagagtctcaaaatgaccaggatacttggagaaagcaaaatgatggattcttctaaagatcaaatgagtatacgagaaatgttttacaattgtatagctttgagcttccttagtattggtcattttagtgatattttttccagtgataaatgtcgtagatatattcatgcagccagaggaaaaataaacagaacaaattacaaatacatttaaaaaattttaatccacgtggaagtatttctttcctgttcttaagcgcaaagggctgctttgcccttcatgtgagagagtgcccagaagaactaatagtaattcaaatgatgcggtaacttacagcttgcattaataacacacaaatagaacagtcttcttactaaatattagtaatataataatgttttactgtctttcccatagtggggaattatgaggacctcatgttaggacctcagtgtcctgacatagttaattatccgtggataatggcttcagccaccagagttctcagtgaggcagctttgttgttgagggcttattaagtgtttgcagactcaggtgcggtgcacctaggctctttcctacagaagcaaacagctgtgttggctttaccgtattatacatcacataaagcatctcatttattataacgaagctaatgatgctagtggaaacctttatgtcccgttctatatagtgataatatatttgctgtaaagttgttagcttgtttttcgtaagtaattaatcttttcttataccaaatgtatcacatgaaaatgggttagcacagggtcaaaatacatttaaaccagtctgcagagattggataagacctttgaatagagcatcactttttttctttcacaaggacctcaccccgtctccaagctaccccccaacacaatgctcacattactaggaacttaggctaataacagggaactgctttcagttttttagtgctgagataggattcagacctgaatgtgtactaagccaagtaagcttagtgacagtcatccatgttcagtcccttaacaaggctgtgtattgtccatgtggataattttggtggtgggtttctgtctaatctacagtgactttgagtttgtgcctagggagactctagtgaaatgtgccaaggcctagttcagagagtcctgaagtagtgcgctgtgcgtggcacacaagatgattctgtgagacactgatgaatactttttatttgaaaatttatatgctttgctttttgtgtatatagggagacatttgaaattcactctcagcaattttgaaatcatgcactctattattattaactgtgttacactgctatgcaatatatctcaaaaactgattcctcctgtctaactgaatatattttacgttaggttagaaaagcataattagaatattggatccatggttttcaactaatattattgaggacaagactcaaatcaatcttgtttttttttttaagttgatttaaagaaaaatgctagaaatgcaataatgtgggtggttcatggatatggctaaaatcatgatagtggatcacatcatcaaagtttataaaatgctggccttataaactggaggggtgcagaaacatatgtttcaatcataattatgctattgattatgaagaagatgctgatcatcatcatcatcataataatagcagctaacctccactgagtctttactgtatgccaggtactattctacgtgttttgcccatattccttacttactcctcacaccaacccagtgaagtagttttgttttgttttctttcattttatagttaaggtgactaagacccagagaggttagggaatttactcaggatagcacaggttgtcagtggtcaagccaggatttgagcccaggcagtcagcttctggtgtcttcttcttaatctacttccttttgtgatagattaagaaatattattctctctctgttctctaaagaagaaaggtggagaagcaacatggaaacatgcaacatagcatatgataatgccatgattatccatgttttctgaagggctctaacctgtgcagctgactggaccctgctgagcctttggcttccttatgtagcatcctggatgtgtactagagcagatgacaagggtcagtggagcaaaaaaaatctttggcaacttcccatattttcgtacttagaaaagtatcataattcttttccccagtcactttaaatatatgcaagcagtatctaatcttgtgggaaactgaaagtgaaactctctagcaaagagcatggttatattccaaggcagaagagacagagttaacctatgaaaattaaccttgactgtcaacaaatgtgctgaaatgggtggaagaatacagcccacaagactgagatgtgggtgggaattggatctgccaggtcccagagctagacctaatgcacatgtttgaagttcttctgtgactctcgattaaccttgatttaaagttccagaaaaatgctcaagcaggtgagaattctcatactgtctttctcatttgatatttttctgagccaaagtgcctactttttttgagcggtatttatgactagttacattgcacaaggaaacttgacttgggtgaggtgttaaggtatggagaaatggataattgggaaacttagaaaacccgtccaatgaacgtttccaagtcaccctccccacgggcctagagtcatcatgaacaattacttgagaattgtgaagggctcaaagaggaaaactgcagaacaaaatgggttgaaagaatgtatacttttgtcatttcgacttgaagccaggggctaaaactcatgtcttacaccattgtagtctacaaccatttaatttgctaacaagacttaactgatcaggatctgcaacctccttctccagtataatcaaaacaagaagcatttggctctggaaagtaaacgttgtctatcttttattgtctggccccaccattttctttctggcaggctgagatgaaacagaaagctgatatttggagccactggaattgtaggccttgtaatttagaaatatccattttatcccgtgtaatttcttccctaagattcctcagtctaaatctgatacaggtaggagccaagacaaacagtaaccatttatagtcacccagaccagtttgaatttcactctaatgtaaagcaaaaagagtttttggcttcatttcaggtgtgtaacaggggtagaaaatgcatttaaaatttagcagcaaatgttaccatatgtttccataacaactgcaaacttttatgttagaaaagcaataatataaacacgtaggaatcttggaacagcaaactattaatttaccaaatataaaaaaatccagcatgaaggggcttttatagccacagaagccatgaggggcccagcatcctgtgaatttctccattatgtggcagaaaatgctgctggttcatttaaatgagcaaatcttttaaaattataggtacagtgtccattctccacagtgcatttttgtgaaacaatgtgtggtgatgccagctatggctgaattcttcttaccatattgaactagtaaaatacgcttcggaagctactcccaatgtatatctgtaaaacaacagcattttctaccttcacttatagcttcaaacttaatgacgaaggctagggtcctgcagaaagtgtagtgcccagtagttggccctaatgcttggcaaggagtagatgttcatagattgttgatagatatgaacaaggttctcagttttctcacctacccattttgaaatataaaaagacaaggggaaaaggggaaaggtggatctatttaagcacatctcgagaatgaggagttagtaagagttgttgaaatcaaattctctgttctctgatttccctgtggaacaaagaaataatcttcttttaacatggctacctgtggatgggcctttcatttaaaaggaggcagaactttttttttccctagacctacctcagagggtacatagggttttgaatctttactacaataaaaccaacaatgttaccttgtcatttaaggcagatggcgtaccttgactattcctgaaacttgggttcatgatgtcactatcattaaacatataccaatcaatgaagggtaagtaaagtcaaagagaaaagaaggtcaaagggaagtggctgacataaaacttaggtgcagaactctgggtgcacaggggatgcattcaggaagggtgctggtgtggctgcagggtagagagaagggtgaaatcttcagaactttagaaggcagagtaaagagacgacggtttcagctgtggcagggttttcaccttggcccctctttagctttcacagtagagcccatgggctgttgagccggaagtggtgcagcaggggcattggttaggaaggctcacgtcgttagtgggccaaaggagatggacgctaatgtttaaggagcctgaatggatctgagaaaacgtggccaagcagaagcaagagtgagtggcatgatttagagtagcagagatgggactggcaaaagaagagctgctttgtgaagacctgattcattcccaactctttggtggacctctatttttagagcagaaacctaatttcacccaagttaccaccgtctctaattagaccagtaagaaagtttctcctgtttctgtcagtgcttgaccacttctggagtgttttatcccataaagcattctttaagcattagtgccattggagtctagcattgaccatatgggtccttaatttgtatctgagtatccagttgcatgaagatggatggttaagaaaaaaaccaagagctattcatttattccacaaatatttactgaacacctaacagtgtccctggaactgggtatacaagagtgaacaaaaaaaccacagcctgtttcttgtgctggtagagcttacagtctagtggcaggaggctgactaaaaataagcaagcaagtaaaaaagaggatgtcagataatgacatgcactatggagaaaggcaacaggtaggcaattggggaggggaatggaactttttagggaagcctcatttaagctgagatgagggggaagagaaggaaccagtcaatatgacagagggagaagtaagtgagatgggatgagagaggaaggaggggtcacattttagggttggagtaaagacttcatcatggagtttgctgacagatgaaacataaatccaaattctatttacaaagtatacggaaagtttccactgtgtggccagtgctgtgttaggtgctgtggaaaacacagttcctctaatcaaggttatagtttagttgttgggaaagagacataattgattgtgagataaatgccaagttaaataacattgaccataagtacatcatgagctctttgaaataagtagtcagtgtgaattggggaagtctttatggagagaaagagggcatcaaaattggagctcaaaactattgaggctgggcgtgatggctcatgattgtaatcccagggctttggaaggccaaggtgggaggattgcttgaagccaggagttcaagaccggtctgggcaacatagccagatcccatctctacaaaaaaatttttaaataaaaattgaaaaaaaaatctattttgcacctcctatgtgttgatggtttgtgtgtatctttaatttttttccttgtagtaatcatacaaaggtgagtggtttcatccccatgttatagatgatgaaactgaattcagagaaagttaaagataactattgacaaaacttcagctcaaaccatttaacatctgagaacctaaaaatcactgaccactaactaaaaatatgacgggctttgagcatccctgtgatatttctctccctgtctctttctctgttttgccgttgatatgctaaatgtcagaaccaagaggatctgtgtgcttgtttttagggctgtggggaggaaagagtgctctggggagtggatggtctattatgaagcctgtctttgggagaaaattctccaaatcgagcaggtagtggcagctactaagtgatgaagaaagcagatctagtcactggaggagaagaggaaaattagtggaagaagtaggtacttcttccttaccttgtaaggttcaggagaccatcaggatgaaaagatcatgaagactattgcaattagaacacatctcaccggtgtatttcccacagacaagcagaaatgctataaaaggaggcataatacagtcatgaaacatctaaattttccttttttttttttcttcttttttattttttagatggagtttcattctcgttgcccaggctggagtgcaatggcacaatcttggctcactgcaacctccacctcccgggttcaagtgattctcctgcctcagcctcccaggtagctgggattacaggcgtgtgccaccacgccaggctaatttttttttatttttagtagagacggggtttctccatgttggtcaggctggtctcgaactcccgacgtcaggtgatccacccacctcggcctcccaaagtgccgggattacaggcatgaaccaccgcacctggtcccactttggttttagaactaaggcaaccctatttaaaatgtatttctataatatgtagatgtttgcttcagggatcctttccttagattatctttttaagggttggcctgggcatagataggtcaactttaagatgatcttttttcaattgagggcatatcccaataaaattttcttatcccctggcttgcccggggctggcatttctgacagacgtgtaaacagatgcaagcattgttgctaatgacaggtgattataagaggcatggaggccaaggtaattaaaccacgatttgacagggacatttggcaatgtgatatttcagcattagaactctctttgcaacgcacttcctccacttggcttggtgaatataattcatttttattcttcagagtgtgttgctttgagatctgaaactgtcctctctgaatttcttcatggttcattgtagaacgctagaaaatgattaccattggacgttgtgggaatctagtcagtatctaagaccctatccaaggttcgtccagtagtagtggaatagggtctgtgaccctactgctggcattgtatttgaatattattatgccctatgtgatagtgatagtgcctttggagagaaacatgagttattttcataccactctaatttcagtttctctgttacctggatttacttgacgttgttctcatgaatcaaaagatagcttattcaaatctcttcttccctaaatttccactactggcagtaggagaaatctcaaattatcagtaacctggtattaggaggaatgatagtagaaatgatcatcaagacatggaatttatttattcattggagttgaatgtaatttttttaaagtaccttctttttgctatcagtaacaatgcctctttaggcatttagagaccacctcctgctaaccgctaatgtggcaaacttatgaatatatatttgggggaatcctatcttctattgtttaaatagcagaccctcatggactgaatatttatagttttgatattgactagctacatgaattatattatttatagtgaacatagtagtgtggtttcatctaataaaataacaggtcacatttactatttgttatggtcctggcacttgtctaaaatagcaacttttcccaagtaggtcaatccattccttgactgcaaaatcagctttttaatactcttggtatagggcatgcgtggccattttaagagatcagtgaatcggcccacttagagaaggttaaccactagctagatagctgttacttttcctcgaccaattttgattttccccagaaagggatgtagagggaaatgaacttgtgagtatagtttcttatggcagaggagtgctgagtgattgtgcctcttcctgggttgcctcctccagcgtggaaagcttgggaacacttcggcgggcagcctgggaagctggcggccggcttttacattctgcttcaggctgcagtctgtttctaagcagaggcttttttaaagctttgtcagataggttaaaaggtgtcccacccccggtgtataaaaaagagagagcgagattaagcttactaagcctgccatgttccctgtaaaatatcaagtcaaaatgattttgaaatccaaagttaccaggcttagggggtgtgaccttgagtggaagcagcctgggaactgggaaggagagatctgtgcaaaagacaattggccacaggctggtggcctcgggaaagctgccgaagccaaagtgaattgtctcatttctctgccttgcagccaacagagcacaaccccaaataaatactcagcctgacatctaggccggtggattcaccatggagctccaggcagccaacctttctcagagtgcctgcttaaagcaaagcctgggttcagctccagcagctgatgggggtgaataagacagggtctctgccctcaggaagcttaaactcagaagaataccactaaaaattaaaatcctcattgaacccctacaaaagcatccaaatcctttgcatgtattatgaatgtgtttaatcctaaataataataatactaactagtacatattaagtgcctctctgtgccaagtactttttaagtgctttatgtgaattaactgttacaatggtaggtatgtttattatctctaattttaagaaaagggtacgtggagccaaaagatgtcaagtaaccttcccaggggcacaaggctgggaggcaggggagctgggattcccaagcaggaagtttggttccagagcccatgctctaggccagtggttctgtaattttagcattagaatcacctgtgggcttgtgaaacacagattgcaggcccttcctgaatgggcttgaatagttgcagtcctaacaaattctcaggtgatgtggatgcccacagctctatgccaagtgggaagagcacagtggaaaccagtcactataaaacaaggaaaagtggaacatcctgttactgatgtaagcagagtgctttgagaatgtcagtagtagctaataataatattatttattattattataattattattgtcattataactgtcatttattgagtgtttgtactggacacttttgtaaccatgtaaccattataactgttactgtgggtaatctcatttaatccacacaacaaccatatgaggtgttaactgtactgtacagctcaggaaactgaggcacagagagtttacaaacttgcctaaatgacaggccaaggattcaaactaccccagcctaattctggagcctaagcttttaaccatgaagaagatagtgaaaagaagggaatcaaacacccatccatagagcaggtagggtacaagctgggtcctgaaggaggaagatgcccaaaaaaggcttcccaaatggaatggatatgtgcaaaggcccaggggcatgaaggtgcaaagtgtgatagagagtgaataacatggagactcgtgtgtaaactgcatggcaagaagtgatgaaccgtaaggatgggaaagcaggttggttgaacagccttgaaaatgaggagtcaacagtattcaagactggacttggggatttttgaacctgtcagggacacactcagcctcaaaactcattttttgagacttccaaacagaatgacagtcatactttgttaaagatgcaatggggtcatctcttctctcctttacatagtttgagagtctcaaaatacgttcagagaagagctggatgtctaaggttactaaccctgtgacagtgaatcacaccctgccaggggaagggtattttgtacacagccacatcaaaaaaccagtgggatcatgtgtgcccagctgtgagtgtatccgtgtataaatccactcactacacttagaaaatgcctgccgtgcgtggcactggtgcaatggtatcgttggagctgccaacttgttttatttctgatagtgcttggcagcccctgaaggagggaaagtatgaatttttatctcccatttactagactttcattgtattgtgcttacagacacagtgtcagcacataaaatgttaaacatcactggtctgaaagaggctcccattgtcttacctctggtgctgggggaatcttgctagctttgctgtagtggttctgtcagtgtaatatgacatgaagcatttctcagtaatgacagacattgaatatgagtgacaggaaccctgaccacaaggaatgggttcaattaccagaaatgggggtggggggggcgcggttacctgagataaaaccaaagggcccaattgtgcttggttttgaccccttgactcccagatccagagcaaagacaaatggctgattaaccagcccctaaccctctttttcagtgataaacttgtttggatttctctgtccgaaaaaaaatctatgggtggcatggtttctaaaggaaatatgatcagaaacaggaggactggtgctcgtcatttttgtctcttgcaagcacaaaactgaaaactgtcattctatcttggactggatctaggacggtgtccagaaatcaatacaagataaatgattgctctcttcaccccacctttcttctgctgcagtgcctacattgctccagttcacctgtagccaacctgacgccagtgtaaatgagagatcctgccatcagaggctctccttttttttttttcccctctcctgcaggctgttctgctctgcatcgagtgcagctttgtgcttgtttatagtccactgcttacagcccccagatagagttatagcgagcagaccaattaaactgtcgcaggctgccctcacttgactagctctgcagagtcatttagccagcagacattcctgactattaaagctagtagcagcatgtctccagtgctggagataaaatgaatgaaatttgttattgtgggctgacacttgatcctagctgttgaactaatgctgttgcacctgaagtttttctttatggtaattgctgtctatgttattatttcatatactaaattggagaaaattgcaacaagtattaaattctttgagctaattcacgagagttctattgtgcattcttccaaggtagatcccaacttctgttgaagcctgggaagacagatgtagctagccagatgcactggcttgtgtttcatcattatcagagacatttcaatttcagatctggccaggcatttatcagctttacctgaaatctcttttaaaatacactttcgcttctaattcagtcagcatatgttgggatctaccctggggaattcagttatgatgaccaacattgacagtgatttgcgctagtctggctgattcagtgacagatacttggtggtatcagtaagtctctggcacagtatacgcttaggtaagtgggcagtgtgaaataagacttcccaccgggcacctttggaatccacagctctaactgggagtccttgaacacctcaggtagtaccacttcaatgagaacccatcagaacaggtacatgcaaggtacaccgcctcccaaagcatccgaatcactagtcctcactgccctgcccatctcctaatttctgttaactccttttaccagatctctttccagaattagggagattattttagacttttcaatataaaccatattcagagtttagtgaaatctctgaggcctctgtttctgtggtagattgcatagaagatcatttcttttacagcattcatttgtatgcttagcttgtggtcagagctcgtggtgaaggctccagacaggacccagaataagaattcaggcctggtttgtggtagaagtactatgcttgctttcatgttaatgctttgggaagacactgaccccaatcataacgttactttaatttctacctgaagaccacacctgacagacatagcagggctctgtcaattacagggacatacatctctagaaccccaagactttgtcacctccctactaggaaacagtaggctggttgtactccatattttgattagaggcaaatgtgagaggcctgaacgtcgaagtactagaagagagacatggggttttgttattatgtttcatcattctgcccccaaatttagggacagtccacagataatgatgcgtcctgcataagtgctttctctcttgacatagacaactgtaatttgaatgataatggctagcattagtgtctgtggtggaggatttagattgcaagttgaagtccatatagtttgtgaggtcccaaatatactgaatgtatgttggtctgcattatttctgatattcataacctttgtttaataaagaagctcttttaacaactcaaatctgctaaaattgaattactgtaatttgcagcaaagttcagcatgagaaatgtatattttctttccccactgagaaaatgaaagaagcattagtctttcgtttatatatgagatgggtagattatgtatagagtatcaagtttagaagatttattttcccacgctcaaatccaataggaaaaactggcattttcatcaaaactaaactaagactaatctttattctattttctgaaattgccaaatgtacaagttttaggtattttaaaacagtatagtcacaggcaaacattaacttgttcccagcggtccttcagatgcacattcattcttgtctttggtatttgaggatcctaatgataccataataacacaagtaaaagttgctgtataatagctgcatgtgtgcatttcagacccagaactaattctccatgtttctgtctctgtgtctctcaagcaggagtggtaagctcttctctccaaatcttacctggacttacttttctgtatatttgtgttattgttggggcctagattgacctcttttgtgtggacagcacagagaacatagggaagacctcagcatgcaagctgattgacatcatttggatctgtgtctctgaccaaatctcatgtcaaattgtaatccccagtgttggaggaggagcctggtgggaggtgtttggatcgtgggacagagttctcatgaatggtttagcaccgtccacccttggtactgtgtagtgagtgagcccttgtgagatctggttgttaaaaagtgtgtaccacctctgccccgacccttgctcctgatctggccacgtgacgtgcctgcttcccctttgccttccaccattgtaagtttcctgaggcctccccagaagctgagtggatgccagcatcatgcatcctgtacagcctgcagaaccatgagccaattaaacctcttttctttataaattatccagtctcactctgtctcccaggctggagtgcagtagcacgatcttagctcactgcagcctccgcctcccaggttcaagtgattctcctgcctcagcctcccaagtagctgggattacaggcacccgccacaatgcctggctaatttttatatttttagtagagacagggtttcaccatgttgaccaggctggtctgaagctcctgacctcaggtcatcctcctgccttggcctcccaaagtgctgggattacaggtgtgagccaccgcgcccggcctaccaatgtatttcttaaaatttaaactttaaaactgttttcctaagtgtggataatttagaatgggttgagctgatatggtccttcccatgtgaattataggcctttgttcaggtcagggatcagcaaactttttctttaaaaggccagatagtaaatatctcagattttgtgagccatacagtttctgtgacaactgttctcctctgttgttgtagttcaaaaacagccctggacaatatgtaaatgagtaagtgtggctgtgttccagtaaaactttatttactaaaagaggtggcaggatttgactgtcaggccatagtttaccaacccctagttgaggccaggaggaagggttatgtttaagggaaccagaacacaaccaatatgttgtattcttttttcatttgttgttcatgtaaattgctggtgagagagatgttctctcagcagaacttgaaaccattttcattggctggggtttaatatttttttaaatctcttgtttaagcacatactaaaagtgtccatgttctttccattaaatgtgttggttgccttcccagacttcaaattgcagtgaatttatccccaaaagatgtttggtatcaattctcaagatgcaatttgaatgtagtctgcttctataatggaaacagtattccaaatcttcattatttaagtttcatagaaaataatgaatcattgaattggttattactcaacattgttaaggcatatactgaattctttgttttcttgtcttatagccttatatcagctcaaaggataaaatagtatgaagatttcattttatggatacatatgagacattagattattattttctagctaaatcgtggtaaacacaaattatattataatgaagcttttttcccaataagcattttataagaggaaaacctgaaaacaaacaacaatcagcaaaaagtttatgagtcattcaccctaacaattgtaatagtttccttgttactccattcctgtagtgatgaaccccccgccctttttttgttttgagatggagtctccctctgttgcccaggctggagtgcagtggcgtgatctcggctcactgcaacctccgcctcctgggttcaagcgattctcctgcctcagcctcccaagtagctgggactacaggcatgcgtcaccacgcctggcttgtttttttgtatttttagtagagacggggtttcaccatattggccaggttggtcttgaactcctgaccttgtgatccgcccaccttggcctcccaaagtgctaggatgacccccttttataaaacgtcccatcatgttagctccatatagtagggattagtgacatcaaattctttttgggaatttatagtggcactaggggtagcagtatcatttaactgtgtggcatgtttgggtaggtagcttttctgtttaaaagtaatcacccttccccacccaagggcaactgtactggggatggaggagaggtgtcagcagaaattgcattctcaacatctcaacttccttgctccctgcctaagtgcctcctgaaccatcagcttactataactaaagtttcttgtgttctcttgatttatctcatgctgtacctgtgaaatatttagttaccctcattctctcttttctctctgttttctagagcaacgacatagggcagtggaaaaagaatgagttttggagtcaaaacccctgttatcttggaaaagccatttaacttccttgaccttcagtttcatcttgtgtaaaatcagaataataatgccaaccttatagagtaattttgaaactttttttttttttttttgagttagagtcttcctctgtcacccaggctggagtgcagtggcacgatctcggctcactgcaacctctgcctcccggattcaagagattctcctgcctcagcctcctaagtagctgggattacaggcatacgccaccacgcctaactaatttttgtgtttttagtagagatggggtttcaccatgttggccaggctgatctcgaactcctggcctcaagtgatccgcccaccttgtcctcccaaagtgctgggattacaggtgtgagccaccatggcagctgtaattttgaaacttaatgaggatgtatatttaagtgctttgcaaattgtgtttataatgtatttgttatttttactgtttaattgtctgcccctaccctgttctggagaatcttgtaccatcattaaaataagtaaatccatagtgctattaatcttggaacattctatgtggaattgcccatatgaaaagcagtttgattatgacagaatgccaggcagcagtgttcccattgtgttgaataaatggcatccccacaatcacaatctcaaataccaaaatcaacaaggaaaattccaagcagctgcctttataacttctgatttgtgggccacatttgaaaccacagtttgatttctcagtctacaacattttaattcatagagcaggtctttctctattagcacattctcaagatcttttgttgatcttggtttcagttgctctggagaacaactgccttccaaagctcccttttaaagtaaattttctttttaatagctaattctatttagaggtggaccaagccaagaatagcctccaagttcagtgaccatctttgcagtcatatacaagtgatgcaatcacaaaaagaaagaaacttaattttatgccgctagatatgaaagacaggtagctatgaatgcatggctccaggaccttctgccatgtcaaatgagctaaacccttccccgaaagccagccaggaaaacgtatgataccatttgcaatggtagaatgttgcatgctgttcttctgtaattataatggcctgatccgtgtggagtgggtgagtcctgcttaacaatcgttaatctactgagtcttcgtatcagcctcccatcttgaggagcagcagttcttggctggatgagtcggtctttgatttcattataataaggatagctttgttaaaattccgctgcgcagtggtgcctaaggattctgggaaaaggtttttctttttattttcccctttttttgcacggtggggatgaattgtttctctctcttccatcccctaggttactgtttgtgctctcccttgatctcctgcttgtccctttatttctccacgttgtgaaagtttctttctgtgtgaccaggagtctgtttagcagaccatattgtgagtgaagggccagcgtttgttgcctgattttggcaacgctgggtagtcagctgggatgtaattaagactctgagaacaggctgtcttctccacgggaagggcatgttagatggtgctgggatttggggctgtcagtttggccaaggatggagacagagagctagggacagagatatttcctttcatttataatccctttatgtacagtgtgtgcacttggcaaagtttacatataacctagtggctagagcttacaagccaacgcagtgaaattagcatatgttacatgtattttttagtaatattttaaagcaagtgcatatttccaaagtgaattatgcatggatgacagcaatagggttgtgttgcactgggtgtcaaatcccacaactttttgtcgagactgtgggttttacactaaaaaggcagaaagactaaacgaagtaaaacagttttaatttttaacagtttggttcggcccaaggagccgggctgtgacagatataactgacatttgaataattggattaatttagagaagggcaaatccggttttgacggttgtgcttgtgtgtacatctttttttattattatttgcaggaatggagttgtgtggtttaaatatacactttttgtgctgcctagcaaatcttgagaaaacatcacaaaatttatgaaattatcatttaattaatttgttttaatttatatgtatgtatatgtgtgtgttcacatattatgcagccttcatatgtatataaaagaaattcaccatatatacttgattcgggtctatcagtgatatacatatatacacattgcacatacaagcacattgtatgtgcacttaggaacttagtaaatccagcttgagataatgtgcatgacttcataggatgtatagaaaatgtgcagacaaggaagctcactgtgacattggcaagcccctttcctccccatatcaatgtgttgcaaaacatcacagtgcagaagcagaaaagcctaatttggtatctggggtatcagtagccaaattctacatggttgattcctcagtcctaagttccttcagattcatatggctttttaagtttcatatatgaagataatcttggcaacataaaaccaagtacagcaccatcatcgccaccctcctccagaaattctggtaatgaaatacaccatctaaaatcagcaggccaagtctaggactcgtggcaggcagtcttgaattgtggctgtgggctggctctaagagccttttccccagcaggacattaatagacattaacactctcggacaagaagtgttgatgtgtggtttataatgttagcacccagttaggcaggtataacacatgctgtaggaatcttgtaccaacacatgtgtgtgttgagtcagattaatgagaaccataaaaggagagacatttcacttgagctggggacctcatcctatccttttaccaagtaaaccagtgctcagctgggtggcagtgtcctggtgggatgttttcaatattagcataaggaggatatttgaaagttttgttttgctttgttgttatgtgatcatgaagcccaaactgttagtcagtacagcacattcaaactccttttcatctagtactgtttggctcagaggaaaggaaactttcacgatattcacaactacactatggggcaaaagttattattttcctctctcagatttacctgacccttcttcaagtgtttctgaatgattctgagacactttctggtttactttgtaaatggggcaatgaagcattcttatctcctgactggttctccttagagaattctcaaagccttttaaaattgtgtgtttttctggggcagccttgaaagtcccaggagtgaagttgccatctgtcctttatattaaaagaatcttctgtattgtatacctgatgtgcttgtcccagagatagatattgttaattaaaggacagcatttgtcctttatctgaaataactctcttgcctgaataacagtttcccaagccttaggaaacaggtaaggacattcggcccagagccctgatgtttactaaaggtccttggtccaggagctgtccctcagccttcactagatcagacatgtagactagaaaattacttgcttattttttggggggggcttgttttctattaattcatctaccaacattatggccttttgcatgcgtgtaagtaaatgaacataatatatactgtcattggtagtttgtgctttttttgtggcgactcacaaacagcgagttcccagacattctcaccacactgcatctttatgcaatagatgtgacaggacctatatcctccagtgtcacctctctactactgcacactctctgtttctataccttctgcccctgggaaaagaaaaatgcaaacatctgcctacagcaaacagagccagagttctgccaggtgatagctagaatatgtatagggagaaagaaagcctcgcccgtaacctgctctatctctgtctcaggaaacgcagaaaataatttgtctctgtaatatagaaaagcagttagggtaacgtggctgtgaactgctgcctaaaagtgtgctgtgtgctcgcctctgtagttgctaagcacggaggaggaggctagccagggccttgccacagactaacttcaagaaaagaggaaaagagtgcaccagcagactctggactgaggagcatgtccaacggaggaggcgaggtgtggccaatggttcttttgttgataagaaagaccctgaaattgcctgttgcatggtgaggagagtagtagattggaccgtaattttctggtgacctaacaaaccaaactaaagctcaagtttaataggcaatgattcccgtttaaaagggaattcaaattatttacagttctccatcatcatttgcctcccttaatcatatggactaggaattgggcaggtgacatacaagagggaagccgacttgggtgaaaaacaacaggggctgggcgcggtagctcaagcctgtaatcccagcactttgggaggccaaggcgggtggatcccctgaggtcaggagttcgagaccagcttggctgacatggagaatccccatctctactaaaaatacaaaaataagccggttgtggtggtgggcgcctataatcccaactactcgggaggctgaggcagggagaattgcttgaacctgtgaggcagaggtcatagtgagccgagattgcaccattgtactccagcctgggcaacagggcgagactccatctcaaaaaaaaaaaaaaaaagaaaagaaaaaagaaaaagacaacagggatggtggtgggtatggcaaacaggtgggcacttatgctgtctacaagggacagttgcttccaactccaaacagttattaccttacagaggtgtgggcccaggattgcaagactagatttttcggtgaaagccgccagtgtgacactttttgagttttcagtgttggcagataattcactgttttaaaacatgcagataaaactcaactgtagttggatgtactttacgggttgctagtttgcacacacttatatacataatgcagaacataagtgggaatattctaaataatagacagtgtggaaacttttcttaataatagtaagaaactgagccccaaacaactattaatatgtttagatgtttccctttgggtctttatttactgcatatacattttatatacatgttttaaaatagttgtaatcataggagcctgtgatttttcacttactgttagaagcagtttctttatatgatttataatggctactggatattccatgtagaggatgtattacaatatgcaaaatcatttccttattgttggacctttaagttgcttttgatttaacatagttataagtaatgctgcaattacatatttgcttataccgctttctcctttttttggattagatccttagaatctaaaaggaagattactaagtcaaaagatatgaacgtttttatggcttttggtacatattaccagattgctttccaaaagcgttgcaccaatttacactgcaatcagcaaagtatacatttatccttgaagcattattatatttttgaggtttttccttctaaactggtaggtgaaaattggacttcattgatgtttgagtttgcatttcttgaggttttcccgttaatctgtcgactaattgtatttgttcttacaacatctgtattttctaaggttaaattttgtggaggttttgtttgctttgtgtatatgtgtgtatttttaaagttctctttataacaattgataaataatttgggaacagcccccttggcaaggccttcctctaggggaccccctgtctcagcagtgctgcagctgctacttttaactgtgtgttaactcggagttgggccagggcctaagcaggatccccttcccgaagaggggctcttttgtgtctggtgaaccacaagctcagggctgtatctgccaatatgtttttggcagaagccatctaataaaatcccatccgcgctgttctatgaaatgcagtcacaaatttggatgatgattgcctgatgccatattttggtaacagctaatctccatgtcttagatggtttttattcattgcctccccccttccctccttcaccactctgcttggtgcatgttttaacgacaaatgatgtataatctgagtttcatgtagcatggtctaatggaaaggcactgagccagtcatatggagacaggggtcctattattggcactgccctttgcttaataatagcttaacaactacaacaaatatttatcctgtgctgaaatgctctttcagcattcttcatgtattcttgaatcttcctaacagtcctgttagacaatattattatcctcgtttaggtgaggaaactaaggctcggagtattggaaatttccagtacttgtattggaaagtatgatattggacaagtattttcaatacgtgtgttgaagatattggaaatacttgtccaatatcatccttcatctctctgaactaaaaatgagttttttatttctagtaatctgtctccccatctgcaaaatggagttgcttctcttcaactcagaatggtggcatggaactaaaatgatgccatgtagatattaagttgccttgagtattgaaatccaagacaataaattggtaataatatgtagttattaactagttcacctctgtgactctcagcttcttcattaattaaatgtagggactgaaccagattcatttcattggttactttcagctatcacattttcccatcagccacagactcaaatgttggtggataaagcctgcgtggttcccagaggctgtgcatactgcctacatttcaatcagctctacattttaggtacatccatccctctcagctagtgttcttaggaagaaaatgcaaacttttaggaaggagaaatctcactcttcagtgtttgtggagagtgcagggaaattctcttaatggaatagtagagataccattgtctgacagccactgtaaagccatatggagctgcttgcttttggctctggagatattgtgacctcttaaaatatatttttctaaaaaaggaacatgccttatttctgtttttctttatacttcatccccaggtaggaatttaaccaagatggttaacggagaaagtaaggcattgactcagctccatacaaaaatgcattctggcttgtttgcataaatatcacagaaaaataggggttcaggatcccatatggcacttagcctcctaagcaaagatcatcagccatagacaagaagcaggtggcctggcatcgagagcagaggttatttttgctgctgggctcccgccatttcagagtttaacagtggcaagtctactcagcaggaggctgaccccagatgctctccccttgtcggacatggagccgtcccatgtcccacctccactgctgggagtaaacctgatcaaatctaggccacagttagactcccagataagtctctgtttaagcttattcccatttgctacttaaataccacttccaaatctgattcatttggggtgaagtcacagacttaattgttcacccatcctgggtggctcttgaaagcctgtgataatgatatcttggcattttcttttaggtgaaccctagtgcaacaggttggaaagggctagttttgaggatagtgttagagaccagaggtgtggaaacctggattctgcctctggttctgcctctccctagagctcagtctcactgtgtgtaatatgaagagatttggaccgtgtctggggtttcaaattcagttgccaacagggaagtataaaaaatgaatgagaagggaaaagaaaggaagagggagacccagtggaaaggtgcatgagggaactttggggcgagtgtgaaaatgcatatcgtgattggttgatggttatatgggcatatacatttttcaaaacttgtagaacttatactaaagatctgtccactttaccgtatgtaaaataagtgtaaaatgagtgaaatggactaggtagtaaactgcagagcatatacctcatttaaaaggggcgaatgataagctctagccaatggcttctcttcagaatagaggcccagtgttgctacattttcaagtaaagccagaaattcacatatttatataaaatctcaggatatgtagatttatgggccctgcttggtcaaacaaaatgccagttttgtgatctctgaactttgggcttcttaatttgagtctgaggatcattttagcttcaacattggatgatgccgacttgcggtgagacctcagacaaaaagattaaacttgcctacacctcagtttttttcacctgtaagatgttgataattcatgactaatagtacaggggtctgatgaagagcatatgaggtaccttgtacaaagccactttgaaacatgaataaataacataaaaatgcaagtcactattaccttttttattattataaagaattatttccgtttttagaattgttattgttcagaattgaagcactaaacttagtaaagatggctaataaaaacatcaagattcaccatgagtaaatgacttgcctgcaaatgatcatgcaaacctttcactatccttagaggggaatgtttctgttgtgtgtgacaagaagaaaaggcatttcatttgtacagctactcatataaattgcaaaaaccatgggagctgaagtccaaggtacagcaatagcatataacgaaatgaacttgatgctgtattaaagattctttgtcacacgcactcactgcctaggagtcgtaatgctcccagccttgtcactgacattttgtgaacaagcagcctgtattggatggtgataaatggattatcttaaatgtcattctgcactgttttagagttgcaaagagagttttgatattgagtttttggttagtatattctgtatcaatcctttctgatgaaataatctcctcaagttacatccagaaatgtcaaagttgcttatttcttcaatcacccatagcaatgtttccattacaacgtatgcagagaagattgtgtaataatgtcaaactatttatagaaacatttcctaggaatctctactctccttgagttgtttgtgtatttaatactagagatttgtttttatatgtatatatatatttctatttctaaattgacttcagctgaggatgttgtactttagtttttatatagagcacattgaaaacttggtaatattagcattcgacaactaaaactaaagccacgctaacattttgtaaatagaaagagtcacgtattttggttttaaatattgtaagtttttttttttttggtgttgcagttgcagctgtgtcctaaaggttgtaaggttgttatattcataacaaatttaaacctatttatttagtctaaagtagtatggaatactttgcccaaagaagttttcatatttattttatgctaatttctccattattttatctttaatattttttgactttccaaatttaatacaattattgctattacacagaatttagtcatttgtataaagatttggtctggtggacttgtgtggaaagaagcacaaaatagattttgaaagcatatctcacattttacttggcaaagttattctaaatattggctttcttccctaaagataagatctttctagatacagatattgaaaatactcagttagcatataccgagtggctcccttcagactctctgtactctacgaatcttaccctcatcctgtcattctacagtcctcaaaaaaaaaagacatgtaatttatattttaaaaatccaaacaatataaataatattagattggaccatataaaattactattttttgtagatccaaacagtcacataggagcaattttatgtggctcacccaagcaatgaagatttatattgtatttactacatgccaaacatgtgctggatgtatatgaattcatatactgattatagcaaccctatgagtaggtgctattatttcccctaacctacagatgaaaactttgaggcacagattgattaagtaagtatcagaaccaggcagcctgccaccagagtctttgctgatcatcaggactctgtgctacctctccaaaatagcaaagttccctggctctcccaccccagtgtagtgcttttcactgtaaaaatttaatgatgtctttcatcttacatgtcttaatgtgatattcctttcagctattctaatcaaatatattattcttttctcttacagtttttgtgcattatatctttcttaagatcaactttctttaaaaactatgtttttaaagaaattcactttaatggaattctgatgctttcatagttttgttttcagtgtttacctatttaatccacctgaactttacttttgtgactggttgttgagtagggattaactttattattaggttttcaaatggacgggcaattggcacaacaccttttatggaataaaccattcttgcctccactgatttgaaaagacacttttatcatatactaaatttgcagaaatttatgtgtcaggtttttttttgcctaattaccaaaactttgtgtgtttttagatattatagggccttccctcctccattttctttttagaaaatttcgttaactgttttcatgccctttttgtcagatgaatcttagattccgatagtcagattccataaaaaattttaaatcctgttggcattttaatataaatgcattgaatttataggtatatatgttggagaattttttaaatgtcacctcatctattaacatgttttatttcttcatttatttatgtcatcttttgtgttcttaaatgagttttaaaattttcttcacattctcctttatttctagatatttgtgtttattgctgttgtaatggaattacagatatgtctggtagctgttgagtttttgcattcatatagttaccttactaaattttattagttctggtagtttttcatttgattcttctggaatttctaagtaaggaattaaataatccaaaataaaatgatgttgcctttctctctccaatgtacttttgttggtctctttttcctgtcttggctgatattttttggaataatgttaactagtagtagggataataggcaccctttgattttttttcctgttgttaattaggatatttcaaaagttttgcagttaacctggagatttgctgagatttctgatcaatatcctttattaagtaaaataattcttattctctttaattctctttaatggttgttgcatttaatcagatattgttttgaggggaggaggttatctactgagatgatgacatgggttttctcctttgttctttaaatgtggcctattacattattggatcttatattgttgaatcatctttccatttctgaaatagagcttactgtatcttgaggtaatatatgcaggaacttaatttggtgacattttatatataattttctataggtgatatttttctatagcagtattttctgatgctctctgaccctggttaacaggtctcagtagaactcattcattcctaacatttctgtgatgttactgttttgaagcttatccaaagcttgattggcttttgattattttagcattaaggcttttgcatgcaatttccctcaaatctttgaagtttatttctgtttatagctttccttaggaaaggcatgagtttactctttcaacttttttgctcttgcctcctatcttctttatggggagagagtatacatatttctttgaagcatgatgagtataaatatttctttgacatctttatgaaacctggaattgtctcttttcatttggaaagaaataaacttttcttgctcatcattctttatgcataaaactatagttttagttagtcctgatttatatgcagtgttcccctagaaagagatatttatttatttatttatagacagggtcttgctttggtgttcaggttggaatgcagtgctgcaatcatagctcactgcagcctcaaactcctgggctcagaggatcctcctacctgtctcccaggtagcaagtactacaggcatgcaccactatgactggctaatttttaaaaaaattttttttgtagagataggggtctcactgtattgcccaggctagatatttagtattttataatgagaaacagtgaggttagagaagacactattgtttcattttatgcatgtatgtcacccttggcaaatatcactaatctcgatgcacattttccttctaaacttgtatatagccttcttaacatggcacaccaaatagttactaccaattgattggtacttgcaatttaaatgagacctatttgcaccccctagtatggaaacagcagtctttggatgccaggagtcctaagctttcagtctctaatttgcagtgtgaaacatcaagctatttcaaaatttaatcttagttttcacagctatacaatgaagagattaaactggataatataatggattttctgattctgtttacatatgctccttcattatttcagggccaaacatcgttttaggttttgtaaattacgactaaactgtgtatttgtaactttattattactattttgttgttttcttgttcatttgtggttttgagattgtaaatacatctgccatttagctaattctcttttgtggccaagtactttttcttacttttaaaattaataaaggctcattgtagaaaatttgaaaattgtagaaaagcacaaaaggaaaataaaaattacccataatcaccgggtgcggtggctcacatctgtaatcccagcactttgggaggccaaggtgggtggatcagttgaggccaggagtttgagaccagcctggccaacatggtgaaaccccttctctactaaaaatacaaaaattagctaggcatggtggcacacgtgcctgtaatcccagcaactcgggaggctgaggcatgacaattgcatgaactcaggagacagaagttgcagtgagctgagatcatgccgctgcactccggcctgggaggtagagcgagactctgtctcaaaaaaaaaccaaaaaagtacccataatcctaccacccagaaggttaacatttggttatgattagaaatatttctgtttttaaaatcgttatactctttttcatagaatattattacatacatcactgaaaaataattttcctcaatatatacaatcatttatttttatcatatctctttagggtttcacttttaaatattatgacagacatccttttataagaatctttgaggctttcttgaacagattcctagatatggaattactaggtaaaggagagtgtacattgtaagttcctaacaaattacaggttcttgaaaaatatatctggaatggatgtttgaataaaatattgccaatttgatttctagaaagatggaccaatttacagattcatcaagagagaatgcctctcccatctcaagtttggcagcatggaatattacagtttgaaaacatcttttccaattttatggactaaaagtaacagaatttctttatcactactgtgattggatcttttttatgtttatggctgtgtgtgtgtgtgtgtgtgtgtgtgtgtgtgcgcgcgtgtgtgaatttcttgtcctctacattttccccttccttttgtggcgtacatgttaactgttaacagctgcagtgcctatgagctcattatcaaagtgttgctccataatttacaattatacctaactttgggggcaaaatcccaatttggaggtcaaaaagagaccaaagtctctgtacatctcacatgactttacttgcattaactttgccttcctaaattacagtctataattaagaagtgctagtctcctggccagctcttatggttatttttgaagctccttgggtgcttgcacccttccagagggctgttactttgccccctctctggaagctcatttgcttccacaggaagccttaagccaaagcacattggcttattcaatctggtgtctggatcttaaaacctggcttctcagtttatgatgctcaccagtaaaacactcatggctcttcttgccatgaagcgaaccaggcttgcttagcttagcttcatgtgtggccttcgtgaatcaaaataagaagaaggtagaactagtcccacccttaagtcaagaagaactggttagtcatgaagtgaagccacatgactttgctcttttctattatgtcttctaattgtttctgacaagaatccctggatttctctcacactcttctagcttgatgctattgggctccttttaccgaacaattgtgaaattagtaactaacctctgcttgctgatgagattgtttgacagccgtttgctacctggaaaccagaatggctggaaagagacctgtttatgcatttttcatgttaaatgctaggcaaagaggttataccctacatgtggactctaagctaaggaagctgacacgtggggagggaaaagggctgaaatccaatgcatacgcccctcttcaatcctgggagattgtatttgcccgtcagaggcacctttttctaatttgcccagaggtgctgaaaaggcggctgaggccctgctcaactgcctgaacaacttacagaagcacctctccttccaaccaggttaggatccaaaaagctgtatgtaaaacctcttgtttataaatccaaggtggcattaagcagccactgggagtatgatctgttagggacaggcttttgctccagtatttaggcttgttcttatcagtaaatctaaatagaaagttcctaagtaaagaagcttccgtatttaaatagctcaaaatacgacagccttatttttttaatagcggcattgtttctctttcccaaagcaaccataactgagacaggattagatgcaaaaaccacttgctgatacagtttagaattgcaaaattctaaattccaacagattcatattatacacaagtataaacagagtgtagccagttttcctcaaagagataacatgggttctccacagtatttttgacccaacaagccattattaaatttggagagaaatttttgcctgggaaccttggctcacacctgtaatccagcattttgggaggctgaggcaggaggatcacttgaggccaaaagttttgagaccagcctgggcagcatagcaatgctctgtccatacaacaagtttaaaaattagctgggtatggtggtgtgtgcctgtaggcccagctaatcagaaggctgaggcgggaggatcgcgtgaacccaggaggttgaagctgcaataagccatggttgtgccactgcattccagcctaggcaacagagcaagaccccatctctaaaacaaatgggagtagagttctaatggcatccaaaggtaaaggcccatattccctggtgttccccaaatcattgcaacaaaaaagcaaagccatttaccctctaagtaatgtcagtaaacaatgaaggaaaacctgaagccttcctgcttaagagccattctgaggcctggcatggtggctcacgcctgtaatctcaacactttgggaggccaagacgggcgaatcacctgaggtcaggagtttgagactagcctggccaacatggtgaaaccccatctctactaaacatgcgaaaattaggtccgggtgcggtggctcacacctgtaatcccagtactttgggaggccgaggcgggcagaccatctgaggtcagcagtttgagaccagcctggccaacatgatgaaaccctatctctactaaaaatacaaaaaattagccgagcgtggtggcaggcacctgcaatcccagctcgtcatgaggctgaggcagaagaatcgcttgaacctgggaggcggaggttgcagtgagccaagatcgcaccactgcactctagcctgggcaacaagagtgaagctctgtttccaaaaaaaaaaaaaaaaaattagctgggcatggtggcatatgcctgtaattccagctactcaggaggctgaggcggtagaatcatttgaacccaggaggtgaagtttgcagtgagccaagattgtgccactgcactccagcctgggcgacagagcgagactctgttaaaaaaaaaaacaaaaaacaagacattcttagcttcatttcaatatctccatcctaagccttagagaaaacttcagtcctcacctcaccacattctgttattagaaggcattaagaaggaggtgttctaagttcttctcaaccttattgaggatgaaggtgaagggttgtacccttacaatagggcatggtatacctccaatacacctcttttcttttgtctgcccatgtttgtgactatgatgtcctaaagcactttatgtgagacttagattttcttttttcatggtgtaagttaaatatgaagtaatcttgattaggccttttgttcacagaaccaatgaactgatgaaaaccttgatgatattcatgtgtctaatgttatcatcggaggggtttcagtgaaacagcttaactttaggttcagagaggtttcattctcacaccagatccagaagttactattataatacctgcttgcatgaacttgttcatggtactcactggtacaaatttatggcttcaagtgatagaatgctcagtaatattgccctcttggaagctgtgcccaagaaacttagtttcctaactgggctctgcagctgttgaaacttcatcacctttcacctgaatctctacaatgctttgcaaatgaggagctggtgagaaaaatatgcagctcgaagctggcaaagttttaagtgggtaaagcttgcagtgttaagatcatagccccaaattacttaagggcttctgctaacatgaaaataagactcttgactgctgagagattggatattcagatagatttttttatgaaggaaataaatatttcaacatgcaaacactacccaagcgggtagtgatgcttcaaaacagggtcagaggtcaggtttttttctgtttgtgttttttgggatggctccaagtttaaaggtattacacatcactacctaccccgagcctcacatggtaaagtaattactgctagctagcggaaaatatgtacattcatttttatttccaaagatcctgagatttctctctgcgctttttgtggtcctcattataaaaaatatatcatgaagaatgatggtttttctccatcctaacggtaaaagagtcaagctgaaaatgcatgtctgatactcaacttttttaacaaacttaattttggaggaataaataagcatagaatgtatttattctttagagaatagtagagttcatttttatagtttgcctttaaaacatgcaacagacccctagggtattggataatttttagaggagatgctgacctggtggtcagccattttgacggaactggggcccaggatatcttcaggcaagcataaagatgtgtggcatacattgttctgaaacttaaacactgactttctcagtggagtggaatttgggtgactgttggaattgctaaacaggacttagagtttcagaaacccttttctctctgccttcaagtagggaaaataattatttgctgagcaattaattcgaattcacaaacacacacacacacacacatcagatatggtaagctcagatctctgcagaagccggcaggtaatgtcaacgagtgaagcaggggttggtgtaatacattagggagttgtggggacaagaaagaactagaaagcacacccccggtctaagaggacaaccagcactctgctcccagccagctgctgccatgagagaatatgggcccactgttgtgtacggctcagggtttttgttttctgtttttccaaaagaagccagaaatccagatgtttgtatgaaaggtatttttataaaaattttgacaactaatataaaacactatttgaaaatgtatttgagggctagctttggcctacaagccactaggttgtaacttcagctttcaaaaattgcaaaaggtagagccagctgcttagtggccataccttctcattctccaagggaggtgtttggagcctggtgcattctaaacaatgactgttctgtggcttaaaaccctattgtgaagaacacagttactctgaaattgagggcagcttgtctcatttatatcatttctttttagtgacacagatccttcgttaaggccaacttttaagggagtcaagttgcagaaaagtttacagggcataaccaccctcaccttgcttttcttactgacttttaaccatcacaaagtaattactttccctcctctatccctcccttggaatgggtctttttttttttttttttttttttttttgactcactctctcgcccaggctggaatacaatgatgccatgatggctcactgcagactcgacctccccagctcaagtgatcctcccacctcagcctcctgagtagcagggtctacagcgcccaccacgatacctgactactttgtatttttttgcagagacagggtcttgccatgttgcctagcctggtctcaaactcctgggctcaagccatcctcctgccccaacctcccaaagtattgggattactggcgtgagctactgtgcccatccagaatgtgttactttttaaagtacattgtgaggcaggacagtattcacattgcctttcccagagcccctaaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttgaggtttcaggacacggagtaaaatgatggaaatgtgtttgtttttcagggcagagaggagtgttggtaagtagagaaattacattgtgtcctcagctgccattgatgtccttccaaataggtgaagtttagtttaaaacctgccgttaatttctggcctctggcaagagtggtacaaggttacctgtttgttccagtatgtgtagggaggggctgggggttggggagagagaagggtggcaattagtcaatgacatttatgacccatttataaaatacaaatgaaataattggttacaaaatcatgacaagccttcacttgtcttttacaaacttgttctcaacacactgtgaaacttaatggacaccctttgtagaaagtgaggaacaacagccattctgaagagaccgattcaaagcgttcaacctgagactagctgtggtggcgaagattctctgagtatgtttctcattctcatctcagatacccgcattattatcgcagatccagaggcagggaatttgtagattcctcagccagggaattgccacagttttggtgtaggatgaccagacatgagaaagaaaaaaattttcccacaaatctttaaatgcatgggaccctttggggtctttgctgagattagagcactgtgtgtttataaataaaagaagaataaacaaaggcagcatgcactggcagtcccctccttcctgccctgttaaaatgctgtgtgaggtggcatcgagaaaatgaacgccaaggttgacaccaaatgtagggcccgagtgatttttctgtttttcaaatccgctgtcagttctccacctctgactcttagtctttttctccttccccacctctagagagaggacatttcctgagtaaaatgaaaatcaaagctaggagctaatcatatttttaaagtcagatatgttgggggtataactggaagctaatttttaaaagaatcctgccatatctttgataaggaagttctatggcttaaagagtgtaaccactagttttagcagagatgtttcctttagttttgaaacattcttcaacatttcaggttcatgatgaaaaatggctgactggatttaagtcctttattttctatactcctgagcaaaattctgaaaaactggctggtctagtttagagaagaacgctgatgtgggagtattttcaccatgcattcctgctctaaatcctttgcttctactgatagactattctactttcgaaataagttcacattgctctaacacttcataagttcaatctttttctcattctgtttaaaataaccaccatgaccaccaaacgcctgaaattcactgtagttaaaattatgactgaaatagacagggaaaacctgagagtgaacgttacccagcaaatctgggttaaacaggttcgagtttttccagagcacactgtttaggatttcagcttcctgttcaaccatctcggaaacagggtgtttctctgctcctttgtgaggactaaccatgtgtccccgccactttgcaccaaagctgaatatcatcccaaactctggatccttctgacgggcatttgtgtggtacacaggaaggggtgcattatgaatatgcaattactggcatgtaatgctgtcttctgctaaaaatacaaaaagggtactctgatctcagagttgggagctgatttctgatttcagcctagacaggtctgcttaaaactataatcaagctgattgtattgccctggaattctaatttccaatttagggttttgctatataatctctagtagagtgtgtctaatctttatgaaacccagagtctttgtataaactctatggattttcttccatgcgtctaggctgagctgagctgtgtctttaggctgagctgtagagacattaaattactgagtaaatgaaggtaacgttgttatgtcactctgtttctgaaagaccaactcaaattctgtctgctgtagctttgatccttttcatttaattctaagtacacttgttattatagtaactgttgtttgtatgttattttagctttttacttaagtagctatttagcaatttaaatgaaaatgtaattaggttacatctgttttacatgcatgtaataccacgcagatgtaaacttctattaaagccatattttctttttggcaagaaaaggcagaaacaaaatcgtgccagtcgctggaatacgtcttgctctaaaaaaattaaaaaaaaggatatacagagcactgtgccattatttatatggtggttagagtacatcacttctattttttgaaaattaaaaaaaatattaacaagtgaaaaacaagcattctattccatgttccctcttacagtttatctggatacggtgtttaaaatgacaatacagccaggcgcggtggctcacgcctgtaatcccagcactttgggaggccgagacaggtggatcacctgaggtcagaagttcaagatcagcctagccaatgtggaaaaaccccatctctactaaaactacaaaaaaattagctgggcatggtggcatgcgcctgtaatcccagctactcgggaggctgaggcaggaaaattgcttgaacccaggaggcggatgttacagtgaaccgagattgcgccactgcactcaagcctgggccacagagaaagactctgtctcaaaaaaaaaaaaaaagaaaagaaaagaaaaatgacagtatggcttccccccattctatgggtttgtgcacacagaaatacacccatcctcccatcataaacactggttcttccaactccacagatagtggaaagagtcaagaagcagccgagattctaacctagctctgctttatgactttggtaaagccattttactcttcagtattattattttttaaaaccaagagtaatatttgcccagtttgcctcatagacatgttgtgaggctcaagggagataatgaatatgtaggtactttgaaaagtataaaatgcaattgttagaaagtattattagtatattagtctgaaaacagcataagcagtaagccccccagatacccccacatttttgtgtgtacaatggggattgaacttagaaaattaattctcctgttttgggaaccattgcctcccttatagcctgttaataggatttataaaacatcatttcagacaaagtcatttatcttatttgctaatgagacacaaaatttggactgtctggaaccaggtaacattttaagagttgcccatttgtttcatacacgttcagcttttcagtgcagtcatttttaatggtggtttttatagcatcaataaaaatattttcatataattcttccttgtaaatatggttaaacttttagctttctactacttggtgacctgttaaataacttaatgtactttgaaattgattgttcagtgccaagacaataagaagccaggaggagccagctttattttttacgttggggccttaagttgggctatgaagaaaaaattctggcagggtttgccacatccaacttttaagggtttttttaatctgtaagagggaacatggactagaatgcttgtttctctttcctgtctgtcttaagtagtatcttagatggcaaggaaaggaaatattctacccatgtcataacatatctaccatttattgagcacctactatgtgccaagttgtattctaaatgcttcatgtattatctcatctgatccttaaggcagactcataggtaggtactactgttatctcctattttataggtgaagaaattgaagtctagagaggttaagaattttctcaaggtaagatagctagtaaatggtagagctaggggtttaaccttggccatctggcaaccaagacataggtttgaacccattatgcctcatcatacctcataatacctagtattataaggggttttgttgttttttctttgtattggttttgtcatctgaatcaaacgtctttgacctagaaagaatcttaaaatatgcttctgccgcctccctcttttatcccaattcagaaaaccattttttgggagacctaggtgccataaaaatgaaaagaaatgaggcatggtgctcatggtactcacagttcagttagtgaggggggttggtaagtaaaggggtatggctaagtagcccgccaaggaggatgacatgtgcactaagctgatacttggctgatgtgctctgagaggccagagcaggcagcagtcaaggtcaagcaaagcttcatttgacctgggcgtgaaagaatgtgcaggactgtggtaagcaaaggagacaggtggcatttcaagcttcaggaatagaatgaacagggagttggaggaaagaaaacacaaaatggcctgttacaatagttaaggcaagagatggggaaaccttcaacctggtcaccagcagacgacataaagcaggaaataaaatgacattgcaaaggcaaggtgatgggatttggcaattgattagcagttgggagggagagcactggaggcaggtactggggtctcgaacccagtaggatagtaggaatgttaatcataaaaggcaactccgatttgggaacactcattgtagttggggaggtagaatagggtagacggcaagaacttggactctatattcagatggtcctgggtggcaatctgtgctctcccacttactggtagagttactttcagcaagtcacttgtttagactctagtctcctcatctataaggcgggaataatattaacacagctgacacttgagcaacacaggtttacactgtgcaggtccacttatacgtggatctttcaaaataaaagctgcaccaagtatgcctgcctctcctgcctccccttccacctcttctgcctctgccacctccaagacagcaagacccacccctccactccctcctcctcctcctcctcctcttcagcctactcaaagtggagacaatgaggatgaagacctttaagatgatccacttccacttaatgaatagtaaatacattttctcttcttcgtgattttcttaacattttcttttctctagcttactttattgtaagaatacagtatagaatgtgtgtgtacatataaaaaatatatgctaattgactgtttatgtgaatcagtaaggctgccggtcaacagcaagctattaatagttaaatttgggaggagtcaaaatttatacataaattttagcctgcagggggtcgagtgccccaatccctacactgttcaaaggtcacgtatagtgacctcatagtgttattggagctcaggtagtacctgtagcatgcatagcacagtgccttatagcatacattcaataaataccacttagtagcctcttggctactactcactcatttgggtgagtaggattttatccccattttatagatgaggatgctaaaatttgagtaggtagagtagctttccagagtcctaaagccagtaaagcctggcaggggtgagtagagacccaggctcctgccttgtggtgtagtttctgacttcaattgtaggtcacttgctgccctcacaccagacagcggcaggccaagtcttctggtgctgttactttgaccttcctcccataaaggctggatgtagcagaggcaggcactgtctcttctcttaccttctgtggccatttactgagcatgtatggtgtgtctcacatgcttttacatgctttgcatacatttctttttccttttctttttattttattttattttattttatttttgagacagagtcttgctttgttgcccaggctggagtgcagttgtatgatctcggctcattgcaacatccacctccagggttcaagcaattctcctgcctccgcctccaaagtagctgacatttcaggtgcccgccaccacgcctggctaatttatgtatttttagtagagacagggtttcaccatgttggccaggctggtcccgaactccggacctcatgtgatccacccgcctcggcctcccaaagtgctgggattacagtgctttgcatacatttctaatgactgagtataggttttcattttctccctttgctttcttcctataaatcagacagtcatttttttctagagtccttttcagcaccccagagggagttgtatccttttgtgtgtgccctgtggaattttcatggcaacataagttgtatttcttcatgactcactgccataggaagaccacccaaaacataccctcttctgtaacccaaatctcagcgtgtgtccttattttccttgttttcagcatgtccaagtgaagccattaagtaggtaatatactgttagacacagatcgtggtgcttgggaaaacaacacccaagcctcgtgattaataagcactgttaattgttaagctgctcttgctggtgtctgacctcacggggtttgtgctgtgacagctctttcatgttgatgaggtaaatgagtctctgccatgatggccgggagaagccaggacagagtatcagatcgtgtttcaccaggaaaacaaggttgatttactgtgttacacgagggtgaagtggacccagcaccactgcaccccgtgctttgattcccttgtatgctaaatatgcaagcacaaaacagctttaacacaattttttacctagaaaggagcctggggctgcatccaagtacatttaacatgtgaaaattgagctgctttgaacttgtatgtttttgataactgcttggtatgcttcctggaggatcacctgtaggcttttctttccaaatcctaatccctttgattgagtgccaggacagatagctctcattgaataactccagtctcataattcttccttcattcagagttgaaagggaacagctccagattcaataggcacatcctcagatttagctgaagtcattcaaacactttaaaactgaaattgttttgttctgaagtagggttcagttgggctactgaatgtttacacaagccagttgctgccaggaactgtaggatggggaagaaaaccacacttctccccgcctccacccagcccccttgccttgcttctctctgcctctgtaaccaagaaggattacaaggacgactttgagcgttagaagtttcaaagcaacctggcaggattgtttgtaaacgtgggcataagaacgtgcttgactcttcttgttttctgtcctccatgagaccaggctgaacactcctcccctctcctcccaacccccttttggaggaaggaaaacaaccatgttctttttatctttacaaatgtgcctggtggggactaatctaaaccagttcaagatgcttttgcttaagcctgtttagaggaacggaaggtgctgcagaaatggaaatagagtggtatatgggcctctttgccaccccgctcctgagctcgctgcctcttttttgtttttgtgggtttcttggcacctacctagatttctgctgagatctctgtttcaggtcttttcagagatcatgtttcctaaaagatggttcctttctgctggacatcctgtctctgtcctatttggccagatagtacttcagttgggaaaagccatctttctcttcgtgcctggtgccctatttcagaaggaagcctgaaaagtcatttccatattctgtgtgtgattgcgtcctgcctagcttatcacagtggttgttccctctcggatgaacaattcctaccctcctctttgcccagcagatgaaggcaaggattgtaacccattattagagtattgaggacctgagttccccactcatgttgaacttgaggcaagactgggcggtttattcccctctggctactctcccacttgtaaaatgaggcgacatctctaatcattgacaccaaacaagaacatagcctaataataaaatgaatggtgttatatggtcatgaagaaggttcaagactggaatctactccataaggaaggacacaaaaagattcaacagtgatttagacaaatctcatctgaacacattttacagatgcctgttgaactaaaagttctgtctaggactgtagtaagatttgacccggcttagcctgggaattttgacccactgatggtagaagtttattaacagccctattcatttagatccttccctgtttctacttttctcgttctctccccggagggtttttatgacgttgtaatcatttataattttaaaatgtcttcaatcgtgcttaaaaacagcacttgattttaatgggtactgcttaaccatagaaagattgtgtctgtattactgtcggttcttacaacaatactttggaacgaaagtagaaagtttatgacacattttattatattcctaaatgtgaaagaggattctaatttaaaaataagtggccatactttttaattcttatttagcctctgtagctgttttaatatcccttttatggttgactggtcgatgttttaaaacaagttcttcagggactctgcccattagtctttggcaataaaatctgaactttactaaaataaaacatgaagccatggagtaattaagaggggaactttcagagatgaccgtgaatatgaaatacagtgatttgtattattaatggatttggggaaaaccagcccacctcttttaagctcaactatgtgtatttggggggttttatatttttaatttatttctttgtttctctcaaggcagtaggggttccatcgcaagctcttaagatctaccaatcctccttttgtagcctgctgcttctgaatatgagcctttcttttttcattttatttggaaaatggggtgatgtcacttaggaaagcatttttcccaaaagtggtttcaggaaccagaatctggtgaagtgttatttaaaagcgataacatagtaaagctctgctttgtgcttcaaataattgtaggatttacgggatatatccctaacctgttcagttttatggaaggacaaaatacagggattcattttatcatagtttcttaaaaactttgaaacccagttgacagtcatttctctagcattataataagctctttgtgtttataaacctagttcatagtaatttttggagtgctgcaatttggtagttatttaatttgcaaatgggattggcctctctaacctctaaaggaactagttccttttaatgctttaaaactttcattgactctcaattgccaactgcaggaaaaagttcaggttttaaaagtccttacatgcgtttcagcctcctctccctgtttcctttatgaacagccccctcccactccctttctttcaatggtaggtctgctgcagaacattctgcatctcttaaactttatatgcactgtatttttcagtctccattcctctgctcatattgtgttctctccatggattctttctttttattatttaattttttttaagggatagggtctcactctgttgccccaggctggagtacagtggcaccatcatagctcgctcgtagctcactgtggcctccaactcctgagctctagtgatcctcccacctcagcctcctaagtagctgggatacaggaacgcaccaccatgacaggccaatttttaaattattttttgtagagacagggtttcactgtattgcccaggctggtctcaaattcctagcctcaggcaatccttctgcctcagcctcccaaagcgctgggatgacaggtgtgagccaccaggcctggcctcagggatttcttctttaccatgtcatagtctccaaaattgtgcccttcctttctgtcaactcaagtgtttcctcctttttttttttctgagacaaggtctcgctctgttgtccggactgcagtacagtggtgcaatctctgctcacagcaatttccgtctcccaggttcaaacaattctcgtgcctcagcctcccgagtagctgggtttacaggtggacactaccactcccagctaatttttgtattttttggtagagacgggtttcaccatgttggccaggctggtctcaaactcctgacctcaagtgatccgcccgtctcggcctcctcttaagaggtattttttactctgtatccagagcttcctcatatacccatgcagcatgtggaaaacagcctgtactgctgtatgcagtggccctgttggaatccttctgcttcccagcgaattgcccacaccccagaccatggcactgtctccagatcttcagcattgcagttatcatgttaaacttagctatttgtgtatatgattgtctcgttcaccaaacagtgagcccgttgagggcgaagttgtcttaaatggctttgtgtccccaactgccaccagggagatgcatagtaactagccaatgaatgaatgttttcttcccttaaaaaataccaacagatgcctaacataagcaattaagtgagggaaagcttttttgccattttaaaagtcattcgtcagcccacacgataccactgaggaagcctcatgtgagagctaatgaacattaaacccagacaccatcgggagctcaccagaaacccatggctggctagtgagagacccggggctagaaacttgatattttggtttcacagccaggtaccctggcagccacaccagtgttatgctggcaggcatgctttgtctgctatctgtggcgtgaactttactaaaatgaaacatgatgccatggagcaaattaagaggaaagctttcagagatgaccatgtatatgaaacacagttcctactccgcctccttcaccccaatgagagaatccaaattttatttaactggtgcatagaggtctcttgatttgggggaagatgggtccctctgccagcctgagatggtaaatcacgcttgggttaagccagtcatcgaattcctgttcccctttgctggatgctcattttcccgggttcccttgcaagtcaggggctgtgtgacaagttctgacctgtgagacacaaggccaagtccactaggagaattctgggaaggattttcttcctggtaaaaagacagagcctcatgtttgccaaaagagcctgattctctgccctttcagaggcttcctgcctttgcacacagtgacaagacatgatgctggggctttagcagccaccacgaggtgacaggtaggaggacaaaagtgattacattgatgttggtgaagcaggatagaaagagcctgggtccacaatgaccaaccttgaaacctcccatttccagacttctggttcaataagaagcaccccgatggtttcatcttttgacggttggttttttgctgcttgaaacaggacacatcctaactgattcagttacttttagaaggaaaaataaaagtggagacagcatcctaagaggaaaggtggtgactggataaactatatggaagtcctgacaacatcatatttaagaaatttggtggctggcctctattcttctgttaggtgtaaggaagacccactgagtaacactggagcattcatcattcaagaaacattatattttaatcttggatattcctagcactatgcaggattctgaggatgcagaaataaaaggcagtttctatccttaaggaacttggagcctagtaagggagactagtgagtaaacaattacctgagagtatgaggatcactctcttttgataggggtattgtattagctcttatgctgctgatatgcctgagactgggtaatttataaaggaaagaggtttaattgactcacagttccacagggctgaggaggcctcaggaaactgacagtcatggcagaaggagaagcaaacacatccttcttcacatggtggcagcaaggagaagtgtcgagcaaaagggggaaaagccccttataaaaccattggatctcaggccgggcacgggggctcacacctgtaatcccagcactttgggaggccgaggcaggcagatcacctgaggtcaggagttcaagaccagcctggccaacatggtgaaaccccgtctgtactaaaaatacaaaaaaaatttagcctggcgtggtggcgggtgcctgtaatctcagctgttcagaaggctgaggcaagagaatcacttgaacccaggagacagaggttgcagtgagccgagattgtgccattgcactccaggcaatggagtggagcaagactctatctaaagaaaaaaaagaaagaaagaaggaaagaaagagagagagagagagagagaaaagagagagggagagaaagaaggaaggaaggagaaagaaagaaggaaggaaggagagagagagaaagaaagaaagaaagagaaaccatcagatctcgtgagaactcaatcactatcagcatgggggtaaccgcccccatgattcaattatctaccactgagtccctcccacaacacatggggatttggggaactacaattcaagatgagatttgggtggggacacagccaaaccgtatcaggtgtgtttggggtactatcggagatcagatcaggaccacaaaacctggataggctggggaacaggagaaatcaggaaatgtttcctggcagaaataatggctaagtcaaatcttgaagaagggataggattttgccagaccaagaaagacaaggaaagaaggggcggggcggggtgggagtgggggggtggtgcagtatacaaaacagaggggacgtgttataaggcagagaggtatgagagaaatagaacattcagaaactgtccttcttaatatttttgccatatttgatttggatctttttttttttaggaaaaagctgctgatggctacaaatgtgtctgttatgttattctctatacttgttatttcaaaaatattttataaaaatttgtgagtgaataaatgagaggggagaaaggaaggcaatgagtatgaatcatcattctgattttaagcataataaaagcaggaggtgacttccacagtcaaatacatttgggaaataatagaaaattaaatagtgttcattattgtgagaattcccagaacccttaatattcccatgttgattgttactgtccaagatggggccactgtctagcgcacttcctaggatagatttgtccataggcccctcttttatgtaaccatctgccgaactgaggccttggaaaggcttgatgtagaccgctctttcagaaaacttgaccgagaagggaagtacgcttctagggtagcatcagagcagaacatggggaaagggagacatttcacaagaagggagagtcaagatcatgtgtatttatttgccaagggcaaaaagcagtagtgaggaaaagcaaacaaaaaccagttgaagacacagcaacagaggagaatgattgacaaagtaagcaaggtgcttgaggttacaaaagggatcagctattaaaggacttctgctagtgtctacttgtcatcttcaagatggcacaatttttacagtaccatgtatctgtgttgcaggagaaggtaggcctctcaatcagagacttagcctataaaccagcatctacatagtgaatctaggtatccctcagtgttcttctatttataaggaacagaaaacccaacttaaattgacttacgtaaaaagagtttgttggttggtgtaattgaaaagtacatggttaactagcttcaggcatagcttgatccaggtattaactatgtcaccaagatccatctcactgctcataagccctctcagttggctctattcttatgttcctcatggctcctggaaactttagcctctttccttctggttgcaggatggttgtagctccatagacatcacatctgccctcacactgcaactcctatgaagaggaaacaccttatttctcaggagccccaccctcttactattagtctgattgaattatatgtccatccttgaaccaattcttatgaccaggaataaggcatagtccccatgtatgtaacttctttctcctgagttgtacaaattatcaaaggaaaaccaagaggattatatctcaagagtggattatgttaagaaagtaaccctttccctccaaaaaaggaaacttccataacagaacccttagatttttacccagtgtgattttaaactctaaatgctggaatgtttagggtcccaggtctgacagcatgaattagatccctccatgtggagcacccaagtaagtgaagggtgttgacagccatcatggggaatgctgatgcttactgaagaagccatgcaataaatcctctttagaaataaacaaaaagcagcttttgagaacccggcttttacccaagaccaaaacctgtcagccacaggcagaagtcattaggcaggatttatatgtgctggtatccaacactgagtcaaaaggagatccgtagaggggatttctctcttccggaaacccagcagaggaacggggaagactttccgggtaaagtttcagagaacctaatgcataaatccccttaacaaacactgggatttgggtttgtaactcatctctcccagcttaggtcctgtggagacaagctgtcatagggctgacacaaccaaatcaagaaaggaaagagtagaatttatagtgaaaatcaggaagctacttaaaatggtgggtttctcagaatgtggtactgcacattttttgcttggtagtccctgaacagttattaaagaccccatggaagcagatggatgctggccagtaggcattgtccccttttatatttataacttcactgaccttcattttacctctaatagagattgtaccattaattggctggattctcccaagctctgtggcaagtaagaatggaaaagtggattttctccgtactccattgcagaggatatcattaatttgctaggtttcgttcccacagggaaatgttaaaaaccagtacagttggttcttcgccactctggattgacagacattctttgtgtaggtgcctctggctttgagaaacgaggccagagtctatatgcagacagtgagcagtgatcttccgtttcctacttgttgcagtagacataaaatcagggcaaatggtgagttccagaggaaaggatccagcatgcagcctgctgaataagagaacaggaatgatctcgaatgatgataaatgtttatactctattagagctttggccatgggtttggccaccattcaattgcctctacagctgattttttatgtggcttttcttttctttctcctgtttggttgcaaacttattttgactgaggatttacttgtcacctcatgttgacatttcaagttattgcattgagaaaaacataggagaaagcaaacaagcaagtatattccaacggtcaacaggcacagaagtcatactcacatttcaaagaaaaacaggagagttgaaatagagaatggagaacagatgtatttatgaggggggaaatcttcttggcatttgagctcaagtcagattctggattctggatagttttctcagctaatggtgattcctaggactgctaagcgggggacattctggtctaaccgaagttgccatgtaattctgtggaatcatactaacattttgatttctctgattataagtgactgcagcaacaaagagagtaactctgttgtaagaactgtttccacagtgtctctagggacagttttgctttagtctgtaaattctccaaaggcaagctgagactatgtaaattaaagaaatagagccagtgacaaccaaccctgtggttttatttgattttccaaaacacatgtccatcggtatgtctcagacaacacgatatgattaaagcacggtaataatcacccatatattgcattttaattggtataatgtatgatgaatagtgaagttggaaccatggggcatactttcacatttaaggtatttctttgatttatcagaatttctaagaacataaaatagaagtcagaaagtctgttttctgagctgggacctgccattcatcagctgtgtgatcttgggtatgttactttatttctctgggccccattttccccagctataaaatgaggggtttaaactagatgagctctaaagagcttttcacttcggagtttggctattccaagaccttttctagtcttgtgaatttaattactgaattctgggatcttaagtctctttatcagttgagtctcctcctttgtggtcttacagcaaagatgactgttggccaaactttggatttctgagactgatttcagtgaattgcattatacatatttttaactagcttatattaaatgagagaaagtgcaaggaaggaattgcaaccacaatttaaatagttttttccgtgccattctattccgtgagcacctgccttggagtaggtgtgaaacgggagtcaggaagtctgtgcatgcctctcagagggtggtatcttcgtcttctgagtatgattccgtaccatgaatatgttggttgtggatttttcttttctgtacaacatgaggcccctaaacataaggaaactacttcctttggtgcttaacctaagaagcatctattctaatgatggaggaaaacctagctgtattacacatactgaaagtgatatagtgggttacaaagtgacaggtaaatatttgtgttccatttaagtggtttgtgagtataattttgatttttcctaactgttgctttctctaatgattttagaaccggataacccctcccctttcccctactctccaagcataggatagagctcatctataaaattcattggattttgtgtttttgctcttctagttggtctctgaaatggtcagaatggagttggaaatgggacagcctattagtccaatctacttctaaggctcctgaacagcctcacaagactccatgcatcccagcatcccttgggacctgggtgattagtttgtgatcaacagattgtactctcagaaaacgtgcaagccaccagcctctcgttcaaactgtttataggccccagaaggggcttcctttgggccagatgattagtcacattttgtttcaaacacccgaggaaaggtacagcagctttctacttgaatgcatgcttttaccacctaaaggcaattggttgggagaagatttgggagaagacattgacagtgtccagcagtccttttatctgttataaagctaaatgcatgtttatcaagttttcagcaaagatatatgttccactttagcctccttattcttattttccacttagaggtagagactgggtctcaccatgttgcccaggctggtcttcaactcctgggctcaggctcaagtgatcctccgacctcggcctcctgaagtgctgggattacaggcatgagccactgtgtctggccacaatacacacttgactgtcatttataaactcaaatgactcagctatcaagatgccaaattggattttagagagcctcctcctaggcacctgatactttcatgcttggcttattgtacgaggtaactccactttctgttcatctcaaaagtgttgggaagtgtttgcaggttaccttcctagcacctgcccaaccttctagagaagtggagaaacctgtgaggaaagcagcacaggcgttgccacttagggacagtttcatggaaagagatctctacttcttgatgtcacattaccctttagaattccagaatcacttcagatcttcaaagcttttaataagcagcgatggccttttacaattattttttaaagcagcaatacttaaaattttattaagtgctgtcgtagaaacttgtgtctacaaaagacagataaaaacaagtgttgatgaggatagagaaaaattggagccctcatacattactagtgaggatgtaaaatagtgcagccactctggaaaatagtgtagaagaccctttttaaaagttaaatatagaattaccctaaaaagcacaggcttttgttgactttccctgggggtcaggtgggctcaccttggtgcatcctcccctggggggctctggtgtgggaagccagctttcctaccattctgcatgcagccttgtactgggtccttggggaaagagaaagactgtgaaatagatgtttcccttttcccagaaataccaacccaagatccccagcagtgaccccttatggaattctgggaagaactaaagagataacagtattctttcctgccttttatcaactctggatggcaggagggactctggggcttgggactggctgccctcaggagttcatggcctagtactgatgccaaggggcagaaatttgtgagaaagaaggcctcctccaggagctgttggtatgagcccctaatgggatcatgatatcctacatatgcaactatgggaagaagaaaggatctagccaacatctgttattatattttaaaaagtaatttaatttgtttacattacttgtcattattgtcacccacttatatttgattattctttaagcacatatagaaagatgaggtttatgttgatttttctggtattacatttccctaggctacatctccatatagagctttccttttttaaaatctgttctttattttttatagagacagggtcttgctatgttgcccaagccagtctcaaacttctggcctcaagtgatcctccagcctcagcctccaaaagctctggaattacaggcaagagccactgtgcccaacctccccatatagaattttctatagcaatcttgtcctaggaaatatcatagaaatagtttaggttttaaaaagaagggctgtatgtcatctaaactcttatttaacctatggttgacagccttgctattaaaaaaagatcttaagttgttttacattttatagtctttttaaaaaaagatgatgagacatctctttagtggttgccatgtttaatattgttactttctaagaacaaatataatttttgtgagaacattatattactctgaaacagagaacagtactctctgtccttttagtccctcaatttttgataaggtaaaataagattatcttatatgactagtgtatactaccttatatttgtatgacactccatgtttttcaatgactttcttccagagtttttgttgaaacacaaaaggatttgtacccaaactgactttactttcaattctggataatagataattattattgcattacaacttttaaaaataattaagaaatcagcttagaaaatgcttgatgatttttacttagcatggtacgtctttagggaaaagaccgtattatgaatttagcaagcaagttgagcatggtgacatccgcctgtaatcccagctacttgagaggcggaggggggaggatcacttgggcctgggagttccagactacagtgagttatgaagggacccactgcactgcagcctgggcaacagagcaagaccctgcaaataaataaataaataaataaataaataaatgtcgtggtttttttttaatttagcaagtaaagtagcagaatatcctatgttggattagtcagtggaaaaaaatatctttcaaatcgcatttgatgtttgctcaccattattatgaactaagctactccatggaactagagcatagctgtcaagtaattatgaagcgcccatgctagggaccgcatgccatttaatgagtttacatcagtaaaaagagaggacagattcaaaaatgggacatgtcacacatacatgtgagaattttcccataggccaaagggcctctttcttggttttgatatcaggcaccaactctaataggatgaagctatctgtgtagcttgatgaagtagaaattcattggagtggccgggcacagtggctcacacctgtaatcccagtactttgggaggctgaggcgagcggatcatgaggtgaggagatcaagaccatcctggctagtacagtgaaaccccatctctactaaaaatacaaaaaattagccgggcatggtggcaggtgcctgtagtcgcagctacttgggaggctgaggcaggagaatggtgtgaacctgggaggcagagctcacagtgagccgagatcgcgccacggcactccagcctgggccacagagcgaggctccgtctaaaaaaaaaaaaaaaaaaaaagaaacaaattcattggagtaccttagcattatgggatatctctaggcagcgccaggtttcttgtcttcatagctaagatagatgttaaaggaaggggaacctttttctatcccatttttctagtggcctttataggacttggcttaatatttttattttattttatattattaaattaatatatttttattttataaaataaaaatattaagccaagtcctatgaaggccagcagattttattttatatatataaattttttaaaatatgaaataaatatataatacatatataaatatatttttaaaatatgtaatatacatatatgtatgtgtacacacagtgtgtgtacacttgttatattattacttatcctagtatattaatggctatataacatagctgtgtcccaaatacatgtaatacatattacttttcatctcatttaaacctcacgagagttctttggtgaagatatgattaccattttacagatgagaaaacctgagaagaatagaagttaagtagcatgccaagcttacccaactagctctcattcattcattcatgattcatgaagtatttatcaaacaactactatatactgtcattaaagatacaaaaaggatcaaacataatccttgccttcaaagaagccacagtctaaggttaacaagtggactggagcggaatttggttttatcatttcaaaggcaaaggaacccagattggagagttttctggcaactgccttaggactttttggccaagattaatgtaatatataaaggtaagcatcaatgtgttggtgggaagaagtatcctagaaatgttttttgttttttactgtatctaggactcttatgaactactaattcattattaagttatttgatgacacagattattgttcaagaatttcctcccagagcaattgataaatatcaaataatttttatgatgagcagttccagaaagggttaaagttagcttctctgggacatatgatgggaaagtagctgaacatgatttcaaagggattttttaggagaaaattccaattaacagagaagtaatttccctttctagcttactaagccctatttcagactaatgcagtttcaagatcatctcccttctccccttatttcaacagatattttgaatatgaaaatcttatgtcaaaacttagctgaagccttcatcaggcttttgaaaggctaagtaagaattctgtttctaggaataaaaagatttggatcagaaagattctttgctggctagagttccttttcggatggtagttcaagcagtctttaatcatatttttgttgattatttattagtttccctgggaaatcaaagactcagtaacgtaaaatgtgttttccttaagatattttatgaatcagaacccacagtaaagaaataatgggaaatacatttcctttgctgatatggactaattgagaattaaaatccctttctctagtcattatcccacatggaaatgctgaatgacccaactggcccaattgcaccaaccacagtttctgcctagacaaaactcttatgccactagtagataaagagagagctttctcagtaaatcaaaactgcagagaactagaactaatttaagtgaaaggataggctccaagcccgctgtttgggtaaacccacactgaaccaagtgagcgattgatgaaacttaatatatgtgtattccagtcatcagcctggagtatgtgtaatgcaagcccatggtgtttgtcactgtgagaaatggaaaggcagaccttcattctcaactgtgtggggctgctagcctgtggcagctttggtcaacatcgggcttgcttttgggtgagccagactttggctggtttcctgatggaggttaggggaattgtgaaatgtgtctccttacacagatcgtcctgatcaaatgaaataaaaaggtattttaaaaataatttgcttagtgaaatacaaaggaaataggatgcatttcatactattaaggccgatatggttttgggggatacgaggtgtacatacgtgaaaaatttgaaaacaattcagagtgaaaaagaatggtcgtataacctaatgtaaatgacgagttaatgggtgcggcacaccagcatggcacatgtatacatatgtaacaaacctgcacattgtgtacatgtaccctaaaacttaaagtataatttaaaaaataaaagaaaaaacaaaaaagaatggtcgtgtagtagagacagtggtgaagagcaggactctggagccaggtgttctgagttcagagcccactctgccacttactagatctgagacctggaggaagttatttgccctttccctgtttggctcttttgtaaaatggaaatataagagtacccacctcctaaggtgggcttatgaattaatagatataaaggtatgtaaaattattgctatcattagttactgttattaatagatcagaagtcacaagctccaatgcctgcagtgcccatgcataccaaaacagggatcactggcaacagagacatggccccagtggcgtggagataaaagaaagtggtagggacagtggcagacagccatcaccctactccccattgattgtgaccctaagggaatgctggtcctgtgtcgccagagcttctggtattgccaaagaagcttgaaatctggacttggtcaaaaaatctctcaacttgtaaaggtggttgctttattttaaattactctacaagccaaataaaacactgtctccaggctattggccaccagtgaatgacctctttggactaacaattaaactcagctatggaaattcatctgattactttattgtcacactgtgaaacagggattcattgtcattccagaaacagccattgagtccctgcttgtgtccacccctgtgctggtgcaaaggatgtgcccaagaatcaggcagacaatccaaagaagccacctgctcctttacaagttgttgacaattaagaaacacctagcacttaatagattctccataaatgtaggttccaactccttccattacctttgatacgtctagacctgatccagtgagtatttgagggccaatctcagtttctaagtaggaatagtgatattgttgaaaactaatgaacccaccgacaacatcacagaaatactcctatacttcttcaatgtgagtttcctgctttttgtgtcatttatcatccccttttatttgatgtctctactcaggacttaggactcgggctgtgatattgtgtatgttacctcacaattttttttctgttttttttttctttaagtgtataagcttcgtttatacttccaaaggatcttcaatggaactctacttctgtgagctaaaccagtgtcatactgcaatgaaaactgcaggtgataaacattgtctaaataaaatttccaaaaagtatttgaccaagaaataccttccccctgcattccccacttaatgcatcttaatatgccaagttactgatattgtttgacctatttggggaaatgctggcttgccaaattattgcccttgttaggaactacagtttcttgtaatttcttacccactccggcatccacacaggtatcttccaaagctcagactttattttcaagaggtctatctgagaccagtctgggtaaccaagtgagaccctgtctccacaaataataataataataataataataataataataataataataataataataataaattagctggatgtggtggcatgtgcctgtagtcccagctacttgggaggctgaggtaggaggtttgtttggtctcaggagttcgaggttgcagtgagctatgatcatgcctttgcactccagcctgagtgacagaaaaagaccctgtcccccccccaaaaaaaaagtctagcaacttgagtgtggcagtggccaacttgatggtaactaacaatgggattgcaaactctttgaggaaaggaactgtcatcctgaactcggcatagcaccaagcactgggttgttacatggtgggtgttaagcaaatgccatggaatgcaacagacccctttttctgctgctgtaaactgtggtgtttgaacctagtagtgaatggcccaaggaaaaaaatactgcaggaaatatagtaatagatgaatttggataaagggtatatgagtgttttggagtattattcttacaacttctctgcaagtttaaaatgataatctaaattttaaaaacttattttccgttcatcaaactactcttaaaatgtgtaaaactatacctgaatttaaaagcaacaaaactcatattgcaagtcttggcaaactgagagataggagcagaaaacaatggtggatgcctataaacggatcaagaaaagggagtgagaatttactggaaagaaggacaaatgagcatcgaattcagcaggtttgggtttttccagagatcagtgcctgatactggttcccagatgatatctcccaagagcccggttcccagggtgtgttccagcctctgtccgccaggcttcccaccaagtcttgtgccaatagtagttgccagcacattctgcctcacaagttgctggctccaccactactaccctatcccacctacgtccaagatacgcatctggcttttctgctttgaattcagcaagtcatctcctttcctgtcatgtaactccctctgtgactcggcctacccagccacactcctcagtgctttgtggcaaaactcaacctgaccccccttcagagaaagagaaataagtgtcggggttgaaggttcagctgtaaagtgatgtttcccatactcataaacttacatagcaatgaggaactggagtctatttttgactgttgtagtgacctttgtgcataccctaaaagacagaggaacattgagctaatgtagccatcccatgaagcctcagtagctctaataggtccttttagttgttgctagggtgccagttcttgcactttaatacaattcttggctgggcaccatggctcacgactgtaatcccagcactttgggaggccaaggcaggaggatcactggaggccaggagttcaagaccaccctgggcaacatagcaagacctcatctctgcaaggtaaaaaaattaactgagtgtggtggttcatgcctataatcccagctactcaggcgatgggaggatcccttaagcccaggagttggagactgcagttagccaagattgcgccactaccctccagcctgggtgacagagcaagactctgcctcaaaaaccgaccagccaaacaaacaaacaaaaaatgcaatttctcccatcctaactcttcatattagtaaatcttcaataaaatgtatatgggaaatcaatatggcaccctcaaacctagttgtaatagtcaggagaagaccattctagcctttaaaatcagtcctgttaaaaaaaaaatcagtcctattgacatcaacgtttttacctccagttcctctccacccttctctacctcctgatttcatgtaggcgagcaatttaggacaatgagagtcacaggattttaaataacttaattcctaggtgtgtttggtacggaaacaaagataaccctgttcaacagtgaatttgtgcccctgggtgaacggccaggtgttctttcaactgaactgtgagactaatttcttcctggcctctggaaaccagctgaagcagtgggccagctggtctatcttcaatcttgcataccaacatctttctctgattcacagatttcctttatccccagcacttcctctggtatgtgcatccccgaaagtaagtgatatctattattggatttgggcgttttaaaatcattagccttctggaggggaggggagaggaaggaggctggatggttacattagaatatttccagagggaacctcactttaatctcatccacctctgacttctgcaccccagataacccccatatttgggagggatgacatcacagtaactgacaatggaattatcaccattgctctttttaatatttaaatgatacacagactcagagaaaacaaaatgagtttacatatagtcataatatccataactagagatataaaacaaaaagctatggagattcttatctagtgaagaaatctcttttagaaagtttctgatgactttcagttgcaaagcatagctctttcacaatatatcaacccactttcaatgatttgagatttggagagggcccagccatagatttacctggtgagtcacagagtagaacttgatatgagaaagcaggaccctatatctatcagcctaatggttctcagaataccaggtcatatccatcatttcttttcccaaatagctgtaacaggcatacctcgttttactgggcttcactttcttgtgttttggagatggtatgtctttacaaactgaaagtttgtagaaacctgcattgagtaagtctaccagtgccattttttcaacaacatgtgctcacttcgtgtctctgtcacattttagtaattcttgcaatctttcaaaagtatttattaagataaaaaacaaaagaaacgatataaaaataaagagaaaaaggaagaaaatttgttattattatacctgtcatagtgacctgtgatccgtgatctttcatattactattgtaattgttttggggcacaatgaccctcatccatataagatggtgaacataataaatgttgtgtgtgttctgagtgatccaccaacctgccattccttcatctctctccctctcctcaggcttccctattccttgagacacaacagtattgaaattaattaataaagttatagcgtcctccaagtgttcaagtgaaaggaagagttgcacatctctcactgtaattcaaaagctagaaatgattaagcttagtgaggaaggcatatcaaaagcaaagacagtctgaaaaccaagacttttgtgccaaatagccaagttgtgaatgcagagagaaagatcctgcaccaaattaaaatgtgactccagtgaacacatgaatgataagaaagggaaaaacagccttgctgatacggagagagtttgagtggtctggatagaagatcaaaccagccacaacattccctaatgtttgtaagccaaagcctaatccagagcaaagccctaaatcttcaattctatgaaggctgagagaagtgagaaactgcagaagaaaagttgaaaggtagcagaggatggttcatgagatttaagaaaagaaactgtctccataacataagtgcaagatgaagcagcaagtgctgatacagaggctgcagcaagctatccagaagatctagctaaggtcattgatgaaatggttgcaccaaacagcagattttcaatgtagacaaccttctattggaagaagatgccatgtagcatttttatagctagaggagaagtcaatgcctgacctcaaagcttcacaggacaggcttactctctttttaggggctaatatagctggtaactttaagtcgaagctattgctcatttaccgttctgaaaatcctagggcacttaagaattatgctaaatctattctgcctgtgctctataaatggaacaacaaagcctgaatgatagcacatctgtttatagtatggtttactgaatattttaagcccattgttgagacctccttctcagaaaaaaaaaaaaagattcctttcaaaatatcagtgctcattgacaatgcatgtggtcacccaagagctctgatggagataaatgagattaatgttgttttcatgcctgctaacacaacacccattctacagcccatgggtcaaggagtaatttctgctgttaagccctattatttaagaaacacattttgtaaagctatagctggcattcctctgataaatctgggaaggataattgaaaaccttctgggaaggattcaccattctagacactgttaagaaaattcatgattcatgggaggaagtcaaaatatcagcattaacaggagtttgggagaagttgattccaaccctcacggatgactttgaggggcttaagacttcagtggaggaagttactgcagatgcggtggaaatagcaaaagaactagactcgtaaatggagcctgaagatgtgattgaattgcataatctcatgatcaaacttaacagataagtagttgcttcttatggatcagcaaagtgtttttttttttttttgagatagaatctactcttggtgaagatactgtgaacaatgttggaataataacaaaggatgttgaatcttacataaaccgagttgatgaagcagtagcaaggtttgagaggattgactccaattttgcaagaagtaaaattgtgagtaaaatgctatcaaacagcattgcatgctacagagaaatctgtcatgaaaggaagagtcaactgttgcagccaccttcattgtcttattttaagaaattgccacaaccagcccagccttcaacaaccaccaccccaatccatcagcagccatcactgttaaggcaaaacaattgtgacttgctaaaggctcagataattgttagcattttttagcaatcgagtatttttaagtatgtacatcgttttttacactatattgtagtctgctatgcatgcaatagcattatgtctaaaaaacataatttttatatgcactgggaagccaaaaaattcacgtgagctactttattgctatatttattgtggtggtctggaactgaacctgcaatattgtcaatgtgtgcctgtataagattctccatgcactaaaaaggacatttgaaagtcatgagtaagttgtagaggaactctggtgacttgaagcttgtttacttttagcagtgtgtacctgttgacacttctagtataatttatattctttctctcatgagtattttacaggaaatgcgttttcctttgctagtgatatatgcactttggttttcaggaagctgtggtgctttggttgaagctctctgtctgttttagagaaaagacttacaatgacctcctgatatagtttggatatttgtctgctccaaatctcatattgaaatttgatccccaattttagaggtaggatatagtgagaggtgtgtgggttatggaggcagatccctcatggacaacttggttctgtcctctgggtaatgagtgacttctcactctattagtttttgtgagagctgacttttgaaaagagcctggcaccttcctcccctctctctctcttgcttcctttctctctctccgtgtgatgcctgcttctctttgccttccaccatgagtggaagcttcctgaggccctcagcagaagctgatgctggtgtcctgtttcttgtacagcttgtagaactgtgagccaaataaacttctttttttataaattacccagcctcgggtgttccttcatagcaaggcagacagtctaggacaccccccaaatgtgagctgcaccataaggcaaactgggaaacctcctttagttttgcatatgtgagaattttgattgactgaaccaaggaatcaccctcctaactccactgcagaaggccattctcatgtcatttgcacacgtttagcttgcctgaagtgtgttctataaaatgcacccagattttcaggcatttaaaattattattattttaaatctcctactttctctctctctctctttttttttttttttttttttttgagatggggtcttgccctgtcatccagtctggagtgcagtagtgcaatcacagctcgcttcagcctccaactcctagccccaagcaatcctcctgcctcagcctctcaagtagctaggactataggtacacaccactgcacctggctaattaaattttttttttctttttagagacatggtctcactctaggtcttgcctaggctgttctcaaactcctggcctcaaaagatcctcctgcctcagcttcctaaagtgctgggattgcaggcatgagccaccatgcccagttgcatgttttaatggagagagatgtcctgggcatttgaactgcagattcccttaaactggacattgtcagctatttatgtattacaaaaacaattgtgtttcatgtaaagtattaaacatcaacattacgtcaccacaagggtgattacagcaaccttcactcctaagtgtgcgtcacctacacaaacagagttgtttgtctgcagcattgttttcatttggtaacaattgtaagagttgaagtagcaccttaaggagtaattttcagaggtgaagcaatcagttttcaaaagtgaactccttatagttaataactaaccaataaaaaaataaagctatctccatggcacaaatgcccatggcacaaatgcccatggcaaaaggaaataagacgagtcgttttaaaaggtagctttgaaaaacaaaaaaggatttaaaattcaaagactttgggaaaattcaacttaaccaataacatgagtaacgactattactatttcctgagtccttaccatatgccaaataccgttgtacattgtacctgcttcacataaattatttcatctcattctcacaacattctgtgaagcgcgggtactttattatctatccctgtttgccagataaggaagctgagacttcatacagtgacttacaagttcggacagcctccagcaaacacaggaaacaggattcgaacccatgcagtctgcctcagagccaaagcccttggccatttttctatcctgccttccacagatcatttctgcctacagcagaggtcagaaactgacaaccggctggccttacctagccttaggtaacagtaatggctattgaacacttactatgtgtcaggattattttacacacattcatgtgttccttcatttaatcttcaaagcaactccatgaggtaggtggcagttattatccccattttacagatgagaaaactgagaccaagaggaagtaacacttcccaaatgttagcagaactaacatccaaatccagactgtctcattccagaatcccctcctcttcaccattatgctaaaaatacagttgtctgccaacatgacaaacctggatgtttccccagaaaatgaaggcttctgacttgtcatgaaaaaaaaaaaaaaaaaaaaaaactggaagacttgtcctcttggaccgagcaacagtcacttgtaacaatgggcagctgcccattttagatgaggtatctcctacctagttgctaccacccctcatttaggctgctttgctctttgattgccggtctgaactttggggacattctattttgcagtctcagtctaaggtatccttaatactggatctgcctcacttaacaagctaaatgtctgtgtgttttatgttttttattgtagcacaagttgtttaatgttctctaaaaagcattccccacaaatagcagtaaatgcctctttcctattttcttccctgtcccttgccccgaaagtaaggcagctctgcagaactagtatttgtgcccaacgaagtgggaagatatgaggctgatagccttttctctctcttcttggttggtggcactctggtagtgcttggttagcgataatggagcatctcatggctttgttatgtgtcatagtaggctattgtgtgacatagagacacctggcttttgtacacgccagagcaaaattcaactacaacatccagaattgaagagaaggatattggcaggtacatgcctccttctcaaaccagagatttatatatttaaaaagggcttttctaagaactcaatcttgattatttgttccatgttgggccaaaccagtgcattattgggaagataatgagtggcattcacccaagggtaatcctttcagggattttgatgatgcagtaaatcatgagtgtaaagcctgagtggtttatgccattaaaacctcaagatagaattagacttgtaatcaccacttgcccatgttttgtcatttatgataattatagtagtaataatccatgtattgttgagaagtagcagtcagaagcatccatcaattttttatcgacaccaaatcaagttgatacttcatctttgctgcagaaatgtagattgaaccaattagtctaaagaaattgggcagtcattaacaatgaagcaagcagttaatctacagaacatttctggcccctctgatgccaacaattcctcttaattatgtggaatatcatgagcttctttgggactctgtcaacagtgccattgttggcttacattagaaggagcatctatgtccctgcttttatttaaaagaatgcagtgccttccagcccccaccttgcactcttaggcgcttctaggcaaatgtattctgaagcagaacacttgaatcaaagcacttcgcattttctttcttatttagaaataagaattttccccaatgggcttctttcggtgatggcacgttagctcaccatcccatatgtgttaactatttttgttcaccttacccaaatcatggaataatcatctccttttaaaaaaggaaagaaaagaaaagtcagagtttaaaagaaaaatccaactatttgtgaagaaatcctggtgctaatgagctttctgcatctgcctcaagtcttttccccaggctagcccagtctccctctctagacattttcaatcagcctcgcccgcaaattgtactaagcagctgaataatgcagggtagaaatttcaaatataaatattatttcctatttaggaaatttggaaaagaaagcaggaaaaaaataactcaccccctggtcccccaccatgacactacctctgtgaacattttggtagatattctttgggctctgacacgtacacacatgttgacttttatcatcatcatcatcatcatcattattctagtactctctttttcactttgctaaagtttgaatcatcttttgtaatggatgcgtaatactctaccaaatatagagtatgtatttgtccatgttttgaattatttccctaggagagcttacccaaggtaaaatacttggtcaaaatttataagcctcttcatagctcttggtacatactgacaaactctctccaaaaggatggtaccaatttttaaaatctcaccagtaatatatgcagatactggtttgatgttattgagatttaaattcagttgtgttggcatggttatagcttagatagatagatgatagatagatagatagatagatagatacatacatacatacatacatacatacatacatacatacattcattcatgtgtttgtgtgtgtgtatgtgtgtgttactcctccttaatggacaaatggtgatatggattggctgtgtccccacccaaatctcatcttgaattatagttcccataatccccacgtgtgatgggagagacccagtgggaggtaattgaatcatgggggtggttcccccatgctagtctcgtgatagtgagtaaattctcatgagatctgatggttttataaggggcttccccctttactgggttctcattcttctgcttcctgctgtcatgtgaagaagaatgtgtttgcttccccttctgccatgattgtaagtttcctgaggcctcccaagtcctgtggaactgagtcaattaaacctctttcctttataatttacccagttttggccgttctctatagcactgtgagaatggactaatacaatgggcacagtatcaaattgtaccctgactcaaattactgtaaacaatgccagttgttatctcacatcacaggaagttcggaaataggacagctgtaggtgtgatatgatcataggcccaatgatgcgattggagacttgagttcttttcttcagtttctgccatcatcaccaccctcatgctggcctcctttgggcttcaaatgcctacagtagctccaggcaccacatccagatgtagaaacaacagagatagaaggaaatcaattcttcttgtgtctccttcttaagagtgaggagatccttcctagaagctcccaactgaaacccctaaaccaagactggcaagggaaatggaagcaccattatcgactgattaactaagatttactcccaatctggcaatggagtcaacttcctttgagtgctgaatacctgaataaaatagattctgttaacaaggaagaaggtgggaatggttgttgaggcaccaacagtgcctcccataggcatcatgatttttttatgcctctgccatactcatagaaccatatacatttctttagtaacagttgatgcatttaatgggcatatgcaaaagttgttggcatatctaccaagtactgggctttgtccaatgtggaaggtcctcccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggataccattgttaggacttccactgagatgaaagtttacagcctgatgaaacaagtctcactttccactttgaattactcaggctctgtgcatctctttccactgcacagcgtagcattttgaacacttcactactcattagcacctccagtgagagatcagaaaagaaggtggctgggaggggaggattgaagaatgcagattagtcaaattgttttttgttttatctagttagagaaacagctgaaattactgcctcaaaaaaatttggaaaattatctggcttatagtttatttctatagttattttcccactaattgtaaaaattaggagtattacattttagagtaaaataataaataaacaataacaaaaaatggctacaacagaagaaaacatgttcctggattgaagaaaccaacctagaaattatactgtatgcctcagaaatttaatactattttgtctttcctgtatgcagttggattatagagtacagatattgtctctttattaatgcatgatttataaatattatttgacactagggatatcaaagtgattgtggatcaaagctgcccatcccttcaccctggtagatgagaacacaaaatatatccatttcctatacaccatgaagacattgcttccagtaggttttcttgctggagacaaaaagaaaaacagaagcacctactgtacttgtgcactttctgttttacagtttcataaggatttttacaacataagtacatgctctatgatattacatacctttccaccacttatataatcaagtgcaattatactgactgcttgaatagatgatgggaaaaatgacttgaatcaaaaattacacaacagaacgctgtttcagaaaggcttttggagtgtacgtgccacagaccccaaaaagagatggatcaagatgattataatagccttgaattttcctaggttggttgagtgtggtggctcatgcctgtaatcccagcactttgaaaggctgaggcaggcggattacttgaggtcaggagttcgagtccagcctggccaacatggcgaaacttcatctctactaacaatacaaaaattagctgggcatggtggcacatgcctgtaatcccagctacttgggaggctgagcaggagaatcccttgaatctgggagacagaggttgcagtgagtcaagatggcaccactgtactccagcttgggcaacagagtgagactttgtctcaaaaaaagaaaaaaaaagaattttcctaggttatggcaccaagaataacttgtaccattttggaagattcatcttttttcccacataacacaatgtagcatgtagtatatgtgacacataccatagctacctgtgcaggagcttggtgagttctggttttgtctttcttcccctcaatttctatcccttcttttctttgtgcttcttccactctcctctttctattcttctaccatcctcatcttttcatttagaggcttggagaagagcttaaaacaataggtgatggggagaaatgtagtttcttcatgcaacataatttccccctgcagtaatccatggatcaacacatttgagggcagctggtttagaagaggcccttacaattgtcttaacttactcctcagagggtaggctgggtgtatagcctacatggctatacatggccatgtaggccatgtaggccattagattacatggcctttacaaggaatttttgggtggttttattgtttgtttgtttgtttgtttgtttttgagacagagtctccctctgtcacccaggcaggagtgcagtgtcgcaatctcggctcactgcaacctccgcctcctgggttcaagcaattctcctgcctcagcctcctgagtagctgggactacaggagcacactatcacacccagccaatttttgtatttttagtggagacaggatttccccatgttggtcaggctggtctcgaactcctgacctcatgatccgcctgccttggcctcccaaagtgccaagattacaggtgtgagccaccgcgcctggcttgggtggtgtgattcttatgtaggagaaaaaagaggaacataaatgcagaacacaattatgcaaaattaggagcctttaaaatgaaatatgatattgtaggtagtttcttcaaaacaacatactagttttttatacttgtttattcatcactgaaaacaaaacatatggaaaaggcaatttttctcccagccaaccccttttcctcggatattttttcaagaaaaattttacagcagatgttttcaaatagatttctatttatttgtgggctaccattatatcagtaggatttctctagaacctttccatcacttcacctgagttttctttatcggaagaaaaaaacaaaaaaacaaaaagaaatgtctgatcacctgccctaagtctacagttgagagcagttttggggactagtaagtcatgttctcttaaggacagcgtctcctaggtgagcggctcgtagtccatatggagcaaattagacagtgaaagaatggtgctgctactgtttctgattggttacggtagtattaaaaaagaacaacaaccgacttgcccagctctgaagaagaaagatggataaaatgctctttgaacacactagtcttttttttttaatgtctgtacagaagggttgcatttatatttggctttccagacctgtctcttgaccttctaattactttatttgaaacagcagtgagggtataataaacctggaggttgtctctcctttgctttatcataaattaaagctgctggtttgttgaggtgaaagtggaggctgaatgttcattactgctcaagtgacggcttgtcaatagcagtgctttttagtttgttctagtcagcacttgctgtgcattttgttggaccactgggaaataaatacaacaagattatacatttggaataccacaagagttcacaaaaaaaaccacaaatgataaattatacacttggtagaaagtgacatgctatcttgtgctattaacaaccaaagataattgcaacgaattgtaattgcagtttgcaacttacagtacagtgtgtccaacatcaatcttaatagtgaacaaagcaatttatattaaaacttaattcacttggtaactttccgctgtatacacgggagctaacagatgtagcttttcagaaagttcaaaggcatttgaaacgtggagagaaatgctaatgcagtaagccttggagaaatattgcattactacttgtaatgaaaacaaatgtatgtcattatctcctagtttgtgtttatttaataaaatatgcagtttgcacattggtgaattcagtgtttctgaatggatatggaataatgttctgttcagaatcaaaggccaaacaggactagcaattacgcatcttctgtaaatagtctgctgtagcatgcaccttgatgcttgagtgggttttgtatgaggtgtaacagcaaaccggggtaactttattcatgactttccttagattggatgtctttgaagcaagaaagggagatctcctggaattacttaagagaacaagcatatttgttttgtgagcttgactgatggccggtagagcagttgagtgaaatctctaaactgattagggctttcgttcaaataatcttctaccgttttcattaatttattccttaatgctattttgctgctcttctaccaaggataataatctcacactcgctgacctccatgagtggatgacctggagctcataactaatcttatttactcttctgaccagcccaacttcatttaccttgactggataaagagccttccgttgctaagcctccgttccttcgtagcattctcgttaatctacagtgaagggggaacgatgggctttcccaatcaagatcccaaagcatgctggggcactgggaacttcgtgcgatttctcttcctttcttgaaaacatgtttccactttattgttccccctttttgatttgaaaataatagagaaaaatgggggagtgggacttcaccatggtcccactctcctaatacagctatttttaccttgaaagttaatttccagccattgaccataggaatgtgtgggttaatttaggtattgttgttgagtacatgaaattttgtatcatgcttttttatttaatgctacattgtttcctgtgttgcttcataattttataattatgcattttaaagactgataatgcgttgtttatatactattttgggtttaattgttccccagtattgaagttaggttacttctacttagttatgctattaggaataatgctgcaataaaaatctctgttttcttcaattagatggtttctcttgaatataatattacaaatggaattattaagtaaaaggtataagtgtttgtatggcttttactatacattaccaaaaaaatgtctaggctgtttttctgtttgtttgttttttgttttttgagacagtctcactctgtcaccaggctggagtgcagaggcactatctcggctcactgcaacctctgcctcccaggttcaagagattctcctgcctcaacctcccaagtagctgggattacaggtgcacaccaccacgcccagctaatttttttttttgtatttttagtagagacggggtctcaccatattggccaggctggtctcgaactcctgaccttgtgatctgcctgcctcagcctcccaaagtgctgggattacaggtgtgagtcaccgcgcccggccttggctggttttatgttagtttgtattgccaccagcgatagagaagtatataattttatcacagtagctttgagaattatcctgactcttccacttacaaactacatggcattgggcaaattacttaaccattctccctcggttttcccatctgaataaagggaataatagcaatgcttaactcataggttattataggtattatattagtttatatatttaaatatcagggagtagtgtctgccacaaaggaaacactccataaaggtaagctgttattattcccaaaatttaatttttcacccagtttaatattaccttctatttaagctgcagtttttagagtaaatgttttaatagtccattgaagctaactagtcaatagattttataatcagtaacttctgtatttaatgaaaaatttaaatcacttaggcaataagccattaagaagaacttctcagtaagaaatgttcagtctgtaaggtagaggcttttagaaattccatctcttaatttataataaaacagcttttattccagaatcatctaaatgggtcttgaatccttaatgaaagtctgaaggagtttagtctggatctcatacctgctcctccattaggggaggccagagccccttgatgacagtcccactaagactgcacactataaggggaagaaatttcccagacgaaattggagcactgttaatactagaagatagagaaatggaggctggacagctaaaaatcacaaaggtacaccaaacttcttaaagaccttattactacagtattctcaacactagtgattgggaaaacaactaaatgattgtagacaccttgaagtatttgggtcacccagtaaccactgcctatgacatttatcctagagataaatgttacttatttttggccaggtgtggtggctcacacctataatcccagcactttgggaggccaagggaggagggtcacttgaggtcaggagttcaagaccagcctggccaacatggtgaaatcttgtctctactgaaaacacaaaaattagctaggcttggtgacgcgtgcttgtaatctcagctacttgggaggctgaggtgggaggattacttcaactgggaggcaggggttgcagtgagtgaccgtgccactgcattccaacctgggtgatagaatgagactccatctcaaaaaaaaaggtggctgggcgcggtggctcgcgcctgtaatcccagcactttgggaggccaagacaggcggatcacctgaggtcagaagtttgacaccagcctggccaccatggtgaaaccctgtctctactaaaaatacaaaaattatccgggcatgggggcgggtgcctgtaatcccacctactctggaggctgaggcaggagaattgcttgaacccgggagatggtggttgcagtgagctgagatcacgccactgcactcaacctgggcaacagagcaaggctctggctcaaagaaaaaaaaattacttatttttattagtcagcacaacattgagaactcatataattaggcattttgctggagaaatggctcatgtttggctgcaaatatcaaagaccagaaaaacggtaacttaaacaatatcaggatttattttccttcatctgaaagaagttcacaaagaacagggttattctggtggctccacaacatcaccaatgttcatggcccctttggtcttgaggttctgctatactttgacttggcttctggcttcaggtttccctcacggtcacaaaagaactgctgtggctcctaatggctcacctacattacaggtaggaagaaggaagaaagggagggaagggtataatgtgcctggcagctgagccaaaccccaacccctttttaaggaacttccccagaagccttgcccaacaatctctacctagactccattacctaaaacctaatcacttagtttcatctataggtaagggaaaactgagaagtgcttttcagctgggtacattgctgctctcaacaaaatcaggcctgtgtgagagagtagaaagggaagaatggatgttaggaaggcaacctgcagtttctggcacaactcccttgtgtgaaggagacagtcttcagctctgtgaactctcctggcagcccttgatgttggccagtattatagacgagaagccaggagagtcataatgaagcacttcctggggcagagaaaaaagtaagtggagtgaatgatgaaaactttaggtcattaaataaagttccaacattttcttcttgcccaaaacattcacaacaaactctgtggagtaggaattgaaggaaaatgtgccatgccatttttctttagcctttttgcaatgcaacgcacaatcaatacaaatctttgcagtaatcatatattgattttcctagaatataactccatttaaagcacttttatccccaagagtagaaacattggaggctatcaaaggaggaagtagatttccttgaccccatctgcagtgcacaattgattaacaggatagttatgagagtgtgagagagagacagagagagagaagagagaagtcaccgaaaggttaataccagctaaagagaaacatgattataggacattaggctttttgtaaaatcataaggtcaggataagataatgataccatctaaaattacacaagattttgagtacttagtatcctctgactgccccagcaacccaacccaaaccccaacaagcatagctgaatttttggggttggcaaagccatgaatggaatgataggtttaggttcaggccccatgagctggcttgataagggaatgagtaatactgattcgatttatcctgagtcatagctgtgtactaaactaaaactttagcatacatcacatcgaatgtttctttgcttcagacaaagcgaaaagaaaaaaggacattaggaaccctcatttttattccttttcttaggaaagttaaacacttcctttcttctactttccctcttccctatcactttactccctaaagatttaaaaaaaaaaatctgctttctgaaaatcccatgagtttaggtctgctgggtatttctatgcacagatgtcttcatcccagagacaagaagagtaattggatggtaagttgcaaaaagcatgcaagttctgctctgcctctggcctgagtaactgggatgtagccaaaatggagaatggtaccccctgaagcaatcgtgagttaatgtctcttacatactccttgctgaaaaggcagagagtgtactcttgtttatagtgtattgttctcactgtatttctctccctaagtccctcttgtttttttgtatcaagactgagttctcacaaacaagctctttattaaattaaatggttcatgtagcctcattatccttctcaatgtgcaatacttgatagtttattttactagcaacttctggagtttgtgtttttttttgttttggggggctttttttaaattttggcttcgggcaaagcaactagtacacattgttagataaagtatcttatctgtcagcagcacccttgtgaattaatcataattcaataggattactaatcaagatttgagatgaatgttttgatagagctatcagatttgtctaatctgtcattagttgacagtcgctgcaggcagagtgaaaacttggcaatagtagacctgtttctgatccctttggcttggcccaccagttgggtagcttcactgattatagcagtggacccaggcattgcaactaattaagttctgtttctcactctccaggatcctccctcctcctctcaccgttttcagaatatgttgggtggagttcagctctcatgaacctgcccatgtaatgaacagatttggtaacaaggtgttccttttggtcattttcacttgataacaaagatgtgccaagccaagtgacaaatctcaagggtgatatggtgtcacttgcaaaaagtggtcaaagaaaaaagagaaacttaatctgttgttaaacgatactaccgattacaactctttccatgtcactaaaatctgtgtcccattttaccaagttgtacattcttggaagtaatttatagcatatcttgcacatttattcagtttgattagataaatgaaagctagtgatgtagattggtattttattgtatacactatatacagtatttaaaattatattaaattttgaaataataataaattatactctgcatattatgtagtactcattaatacaaagatgggatcattttatagaggagtcctttaccaatttttcttcctctctctacattgttattagtataaagatatttcttcattatagaaaacttggaaaattctagaaaagtctaaaaaattttaatttatcataatcttgtcatctcagaatgatcaatattaacattgtatcatcctattaaaattaaataacagcacaaataccttaattagtaattgcttgacagtattgtcaataaaatatgattctacctggcatggtgtcctggaatctgtaggcaacacaaaggaatccagaaagatcgtactttctctcaaggcttcactttctacatgaaaaccatatgggaaaactcatttaggctgttagtgtatcccatatgttagaagtgacaactttttaatttcacaagcatgtcacaggcctcactaaatgaatgctagccacactgagagatttgtagcttggatgatttagacaagggatagttgagagttacctaattagactccaggtgtaattatgtaaggcgttccaggcagcagtgtgctgtgtgttaattaactttcatgctgaacatgcagtagcccctgaacaaagaacagttcatggaggaagaaaagcttccttactttgccctagctttagttattctcctactaaagttaacctctcacactcccccttttttctagttgagagatgggccataaacacaagccactttgcaaagtgttcattagtccctgtaactctcttcctaccgtcttccatttccttaaaacattctttggaaagatcttttaaaaaataagaggtgtatgtatttatttatgtacaactctgttactggttttaaaaatccaagtgacttctaatcctgatttttttgctgcccattaaactccacaagtatctttctgtggtgacggggagaatgatatttactgaactacaagattagctaatatcccatcaataactgagtgccacagacttcctcagttcatcccattcctgtctctaggtagcaacagtgagaaaagcacttattaaagaatattttttcttctactaaattagtccatgacttcatttgtgctggtctctgtttgtcaactgctgccaaaaatttttaactcatgcagtaaagtaagcttcgtaaatctatataattcaactcaacacttgcatgagaaaatatttcaggtaaccagttaagccctgtgtatggatggtaactgattgattgtccagtcctctcccagttctcaagtgagaaaatcccatttcgaggttctctcttcctcctaatcctgtcaccttgacatctgcaggctttagttttctactaataacgtctagaatgacacacaggaccaccttgttcatatggaagataaataatagttctagaattctgtctacaatagcatgaaattaacgtagattaaggatttgcctgaaacgttaagaacagataggattcaacatttttttcttctagtacctcttaccaattatgagaaagaaactacttactaaaacagtcttgatttttattgtctgttggaagaaaggtaaaataaggacttcgttgtataaaaagcattatctggcagcccttatagctatatgggaaatgcctcaaagagatgcatcctagtgaagatgaggaacatttggacaatttgagtgttctctttcagttggataattttcagttggatatctagcaaaacttagtcctcatttttttttgtttgtttttcctctgatatgcaatgtagactacatcaggcctttatagtcaaaaccagaccaaccagttttgaccaagcacttcctctcttcaaggctatgtttagtgcatcaggaatcgaaagacatctaagacataaaccctatccccagagagtatactatctgttagggaagattagacattaaaaacatgaaaagtaaaactctaataaaggatttaaagaacagttcaagataacagtaggaaagatatgccacatgacaatacatgattgtcaaatgcatttacagattccctttagaacaaaaactgttcttgaatccttctaatagaaggggttcgtagagaccattatgaagccttaaaatattaagaaactgaagtattattccataagaatgcctttcaatttagaaatttcaatgcaaaggagaaatctggtttatgtaactggtaaagtcattattttaggttatcactgaattgaaagtgtaaaatgtgaaaattcttatataaccagtagatctctgagaaagtgccagtggacaaccccacagagccaggagaggtaatcaaatcatttcttttagcaagttccaaatatgatgaggttgttttaagctacatacataagatcttagggaaaaaatggattttttagttgtctaaatgacactgcaatttgttacagcccaacggatacttcttgcttgctgcacagaaaagccaatgcactgaaacagtggtgttgcggcagaaaaacagtttaataatctcaggaccagctaagtgaggagatgggagatatttctcatatttgccttcccaagaatttggaagctagggttattaaggaaatttggtgggcttggggctagggaatggatactgctgattgggtggagatgaaatagcacgggcgtcaaaactgtctttgtgcctgagtcagtttctgggtggggcttacagagctggtgagtcagttccttggtgtgggtcacagatctgggtggcatcgttggctcatcagaatgcaaagtctgaaaaatacctcaaacaccagtcttaggttttatgatactgatgttttctatgaagcaatgggagaagttacaaatctgtgaccatgagctatgtgactcctaagctgtaagcaattatagaaaagcaaagcaaagcaaagcaagttatgaaacaataactggttatgatttaactatgcccataccttagcaaaccttaagtccttatcacaattctaaccttgtgggcttttactaatttttttaaggtggttttataagacatgggcagacagatggaaagaggtcattccagttaggtagaattccatatgagagtgggaataaggtagtgtacagtaggtttagtgtgttaagctatctggctgaaacagaaaattcaggaaacttagaccaatatatgggaggcatcaaaagatggctccattctgggaagccttcaaaggtttccgaggctaacagtgacatgatgctggtgatattacaggcagattagtctagtgggcagtgtctacaatggatttgagttgttcttgcttgaggcaaagggatgtacctagagaaaagcattgttcctgaaatgaggtgatgtaagcatgcatctgacagagcagttataatagaaaagacgtgaatttcagaggacttctaagttgacagaactttgtaatcaattggtttggaggatgaagaagaggaacgagccaagagtgattctctgatatcaaacccagaaacaagtggacatttggaggctccaaaaccaatttgagtatgggaagaggttttaaagatacagccatgtaaattagctattgggaagacctaaagtgcacaacattcttctggctgtgaaaattatgaaattattccccaaaggactacttagatcattatgtctgctcagtcatctgaaatatattgatatccaaagtacacatccagtaattaaaaggaaaaagaatccaaacagtttgttgattttgatattttgttatgggttagtaattgccttgactatcttcttgcagagcttgtagttaaaggcttgcttatttcttcatcaagtaacagctgaatttcttctttcttcctattgatatagtttagatacttgtccccctaaatctcatgctgaagtatggtccccattgttggaggtagggtttggtgggaggtgtttgggtcctggggatggatccctcatggcttggtgctgtccatgatctcatggacagtgagtggggtctcacaaaatctggttgtttaaaagtgtggcatctccctcccctccactcgatctctcttgtgcctgctctggccatgtgacataaccgctcctgcttcaccttctgccatgagcaaaagctctctgaggcctccccagaagccaagcatattccagtatcaagcctcctgtccagcctgcagaaccatgagtcaattaaacctcttttctttataaattacccagtctcaagtattcctttatagcaatgcaagaatgttctcacacacctatttaggttaaaaggttttcttatcatcttggttttcagaaatggacaaattgccaagggcctgtcaattctggactgacattttttcacctgcttgaagagatactgttttctcttaagaactagtgattttcttcagttgtgtgactgacttacataatactagcagaattggccacttagtgtccaacagagaaatgaagttgagactgtggggctgggaagtctctggggcaatagcttcaggtttgaaaagtgaggagaaatgaagcaaaaaaataaaaacactgtaccttttgtcaaaccctttgcttagatcaaggaatctagatttggccaaaaggttgaatttaatgcatacagttgtgtggtataaatttgtctttgtaaaggtcagacttgtccagacacagtggttcatgcctgtaatctcagcactttgggaggctgacacaggaggacccttgaggccagaagttcaagaccagcctgggcaatataacgagaccctgcctctacaaaaaagagacaacttaacagggtgtggtggttcatgcctgtaataccagctatatgggaggctgaggtaggagtattgcttaagcccaaaagttcaaggctgcagggaactatgatcatgccatgtactccaggctgggccaccgagcaagacccagtctcttaaaataaataaataaagctcagattcatcccattccagggaatagggaaagttccacattgatcagaactgagtcctgtaagctccaaacaatatgactcgcctttaaagtccttctgacgatacctttccaagtgtctgacttatgatgtgttccttgttgtatagacttgtacgtacctgggctatgtaagtatcacttctgagggtacaggtaggagggttgctgcgagggcccactgtcacttcgggaaagtgtagcagtacttgccaaatttaaaagccattgaaacaactgaaaataaaaattaaaggtggttatttcccccattactgaaaggtatatgtgaaatcttgcatttacttttttttaaatagactttaaacattgattttcctttctctgggaaggcagatgtttgtgtaaccaggaaagaaagctgctctcaacagcagttttctaataaaaggcctacttgcttttccattttaaaaccagtgtttaagagctttatgattctaaaatgaaaagaattcccttgctatacaaggaaaaggaagagtgatggaatatttttgcaagaaaaacgtaccttaatttgccaccttacaagtagcctgttggcatgagtacattggaatgaggaagcttttattaggaaataatcatttccagttctgttatagtcattatcccaaaagtttcccaaattctgtgtacagtagtgtgtcctggaacctgtttagtcacacgtggggaatgaactgagcttttgagaccaataggatggtgtgaacataagaccaggtaatagagctgttctcctagtagttttagggtcttaaaaggggtcattaatgctttcaagtcacaaaacaatctttaaagttctggaactatactttcctacaatcatatttcacatttgcacataagttagcttgaatgaatgtttaataaaaagctggctacattcacaatgttgcgcaaaaataaaataaaaaattaaagctggtctctgtaactacttatatgaggttctcagcccccactgacagtgtgtgttttagggaaggaagcacattgagtcactagcaaaacataattgggaaagtgcatcccttccaaactaatgatgtatggtcactactctaaataaataggggttgggattatccattttgataacctgttttgtgtgctgtaactgttcagtttagaaaatacagagttgattccaaatttttcctgctggtttgaaagaattcatacatctttcaaagtgtgactgatattcagcaaggaagtgccttactagttgaacaggatctgatttgtcattcttgtttttgctgtaaagcaaaatctacttttagttaaatcagtaatttacaggtatataaactaaagcatcaagaaaacagcaaagaagttttttccaagatcattcacatccagaaatgaaatgaaacccctacgaggctccttcttcattttgatggggccattgtggttctggcccctcagtttggttgagggcaacatgcggagtatctcagctgaacacagatccttcatttgatgtcctgtctaaacgtgacttcacaaagatcttttagtcagacactggatagcagaactcctcccctgggagaaaaggtctttaaggtattttgaggggaggagaagggttaagaggtctaatccataactctaaatccccatgcttggaggaactcattgacattgtcggttttaagggctcctttggagccattatggtgtgtcacgctgagacccactggagaacacttaattgtagatcattgtcccagtgtgtttcaaggccttttcagggttttgacaaagcagcctcctccgccacttacgggaaaccttgggaaagtttcgatactgacaaacccaagaatattcttcaggtttgtgcttttaaattaaataactagaattatcagaggtttttctgtcttcctttcacccgcttcctcttgaaatgaaacctcaactggacatagaccccctggctgctggatatgtgttggctacatttctttccttttctaatttctttggttttgaggtcgggattttgtttttgttggtggcagaggtggtataatgagcaaacacagttatcacatgcagagcctgtaagctttgatttcaaaatgtaatcgaaatcacatcatttcatgtggaaccaatttctccttgcctccttcccctgaggagtgaaggaaatatctctggtatatcgttaaatacctgatagattagaccttcagataggttggtggattaaggcaaagcacaaaaaaagctcatgttttcaactgtctatcctattttaaggttcctattggccctcagtattctgaatttaccacattagtcctaatctaatatttagccccataatgttttaaacattttgaccagactcagttcccagcttccatgttgcctatctctgttaacatctctgcatgcatacgagggtgttcattacggctggattgagggaaaaccaccaaaaaaccaattcccatttcttgggcctgggaatccggggccctaacagtgagctcagaatgaattgagagaatccctctgggtcataaagatagactgcagggtcaaaactcaaaaccttgaggttctttttgcttaaaattccaaactcaatcaaaaatgagttcatttctaaaaatgctgcaatgccttctcatggtttttccacactgtaaaacagaagttaaactctagggtcagaaatagttaacaaagagagcctttgtgctaagcaggagtctgtggattgagttctggctcagccagtatatttctgtgtcatttggctttttataagctcattgcctcagtttctcttccataaatggaggcaataatattattgcatttctatcttctaaaattaccaagaggtatagatgtgtagtaatacagaggacacttatgaagactgttaactgtgagtcctttttgctatgtgagatataccagtaaaataagggacatgattgttttggtaggcctctgtacggatacaggatagctcattgaacccgatctcaggaattatagattagaaagttgtcagtctttgatttctgcatctccccgtgtgtccacttgctcccctctttcagcaaaccaactgccactgtatctttgggccacgtgaccaaaaagatggttaccaatgggttttgagttttcatgtctcaggtccaacaacctgggtagagacagaatctctttaggatctcaattccagattcccagggagagaattctgattgtttcacccacttctggaactaacagctgtggctagggagttcaggccaccccgagcgagcatggctgcctggaacctgctacttaaatcatatgcatattggggaggtcagttcccaaaaatggagaatgtggcacacatccaatgtatttccactggaccactcctttaaagagtaagttgaagtacccagagttctttgtattcctcagaagaaagttgctttaaggaataaacataaaactttaaagcaggaagggatttaaagttcacccaactctaccctccttgtcacgttgatgaaactaaggcaaatgaaagagattagttttccagaggtcctaaagctacttaatagcatccagtgctcatgcttttagttaagagcatctagtgtatcttttattcagttttcttctgccatctcacagttgtgcgtatttcagatgtcattttttcctattgcctagacgtgtttcaattataagagatttatatttatagtctctcatttaataggtggtttaaattttatagactcttctactttagaaaaacatagatagtatttacaaagacaacatagaaacatggagaaatgcatatgatataccattacatggaaaaagcaaatgaatgcttatatatagtcattatgttaaaaaatatgtaaaaattacgtatgcatatatcaactaggcttgttagaatagtagtattacgtgtaactttaaattttccttaacaccatcattaaattattttagcagttaattttagaaaacatatttaatacaaatacaccctacactacttctcatcttagagctacctgaacctgtatacctaatgttcttgtgcaggaaggtgaactttctctaatgtaagccatatatattttgggcacagctggaacctttattccggcagtgaacacattgaaaatggagtcctcatagctgtggctaaagctgcattaaattatgatcttagtagagacttggccccagacaggatgacccactagaggcaataatcagaggataagatgttttcaagcatgagtagagtcagactctaggagctgggaagaaccttacctcctgtaacctgacccttgtgggcttcagaactggcagtggaagcatagaacgtttccagtgtttagaggtggaacttggctaaagtacagagagaggactctcagtgaagttccttctgctgccatagcagctgcattgtgattatgcccaacctggaaagtgcctcccccaccttcccaggagcctcactgtctacctctgatggccaaagctggggagaaaatcagtgtctcagataccatctgctatggtttggatgtgtgtcccctccaaattgcatgttgaaatgtgacccccattgttggagggaggcctagtggaggctgtttgggtcatctgggtggatccctcatgaatggcttcacactgtccttgcagtaatgagtgagttctcactctattagttcatgagagagcttgttgtttaaagagcctggcacctctcccctctctctcttgttccctctttcgccatgggacatgcctgtaccctcttcgccttctgccataagtaaaagcttcctgcggcctcatcagaagccaagtagatgctggtgccatgtttgtacagcctgtagaaccataagccaaattaacctcttttctttgtaaactatccagtctcaggtattcctttataacaacacaaaataaactaatacatcatctgactttgaatctgccctcatgtaaatacatctgttcacatgtaaagcaagacagggacacaagagcagccagcagggcttgtaggggcaggagcaacccgagaggtgggcggcctcctgttaacactgctttctttttctccttgaaaaaggcaaactgggttttcaaggagaatgagaatttcagggaagggatcagagagagtgggcactacatgtgccacatctgtcagatgtcttcaaaccattaactcccagaccccaggaagctgctgctctttctagcattttctagagcatctagcagagcactaagtggtagtggcttaatgatataatgttttgtgaactttgatgaggagggagattttctcaagagcaacttcagaggtgcctatacttctctgtttcagagtggatatagaggggtggaagaaggaggccaagatactttgctttctgcaagaagctatagagatcaagaaggaaacatagggatggaggtaggatttctacctatgaagagttatcaagcatttaagtcctatagggcccatgtggcccattcattcattgaccagtttattcatccactgatgtttttcattcaacagactactactaagcatcttcgactatgctaagtcctgagcagacagtgaagaactagaaagacatggccccgccctcatgaagattacaagttaggcctattctccacacttgttctaactcaatctgctacatataccttgagtacccagtatgcgttaggtactaaaaggagctacaaagatgaaccagacacagtcttcaagaacttcagggatcagggaaggtttatcctgattgtaatccctccagaggttttgatcatttctctaatcacttattaggcctcttgcttcctgtaggaatttgttctctatattagattgaaatctgcctgttctaatttcaacttcctttcttctggccctggctagtcctcagtgtacagaattgccattggtacctgctggtcaaggccaagtgttgtgagccaaggtttctaaccttggctgcagttacacttaactgctcctctccgaagctggatttagcagagatttgatggaagccctgcaaacctcgattcaaatcaaagttcaaacctagtgactggttgagtgaactgctttaataataacagtgcaaaaattgaatttaaaataatccttttagggatgcaagatgcagtggtttagccttttattaatattcttttctttccactaataaagattttaagtcaacatctccttaaatttgattaattccattaggatcactccaaaaaaaggtttatcagtggctttgaaatccaaatgggatgaagaaaaaatcatttatatggcaaaatctcagttacactaactagattaaagaccttctgctgaattaaagaaaaaatcaacacacagattatttgaaacaaatgtaaatatgcaacttttaagcacatagagaaatctaccctaaagttgatgttttttcaagttctcttggagcttacattccagtgggagaaacccgtgttaaacaaatacatagaagacaatttcagattgtgagctaggaaatcagggtagaggaatgggtaatattagagagatcagggaggcttctctgagaggtgacatttgagctgagatctgaaagaccaagccacagtcacatgaagacatggagttagcgttacatgcaaagcaaacggttaagtgcaaagtccctgaggctggaatgggcttaatgtcgtggagaaacaggaagagagtggaggagtgatgcgagatgagaatagtcagagaggaaggtagggccataggaagaagttttgatttttattccaagcacagagaatactttagaaagctaaacactgacttttaaaagccatcaacaaaggaaaaatatgcctaaggtgtgtgttttatatgggaccgaagaagaaaataccgaggcttctccccattttattcttccacattgagtgtacagctattagtaaaatgaaatattatttgcaaaaatgctttgaaaatgttaaagcactattctccttaaatttaagaatattgtcctggaaagatttaaaatgactaagggtactattactttatcacagaagaatcatgctgtgttagtccattctcacaatgctgtaaagatgctatctgagactgagtaatttacaaaggaaagaggtttaactgagtcacagttcctcatggtggggacgcctcaggaaacttacatcatggtggaaggcgaagggaaagcaagacggcaggagagggagcacagggggaaaccaccacttttaaaccatcagatctcgtgagaactccctcattatcacgagaacagcatgggggaaaccgcctccatgatccaatcacctcccaccactcccctcccttgacacctggggattacaattccagatgagatttgggtggagacacagagccaaaccatatcacatgttaaactttaagcaaactctccctagtagacccacctagcgattcaaagaaatacatggctatgaggattccgttgccattttccttatctcatataggtctaaggaaggaagatttccactgtttagaccggaagaccctgaggacagtatcctttctggctgccctgctgtcatatgagtccatagggggcaaaggtgaggctttcctgggcttgtgattcccaggatgtctccacttctagggccacattagctaaatggtaattatgaaaatatccagggcaagaagctaataaataagaactgacaggcattgcatagtaaagaattgttgtgcacgctggctcttctgcaagacacacgatggaggttgagagtgtctaacaatcctcctgaaacgtgctgcccgatgtgctgatgatacaaaaggaaacctgctcgaatagaagagcacgggagaagatttatgtcctgcggatggctgttcctattgtcgtggatccctgggatgtttctgagagctttcttgtgaccttcggtttctaaatgtagaacctggctgtgatctctgggaaagagaaaggaatatgtcctaggtttgtccaatggtatcaggaataaagaagctaagatttggaggagccaagatggccgaataggaacagctccggtctacagctcccagcgtgagtgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgccttacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccaggaagcttgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttacaaggaaaactaacaaccagaaaggacatctacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacagaacaaagctggatggagaatgattttgaagagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagacaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccagtctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatattaactttaaatataaattgactaaattctgcaattaaaagacacagactggcaagttggataaagagtcaagacccatcagtgtgctgtattcaggaaacccatctcacgtgtagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaaatcagctctgcaccaagcagacctaatagacatctacagaactctccaccccaaatcaacagaatatacatttttttcagcaccacaccacacctattccaaaattgaccacatagttggaagtaaagctctcctcagcaaacgtaaaagaacagaaattataacaaactatctctcagaccacagtgcaatcaaactagaactcaggattaagaatctcactcaaagccgctcaactacatggaaactgaacaacctgctcctgaatgactaccgggtacataacgaaatgaaggcagaaataaagatgttctttgaaaccaacgagaacaaagacaccacataacagaatctctgggacgcattcaaagcagtgtgtagagggaaatttatagcaccaaatgcctacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggaagtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaagcaggagaaggaaataaagggtattcagttaggaaaagaggaagtcaaattgtccgtgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaaccgacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacttaaaaccataaaaaccctagaagaaaacctaggcattaccattcaggacataggcgtaggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtggggctgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggagaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaattaaaaaaaaaaaaaaaagaatttccctaagtcaacaagacaaggtctaataaacttcaggtctaacaaagacttctgctgtttaatgtaaaaaaaaataaaaaataaaaaataaaaaaataaaaatacttgaaaaaaaaaaaaaaaaagaagctaagatttgagttgcttgggtggagtaggtacaagttggtgattaccattcaggttggctgccatctgggtaggtctcccttcatggaaggccccagcagggaagctgtaatcatgtgctcagtgaaggcaaaagtcgttttgatatctttttagtaaatcattccaccaacgctgtgcaagccataaatgtggcacagattaattgagcaaaaaaagtgacttgcatacagttggcacttctgttcttattaggatcagaaagaacaattgggtgaagatcacttcaggaaaaagaaaaaagcatatgttacttattgttttgggtgaatgtttttatggaaacagggatgccacgtcattaataactctggcatgccatcccaattctggtcggcctgatagattaaacatgagccctctctcattattccagcagccgtagagcattgactttgcctccagcctgataagtattccatgcacattcaagcctccgagttgacatcttcttctaaaattgtttggctgtaataaatataaaactttcaccactgatgtaaagcattgctggttggcatcatttcctacccccttttaattattcctgacactgtggagaaacatctaatataaatctgtaatgtgcactgatgacaaactacacggttgaaggaccatgtaatttctccacaattaattaaagtgcatggagattttttttttctctttcattctttctttctttttttccccccagcagccagatgccactgactagctcagataacactgctgtcaactgtaaaaaattaagatccaaaccgtaagaaaggtacttagataaagaaaccagatgccaggttatttgtgatactaccacatacgtcttgatggaagccaccattgttcaacatctgtagttccacagccttaattacgcacttaactcagcaagcctgtcagcagtttatttctacaagtaccgtcacttttgtaaatcttcccttaaaaattgaatgctgccaatcagcacagggaagagagacagagaccctggaagaccttgtgcaaaaagagatggctgcccgtttatgccggtagcacatgctggtgtttatgggcatgtgtgtgtggtcacccagagaggaaaaaatgctctgctaccatttcaggctgatctaccacctggaattgatcaaaagcaaattaattttcattttcaattaggaatacaattaaattcaaagtggtgagggggggaaatggccatgtttacatatagctcctgctggtgggagggcttgaggaaataccagatgaaatgaaatacttgtctttgtatctttgcatttaactcattcaagtgttaaggtggtggctggggctgctgctgctgggactgcagtttacctcccctggagctgcccctccttcccttcaggcagaatgtaggcaaagggaagagggagggcagtcagaaggtggccactctgagatgcccattcatgggctcttttcccaggatttggccgtggatccaagatatgggtgttttcatgtagagcctgaatgaggaagcagtagtttggctttgcattctgctggctctcagcgtcaaagcattacctggcaaacggatccacgtctggccatcatgagagatattgagtgattgtgtgaaaacaatctggctgttgaatgcctcatgtcacaggatcccggcccttttcacttgacttttctctacattcaactgctgccttttgttggagtaactgagtgggggcctgtggggcagacaggattcctcctggctgcctggggaacagttgacccagtgtgttcatcaccaagggtggtaatttggggagctttgaccctgattttaaggaaagtcaattatttgtcaattatgagtcccagaaatcctgatatgggactcagatgttaaaggcccggctctctggtttcgggagagatcacagtggatctgagaatatgaagcggtcatattctcccagagcagtgcatgttgcttgccataagccttctgtcatgctgatgagattcttctaactatccatcttggagatcagcttctttgaaaaagcagagtgggtgataaatatttggtcatatgaataacaatgaagtagcttcagataatagcttacatctttataaaatcctctgggtgatggatgaagaggaagagaaggttctgggtcatggaaacagctgctttgggtgaaagattatccaaagcagggtggtgaccaggaatccttgctgctccagtccatactttacctcctacccacacccccaaccacctttcttgtcctaaagcaagggtttacgtttcctccctgcatggtatttgtgctttaaaagaagattttattacttctgctacagtggaatttctctttttactagacagttggcatgaccgcagcctaaaaccgcaatggagttgttaacacactgggatcagtttttccccctttaaagctattcttttcttttctttatttttttaaagaggaaaaaaatgctccaacaaatcaacagaactattaactttctgatttatttgctagagagagcaaaaaaagtcaatgtgaactgacagaaacgccagaacagacagtatgaaaacattctatgtgaaagtttccaactgaaatcgcaccacaagcagttggttatctggagatagacatcttcaatttcctgattgcataatagaaatgggatttctttttcctctacaaaaagcgttatccataatgttgacataaagttttctgtgccttgagttccaaagagtactcttctcaagaacagcccagcatcttctcaactgctaacggttactgccatttctcctccttcaagggaaagggtaaatgttgctaacatgatgaaggccagaagaagaaatcttcaagagcctgggagattaactctgcccagctggccggtgtcatggcatctagtaaacaggccgatcctccactataaggagaaatagccttgagaaaaattaatctggttatgggttggcaacccaatagctgcctagccagtgcacgtttctccctttgcaagtatctcagggttagaagtgtctaaggatttgagactgtgattctgggaggttcaggacagttgtcctggctgggcctgagccaggctttgccgtggatctgcccacctcaagaactggcacaggtgataggtagtcttcaaatctacatggcatcccaatacagttggtgacaatgcactgtattttcctcccccctcagtttctgaggacccatttctgagatggaaagttcttggccctggcctgtagcttacatcactttggtatttttaaatgcccatgatctcaaaagcagtcctcatattaaaatcaccctttatatcaatacttcattttatgtaacatagtgttttaaaattatatttaaaaggcagcttcttttgtcttatgtgcccttggctaggaaacaaaggaagtctcttttaagaggtgttttacattttatgactactgagagagaacatagttctttaataggtagatatctaagagagtttcacattataggttttcagagattagaagttctggaacaaggttgtttgataacatctctgaagggcaaaggagcaaacggaaacctcagaggactggatgccaaaacagaacactctctagacttgtgggcaacaggagcttttctgagatcgtattattctcaccgataatagcatcctgccttgactgagggtgagggtgtgcaagatggatcattcgtgtcttatacttcatggttatgggcatgtaatatgttcttcattgagccaggcaattgacagagacgccagtgcatttaagacttgagtctactggaaatgagacttgctctcttgccagaaatggatgcttttctgtgtccaccactatcagacatcttgacttttttttaatcctgactcttaaaacaataatatcaaacaactcgagggggaaaaagttaaatatttccatatgaagagctgattaaatttgtatggttttcttttcagtaaaaattgatatgtgatgaaacacagtgcagctggatggctggtttgggttgatgctgtcacatcctctgatctcgctacccagctgtaagggccagcacccggtgagctgccatgctgctcagaatgcccattcccaggcactaaacaccaatcactgattacctggctgaagtctttcctcttaagtctcatcgttcttctgtgtgccttccttttcaagggcaggctgagtccatgtggagcattatggttgataggcatgtgatgcccatctaaaatacggataataagaggaaagggcttctcaattattggtgtggatatgagaacttgactttttttttttgagacagggtctcgctctgttgcccacgttggagtgcagtggcactacctctgtctcctgggttcaagagattctcctgcctcagcctcctgagtagctgggactacagatgcatgccaccacacccagctaatttttgtatttttttagtagagacagggtttcaccctgttggccaggctggtctcgaactcttgacctcaggagatccacccacctcagcctcccaaagtgctgggattacaggtgtgagccactgcacccggccaagaacgtgacttttgattttcccagtatttggagtgggtgggctgcttctgctgttgccattggtggccaaaggtaacaacagtatattttgctgtagcagattttacagagatgaaaccatcttgccacttctattcttaataactgtgtccatctttcctctctgcagagatgaaattgccaaagagtcagaagctcctccaggcttagccagctttcacctttgctcatcatacatctatggggctcctcttaactcacagatgggctagcgcctgttttcagcctttatcctgatccttcgtatctccatgcccgctccatgtctctctctccaatgtctcttatctctgtcttgcttaactgggaccagttcttccccctccctctttcagtttccaaagatcatctcctgccagatcttggcctaaagttaacttgattctctggcctcgcttacagaagccgaactgctctaaaccacctttggtggcagtgactccttcctgaatgaggtcaggcactcgaaaaattgataggcgacactcactctggggcttctcacatatattcctcagtcgggaatggtaaaggtccccccattcagggacttcaattttgtgacagagaaaaagacaaatttgactgtcaacatttgttgggctccaaggaagttacacgtgtaactgagctatttcagatctctatttgtcaagcccagtgttcactgtgggtttccttacatccctcccctgcccaaacccctgccttcgagaaacagtctacaaaaaaagcatttaccctctgaggattgctttgtaattaaaattttacaaatgccaaataaacaagggcatttttgaaatgtaaatttgtcatttttcgtaagcaacttaaatcaactccacctgccttgagactggtttctccttcagcacaaagccacgtgctcctaggttctcttttggctcctgcagctccgattccccgtgcacttagatcctggtgtcggttttttttttccttgaacactttctgcagtttagttatttgttgtaattatcaagttcatttttctctaatagatgtgattaagtatatttagcactgtgtaatgagttttctgcctggttgcatcttagctaataaggaattccttagcggcaactctgacagctgctacgagtcccaggtctgcgctgccacaagagactccttccatgaactgctagcattagagaaattaactccattacactaaccataaaattgaggctgaaatttgattactaatagatcctcaattcaactagaaactgtagaaacggggtggtgccagtggggaggaaggtgaacgcgtgtgaaatgccagcatccacattttcatcagtgtgtgtgttcaccacacttccaatttatttcctgggcaggaaggagagaatagagccaagctgatggaattaaaactgcgtgattcagccggtataagactggaaatctttgttactgccatgatggtaataccttgttattagtgcctctgtcttcgctgagctgagaaacctcccggtgtgtttttggccatcaaaactacttgccattgtcaccggtagtccagatttgtaaggctaaagtgctgaggacaattagtaattggtgactggctgctatgatgtatagttgcttagcaacggtgcctgaattaagtctctggaagtggcatacaggaagagacaagacaggaagatgaaataggtaccatttcaatgtgtaggtgagtcagtaatgaaaaaggagtgaaagatatttgtaatcatagagacggctgagtggaaaattggggctaaaggaaagaaaaggcggaacttagttcctctcttgcgaagtaaaataagagtaaatggcagttgaatcaccccattgatacaagagctcattctctttctttgacactatactgtgaacccaatgctagctgaactcagggtgcattatttacccaaaaggcagcatgaaaattcatggaaggaagagatggagaatgaagttgcactggcttgaagtctttagaacaagattaatttagcttccgttagttcataccagcgaactaggattaagtgggcgacagggcccaggtttgattcagccctgcttgcaatactgggtggaactggtgctctgatatactgatgttcagtcttgctctgtttggagtagagaagtatcttgaagaggccacgaacagcatattcatttcattagacttggctgttttgagactctgagcagactaagatatcaccctgaactacatgatttagtgagctggtttagcctctggaaggccagatgagcaaaagaaagtggaaaagcagtacaagaccttgatccagatactgagccttgttaagggactgccttatctatggcaacgagctatgtctagaggtctgcaaaggtgcaggggctgttttgcaattagtgttgaaacactgagataaagaaaggatatataggaattaaaaagagataacgtaaacactaacaaagagtcttaatcccctcggctgagtgttttgcatgtttacctctgatcagaattcttaataattttgagtgtgttccaactcaataaaaattccctaggaagaaacaagtcgattcttggattaaaaaacaaaacagaaacagaaaaatgtatgcccatgtctattattttaaaaataaaaattaaggaaattaaatgacacaggaaggttttgtttgggtttagtttggttcagcctactcatgggcacaattcagtcccccattatctactgattagcaggatatctttagggctcagaaagcaggttttctgtctctaccgatggcttgttttctggctgaagaatgaaggtgttttgatacaaagttattattgttcaattgagaaagtctttgccctcctggcctgaagttccccactggagagaggaagctgataacaatctctggttctttcctagtacctataaagggctcatcctcacttacaatagagcactgtattttcaggacaatgtataattatttgggaagaagccaaaatgatgactagtgcgtaacaatagcatgcatgatatcacaatctgtctaatggctgatggttccagtttaaatatcttaagctaagggtgctccgtgctctcacattcattcccacagtcccaccactgctgtcccttaggtaagtaacactcaaactctagttgtttaatactcaactttcctgtaactgtaaactctgtgagggcgggggtcatataccttgcttcccactgaccatttattcccagcacccagcacagggtttgtggcccagagggcacccaataaacgttggttgaattaaattgttagaatttccaagatggcccccagtgagccccacttcctgatattcacagccttgtgtaatgccctccctgtcagtgtgggctgacgcttctgatgaattgagtaagggggaataaactaggttacaaaaggcagtgtggccacttatgatctctttctgtctggactactcacgctgggagaagccagttctacattgtgagcaaccctatggagaagcccttaagttgctgaagcctccagccaacagccatgtcgctgattttggaaggcgattttggaagcttatctcccagaccaaatcaagcctcaggtgactgcagccccagctgaaacattgattgcattcttatgagaaaccctaaaaccagagccatcagctcccaaattcctgacccacagaaactgtgaaataataatgtttgttgttttaacctgttcatttttggaggtaatttgttacccggcattaggtaatgaatatactggccaattaccacatgtatcgattcatttatttattcattcagtaggcattgaatgacaactttgccagggactgtgctagatgctagggataccaagacaaataaagcaaggtccctgccttcaaagaactcacagtctaggagagtgagatggacacggagtcagagaacactgaaggttggtttatgagcagcaggcatacaaaggaggaagctggagtggaaggagccgtaaaattgacaaagtggtctctaatataaccctccccagacacacatacaaatacaacactttcttcctaactttcacttagcttagctgtagacagttccagcaaaccttgtttagcactgctccgtgctacattgactccttatggagctggctgaccactgtggaagagagagcactatcctacattctcagcccttggctgtgggcatcccatgatcaacgtgactcagtttgagtgactcttgccagtctgtcagttttctttcctcttccctggtctctctgtcattaacaccctattacctatggatgtcttcattagaagcaaatgttgttttttgttttttgttttgacacggtctcattctgtcgcccaggctggagtgcagtggcacgatctcggctcactgcaacctctgccacccaggttcaagttattctcccacctcagcatcccgagtagctgggactatgggcacgggccaccacgcctggctaattttttttttttctgtatttttggtagagatggggtttcaccatgttgcccagctgggcaaatggttattttttaaatgaccaaaaaaaatgagattattttaatgctttgtatgctcgcccgatatataaatgcaagtttcactgtggcttgagtctgaacatggttggtagatgtgagtcataccctgggcccagctgcgtccaccaacagaatacttctaaggagcaccaggaagataaagacatcagcccaaaacgctctaatatgttgctggtgagcagtaaatcacagtggtaagaacacatctccatggggaccctgctatcatggcccttctcatggctgattctttagaagactcattcccacggcctcttcctgtgggtgacacagtgccctggacatgggtggtactgtgtggttgacatagggcctgaaggtgggtgacagatgttatggaggagaatttattttattttattttttgaggggggagacagagtctcgctctgtcgtcaagactggagttcagtgacacaatctcagcccactgaaacctccgccgcctccagggttcaggtgattctcctgcctcagcctcccaagtagctgggactactggcacacaccaccacgtgtcagtagtcccagctaattttttgtatttttaatagagatggggttttgccatgttggccaggctagtctcgaactcctgacttcaggtgattcacccacctcagcctcccaaagtgctgggattacaggcgtgagccaccacgcctggccggaggagaaactccagcgcagtaaagaaacagccctgctggtactgggtcctttaccctccagagtggggctcaggaagaaggaacaggaccaggtaccaaaagccccagtaatcccgtcaagaggtgcccaggtttagagatgacttcaaggaggaggaaagcctacacactctttttccatctgctgcaggccacagtggcaaagcaataaaatgctgataccatcctcctgcaggtataactgatttaagtggggaaaggcagacaatctgtgagagacaccaaagattacttggcttttccccccacctcctgtgcatgaaccggagaatgatggaacaattggttgtgtttggggcctttatttgcttttttccctcctctctttaaaaaataaataaataaataaaaaatctgcctttgtctgctgctactgtgtctatttttgttgtggtggtggttgttttaaataggagaacttgtgaaatgagactgcataaaagatggacttgttttatatatgggatattgcctgtccttcagatctatgtgtctcgcttatggaatgaaccaaagtaggagagataaactaatattttgtatcagctcagccagacaatacagatgataaagatgtttcatcttcttatgcatgcagaaaatatgaaaaatcgtagtttacacacatttgctcaattcaagtgtaaaattgggcccctcgattgccctgggccacagtggctgtgttaaggaagctcgatttaccttgcagccgagtgaaaaatgatcagaatattagactcatctagcccacattaaggagccattgcatttcccgacaattgtatgctatctcaatatgaaaacagagcaatttcaactcatatcaggttatgatcggcaattacagttgcataattcacctagtcatctctttgcagggcctttattttccctcttggtgacattcctgagaaagtgcctgataaaaatgtcatatatcatcccagctttagaactcgtgagggggtaatctgctatgccttgctgagcccatattcatcactggatttttgacttggaggggtcatggcactcataatttcctgtttgatattgtcctcaccagctctgacaaggggctgtaaaagctcggttgtaggcagtggttaagcgctgctccagtggggcccatcaccagcaataagagtgcattactgtggctcatgctggagttggccgtttcgaagataattagatttgatgtcaacatttctttatcacctgcatccttttgtgcatctgtgtgtcaagttgttctttccggatttattagcaccctcagagctactctctatctgtcagcttgtgtgctgtttgtgttgacagttgtaaagttaattactagtactaatgagcatcgggcttttggtggacatggcgttttggacatttaaaactataattagtttttttttgttttttgttttttgttttctgtgtgtggtgcttcagtacaaaataaaacgtgttttaaaaaaatacgtcccttccattgcattttgacattctgtgtgcagtcaacttatcttttattcaaaggctccaaaaactcagttctgtttctttttaaaacagacttccttttcattgtaactccatgaataatttcttttgttccttacttctcttccaacttgataacgtgaccatttcatatgccttgagaattaaggatagtgatggtggaatgatcaaaaaatgtgctgggtaaatgttcatctctgcccaatcggtggactacaaattttccacttttaactctcctcttttcaaatcgtactctgggttcaaccgaaagactcagtgaatgaagaagattggataaaatgaaaagtgtaataaatcgttctctgagtggctggccccaaaataatagtgatagctcatattggtgtaatgttaactctctgccaagaatcatggtaatctctatatacagattacctcatttaatccttgcaacaaacctaagaggtcaatactattatctccattttacagacggggaaactaaggtttagaaaggtgaagggtctaacaactaggaagtagtgctgggatttgaatccaatcagtgtagctcagagcctgtgctcttaaacactattctatagacacaaagtatgctttcaaggaaaattagcagactcctggggcatgtattctagaacaacaaaaaacaatcacttactaaatcagatcggctcatttgtatttcactcccagccatactgggacgctagtttcagtgtaatggcaattatctatggcatgtactttatggaggtattttgtttggtctattgcggcagcaaagcaccactcccttgctgctattcatatttactttctattcatcattatctgccattttgctaaataactatccttcccagacataaatcatctataaaaaatactctggctcagagaaaatttcgccctggccctgcaatgatgagataaccattttcatctcttgttgaagcattgagatttattggctttcgatgggcaacagaccaggcatcactctctgctaaacagactcccacttgcatttattcttattgcatttagtgattcaaaatggagctctcggaatcccttgagggtccattcccagcctgggtggggtgttattactttatattagataagggaaggacacacaaagaaacatgcggtgattcggatgattttttatttccgtttagcagtgatgacagaatgtcatagtgaaatgacttcaaaagtcatttttccccactgccctggttctgcagccttgtcccttgagggctcttccattgtacagtgttattaattctgctaactttcagacttcattgctgacaacaggcctcttggctttcgcagcctattacattaaatttcccatcaaaccatgtcagcctctgaggtcacagatttcaagagaagctttagatattttgccatctgacttcatgggcaggtgttttctaaattgcttttaggtttgtttttccagtgtcagaaatcagattgaacctgtttaaaaaaactcagacagtgagtgctcatcaggataagaacaaagcggagtttgaggcacgcctgaactggcatgtgtgtttgtgtgtgtgtgtgtgtgtgtgtgtgtacagccgcacgcatgcacttgtgtttcagttgaccttccaaaggcagagcaaagccttccgactcaacttcatccccggccccacctggtgagtacagtgtcttgttgactatctatttttctaatacttaactgaagccccaaaatatagtgtgactgccctggtgaacagagatatgctctactgaccttgactttggagggctctgtgaaactgttgagtagcattagaaggtcactttgggcaggccagtgaaatgacagaggacctggtctagggctagaatgccttaacatggactcctcaagcaagttcctggcggcaataaaatttcagtgtgtcccttgatgcctttattttggtgtgctgttgtgggatcaaaataaaggaaaagcagaaaccttccttccaagtaacatggccacaggcatcacgttgctgtcaaaattacattctgaaggaagcctgcacaggaacgtgcaactggggctccatttaaaaacagaaaagaaatgagatgttatttttgaagcagtcaactcgtggaaatgattacaagtcatttggcaaacccaaagtccccttgaaattcttatttattattagttccggttaatatttctgctctgaaaatgacaacattcaaatcttggcttgccgtgatagttcagattgacaggcttggccgttaacacctttttggtcttctgaactgggtattgtagtgtgcttggcaggggggtgcggcaggaaagtgacagaccttggaagctgaagaggagggaggacccacacgctggcttcctcagtgatgggtatctaagcacttcagtgcctcacctaagagcaggtgacaagagcttggtggcttgcaggaagcactgcagttaactctagccccgccccctttttttctttataatttgtagagacctcggaagctgctgttatctgaacccatcattagccagctctacctgcaggaggagatgctgaaccaggctaggaccagagaaagatgagtgaggcgaggtagtgtcactctgtttcctcctgctagcagccataaggagagagaatcatttgtggcactctggggacagttttgtcaccctgacagtaatgctgttatgcgctggcttgacacacaggatgaatccataaagacagataagtaactgtgaaagtggctggggatcaggctgagtgccaccactcacctgcagtgacaaatagatagtcatgaaggattggaaatcctgcccaacacagagatctgtcagcagagagatggactgcaaccccagtgacacaggcagctggagcaaagtgtgtgtgtgcacacatgcgcccccgaggggtgtgcggggaggttaacttcagagccttgtttccgagagggtgtgtgtggtggtgcaggtgggatgagaagatttcgacacttttcctttatgaagtagaactgtggatgttgtgtctttttgttggtaagttcaggcacatttggtttagaaggctgtgcttactttccgttttccccggaatttttctgataccaataggggtccccatctgcaaatcaaatgaatccaagttatgagagcaaaatactactgctgaactgctgatgttggtggcaccaggcaagggacaagcggaagcaggggggcccttatttatcttttatgctggaaaggcttgttcttcctggctggaaatctgcttttcgtcaatgaaagaaattccaagggaattgtttgaaaaaacaagcacaaggctggaactgctgtttcccacttgggcttgagatccgaacagcgctacgttttacagttttgaaatctgttactgttattatgcagaatagatcatctttgttgtaattatccttgagatcacaaatgccgtatggtgttctattgtctttctgggaagttatgaaatagatttgaggcgaaaagtaaacataagcgataagagtcaaacctcattgggtcactgtcagccatttggacagaagccctaaatggcccagaggcacagccatttagaactcttttcttttttttttttttttcagtagaatattttgacccccagaggtatgcgtagctatatcggggatccaaaggtttcacacaggatgagtcctgtgtctacatgcagcgtagcaggagctgggaatggaagcaaaccaatattccagcatctgcttctagaacagtgatcaggatcgctatcgttaataagatgggtgtatgtgggacccaagactcatctgtcaagcccttcttctgactgcttttaaggtaatatttttaaaaaacaagaaattacaataagcttttttttttcaaatgagtcttcttgtcctattcctttattattttgccacctacctttgtcatcggtggaattgtacttcatctatttcagctttacttatcctgctagttttacttctaggagcttaacgtagggtactggtaattctagaactggttcctgaaaaatggtacatgtagctttaaactattatcaccactgttgctgctgctattactattactacttctacttgagtgctatatatttaaacatttattctttctatgtaggcaagcccttgcaaccagatatttctttccaaagccctggggtctatttgttagctttaagattctttattttagtttatcattttgtgagactaagaatattttaaagcagttcagctgtaatgaaaacattttctttttgaccctgggttctgagtttgacatgttttgaccctatcattctaaccatgatttaaattctgaatttccagaagccttattaaagatgtcaatttgtgcaccagaatggtaaatgttcctgtgaactttgactcctaaaggaaactctattttaaaagaataaaagattttcctgataaatatgttcctcattttgggctaatactttcagtctgaactggggaatggggcagggagagaccattgcctgaccctacttgctccctcattctgtaatccaaagctattttacaacccacagcattcgatttttattttgccaagaacacgttggtaatgggatgtaaatctcccggtgcacacctgattaaacaggcctgtatacgtgaattaaaaaagagggtgagccccttgccatcacggggtgacagggaagcacgccagataaccggagctcagttggctgaagggagctcggtggctgtttttattaacttgagagctaaggtcatgcggcttcttggggccttggtgaggaaatgtaagtgagaggtctttccctggctgcagatctcctcattctgatgtgcaaggatgctcctggaagtggtctggcccccacccgcctgactctggtcacaatggccactgtcaggcaccaaggcacgtaccactgaggctggggacagctgagtgttagcataacattttattttattttattttattttattttattttattttattttattttattttatttattaatgtactgatttttgacctggggtcttgctccatcatccagtctggagtgcagtggtgcaatcatagctcactgcagcctcaaactcctaggcttgagccttcttctgcctccgccttcccagtagctgggactagggactacaggcgcacaccatcacacttagctaatttttaaactttttttaggaatggggtcttactgtgttgcccaggctggtctcgaactcctggactcaagcgttccactcaccttggcctcccaaagagctgtgattgcaggtgtgcaccaccgcatccggcccacagttactcattctgctgacctctgttgctgctctcctgagtatattccggctttgtagtcaggacatcagatactagcatttgtcaataaaaagtgtcaaatgatgtgaacttcctcagtcttaccaccaaaccctacttttcagcgagagtgcttgcagagagaaatttcttctagagggtttggcttgccttgtcactttctggttctccctgtcttcaccagatcaaactattcgcagagaaaaccgggccacctcttggacctttctgggaatggaaaaattattttggtgataagatgtttccagcccactgttagggatcatggcactgtgcccatcaacacttggtattaccccagcctccttggagtcctcgtccccatctccctctgacctgagtaactttgaggaactttagtatatttggaacccgtatgccagcagcactgttggaagctatcaggaggacacctggtaactaactaacttactagctaacttactaacttatacagctcaactaacttatacagcagagctgtttagactagccacttttgcacacagtacttctcttgatcctcctaacccagtgagatgaatgaggtagatattattggtcccgccttgccttggggacactagcatctgaggagttaccactactagtgagtgttgggaccgggattccccatagcatttttgctgtcccaggagactttcatatgcattgttttcctgggtccttacggtagtccatgcagtaggtgagacaggtgatgaagttttggtctgcaaatggggatgctgaaactcagagaggctgactggctttcttggggacatggcagctgacaagtgacacaactggaaacgtatcccagcccttccaacttttagaccgacaccctttcattacacgaggactaactccacaattatgaaaatctcaaaaacaaagctactctgaagtctctatatagctttgcccttcatatgattccaaattcccatgccagtgaagctgcagttccggggaaaatcccgtgaaaggaaagtcttctttggctagctattcagaccaggccagggagggcttagcagtgtgccctacacccagcgcatgtgctcaccagcccattggtattgaaggtgctaacagtctggactcagatcctggcactgcccaccatttgctgactcatgtcccaggcatttgcaaagtgtatgggctgtcatacagaaatagagtggatgtttggaagaagagtatcaggtgtagctcaggaccagtaggaaaggtgtccctgccagtggggacagagagcaaaagcaacgggacaaacattgaaggcacaatactgcactgtagaggcctcccatctctgcagccccagcttggatcacaagggaagttactgcacagccaagtatgctgcatttgcaaaggtcaggctttaattacatgcacagttaaatggaaatactgtagagaggtcacactcatatttctttggctttcattaatgttattgctctgtcactttccctctccttaggtttgtaaatgaaagttcctttagtacatttaaaagcattatttatttttaattgtcttacctctggagggagaggttacttctttttggggtgtttttggttgttgttgttttttttttgttttctttttttgaatagacttaaaaaaaaaaactttgcctatgcatttctggttaatttatttcaaaccttttgctttttatagtcttatctactaatacttttgattaaaacacaagcaaaaaccagccaacatgaacaggttgaatgccacatctgtgcagaagatagcagctcacttatttatggctcagagaaatggagcctaaattaagctagctattgctggagagtggataagcggccattatgaattatccttaattatagcgatttcctaaactaataaacctgctaaatctttattgcaaaggttagtttacgcagtgcatataaaatccgcatgtgctccgcatcagccaccagctgtctgacagtgtgttgctattgcagtgagtgttcacataaattttatgttggttatattaacagtccgtccatatcactacccacagatgccagtagacataaaaattgctctctagtgagcctaaatatccctagaagctagttgtgtctaatgttccatgtagtatttgaacgtgaaagcaccagattggagggttatttacagatgaatatttcaatccacttagttcatataggcctacttagccttctttgctggtttatttgtatgctaaataattcaccaaaggttcttgtttactttctatagtagtttctatgaaatgcaaacaagggagccaagttgaggtgttcaaaaggctaagcagctctgtgtttaaatgcaggtcagagcagcaaatgcagtcttactgacgggctgtcactcagttttacacattcctctctcctctgtctttttttttttcttcctcctccagatataactggggcttgctgctttcataggaatttttggttggactatcttctaaatttgtctttttcaatacctgcctgtgtgctaccttcagcttgcacaattaaccacccaatgccagcagcaaagaacacatccctggctttgagaagcttccccacggtcctctgggctaacaagaacaggtcaatcctcagctcttgaaatgtccttgttgtcttcctttttttcctttctcattttcttatttttcttttctttttctttcatttctctcccatggttttttctagtgcatttccagatctcaagatttgaaaggacagcaaataggacttttttccttgagagccctgagctcgcccagcctctgtcaacctgaaagccagaagggcaaagtctagctctaaaaaatgcagccttgagaagcccttagaatatatgttcacccaggggtgagaaggatcattgttttctggcaaggtaacagttacctggccctattgttcacatgtccccatggctgaggttatgaatgaaaaatacctatctgcccccacattttgcaaaggtttacgatcctaaacatttgcccccaaagagatgggaaaatagcctcctccattttcagccaggcactgccaagatcatgggcgagttcaatagcagtgctaactttttatttaataatattgattttatcatttttactacttacaatggggattggtcggctgatagttatttgacctccctttgtgcatggctgtggagtgcttcgttaaggctattgacatatatctctcttccccactcttcttccagcagcccatctcggcaaataatattgagatgcggtaactgttccctgatattgatttcagattgtgttcatcacacccttctcggggccaggcagagagcagcagccccagttctgcaaatccttgatggctgcaggctgaagtatcgtttccatctttcaagcaagaatatcaaccatatatatttccaaaacattacccaagaaaacgaaagcattttttgatcatgattatttttttacacatacataattaaactgatcgctccagttttatgttgggctttttctgcacttttctttttaaggaatgctagaagatccatgggtccctgagctggtagaaggaactctgattacatttttaagcttcagggattcaggatttggcacactcggccagacccagggcctcgttgaccttcagttctcagccagctggggccgtctgcaccacctgggcctaaaaagttccatgtttggcccctgtggagtcagttgagatggcagggtatttaaaagaaccagaggtttaacattcagggagagcctacctaatctagtgattacaatcagacgtaggaaggacatgatgcagagtttaggtttgcatatttatttaaaacaccaaacaccaagcaaatactaataatattggaaattatacgttccatggggaaaaacaaaaaggcaatagagaatctataccaagagtgattatatctgagcagtagaattgcaggttatttatattttttctctttgggcatttctatgttttcttaattttcttttgtaattagaaaaaaagaagcctattcataagtattatttttttttaatggaaagattagttggattggagctccagaagatccctgtccaccaaagtgaatgcattagccagggttgaaattgactcactggccatgctaatctctgccccaagggaagtgggacagacatcactcctatcattgtgcacctgccagttttcattttgtaaatccagtgggggttgtgctagcccttgccgctgaagcagacatacaaaatggttaggaagaagggccatggagtcagataagcctgggtttgattattggttctttctcttgccagctatgactttgagcaggttacttaactttctctatgccttggttttttcatctggaaagtggatttttgacaacccatctcatttaacaggttatctcattaaatgagatagtgtatagtaagctcttaacctagtgcctggcatctagtaagcaatcaatacgtgttaattatcattactggcatcgggcatctgtagagcaatttcctcttcaaactagactcataatgagaattagcctaaacacagtctgcagaatggtcatttttttctccttaagcacaaatgagactcagttgagatctgccccagtgtctaatacatataagattttctaggacatcctgattttatatagcattctttgattaaaggcaattcattttaaaatgtatatctaaatggaaattttttgaagattttaaaataaataaatatatgtatgtatcaggagaaaaccttagaggtctttattcacgattctgaacatatgatcaccatactgatagctctttgacatagaaggtgctcctccccacaccttctatccaaagcaagtattattccagaaaaatactggaaacctatcaggaatctttagaatatcgtccatttttttagagtcagttttgctattctcatgcgtttcttacttatagggtcaaaaacactttctaataccacggatggcatggaattcttccctgcaggcagccatcttcaagactgaaagcagaatttaaaaagcagctaaattagagactttacacagttgctggatcctgcttaatgagagacagcgaacattttgcaggctactgaacttctgaaatgtgacaatccaagcaaatgaaatcatggtacctttcattgtagtttaattggactcaaactcggcaagaggggctgctgaaagctgtattcaaagagacagacaggaattgtacaacaactaattcagcccacacaacacatcttacaactgtccaagctccacacttgctctcaagactgactcttttggtcaagagagagatagacctgcagtgaacaaaagcacagattgtaaggcaggccaaatactggcattgggaatggcatagctgtcaccccaagttatgcatttgaaatagctcagtctcatggcagccagtacaggccaatttattttaaagaggaaaagagaagtgaaacaaacttaggccctctcttctgcctgttagggtgtcaagatatcagtgtcaaggagtccagttaacagaagggtgaggatgagttgagcataaacactaacaagagaagaacttagcacaggcctcctgttgagtggagctaaatggcagtcccagttgagtaacccaaaaagcagagaattaccgtagctgtcaggagtgggaccaaaatcctgtcaggcagcggtaaaggggatgggaacggtttgagggaaaggcgagttttgtgggggagtgaggtcaagaagtagactgttttagggcatgcatgtctgaacttaggaggcccttggactgtttaggagggtgtcttggcttccttgttttgttcttgtatcatttgagctctgtggcctgaaactgattatatcatctcagccccttctggtgtaaccatcccgcctgaccacttgagtccacgtttactgttattatggctgtaggtttagccagtaaggctaaaagagtggacaaattgggtgcctgcatgtaacaggccatcctggacattgatttttgaaggttcattagataaatgctgacatcacagattgatgtctctttaaaccagtacctagtgcaggaccgtctggggaatcaaaaatattgatgtaaacatgtttgagtagaaggcccactggagaattccactgcctaaatgggatccatcaatttaggctttctttaattattctaattctatgcatcacatcaataggggagtttgtctgcagaaccggtttttatagggggtgccgcccctacgttaggggcaaaggaaggccggacaaggtatccacatctatttttcattgttgttttgagttgctgtttagtaattaaaatttttgatcatagactaattttcccataccatgtggccgtgcgattgacaagggactgattaatgggctgaccccagggccaggaggctgctgggctcttctcttgtggaaggcatgccggcaaaataaagttgatggttttgtttgtgtttaacccttcaccttggcactatcaatagattgaagacatcatttgtatctgcaagtgtttctttaattaagacctcctaaaaatctttcctattgattcattccattatcctattgattaactgcagtggatcatgtacttggtcttcagtggaaggcaacagcctcagccgtctgtcatgactacagatgcagaccacaggcagccagcagccagcgcccagggctggcaggagtgtctcgcgttctaatgaggcatcagcggtggctcactgaacaccacagagaaagccagttgtctcctgctgaaggggtggccaagcataaagcattccttccagttatttatactgcagccacttagctaacagtatgtacggggctactggcagtcttgagctgggggaggggaaggattctgctgtgcatctgaatttgaaaatcttgagctttgaaataaaagcagactctgaaatctaggtgcaaggcatggttcaaaggctgactgttcgtgttcctttccccaggctgtagttttgtgccccgccccatcctcacactgtcccccatcctatcagcctcctcactaggatggctaactaggaagtaccacagggggcttccgttttggaaggagcttccctctgactcggtcagaaagaagggctggcccttgtttttaccatctgccactggacatacatctaaatcatcccctgctattaaaaaatgaagaaacctgtggctggactagttcttaaacttcatgttttgcaatattccttaacattgacagttacaaagaattattctggttggagtttaaagagagaaggaccttattaggctgtagttgggtattctgggatatgcgaaatcaagtgagttaaaacactaggcacatagtaggttctcaatcaataaaccaataattgttgatccaccaaaaattcacctttcttcctctcctacgtgtcctgttgcgtccctattcaagcattctctgcctccccatccatcaagtagactcaagaaaatggccttctcaagggatgggacacctttcttcccaaatggaatccaacaggaaagagaaaatatagaagtgagggtaccaggcaggaggcagattaagttcagagaatctgatgtctctcttctctgactctttagtaggcaaattaattaagttttacttttggagtgaaaaattctaagactttgaaacatctctcctcagcaagtttataatggtcttcatcttcaggatcaggcttggcgtgggttttcaggaacgtgtgtggccctgagttaaagtcagtggcttttttaaaatagtccccgagaaaggaaggcagaaagtcccacctcccccatgtgtattttgggattaggaaagctagtggttactgggaggagctctctctcttctctctctctctctcccctttttttttttgaggagggaggtagagactgtctcaatgtgttgttctcaaactcctagcctcaagctctcctcccacctcagcctcccaaagtgttgggattacaagcatgtgcattgcacccagcccaggaactcttctttctaatatgagtatttatagaatactcatgtacagaattttcattctatagatttaaagaataaaaatttatagaatactcatttatagactcccatctatagaatattaaaatcaaaattgagtgcaaattcagggccgatttgtgtttcttctatcagcagttgttaacaaccaattgtttgcaccaaacccaagggcttgatttcccttggcactaaatgttatgttttgggtgtcttatagtctgtcctgtgagttaacattgtacaataaactgttttatcaggacttgctgatcatcctgcctgctagttctaccctcgaaaactgttttttttaatgcttatttcaatacttctgtgaaatttgacgttatgaagatatccccaaactcttctccaaaaaaaaaagcagaaatttacttatatctaaggttacttttcctaagccaagtgattcagaaacttttaggaaataattttgaggctaaatatttctgggtttgcttttttaattaacatgttttaaattagcatgtaatctgtcttcattaaagacatgttttgaaaattcagagaagtataaaacagaaaggaaaagtctcctgtaagcctaccaccttgggtaccactaggaatatttgagcctgttgcctcccagtctgtttttaatgcatatatacttgtatatatactttttaaagcaatattaggatcataatattttataacttttgcctcttttcacttactatatcataagcaggttttcttatctttaaatattccttgggaacatgattattaagggaaactagaattcccttgtatggatatgccataatttatttaacttttctcctatcattagacatttaggttgtttcctatttttttccctatcatataaaatgctgggatgaatatccttgtctaaaaattttgtgtgaatctttatcacctaaggatagattcctagaaattgaattaccgagccaaggattcacacatttttaaggctctaccacatactgcaaaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattcttttgataatgaatgaggtagcagtattttcttatatttaaaggctatttctatttcttcgtttgtgaaatacttgttcatgtcgtttgcccattttgggggaatgcttggctttttctaattgattcaaatatttttttctttttaattaagaattgtggccctttttcatagaagatcagattagattgttagagatcattagattggatttttcatgtagacatgaagttatacttggaatatctgttggtaatggcaatattattaacgtactttttacttttaaaaatggtttgttcgcctctgataaaaaagatatatgaaaaagaatctgacagtgtcaatccagctctcgttaactatcccaggacgctaccagcattttattacagttgtcaagaaaaaagaaaaccaacaattttattgttttgattattgagatccagccacagatcaactgagcaattaaaatctctaaataacgttctctgaattgtcaaacaaaggattagttcccggtggaaaggacttttctaaaagatgatagttttctctgtaatgtctgtgccagtaaatggttgcactaattggagtatacagaaatattttactagtttaacaatgcatgacatcctaataagattgtgatgacaagcttttctttttatgaaaggtgatgtcaccgcatgcttctaatatacatggactcatgtgtctttttgtgacatgctataaatgaaatttttcgatgaaattaatctgttttactaaatctttactgtatgtgaaattatttctttaagcagggcaacagagtcttgatgcttgtttttatttatagttcttagaataatatattttaaggaatcttagagttgagtagaaaggatcacaattaaatgcatattaaaatgcttgtcccaaatcccatgaatctgtcactagaatatgcgaggccggattccccatcttcccctagctcaggtggctagccgagtgcaggcttgggacggttaatgacaatcctccaagacaagcaggacttaacatcaatatccctcttcctgataatctgtatactctagaggtggtgagctctggcagggttttgatgattttatgatggcttgtgtatatttatagtgtgtttaaaatactctttttagttatcatttgagtgacacaacttaatctttcgatctttacctgcacctcctggtgatgtgtgtttgttaggtaactaaaaagaggaaattaagcaaagccagagctttatgccagcagtaggactgaggagtcaatagatgattaacctgcctttctcctcttcatgagaataaaggagtcactttttcagagcagcaccctagaaacatataatagctatgcagaaatgggcaacatttgagttccacaaagcaagtatacagggaaaagaatagcaggaaatcatttgaatgctgttctttaaacacactgatctatacccccgttgaaactgtctgtgacagtcagtgtcttttgcgttttatatacacatatgtgtttgtatgtatatgcatatatatgtgtatacatatatgccatatatgtatatattatgtacatataaattatgtgggtgtaagcagcatacgtgattggatgctgatattttgttagattttagggacttaaataaacaggatataatcataatcttagtctatcaaagccacaccttaaatgcatccctgtatcatttcatttgaaaaggcatgaaaggccagggtaattagtccttactgcagatgagtaaaggcatctgtgttaataatggatgcttaggattttgaattaaatattgaacctctggcttgcttttcccaaacgatgaggcataaccaccactctttttgaaagctcttattttttatattatgggtcaaaattttaagcaaaagctgaggaaaacaacttcagttaatcggcctatgtgattatttgacatatgtgattaactgactgaggtaaggagcgtcattattatatcataatcatcattatatataaaggaactccaggctaagactgccctcaaagaaatcttaaaaatcatggattgatttgcagatttagtgggatatgaaaagctgatgttgtgcctgaataagataagcattctttattagattgtagtggagaaagccctcacgtggccatgtgattttattgacagctcagaaccaaagaccataaattctgtcaggcaatatactgtcctaggaaatggacatcacagatgccaaagcggcctttgggggcccagtaaacgctgtgtggagtcaagtgaagaattaagccccagaccaagcccagtacctgcatggttatattttttagctggtattggtgaggcttggctgtcgtttgtaacacatccgtgcccctggagcagcttttctctgacatcacctgtgagtcacagtaaaggcccagtagtcatcctgaagccgcctcccccaccaagctactaacatcaaaatgatgtttctcatatgattgccaccttaagacacgggcagcggtaggacaatgtgaagtttgtgcccaaagttcagccagacaggaaaggaagcttcctgagtcccctcagtcaggcaggcaagtgttcatgttcagagaaatcatcaaatgcagagaggaaagaatggtgagctgaaacaatcagatggcaggggggcaggtcagggtggggagctgagtcagaaggaagaggtaggcaaggcctggaggccagaatggcaggcagtcggatcaagaatccagattagtggatttgggaagagaagatcagagactcagaaggggtcaggaacccggaccagagtgacttaaccataaaaagtagaaatctggttaagaggtgggcccttaagagagtgacataccaaggatggggcagtgggggcagtccattttagctccccggccccacccccatccatgctggtgacaagggggtgcactgtctgtcgaaaaacttccaaacaataataaaactaagagtcagtctgctttttattatcccctttcaccatcagttgtgatcaatgtaaaaatccttcctaacaaaatcttccgttggtctaaattctaaacagtgttcaaagttacatctaaagtttacatatacaaatacacatatatgtatatgtaaacttatatacaaatacacatatatgtatatgtaaacttataaacttagtaaaggatatgttactaaaatgtgctaatttgaagtgtgtgtgtgtaaatatatatattatttagtaaaatagtatataattatatataatattctaaatatatattagtaaaataataaatataatatttataatatacataaattataaatatatatttgcacacacacacttcaaattagcacattttagtaacatatcccttactaaatactgtgttcttcatggatgcagagttctcagttacacagtcagctgctgacacacacacagtcagctacacatgctcgtttctggagtcaattcattaccatttggattgttttgagtgcacttcagatagagtttgtgtctccagtgactgtagtgccacatctttctgcatctgaacagtagattcaaaatcaatagtgattaagatgaagaaacaacatttggggtatttcagctctttcctaccatgtgagcacttgaagtttttctttttgtttaaactctaaaacagaaaggccaggtatggtggttcacgcctggtgggtcacttgaggccagaagtttgagaccagcctcagcaacatggcaaaaccctgtctctactaaaaatacaaaaaataaaatttaaaaatttaaaaaaatctaaaacagagaaacagtttataaactactcagtgtaatattttcatttggtaaatgaacatgttcttctctacataaaatatttagctgaatttcaataatgtttttaagttgaaatttatttttcaatagttaagaaaattgttttttaacaattaatttgattgttaaaactaaataataaattttagaaaacattattactgactattatgtgacagttattgggaataatttgttataaaagacagataggtaaaaaataatctgcttcaactgtcagatatgctaggtacgcccttagagatggggtagtatttatgaagatctagtgagttcagtgcctgctgacataatcagtggtaataaggtaatacaagcacaggatggccaaaccaagaatgaagcttgattctgagctttatgaactggcatcgtcctacgttttctgggtctgaactggcctcaaagtgaagccagggctgaagccacagaagaaaatacataagtaaattttactagagttagggaatagaaacaaacgacgaacagacttactgttgatggcagccactagaagaaaaacacatagatgctacccaagtaattgctgcgggattgggaaacgcatgagactatggtaaagcagctccaaggccctgaactaaaactgcaggaagtgcaatagagaggcaacccacggggtgaggggccacactaaatgggcaggctctattatagcccaatagaccgaataggacctggtgataaataggaacgaagcaggccgcacagagagagcctggacgagtttcaaactggaacgtgtatgtcctatctaaggaggcagtcgcgactcggctctggccagttaccgtcatggcagagtattggcccagataagcagatcttcccatttttcaagcagagtcaaaaatctggactttttattaagatctctatttatttttctcttctttttaggaactaattcacattttttaaatattgcaagagtcattactatttaggccaaaataaatacctgtagatttaatgtagcccctgagccaccattttgtctcctctgagccagagccttaacctgttccagttgaatctgttggtcgctctccataccagtcataagatagttttcatgctttaggctattaggtttaataatcataagaagagtaggccaggcatggtggctcacgtctgtaatcccagcactttgggaggctgaaacaggaggattgcttgaggccaggcattcaagaccagcctggttaacaaagcaagaccctgtctctaaaaaaagcaaagaaaagtagaagcattcctgaatattacagacagtaacagaatggctatcacaacagtcacagcttgcagacaccaagctcctcagaaaatattctactaataataatagttgtcattgggctagtcactgagtgccaggcattgtgctatacattttgcattcacgatctcgttgagtccttacagtagctctatgaaatggatacttgtgtctgcatttacagataaagaaacttagcaaagttttataattttcccacgttcagttgtacagtcaggacttcaatcaaagcctctcttgaactgagcctaaattgccgatggtgaggggactctgttagctaaactgaggaaccacaggcagggtggccttgaatttcaggctgaaggacccatcacccaagagtcttggcagcttcctcagcaaagatgaatgggcttgttaggtggtttttgttacctgatcagtaattgtttcaacactagagtttgtcgttactgttgtcctgttatgaagaattctctttaacaaaactcatgggaaaagggactgactcatgtgcagtttggcctgaagcatttgcgtcagtattctgctcctggaagagtatactttgacttatgcattgcttgcttaatagaccacaaaagtcaacatccctctggaagaacagctcgtgcttggaggcgtcacaagctccaaaagatcctgttaaggcaggatgtagtgtgaaacccacaagcgaagcaaaaccccgtgtcccctaattataatgttaatatttaagaaagcttcagaggctgcctctgtgctttatgcctaaaaaggagttgggattttttttcccccttttgcttttcagacctggaatcgcatcaatattttttttcaacaaaagaatgtgtctcttgtccccaggtatggcaagggtacaaagaagccaacttgtagaggggagagagaagaggtaactgacagagtcagagcacgttggaaagtgatacgagaacaggggcttatggttacagccctaccccctttccaaagaaggcgattagatattatttcagatagtttctcactgtgtcctaatttcattttccagcaaccctgtggcaggtccccagtttttcttggacttatgtgattagctaaactagccatgcaggtattggcattacactcacagatatgaaatccagcctgacacccaatcaggacacattcttgagtggctgtgtggccccagagtctcccactgtcttccacttatgcacagtgtatctaaatagacactggccatgttcagtccaccctaaacccttgtgtcaatagccaaagaggaatcagatttgaagccaaaataacaagcactatatataaattactaaacgcccccaaacactatggcattgtttggagatagggcatgtgtaggaatagtaggaggcacctaatcagaaattcaaaatgaacagcctcaccgaacagatgggcagagtctatggactttccttccttcaggagaggatgggccattatttaaatttatatacagtggaagccactagaaccccattctgatgattaaatctggatgatcataatatccagatgcattaaacaatgaccttctcaaatcataacggaacagagatgtcacgtggctctggccaaggacgtaagtgagttcgttcaacaggcattttagttctggtgccaggtcattggggacagagcagagatacagcctgattttcctcagcatctaccgccccgtcagacagggggcaataattcttctcccttagttaaactctgccccacaccctgtttatctgaaaaattactccagtcagattctcctacttaaatattcatgaagatgttatgaggactatatgatgtcaagtaaagggacatggcttttgtgaaattctatttaaactgttgaaatgagggtggtgtcactctctccaaactttccagttccctccaataaacctgtagaaagcagaccaccagatgtttcaaacagtttggatcccaattccacttgattcttgctccagaagctgagaacttaggagcaacttcctgtggaaaccaacattcccaccaataccaaagttttataatatgtagaaaacatgacctctaagaaatgcatgtcaagtgcagcctggggcttggggtgtccagtccagaaatctgcctttggttaaggtattagaagattagggagttactcaaattgtccttaacattgttttcatatgtgttatgggccacgcatgctccatgacttttataacttatgtactctcatagacctacaggagagtccttcttccacctcagggtttgctgatagcctagatggtagaattgcagtaaggttaaacagatgtagggcctcatattgcttctcatacaattttaagaatccttaaagtcagttttcatggtaagcaaactttaatttaaaaactttgagataggagggatcattcttcattcagttcatccaggttcaaggactccttttggttgcaactgacccgccatgctgcttcagaagaaaccctttaaaaacaaacttcctgagaagagaaaagggttacaatttaggagctttttaagaattacctttgggtttttccaagctctcctcttgagtagaaaacaggacatgtcacagatatatattttcttaattgtaaaaagtaaatactctaaaatgtatttttttcattgtgattatgttacagtggtttctatgtaccatagattagatttttattaagggttttattaaataactggtgtttcaccaacatctaattaaatcttctatctaaattgaacagaaaattatggggggaaaagaaagcatttgtagcagactttattacagataagactattatttgttcatcttaagaatttgagatcaaatttacaagcagcatcctcatcgaatttcttttctgggctgctgagccctggccccttgaaagcagcccattatctcctcacctccccccattttattatagtgtcctggttgttggcaacacgcccgctgtttaaggttactttcattaattaaccgaaagttaatttctttgcaagcaaaatctctgatctcattatgttgtctttaaagccgaaagcttcaggttttctggtctcctttgatgacacaataaaaagcatgctctttatcttaagggaaactgtctccagggtttcatttaatagtccttgaaatagttacagcacagccaggcagactacaataatatgccagttttagaaaaccttggctttgtcatggttagagagcccagtgactgatgtgagctacggtggatccatttccgaagaagttctgcactttgcctcgagtcccatttttacacacgacaccgccctccctaccgccattatggagcctatttgagaacagaccaacaccaacaccagcatccttccaaagtgcaccactgcccagccattttactctctgggattttggaaagtttgcgggggctggcattttgtctgtttgcctttactaagctatcttttgttcctctggtggaagcaaggcaacattgggtggtaccaagagtttggggtagtgcttttggagcctggcaggcctggatttgaatcccagcctttccatgtacaggttaagcatccctaatccaaaatctgaaatccgaaatgctccaaaatccaaaactttttgagcaccagcatgatgctgaaaggaaatgcccattggagcatttcagattttggattttgaattagtgatgctcagccagtgagtataatgcaaatattcccaaatctgaaaaagtctgaagtctgaaactcttcttgtcccaagcatttcagagaagggatattcaacctgtactggctctctgtccttgaacgtgttatttaacccttctgagcttcagtttcctcattagtaaactttaaatgattatgtaaagagaattaaatgagataaaacaaagtagcaggtacttgacaaatgttactccccttcctttgacagtcctgttctagtcttttccaaggacaaatgtgtttctagagatggagttcatcctgatatttgggggctggcctacgtacagattgctataccagaaggagcagtttgggggagacagtcagattccacagagcatgttttggtgtggattggatgagttaggttctgtattgccccacatgaccttttacagacatggggacttaaacagtgtattttctttgtctctctgcgttagcttcatcttcagtgatgaaatcttgttgcttcctgaagcattaaattcagtgagttgagagtggccaaaatgtcttttcagagccaccaggtgtaggtcacacagaggggacagaactcttcaggtggctcaagtctcaggagcaatctagatacagggagaagccatttgtatcccactgagtcctgtgatgctgcacacacacagctgagatttacagaggccgggcggggagggctgctgagagggggtaatggcatgacctgccatgctgcttcagatgcctgggagactgggtctgtgccatttgcatatgtcctctgtacccattcctgatgaaggatgcaattgactcaactcaagcaggtcaaaatcacttaggcagaaaatcccaggccttgggaagaaaagtcatgtgcctcttgggcccttggcagaagtcaaaggtccaaggtaatgtattggcaaagatcctgtctgctttggtgccttacttactgctccctaatgcttttaggtggaaatattgtcaacgctattgattagttgatctgataatccagcaggctccctgatgtgttaaatttcctacttttggaggactataagtatgggcagagtgtatacttctgtaggaaagaactctcagtggaccttgctaagacactgcttctacagcgagattgctacaggcatgacaattccaattattcttttggctgtgacatttaacccttcccaagacaaattttctatagttatccattttttccagccttcctttagattttggaaaaacactttgtcttctgcattgggcctgtagggtctcttgatttattagcatggtttacctgtacgtttttagatttttattttttagtttattatgagtacattccattatctagatctttccctccttcacatgccctccatggccaaaatcatatttgcctttctccttgtcttttaccatctttaaacattccatcagccatgtccctcatttttaaagtatatagcaacttcatgaaggatatataattcataatgtgtagatatcaaaagaaaaggtgaccttaggccaaggcagtggaattttctgtaagtaaggagcatagagatgatatataaacatagtgatgacaaataagcattgaagtttgtttgcagattgtttgtttagagcttggtctggaatagcaagaaacctacataccctccgactcgtctcgctgtagttgttggttattcaccgcaccctctctctggcttcagtctccaagcccttcagccttgttgaaagggtctagaggtacccttgcacatccaaaggccacttggacaaatgatgccttcagcttttggggtccacagtgccatttcttctacatcccagcttactatgcttgacttcagttatattccccagtaccaagaacgcaggaggactactttaatcccctttgcaaaataacaacaacaataaggcctccaggcagagcacattgagcctaattcagattttttttaaagtggaaaacaaatcataaatacctgagaaatcaggttcataatggaagccccacgaaaccccttaacctgggcaaaatcctataacacaattatataaaatttcacacctgactgaagctgttattggaacaaaaataaccatttttctgctcgtgctaaatgaaccacaagacccatgtatccagccacagaaaaacacaagattgcccattccatctgcatataatcagcatacttgctggcaagggcactgcaggatcaaaagagttaataattggatcctgcccacagcaaccacacaattaaggacaagattagcagagatgaggaatttatggtgaaaatgcaatgatagtctgaaaaacaaaatgatttcaccgagcagttgttctgttgccataatcctaatgatcaactctattacaccaataataggagaaaaactaattgcagtgaggacaggacaaatctttttaaatctgcattgtcttcccaactaagtcccaacccatttgtattaacctttgctgacagagtcacatgatggacataatttcttataatttaccagctatggatctaacctttcttcatcaaatattcataaaggcaggattctcaatgattttctgtctctcttcaatttagagcttgttgtcttctttcttacagtaatttggacacaattgaagtcaaatggaattaaagttaaatgcctttagcaactgaggtgcctaaaagcaaacacttaggggaggggtcgtgaactgaacggggagagcttgtattcccaagaccctccacgtcccaaaggagttcagtgggctgccggcccccataaggaaaaagcaaactcagccagagaatgagatgccattgctttctcttggacttgcttgggcctcttgtgctgggtgctctgtagctgagttaaaactgagagcccaaggccttcccctgtcttcaaggcttgccaggaacttaggctgccatgaccaggccctgtttgagcatgtgtgcccagcagggtgcaaggaacatgccaggggctagaatagtggacaagaaaagttggttggtacagttacttagaaaacaagcgtgaacacctaaaaccattcctgaaagcgtttttggtttctagaaaaacatctgtttccactttgcatctttgttgctttgacacttttcttaacagggatgtagataggaaaaagtcttctaaagcttagatgtttaaaataagtatagtaaatggtcctttactcttcccgtcgcaaggcttcagttttactgggatggcagaagtttggggaaggtgagatagacaatcaaaagaactccctttttctactccaatcctcagacagccctacctttactacaatggcaaggaatgttgtaaattctccctcaagatgcaaaggaggccaagcacagtggctcacacctgtaatcccggcattttgggaggccagagaggaaagatcactgaaccaacaagttcgagaccagcctggaaaacatagcaagaccccatctctacaaaaaatttaaaaattagctggatgtggtggcatgctcctgtagtcctagctactcaggaggctgaggcaggaggattgcttgagccctggagttcacagtgagctatgatcacgccactgcactccagcctgggaaaccgagtgagaccctatctctaaaaagacaaagaaatttacaaaaacaagatgcaaagaaattgtttcacctagttgacttcaaagtactgtattgaccaagccaagaatttacttcttgctaagttcccagaattttattagaaaggaaatgagaattgaaggcagttgtaatctttaacagctgattcatgtctgcagctaaggtatttagttctagtcaccaccatttttagcatctttatcaatttttaactgtacaagtaatgcacaatacattcactttgtaaaaattaaaactttatagataagggtaaagtcttttgaccactgcttccaaacatagaccttcttgcccttccaaatattcttctatgcatttacagacatacatgtatccaacgacaaacatatgttttccttatttgttttacataagtggttattatgccatacaaatcaatacccacattgcgtttttactcaataatatgccttatgtttagaaatctttccatgttagaacatatcaatctattctttcagagaagtccatatactgtaatttagtatcattccttcagtgatggattttgcttccaggttttcagattataagcaattctgcaaaatgtcattatctggttggaactaagttcatataattgtcttaatggcatgcttaactagcttttgcaagtacagttttcttcagtatgtttctactgacctgatcattcaaaacactcttttaatgttttctaccaagccacacctccttcttgatggtaaggacaaaaacaactatgagatatttcgtattttgaatgccccacaaataaacagatattccaaatacggcagtgaattaaatgttttcaatagggggaaaatgagaatctcctgtcagaaatgcccaaggaaaggttgttatgaaaggaaaacatcattatggcaagtttcttgttacacaaattcggttatacagatcagaccatgtcccttgaactaccactgcacactgggaaaattcattcattcatagtagcgtccttccacacagtattcagttttccatttaccttgtttgctaacacccacgttataaagagttgtcactgattacataaaggatggtttgccaatcaggatatgcatacatggcctcgataaccatccttcagtccaatataaatctcttacaaatccaataggagatggcaggaagttcttttgaagaatgagaaaatttttccaggaaggtttgagggcgaattccgtgagaagtttttcaccagggatctcaggtactgtcattcctctggacaggaattgagtaggtgctgagatactcaccagttaattgcctttgggttagtggaagaagtaagtcacctagccagatcttatgcatttgcacaagtagagaatggaaacttccaatctgagtgagtttaattaaagattctagaatatttttaaaacagttcacactaattacttttagtttagggaataactcaaagttgggttaattgtgttgtcagttagtgaaaaccaacaactgacttgagaatggcagagatagggaaacagtccttccagagtgtaagagatactggatatctcatattccttcagctccaatttgtgctgttaattggctcagtctttcattctatactgagcactcatatctgcatcttataaaaagggaagttgggagacacggttaagagttaatggaaaaaacagataaattggacttcatcagaattacaaactcttatgcatcaagaatgctaccaaggtgaaaaaaatagcgtatagaatggaagaaaatattgcaaatcatataatctgataaaagtttaatgtccagagtatgtaaagagtgcctaaaactcaataacaggaagacaatctaatttttaaaatgagcgaaggatttcattagacatttctccaaagaagatatataaatggcaaataaatacatgaaaagatccttaacatcattagtcaatagagaaatgcaaatcgaaacctcaaggagagattacttcacacctactgggatggcaattaaaaaaaaaaaaagaaaagaaaataacaaggcaagcatgtggagaaatggggctcctccattattggtgggagcgcaaaatggtgcagcacctttcaaaaacagtttgatgggtcctcaaaaaaattacacatagaattaccatgtgacccagcaattccactcctagatgtatacacaaaagaattgaaagcagggactcaaacagatactgtgcatcagtgttcattgtagcattattcacagtgttctaaaggtggaaacaacccacatatccatcaacagaggaatggataaacaaaatgtgttatatgcatacagtggaatattattcagccattctaaggaatgaaattgaaacacgggccacagtatgaatgaaccttgaaaatattatgctacgtgaaataagccaaacacaaaggacaaatattgtatgatttaacttacatagaatatctagaataggcagatccatggagacaaagtagatgataggttaccaggggctgggagaagggaaatggggagtttgttgcctaacacgtacagcatttctgtttggtgtaatggcaaagttttagaaatagatagtggtgatggttgcacaacattgtaagtgtaaatgtgataattccactgaaccgtatacttaaaaatgattcaaatggcatatttttgttatatatattttgtcataaaaaaagttaatggaaccatatacagaattaaagcatgtcatcgacagttacaaaggcatccaatgaaagatctcataatatggaaaacgctatttcagttatgcattgcaatgtaacaaatcaccccgaaatgtagtgagttaaaacaaccacagtttattattcctcatctaagactccggccttctggggttgactagggctcagctggacaggtggttcttctgctgggttcactgagggtcttacccgtgactatagtcagggagcagctgggaccaaaaagctggttctgctgtgactctgagatttctgggcctctctttctccttgtagtctcagggcctctttctctccaagtggcctttccatgtgggctctccagcagggcagccatgctccttacatggcggctcaagacacctaagaatacaaaagcagaaactgccaggcttttttaaggaaatggcccagagtcacctgtgccgtgatctgttgttgaaagcaagtcacagaaagggccagtccaggttgaatgcaggagtgagtgctggaggtgtggtccgttggaggccatgtttggaggctagttaccacaaacaccatggacatatgcatggaacaagtgagagcaaaatcctcatgaaacattataggaaaccaacagataatatctaaaattaatcgatcaagaaatggtatgccggtacagtggctcacacctgtaatcccaggactttgggaggccaagacagaaggattgcttgaggccaggattcaagaccagcctgagcaacacagtgggactctgtctctacaaaaataaaataagccggaaatggtggtgaacacctgtagtcctagcaactcaggaggctgagttgggaggatcacttgagcttaggagttcaaggctgcagtgagctgtgatcacaccactgtgcactccagcctggtgacagagagagaccctgtgtcttaaaaagcaaacaaagaaatcagggtacatgcatattagttagagatacagaaggtaactaccatatgaaacaaatctgcgggttggatggatggagtggaacagtcttgctttttcgttgtgaacccttctacgtcattggatgtaaacctgtgagtgggccatgtttccatcatattataggggagtgatttggagcatgggctctggaaccagactgcctgggttcacatcttggctacctcactcacaatctttgtgaccttgggcaaattacataaccactcagtgcctcactgtttgcatctgtaaggtagggataataatcatagcaacctgatggggttactgggattattacatgagtaaagcacttacagtgccatctggcacatagtagatgctcagaaaatgttggcaattaacaattacaacattagaaaaaagaaaaagggctgggcactatagcttatgcctgtaatcccagcactttgggaagccaaggtgggaggatcccttgaggccaggagtttgggaccagcctgggcagcatagtgagacactgtctctacaaaaagtaataaaaaaacaattatctgggcatgatggcacatgcctgttgtcccagctacttggggggctgagttgggatgatcacttgagcctgagaggtcaagtctgcagtgcaccatgattgtgccactggactccagcttgggcaacagagtaagaccctgtctcaaaacaaaacaaaacattaagaggaaaagggaaaatttgcaggcaggcccatagtgaactaaggatctcaagacctggattctagtctcctgactttgacacaaatgggttgagcagtctattaaacttgcctttaaactgaggggggtaggagagaagataagaacctcccaagaacagagtctctaccaaatctgaagtctaaaagagcaagtcatggctgtccaaaattaccttgctgaaaaatgagaattccttctctttgaggaaagatctctagattctttacagttgaacctgttccttcatcctcacactgtacccaccatggagaaataattcacagacccactcgctgcctccccaaaagacctttctcctgggaaagaactttataaatcactttaagttagcaaccgtaattcccagacgcttacatgagacccactgaaaaaggacgttaacttggaaccagttaaattgcttctagtctttatttgctggcctcctgtacatctctctcttgcagaaggctattcacgtgatcaaccctaggtgagactgtaaggaagtttacctctgcttctcacccagggactgcagaggtcatgggattctcccttcttcacaccaggaagcagcaaggaagcagcatgctctatccaagaggtggcttaaactattatcctccttagaggtagttgcattgtaaaaatacctttccctcctttccccatacatttgaacaaaataaattaatggtagacttcctggcattagttgaaagccagagcaagagtgttcctggagggacaggaacactgtcctgggacccatccattcatgccacacaggcaggccacttgctgatggcacttacgcatccaaccctggccccggaacttactggcggatgcctttgggcactaggacctttgcgagtcagtctcctgctagaaagaacagtttaaattaggaatagcaagttctccaagtctcacagtctcgcccgagctaacctatcagctagcgcggcagaaaacgcataatggagcctccgtaaagtattctgtgccaactcccaggtggtctcagctgcagaactgttcttccaaaaagtgtaaattctaacttagcagtctgctgagaagcccagctccctggcaggccgggcacggggcaggaggtcacagcagctaatcaagtccttgctgtgttctcctgactcaccgccgagctctggcccagtcccagctgaccccactcctgtaatgctcagtgaggagccgaacttctccattaatcggcctgtttgcaggagctggaaaggtgacttgtaacaggcctcttgttcccagactcctctataatgacattctgcacaagcagatgtcgtcctttgattccttatgaccttctgaattttggcaaatgagaaagcatctgggatccgcagtgagggcctaagggtgtcttttctacaaagagctactgtcgtcctccaccccaccctgcctttgcccccatctctaccaggcacgtggcaaggacatggccttgcttattttccctgttggaaaaagccttcttcccagagccagggggctttgagatgaggtggcccagactgtcccatgcttgagcatttaccagacgtgactttgggtccctgtggctgtctcagtttgacagatgagaaaatgctgttgctaagggcccttcccaaggtcaccccacaagcaaacattggtgctgggagaatgagatcacccccagacagtgaaggaatgacagacccacgctttcaaagccccgaaatgtgacactccaccagcccgttgaccagagactacaagacagtaagtaataaatagataatggcctgtctctcctcttgctttctccttaaagatgcccaggtgggaaacttgtggttgtgatgattaattaataagtccgcccagttaacctgaagtttgcaggccatactgcaagcctaaggcggtctctttggcaactcatccttcttttccgaggctccagtgggctttattcagtggcggcattgctagcagcaccgcaaaaacttcagtcggaggacttcagaatttggcctgctctctattgaactacgatgttttaaaactcctttctaaccaagtcatttcagaagcaaaccttgcactgactcagaaggcctgttcagtcttccgtggctctcagcatataggattaccctccttcctcagcctgaattcacggcaccaaaaagaaaaagaacagcataaattggatgtgtgttgagttctgaagatacacatcaggtggacttgggaatccagggaggctttggcgtgattccttcttttctattccagcgcaaaggcgaacaatacatcaaagccttgaaggataaggtttacagccttccctccctcccagccccagagctggagtggcctaggacgccaccgaagaggcgtaagatattttgcttcatcaaacgaatactgtgtgtaggtagagcatagaagtttagtctcatgagatgactccattcctaagggaatctagaggctttctgcggagcaccgtgacatagatcatatcatcctcctgcttaaaaccctccggcggttccccatctcacttagagtaaaatccagtctccacagtggcttccaagagctcagacttcactgaccccatcctctccatcccctctctttgcccccttcctccagccacagttgcccccttgctgtcccctgggcatgcctaactcttttttctttcttttttggcagagacagagtctcgctatgttaccaaaggtggtttcaaactcctaagctcaagcaatcctcccactgcagcctcccaagtagctgaaactgtagacttatgccactgtgcctggctaatttatttattttttgtagagacagagtctcactctgttgcccaggctggtctagaactcctgaccttaagggagccttctgccttggcctcccaaagtgttgggattacaggcgtgagccactgcgcccagccctaatgcctaactcattctcacttacaatacccttccccaggacaagcgtccatcacaaccaccccagcctagtctcttccctcagcctctctattcactcttttttttttttcatttctctgcttgatttgctccagaacacttatctctagcagaaattatcttgatatttatttgcttacattgtgtggcaggcagagaatgttagcttttcatcctgtctcactttttgcttcttccttgaagtcttggttttgacagggaaagggagcaacgtccagctaaaatctcacacttcccagtgactaagttctaatcagtgagatccagatggagggggttacttgtcctcctttcaaagaggaggtaaggggatattatagccctctgtcttttctgctgccccccgcctgggactcagatatggtggttggagtgtcctggccccaaaggtgacttcgcagatggcagccatgtgctaaggatgacagagcagaaaggtggatggaacagcctgggttgcagacgtccatggtctgcttctgtgtgatggtccttagacttctttaatgtgaaataaaaataagctcccatctactttgaccactgttatttccagtcccccttgctagcagctgaatacagtttataaccgatacatgtgtttattacctgactttcctgctagcatgtaagcgccacaaaacctgggacttggtgtagttctctactggatctctagatcctggcacctagtaaatatttgttgaatgaatggatactaaaagcacaaaagtcacagaagtccttctgcccatatcctggctttatcagtggacacttagcaagcatcttcttgatcactgacccagcggcatagatatttatgtgggacaaagcaatgttagtttccaaatgttagctgtagaaagagtgtcattcatttcctaggtgtacaaaatgcagacttgctttggatttaaggccaggacactatgacatctttggagttcaggggcttgttaacatgacaatcctgatgctgcagtggcctggacttcttccctttctacaaaacagctgcaccaacatataattgtgctcctgtcataaaacatccataggcaaatggagcagtttattatctgtaaccttggaatgaagcggcagcttaaagactccataggttctttggcgagagtgaaatagcgcccaggaagtactggagtcaatgacacatatcgctcagaggattagaacttgcctgcaaaaatagcttttgaatcagagtttaagagtgagtggcagtaatcccaattttaccaagttcagtttagttgaaaagtgttggactagtgagtgacctaagtttcagccccaattaatatgacttgttatttatgtggttgtgtgacctggaacaatgctttcacttaagggcactaatccctttcataagggtaccaccctcatgacctaattacctcccaaaggccgaccttcagatactgtcacattagaggctaggagtttaagatatgacttttaggaggacacagacatttagtccgtaacagatgattgtcactgcttcaagtggtgtcagctgtgttgtcctagggctggaggccccaagatggactcatctgttaaggccttggcactagctgtggcctcattttcaaactgggattacacctttctttgctgccctagtagtgaggatcacatgggataatgcatatggacgtaagccatactgtttatatatataactacagtttttttagagatgggaagacctttagggattgtctaactcaagccctcattgtacagatctaagtaatgatggccagaaagtcacagttttgcccaagatcctagggtaaagtagtggcagaactgggtctttaactctcagaccagtgctctccctactataccatctggcttgttaggttgttagcttgctctttttttgttttttttttgttgttgttgttgtgttgtttttggtgacagggtctggctctgttgcccaggctggagtgcagtggtgtgattactgctcactgcaacctcgaccttctgggctcaagtgatcctcctgcctcagcctcccaagtagctggtactacagggtactattacttttacatgcccagctattacttcttcttatcactgttattaacttgctgtgtagcagggaaatcagctccctgttaaggagatacaattcagatgcaagatgctttcaatcccttgtgcactccacagtatttattgctgctaccatgtgtcaaactctgctctaggctttgaggatatagcagtgagcaaaacagacagaaatccctgccttcagagagcttagctcatgtgcgtgtgcacacacagacacacacacgcacacacaaatggcatcaagtgctacagagaaaaataggacagtgaaggaagatggggagtgctagagttgggggacagggaggggagatgtttgctgtcctgagtaaggcggtcaaggaaggtctccctgattggattaaggagtgacctgaaggggtaaggggaggaagccatgtggatattttaggggaggagtgttcaagggagaaggagcagcaggttctaatatgctgagactgctcttggccccttcagggtgagcaaataagccggtctgactggagcacagtgaacaatgggatgagtgcaaggagagggcagagaatcggggtcaggaaagggtccatcatggagggccctgtggaccactgtaagaattttgactttgactcagcttttaaatcagtttaattcatcagaagactgatatgatctttataaattagcatttttcttttgacccaccattttctccctaatcctgaatttgaactgtgtcacacagttggtattagatgctactgagttccctaccctaagtgacctgttagtgaatgtttctaaagaagagaaatccagaaagacccaggaacctcatgttccaaataaggttaaaatgaacttgtgaggtgtttcttggcatccaaaaaccaattaagcaggttacacggaagtagttctaaaaacagcagttcagtggcaggagactgacaggtgagcagatggaggaatcatcaactcaaatttatttcatagcctacaactcaaatgagcattccaaagtcagaacagctggccttttattctgtaagccattgtcccttgctttgcttatctctcaggagtatgagtggattatactcactggcagtctgtctgtcggtctttgactttgcaggggaaaatcctttgtagaaaaacaggctgtttgtgtaaatcagatttttctgtaatgtctgccgcttcctgcagattgtgaagtttctagatatggcattggccttttagcttttattttcataactgtattcgttacttacatgactgctattatttactcagaatcaagttgattctgagtgaatggaattgaaccacatagtcaaaaagcacagtcttccaatttgcaagaagaaatgttttttagaatgttgtagtgcgtttaaaaatcacagccaccttggatttctaatcagaagttattctggaatctttctgaagtttgagactgtcccatgcaaacgttacttaaatttcaagcaacagggaagtcatgagatttggaaagggttatcttttctcaatcatggtcctttgtggagttctgtggtgacagaggacagcggagagaccgtattctgtggctgaaaggagggcttgatactacccggtggggattttgttccagtaattgcatcaaattggacctgctgccatgtcgtaggtatagcatgaatatcattcattaagtcatgcacctatatgccttccctcccaatggctgagtcactagcagaatatattttcttccaaagtgtttgttttcattgttgccctttaaaaataatgagttcattctattcccttgcaaggaaagttactctagactgctttgaaattgtatatcttttgttgagcacatttctgcagtggttccatagcattgtgtgctggggaacccaacccggcctctcttaaagcgtccaaccaagcggcctccgacttgatacatataatcgtccagctcatttgacctttatattgttacctttgggcaggtagaagtcatgcaagtttcgggtgaccctatcatgtgaccagagatcaaaggtcagcagctcctaaatgttcggctgtcaagatagcccattcatcactatcattatgtaactgacaagcccacaaatgaactgggggataaaattattctcagccctctacctcctgggtttacacctcagtggtgggccaagcagtctcacgtattaagtggttccaagggcctgccacagtccctgaagtagggggaggacttcaggagacctatttcatgtgccagaccctgggaagtcaccagctgcctgcctggggagccaagttgccgctctacaggactctacagcggcctgagtctggtttcctctgaaatggagctgaattgaatgttagttctttctggacccaaagacacgtatgtctcccccaccgcaacccacctttagcatctttgtggtcctttgtggcaggttaacacagtgcagtgttttcaccaactggcctgatcttaagagtcacctatgaaaatgaagattcccaggacattcacctggaaagtctgacttaggaccaggtgccattaggaaactcagtttctaacaagggcccaaatgattctcgtgatgtctgtattttggaagaatgcaaagagatttcgaatcagacaattttggcttcaaatcctgaccctatcccttgtttggctgtgaaatcatggatgggttagttaatcttctgggcctcattttcaattttgaggacaaacattttaatagaagatgtatagaatcctagcactcatctttattattgtggggtttttgtttgtttgtttgtttgagacagggtcttgctctgccacctaggctggagtgcagtggcacaatcacggctcactgtaccttcagcttcccaggctcaagtgatcctcccacctcagcctcccaactagctaggactgcagctgcccgccatcatggctgactagtctttttaaatttttcgtacagatggggtttcactatgttgcccaggctggtcttgaactcctgagcttactatctgcctgcctcagcttcccaaagtgctgggataacagacgtgagccactgtgccaagccttattggctcttttaaatgtttttattagtattcttattatccctttggtgtgagaggagatgtcatcgaaagagcattggcatgaggtacaatgtctttataatctctcccatgtcaacaaaagtctctgataaacctacaggggcggttttgagagggacaggagaaaggcagtgctgtgaggatcacacatgctcatcacatggcttgggaggtgccctggtggatcccgcacactgtagcagtaaaggggaaaaggcagggcactcctctggacccctgaagaaagcgtggagatgcctttgagctatttcatgaccataagtggccctgacttccaaaccagcaaggggctcttgcatcccttatctcctcatcttctgacctcctggaggtacgatctgagcacttttaccctcaccccatagagcctttaccataggccagaggaactgggtttttttctttctttttttttttccacttttattttaggtttaggggtatgtgtggaggtttgttacataggtaaacatgtgtcacggaagtttgaggtacagattatttcatcacccggttattaagcccagtacccaatagctatcttttctgctctccccctcctcgcacactccctgctcaagtagactccagtgtctcttgtttccttctttgtgttcataggttcttatcatttaactcccacttaaaagtgagaacatgcaggatttgttccagggttagtttgctaaggataatagcctccagctccatccacgttcccatagaagatacgatcttgttttttgttatggctgcattgtattccatggtgtatatgtggatcttgttgttttttatggctttattgtattccagggtgtgtatattttctttatttaatctttcattgataggcattcaggttgattccatgtctttgctattgtgaatagtgctgcggtgaacatttgcatgcatgtgtctttatggcagaatgatttatattcctctgagtgtatacccagtaatgggattgctgggctgaatattagttctgcttttagctctttcgggaattgctatactgctttccacaatggctggactaaatgacactgccaccaacagtgtataagtgttcccttttctccccaacctcgccagcatctgttatttttttacttttaataatagccattctgactggtgtgagatgatatctcattgtggttttgatttgcatttctctaataatcagggctattgagctttctttcatatgctagttggctgcatgtatgcttttttttgaaaagtgcctgttcgtgttctttgcccactttttaatggggttgtttttctctggtacatttgtttaagttctttatagatgctggatattagacctttgtcagatgcataatttgcaaacattttctcccattctgcaggtcatctgtttactctgttgatagtttcttttgctgtgcagaagctcttaagtttaattagatcctacttatcaacttttgcttttgaaaccctggaagacaaactaggcaatagcatcctggacataggaatggacagaaatttcatgaaaaagacaccaaaagcaatcataacaagagcaggggagctcttaaccatgatttacagtgagacactctggttccatagccaggatgatgggaaacctttaccaaaacaaatctcttcttggaatcccaagttggaactctgaatgttctatctcatgaaaaataacaatcagctgggcattgttttgcgtgcctgtaatcccagctatgtaagaggctgagaaaggaggatcacttgagtccaggaattctagaccagtctgggcaacctagagtgaccccatctcaaaacaaaacaaaaagccctgatgttcatggctatttcactttatagtattattaatattatatttcagacaaactgtaggtcatgtaggtgctgagggaaagaattgggaactgtgaaaaccattgtttatatagaagctgtcttttgagttccaaacaaatgtggagaacgtaagacattgacagcagctgggtaccgcctgcactgtctccttctccaaggcagcaggatggcatagacccacaggaaggactctctaattatgctaattggccaagatccaggcagcagagttatctatgctaaatggaagaaagatttcttgtctgtgcatggtggcttatgcttgtaatcttgaccctttgagaggccaaggcaggaggatcacttgagcccaggagtttgagaccaacctgtgcaacaaagggagatgctatctctacaaaaaacaaaaacaaaaatagccagatgtggtgatgcctgcctgtactcccacctacttgggaggctgaggatcactggagcccaggagttggaggcttcagtgagctatgactgtgccactgtgctccagcctgggtgatggagtgagaccctgtgtcgaaaaaagaaagaaagaaagagttcttgaaaaatggatggtatttatgtggctgaatggcgttatgttggtattcaaaagcacttcaggtatatttggcagtcaaagggtttttaaagcacctgaacagcctatcttatataggacttctcacctcttcccagaagcgtgaggcccaaaagtagatgtatatacaactggaagttaagccaaacccggcttctcaagtggtcatggttgaagaacactaactactaaaaaggtgtattgacccgggggaaaaaaagctgacccctagggagaagtctggcttttcctcactctctgatgtgtgttgactttactgatctggaaacattaacgtggggaacagaggcaagaggttaaaagcctttcaaagaaaaagtgaacgtgtcttttgtcaaaactcatttaggaattggtttggtttagtggttctacaataggtaaactgagttatttgacatgctgacttgataaagccacctttgtccgagtagaccgttatgatagctgtaagtatgactgggtgactatttacttgtaaagttgtccacagtgtcatgatagcagtgacaaaagtccaaaaagacacattacaaattcattgacttgttcttttcagaggatttagagtgtcaagggaaagattattataaactagactgcaaatttttttcaccactcgctataacagattatttggagcaaaatatggtgagactatgaaaaacagtgcaatggagtgtcctcttccatgaggttagattttaaatgtagcgcttaaggtaggcatcatggaggtgagaattatacatggaaatcccttcaatttgtacatcaggtactggcagggatttagataccatgttaatatgaaaaatacttatctttacaccctggaatcactctgtatggcaagacatttgccacacaaatacacattagagtgaaatgaaccctcaagatactgaattgaacagaggacattagggtcccatattggtctcacgctccctttaaagcaaaaggccattgagaggattgttgccctatgacatcattatttcctgctgatctggcaggtgggttttgcaggttcatgtggacttgatgtaacaccaatgttttctacctgaggcctctttttttttttttttttgggatggagtttcactctgtcacctaggctggagtgcagcggttcgatctcggctcgctgcaatctctgcctcccgggttcaagtgattctcctgcctcagccttctcagtagctgggattataggcgtgcaccaccacacctggataatttttatatttttagtagagacagggtttcaccacattggtcaggctggtctcgaactcctgacctcgtgatctgcccacctcagcctcccaaagtgctgggattacaggtgtgaaccaccttgcctggctcctgaggcctcttaagccttggtattggcttatgctattgcacattaggagaatgcattatcatgtagctgatgccctcaaacagactcctactcagcatttggccaagtgactgtcaactccttaaattcaacttccagaaaaaacactgacttaaagaagaggagacttttaaacactgggtattttctgatgaagctgtccatttaaactgctctagtctttagaagtgtgatgtctttcgtttttatttgcgagcgttacaagcccttctggccagcgttgcatgatcactagattgatcagcgaggttttaaaaataggacttgtatcacataagaagagggatactgaggcataattatacatttatatggtagtttacatattttagagtgcttttatatgtgttatttgattttatcttcacataacccggtaaagcagagaagcattaacttcattgtaatagttgaggaaactaagagattgagatatttttctcaaggtcacccagggaatatattaataattagagatagtttatgccctcagaagctgaacatgtatcttttatttctatagactgtagatacttatgctgtaagggcctcacagtcaaaagaatgaaaagaagaaaactaggttttgtcagtcatctgacataataatagtccttctagaaactggaggtaaaaacaacatttgcttctttcctctgaaatgatttggaatgtcctgcatatttaaatttgacaagaatagctgactagtcaatggacaggatccattttagtccaaatggaaatccatgaaaaagatggaacggagtgaaaagggcagccagccagatgtccaggggtctgacccgccctggctcacttgcacaccgttccatcaaaccttgagtaaggcagccctcactcaaactggggatccaaatacctacccctgccatctctcctagattattaggaaagtaagaagcagtgctgtggattgacattattcgggacatttaaacattgtacaaaatgtaattgttattttaattaggagttgttctcctctttcccactgaagaattccctcttaggagttcatttctgttatctcttcagtggcccatgcttggtaatatttctccatcaagttctagtctgtgtgtgtgtgtgtgtgtgtgtgtgtgtgtgtgtgtgtgtgtatgttacatttgcttattctgatgaatctttcagcagaaaccatttctcctgaaatctttatcatttcatcaagagtaatggaaatgttacctgtcctttatttgttgcaaaatttagggacaaggaagaagaccgtgtatgttttcttaaaatcaatggccagcacattactgtaaaacctattgattaaaaacacaaagtataatgttagtcatttagtctgtgaagtgatgcaataagggaagaaatttatcctttgacttttgcattaaccttttattgactgcttgcatacccataattaacacacactttagctaaagtggttaattttagcatggtgaccagtgttcactaatgtagctgcaatcccgatcttctaaatgtaagtgcagccctgggggaaatcagcgggcagtgacgcccttcatgagttacaccttggtcaggaggacctctagacaatctgctagcagccagccaatgtgacacctttcggctgcttcctgttacgtcactaggtcattcagggagaaccactcctaagtagctgagagttttaggaggtggtttatagagtgctttgagtcaaaataatgtgaatttaggaaggagagagagaaaaagtatatatataatatatatactttatatacacatataatatgtaatatagtatatattgtatataattatatgtatttattatataattattttatatattatataatattagatataattattctatatatttattatataattataataatagttatatcatataattatataataaatatataaatttataaattacatataatagttatatcattatatattatataataaatatataaaattatataattgttacaattgtatgtaatagttatataattatatattaaatatataaaatatataattgtataataataaatacatataattgtatattttaataaatatataattacatattatatatacttattatatataatttatgtatatcattatatataataattatatataataatataataaatatattattgtatataaatatataatacacgatatataatatattaaaagtatatgtacctactatattatgtatatactttatctctcttcctcctaaatttgtattataaattcacattacatattatatattatacataatatataataaagtatatagtataaaatacgtatatataaaatatttgtatttattatatttaaaatatttatatataaaataataggtatacatataaagcatatgtttacaatattttatgtgtatatacatattattttcctttgctctccttgaactgcttcatgaaaggggcagtattttctgaacagatccaagtttatttgctaacccaagaaacattttaaaaaatgggatttttccttaggataggattagagaggacaggattgaaaggggaaactgtaactttctaattgtttagctgggttcagtaggacttgggaatgacactgagaagggaatcttgttaactttctttagcaacattatccagccctagtcctgaaaattggcttattttcatgcaaaggccagtgtggatggaccagcattctcttgttttctgggcagaaatttgtcccaaatagaaatactatttgaaacaaaaccaaatgtcagtgttttcatgggttcatacccaggtattctctgcacacactacgctgtatcaaccacaacatctcagtttggagagactatctgcattcacttggctaaggcaatggatgttataaaaggcaggaaataactgacagcaaggaagcatggccggcatatcagctaggattctttacagaaaaacctaactcagacaataaagtctcatgaaactgaaacatctaagtgaagcatgactcagatactcaaacagcatcgtacaggacccaccccttgctggacggcagcaaaatgttgatggcagttccacatcacacatcctaattgttcataggccaggagaggagaaagtcttttcctttagctcccataccagtcctctgatttattctcttgattttgccccatattgggtcatgtgcctcctcttaaaccactccctgtggctaggacagcgtgatgtactgacgtagcttaagccaatcaaggctctcccctggctgtagaggtggagctagtcccacccacatcaagtcatgaagcatggggaagggacaggtaccccacaggaaaattagaatcctgttggtggaacggtgggagtaaatacaggacaacaaatttccatcacagtcagtattcctcacacatttcgtaagacaatttggggcccctttattttgcaagagactatgtagagtattgtgtgctaagaaacaatccaactttatttcctgtaaatacaaaatcagtctggaacaaccaccatttggaaggccagacgacaatgccttttatcaatcctaggtcttcaggaataactgctgatcccttctgaatctgaacattttagcctgacactggaaagttgtagcagcttgaatacataagcctcagggtcttggaatgtcaaaatgtgataggatccagccttaggtgcaatttgattcaagccagacagagctgctcctgtatccccagagcttcccctagaaggagtctgtctagaggctacgcacccagttagtatgaaggaaggagactgcccaagtataacaggcaactctctcattggcatttctcatctgccactggtacctggagtagaagtaacgatagtggtaatattattttataggtattgggcgcttgctatgtgccaggaaatgttctaaacactgcgtataattcatgtaatcttcacatcaaccccataagtaagatactattattaccgtcaccacttgacagataagaaactgaggctcagcgaggtaacaaaacctgcccaagacgtcatgcccctggagagcagcaattccggcaatcaagagaacacactctttaccaccatgctgcagtctccctgcttcccatctttggaaattaagatccaagaaggaagaatgagtgacctgagcaaaagaaatgaaaccctaaagggggacagatgtgccttccagtaattcccaaccttctctttatcagttccatagtctggcatgattctaaatcacaaaatatcatttgagttggggatgtctgtcctttttcatgggtgactacatcacctccaataacgagcgctctgctggcccctattactatcatttggaaattggcaaggaacactggacattaaagaaaaaactttaaagtaatcttgaaatttctgaatgaaggctctgaagaaacccaacaaagggttctactcctggcccagatggatgcagtgactatgtgcagcttgtctgtcagagcttgcatgcaaaggagccacttcccataccagccagtctttgtttttttcttcttcttcttcttttggaaagagtcttgctctgttgcccaggctggagtgcagtagcacaatcttggctcactgcaacctccgcctcctgggtccaagtgattctcgtgcctcagcctcccaagtagctgggatcacaggctggcactaccatgcccagctaacttttgtgttttttagtagagacagggtttcgccacattgcccaggctggtttctgactcttggcctcaagtgatctgcctgccttggcctaccagggtgcaagggattacaggtgtgagccaccacgcctggccccagccagtcctttgatgagaagaacaacagcagaaaactgtgaaacagcttcgcccaaaagaaaagccattgggattgggaagcttgtacaacacagcataagcaaacctctgcagcaggcttcgatatgtttcatactttctcaaagtacggaggcaaaacccatttgacaggtgaaaaagcatctctattgactttctacaaactttatgatattctaggtggatcgacacttatcatagccctttaatctgccagccaggataatgtgtgcacggacaatttatccactgtgagattgaaatgctcaatttggaataactttccctacccagtaaattgagcattactctaggattctgagacagagagaaagcacaattttaaaagctttgcagagttcctttgtaattagtcgcagctttccttgaatattaattttccctgcatccctttcaagtggttgagagactgtctctacaactacagagatgcaccctcagaacaacgacagcaagcggcatggtctcaaacacctatgattaagtagtctacagaacgcaccctctgttcttcagtgcagtgtgtagcttatcagtgcaaacagtttaatatttatgctaagaggattgtcaaaagcagcttctgttgctttaattcttgttttaaataaataatgagaacatttaaacacattactcttcttggggccccggggtcagctaatcttattatttatgaagtgatgtgctacataatagtacttagtgcatgttaacagacgctattatcagggccggatgcagagagctgaagatatattagaatgttatgtgtaatgtacgacggattgagtgcataggatgccggtgtagcaattaaccacactcgaaaataggtgtaaagttgaagtatgttttccccggggggatcccctcaccattaataattccccagagaagaagatgtctttcagttaggaaccctctctaccatcaggcttggaaatggggccaggatattccattctttgatctcttcatagtcagtcctacacagtcagaagacaaatagtgagcatgaccactttttaattgatttagacaaaaatggagagaaggcgggggtggagggaggcacatgtgcaatgctcccaagtgtcctcatagtgtttggttttgatccactcgttttcactgccacgtactccaggagagtcgagaaattgttcattccttaatgcaatctgtttccttctctctgatcctcattttgcagataaataaagctaaagccactgagttttcccaggtcactttttaaataagccagtctctctgagagatagatgcctgccaaggtgtaagaacgttgccccaatttttttcctgtgaggctataatttagcttcatatgataattaatttctctactattgatgaataatccattcaataaaaaccgtgatttaagtgttttccttagggactaactcttgctggcctcttaatttaattttgtgcaagtttttcccacctcttcatcagtggaaatgattattaacctctatttgcatatatccttataaatcggtctctccttggagtgcctttttctgagcacagcaagctgggacacttgtaaatctccaggatctccaaagtcaatcccggcctgtaatattgtttaatctattcttggacgttttaatgcagtaaattcaatttaatctttcccagtaatctagtaatacattgaaatcccacaaacatttaaatctgataatggcttaatcacacactttaaataacagttgagataatgaaaaaataattcaccattttaaaggcagagtaactgaatttccctgatgattggcttctacgaagccacctgagataatacaaatctgggagtcaaagcaaaggaagtcccaacaccatcagaaacagtcttccttcttataaacacctgcgttccacctgtagattcattcagtcgtcaccatgaccttcacccccgaggactgtctttggagcattggccagtgttgctccaagcttcctgtgggttggggtcttctgggggtttcctcccgtggattaatttcctatttttactcttccaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaaatgcagctcttcagtcgccctggccacatttcaagtgcttaacagcctcatgtggctagtgactgctgtattggacggtacagatatggaacattttcatcatcgaagaaagtcctattggacaacacttctataaaaagtttgagagcaggaattctcatttccattcgtctgtagcttctatccccaaaggcaaagaaactaaaagagaaatgactcattgaagattggcctctttcctttctctaagacaaacctaagtaaaagcctgagctttgagtcctatgctcagcacacgggaaggagatgttaataattaaaataaagttgatatcctgtctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaaaggcaccagtcctaaggtgaacattaagtgagatgattctagttacagacttagaacaatttccagcacatagttaaatatccaggaaattctggtactgttatgtgtgggtgagctgacctggatgtagatgttttcctctctcttgctgacccctccgccagttttgtcttgtgatgccattaacacatctctccctttctgacctggctcctgcccattggtgtcccaagaaatcgtgagaatagttagccccccgtctccccagcctgttgctttctcgtgtagttgttcacagtagttgagaagttgaagagcttttgcctattgaaggtgcactgagaataaactctttcctgccaccagaattgcagtggttcacggcctgcactcattcccatgaatgcagttaatagccacagaaatgtcacattaagcaaagcagccagggtctcatcgtgttgagactcgagtctctcagaccttggattcattccctggtgtctttgagcctcagtttcctcattggtaaaagagaagtgaagcagtgtctcacagggtcattacagagattaaatgaaataaatgaaataacatagaccaggagggcgtggtgtttaaaagtcacagatggggcaccctcgggccatccagcccagtgttttctttagcccctatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaattctcctgcctcagcctcccaagtagctgggactacaggcacgtgccaccacgcccagctaatttttgtatttttagcagagatggggtttcaccacattggccaggatggtctcgatctcaacctcgtgatccacccacctcggtctcccaaagcgctgggattacaggcgtgagccaccgcgccaagccaaggtctgcatttttctttagaactcagaacacccaatagtcctaggcccccatcctcgcatggcagcaagctaaataagcatcttcccactgcgagttggggcatgacccagcctatggtttgccatactccctctttttctccgttttttcattaattgtgaacctgacctgcatcaccctttcatgtcagtgctctccaaacctgcttgcttgcacccctctagtcgaaatattttgtgcttaccccaatatatgtgtgtgactattgaactctattcgtagactgcttgtactaatgtcatttgcatcataaaatattcatatccaataaacatattaaaaggatgagataagaaaccgagagattttgctgtttttttccttttgcatggatgagccagcttcactgtcctgggtggggcccaggtggaattagttctcaaagtcctccaggtggagtcagggaatgtgcaacagggttggagaaatcactactttaagtgaatccgaaaggtgagatcacatttgctctaaagaaatggtgatcccagcactttgggaggctgaggcagcagatcactggaggtcaggagttcgagaccagcctggccaacacggtgaaaccccgtctctactgaaaacacaaaaattagctgggtgtggtggtgtgtgcctgtaatcccagctactcgggaggctgaggcaggcaaatcgcttggcccgggaggcggaggttgcagtgagccgagatcatgccactgcactccagcctgggccacggagcgagagaagaaagaaatggtgactttcattgatcatgtgtttgaggatttcatgtgctctccagggaggtttcaggtgggtagaaggaggtgggcaagacccaataaaaaagcagctggtgcgggcaatgacaatgaactcgtatcctgcagggtcaaaggaaggcttgcttctgctgtgaattggagaaggactttcctggaagcacaggcccagaaatcgcacccttctccccatgtgtgcggataagggaccacttccatcagcagcagccccctcctgctttcctgccagtcctccctgtggtcccaggtctcttgagaaaagtgatctaagagatccctttgcaatgaggtgctactgactgccctacctccctcccttcctcccatgaatgtttcttggtgctgaccacagcctcagcaatgaggcaagcctggggacccaagacagatctctgcctcccaggctagtggatgccctgggatatgtagtcaccaaaataggaacttaccccatagtggggaaatagacagtaagcagcaaatcaataacaagagtgttccagatggttgtaagtgccaggaagggaaccaactgggagagggacaagaggagatggtgactgaccaaggggaccttgatcaggctgtggggaagggaggtggttgggaagagcttcccaggaaaggggacggcgggcccaggcaggagagccttgggagggggtgcccaaggaaggaaaagggccctgagcctgaagccgagaagaccaggaggggagaaggggagatgtagggcagagcagacgggagccgctcgggttttattccacacaccccaggaagcatgagagggtttcaagcagcaagggcatggaagtaacttggtgagatatttttatgcattagatcatcgctctatctggattccagagggtctctgagagagcaaacagcttaatccaaaggagcggctttccaactgggaatgtccccctggctgggtgagatctcaagatggcctgcggcccctctagattgcctgcctacagagttcactctaaacagcccctcccctccacaccccagcagatccattcctgacgccctcactggcaggctccagccccacagagctttctagacataaaagagcagggtcatggcatcattggtgacacaattttagtaataagcttcaaaacccatcactccactgaatccagggatgccagaattgagagtccataggacccgtttaacggatcccacattcagtagacggttttttgtatgcttcgagggaaggaaggtattttcaaatgcaacttcttttttttttttcttgctctagttagggctgattttaccactgggcaaattgcatacatttggatccatgccacgctaaaaactgtttattttggagatctgtcagaggcaagcacatggaagacaaggggattctggtttgaaaaggcaattctcatccagacagattcagatggagaggagcggtgtggattaaaatgcgccgaagtggtaatgccgtttatcccgtttgcctttgttactctgtgattaaatggtatttttaattaagtttcattgggagccataggtatcgcggtggtgaaatcaatttgacaaccataaaggggagagacggcacaggcgtgttgtgatgattgcggctgtagggaaagccgggcagcttgcagaggatgggtgggaggaggggaagccggctaagaatgacttcctgcaagacagcaagggcacccctgggccactgctgtgtttgggaggcaggttttgggggttgtcagaaggcattcacctggttctctcgctcacctgagacacccgatagattcctggaaactccaggaaagtatctgaagatctggttctccattctctcttattaacaaggagaaccacaagtgccccccagatcccggctagaaggaccagacagctttccaccccggttcccaggcagccctgctcccatagtcctgtgtcccatcggccccatgctcccaggacagtcctaattcccacctctcagaaccttgtcagccaagttcttcctgctctctggcccaaatcctcctcctacattggaaactgagcctctctgcatcctctgctctttctatcccgctgtcattcatcagattttccaaatctttggattcctgagtggcagaagaggttttctgagtttaagttctgattctgtgtgtgattctcactctaccacctcttcaaacctttgttgtcttatctacaaaatagaatagtagtaatccatcacctaaggttgttgtgaaggttcaataagttaatgcgtatttaaaatgcctcccacagtacctgacatatactgggcttcagtgaggtactagctattattattaaccaagtttcctgtggtaacagttgtagctttgtgactgggccaaatcacttaacccctctgcgctccagtctttgtttctataatggggatgatgataatgcctagctcattggattgttctgtcccctacgatcagccatgttaagtgattcatatcatgtctggtacttaaaaatcacgccacgcatgtacattattatgatgaaaaatatgatccgtgatatcctgaccaaaatattaaagggactaaagatagctgtggcttgttcaagaagaatattgtgtcactatcccatatattatcccatttgctcttcacagcttccatttttcgctaggcggatggcatggaactttttataaatgagatattatgaaaaatgatgttttaggactctcatttctacagtgggagtaggtcacccattgcaattttggatttgcttaaaaaaattcttgccatcaccttctaatggatgatctgtgtacaacaattgtttattgactctgaatgtctaagtaccagggtcagtctatttcaaggggagggaagcattaattaacctccagcattagattcagtgattcttttccaatgatgcagttcatgactttgctcgcatttacttttcatcaatcctgaaagaattgaggtaaaatagttcctctgcacatgtgtgtcaagctaaatggataacagcagatacagatctgtttgcctgtctgcacttgcctttagacaaaattcatcaattttacaaaagccactgactaaacatggcaccaatacaaatgaagcacttctagcaggcggagattccctttgtttctgatctggtaaatgcggtagtttcctgctgagagatgggaagtgctggcctaggacagcaaggtgccctacaggtggggccaaaagggtcaagaccgttctacaggaagtttaggagaagttcaatggttccagatcctgtgtgcttcgggtaattctgaccctcttcattagtgataatggcatgaagctctttcacacagtcttttttttttttctttttttttttcagacagggtctcaccctgtcacgtaggctggagtgcagtggtgagatcacggctcactgcagcctcgacttcatgggctcaagcgattctcctgcctcagcctcctaagtagtcgggatcataggcacttgccaccacatccggctaatttttttgtagagacaggatttcaccacattacacaggctggtttcaaactccgaggctcaagtgatctgcctgcatcggcctcccaaagcgctgagattacaagcgtgagccactacgccttgccctccacacagccttgcttggtgttaaagattaaacaaagaccacaggtgatcactgtcttcgtggtgccagtttcaagggcacccttcttcccttcccagcctccgagagaaggagagagggtccacaagccagatccatccccatccacacaggtaaaaccacgactgtgcagctagcaggtggagataacatttggaaaaaggctttgtaaatgctaaagtcctactcaagtccaagggagagaaattattattattcgttttgtgaaaccaatttagtttggctgggtaatggaagaatttctacatacattcattacttctgatcaggcaagaccagtctgacacaggaacagtctatggctcactcttaaagccacagcaggctgccagggcttggagaaatagaaacctctcttgcacaagaatagtctcaatgaatcatgttaaggcctctttaggtttttcagactccatgcaccctgtggaaactgcctttcttgagtagaggtacgttcagcacttcataaaataatcttggagcctccagacacacggatggaggagcatgatttcatttgtttctttgcaaaactgctgtccccaactgaaaaacctgattatcctttcaaatagggaattcggctttccacgttggaaccagaacagttaaccttcaaacccccaaggcttgcaagagatgaatcagtttctcagacagccaaagccgtggcttataactcatccaacccagaaaactggaccgctggtcaccttccttccccctgcccccaactctgcagacagaggtttcccgttgattatgccttgattagagtcaggagagaagcaaaccaggtatataggattccattatccttccctcctctgctcccaaccagggtcacgctgagagggatctcggtgaacatgtgaacaatcaagccatgtttaccatggacgtttagttttcttttctcaaaatcaaaacagagtttagtaggcagcgtatttcatacatgccccttgatcaatggaatgatctgtcagaagccattaaagcccccattagcttgaatgcattcaaagctaaactattggatcatttaagggctgcagtgattgtttttaatataccgtacattgatttctccctgtgagcagcaacataagtttgaaactaactgtgtatgactaaggctccatttgctgtctccaaccctctgtgagaagcatggtttcacttcgaccagaaatgtctgtgtatagttttcaaagagatgcagaccctgttcgatttcccaagatttagactgggtcgggttgttatttcttttttccctgagctttctcccatttctttgtgcccattaagtgagctgtgcgtgcagaatgggagaggcatccctgccaaggacttcaagtgaaaggcggtgggagaaattgttctgaaagcatgaagcccagctgaggccaaaatcaaagtgaatttgacagccttgggccagcaaaactctgtacccagcagaaaacaatagatgtgtggctgtgtcaggggcatcctcactgggacatagcttggggagctgaaggtaccttggaagggccagatgaggaagctagccaaggccacaggccttcctttgactgccatattgccagctcttcatagtattgactcttcagtcttagccaacacacacttgttgattccttccggaatgtcagactctgctagcaacacaaggtccctgtcctcaaaatcctattcttaatcagcatttctaatttctgccctttgctcattttaatacagagcctgaggataggagagcagcgtggtgaaagaagcaatagttaccacatttgcaaaggcacataccccaaagagaagtttttaatatgtcacacccatattttatagatggggcaatggaagtccagatgggagaagttatttcaggtgaattatagaaactggatttcaagtttctgataagtattgaatttgggaaggctgtgaacattcttgagcccccctcccaagttcaccttcaacatcctaaagcaggttgaagaggaagatggttccaggtcacttacaagaacaggaacagcccctccctccaaatttgagcccagaaaggagaacctttgttactctagaaaacagtgtgtgtgctattgttttctccataggtcacaaacatccacaagatattggtgattttacatattattagagccactgaaatttatgatgcaggatattaacgtcaaagaggccaagatgcatcattcagaacactggcaggtcaagcagaaaccaccgtagtaaaattgaaagctggagtcagcaaagtatagcccacagccaaatctggcccatcccctgttcttataaagttttattggaacgcagccatgctcatcggtttatgtattatctatggctgtttccaactacagtggcagagctgaatagttgcaaaggaccatagggctatcaaagccccaaatagtcattgtctgacccttcatagaaaaattttgctgaactgtagtctagctccaaggattgttgtatcacctgtgatcgtgcctattaagcaattaacgtcatgtctagtacttagtaatgactcagcatgtatcaattacgatgataaatattatcatggcatccaaaccaaaatactcatgccaacatctctctgtacagaaacatggaaaaagagcgatgctattaaggaggaaaatggagccaggagcaaaacctaaggctatttctgaactaaagaggcctgaataaggtagtgaaaggaccagggaaagccttcccacggggatggagagccacctcctccccggctttctggttcagatgtcttgtctcaacagacggcagattcgcagggaagcaggccgagcctgatcttttctccgctagaactgctcaacaggtgaagaatctttttccagcactcctgagcccttcgggtcgcggaacagtgcgaagattattccaatgcctcattcggagaggtgataatctggtctgtggtttctttttcggtggggcatggggtgggggtgagtgtcatgctttctaaggcacagggctgactaaagggtgtcctatttataagtcagtaaaacacagcggcttcatactctgtgcttattacccagaagccccggctcttagagtttctattaagatgtacctcataaatatatacgcctcctatgtacccacaaaaattaaaaataaaaaaattgaaatcactcatttatgcttggtgttatgattgtaactaagaatcctggagtgagctggttacaaagtgagcccgactttccatggatgcaccatcctagagtgcaccgtgagcccggctttccgctgatgcacagtcccagggtgcgccgggagccccgccgtccatggaggcactgtcccagggtgtgccgtcgccctgagccccgccgtccatggaggcactgtcccagggtgtgccgtcgccctgagccccgccgtccatggaggcactgtcccagggtgtgccgtcgccctgagccccgccgtccatggaggcactgtcccacggtgcgctcctccttagaggtctctgcactctgcctttgctgcccacactctccaggagcaccttagttggatctttacttccttactgcctctcttgccacgcgaatccttgagtcacttataagacactccacgttgatcattttcatttgtcctgtttccagagtgtttatgaacacaattttacttgccaaatctggtttccatgttggactagaggaactagagggcaggacttgctggatcaaatttttacttccattttatgacatcccacaggactcataagacttcatgtcccccagattatttgatcttcaacagctgtcaatccagctaacttttatctgacacataataggtgctcaataaacatttgttagctgactatctgctaaagcaaaattgatctgatctcagcatcccctgctttaaaatctcctctagttcccccttctctttgggttctgaccacagcttgcaaggctgtttgaaatctacccccgcctcttacaatttcacctcccaaaacttgcttctaacctttgttccagctacacccaattttgtaccacatcctgagttgtttcttgtcactggtgctgtataaggtgagttgaccatgatcctagtggaaccttagcagcaggtaagaggagaaagctgataatgggcgaagctggggggaatttggtcagcgaagttagtgtctcaaagcaacacttaattggggaggtactgatatgatagacaggtgtctgagctggtgcttggggcagggcagccagtgggatctgcagaaggtcttggtgctgtcttgattaaaggggtacgaggaagcactccaaacaaggcactgcaaggccacaatgtggggacagggcccaggccagccccagagagcaaaatcacaaaagacaaactgctttggccaatggagttgagggaacgctggaagagcttggtggacatggacttggggcactggactgacgtcagatccccctgtgctactaagatagtggtgtcacttcataaacttttttttttttagacagaatctcactctgtcgcccaggctggagtgcagcgacaccatctcggctcactgcaaccttcgcctcctgagctcaagcagttctcctgcctcagcctcccgagtagctgggattacaggcgcccaccatgcccggctaattttttgtatttttaatagagacagggtttcaccatgttggccaggctggtcttgaactcccaacctcaagtgctccacccaccttggcctcccaaactgctgggattacaggcatgagccaccgcgcctggccccatcgtaaacatttaactcacgaattcagttatctgtgctcagcaaacatgcacaaaaaggcaaaaaagcataagggttccatccccaaactgcactcagggattgcacagcctagagtgtgggaagatgtgagaacagagaatctgttttctcatttgggaagctactacatggcttctaacccaagccagagacttcacgtcgtgctcaactgaagaacaaggatgttttcctgtgcctgatgaagaactatccagacaattcactgaagaggataaacaggtggcaaataagcacataaaaagattatcaacacccttagccattagggaaatgcaagttaaaaccacaatgagaaattaccacacacttctgagaatggctatcatttttctctattgagaatgcagagatgctggatcactcacacatcgcagggggagaatgtcaaatgatatcaccacttcgagaaaatcatctggcaatttcttctaaaactaaacatgcacttaccatttgacccagcaactgtactcttaggcatttgtcccaaataaatgaaacctgtatccatgcaagacctgtacatgaatgttcatagcagctttcataagagccccaaactgtaaacaacccaaatgtccttcagtgagtcattagttaaattttgatacatccatatcctgaaatactagtcggcaataaaaaaggataaactattagatggataatagagaaaaagatccagactcaaacaggtatatgctgtataattccatttacataaccttcttgaaataacaaaaacatggagctggagaacagaatcctgggtgccaaggcttagggaaaggagggagggagtgggcgtgg

SEQ ID NO: 281 - DNA, 36152 bp, Homo sapiens
aataataatatgaagaacacattaatattcttcacataataacatgaagaacctgtattcccatgaaatcctctgacctttccaaggcacttcaacattttatttgtactcttgctctgagaatgtccctgtgcatgacagtagctttggagtttacatcttatccaagtccaacagaatccatgtttaattgacttccattctgcttgtgcttctgtaacatttccccagagcacatcactgggcttgaacccaaaattctgtcctctcttttctatactccaagcatttgataaataggcagattccagggcatgagtagcactgccagaagacaatgctcagtagtcccctagtggcctgaaagagttcacacagtttactaacgtgcttattctgttccatggaggtgtgagagactcattaagcagcagttcattaagtaactgccaattagcttgatcctttctggaatggccaggaagcaagtccaggattccaccttttctaggttttctctcttgtgggtcacacgacctatctgagtgtcctactgtattgtcacaatctgaaattctgctttcatatttggaatacagccttctgagttaagctcctttgagaacccagtgatagaaaacatttaagttgccttgaagaaaaaagaggaatttataataaagacacaaccctttcttgggggaaaccaaaggcagaaatgacacctagattatgaaggaataaaatcagggaggctgtcagagatccagacagctgctctctcagattttggggttgcagtgactcttgcctatgcctccttccatggggctgctgcagttcggtttctttctgtctctgttgttgcattaactcagccaaacatgcctgcccccaaaaccgacagccttaggaaatgacactgagcaaacgctaatttctcaatcccatttctaaatgctggagagaaaaggtttgacatggccaaaaatgatgatgacaatgatgattatggtgatgatggtggtgatgatgttgatagatatttttatttattgtttactatggatgtgccccatgataattacttccatgcacatttcatttcatccttgtcatgaaccgattaccccatttcataggtaaggacaatgatgcctagagatagcaaataattttcataagtaacttgcctgctggtgacttcaagtttcctgattccaaaggcctctaatcaatacatggttaagcctgtagcacaaacattgcaaggccctatttcatgcctgaatttctaacagcctccctgattttattcctgagggcaattctcagagaaacaatgctgttaaaaattgtttaggcagtcatgttctggtctgctatagaagtccatgccttttctcaaatcctccagtgaggagcatgctcctctataggactccgtcttctcttccagtcttttcatctattgcatttctctttgcttcctctattttcttggtttgttgtttacaaacacaacatgcattgtgtcacctctgagctcataatgcagcctgaaatggtcttttctaatctgctaacagtttattcaatctcagaattttagcccaaatatcatttctttgatgaaataatccctgatcccattctttaccattggtgcctcctcattcagtgtctccatagcacatggctaacaattctactttttagcacctgacatcttgccagtactattatgttgcatagggatacctagaatgtgagctttctgaaggtgatctttctcaaaatataaaaaaccacttgataaataaaagttaaattgaatgaataccagttgagcaaatataaatcatacattcatatacatgtgctctttaagaagtgtctttttggttctttggtatttgtgttttgaagattgaaacagctattccctgcctatattttttgggggtcccagaatgccctctcatgtactcaactttctactcctaaccaagccaaaacaatttaaagctgcagtccagagaagtgtcgctttattgtcctttgcttcccagagcaattaggtccttattgcaccggatcctccaaagggatcacatggggatttagtcacagtgtccactgagatggtgggtattatttaacaacaatataaaaactattattggtccagagagtttaagagccctaactttagagaaaggatcagatctgatataatgcacaaagcacaatgtataaaagagtgtattttggcatcagaggtaataatagctctgagtcctcaggtaataacatatttttgtgagtctcattctcctcttttgtaaaatgaacataaaaaggctattttgtaaagtagttgcacagattagagacagtatcattgcatatgcttgaaatatgttgtgttcaataaatgttattatataatcctttacttttgctccctcttttagtataactccgtaagccctctcctttttttctccttaacagtacattgtaccaccagggatatctttaaatttcctttctcatgtcactccaaagaaactctgtggtagagttttcattactccaaatattgacttgagatgtctatcaatcagatcttctttagaatacccacaagtagcctcagtgtcctgctgaatgttcatggggaccatgtaatttcctcagaaaacatacatccccagccaggcatggtagctcaagtctataatcctagcactttgggaggctgaggtgggcggatcatgaggtcaagagattgagaccatcctggccaacatggagaaaccccacctctactaaaaatacaaaaattagccgggcatggtggcgcgtgcctgtagtcccagctactcaggaggctgaggcaggagaatcacttgaatccggcaggtggaggttgcagtgagccaagatcacgccactgcactccagcctggtgacagagcgagactgtcaaaaaaaaaaaaaaaatccccatacagaccgtattccatactatatttgaatactgttgttaatgggaaactcattttttcctatgatagcccattccaccccttcaatagataatgacagtcagaactttttcctttaatagaactgaaacttacttttcactgacttctggccattggccttggtttctacctagctgcttttgagttagaataatctagttttaaatcttgattctgccacttgttagcaatgcgagattgtgcaagttacatatcctgctgatctatcaaattggcacaattataggcaactcatagacatttgtgttagcaatgaatgagttagagtctgtagatttattaacataattcttgatacacagttaatgttaaacatttgctattattgttacattaatttctccatatacagccctaaattttatttattgttttttgactgatttgatcttcattacaggttctaagacagttaaggaaaaagttccaagtattctggtactgaatgggaagtagttacacaaatactgaaattctttggttccagactctcatactgttgagaaaactaatactcagagagaagtaatttgagttattagtagacaaagcaagggcttctgtttttgaagctcagtttcattctcccctgtcattacaagatgactgaaaactattttagtcaaaatcaacttcgtggcaacaagagcctggcatattggtttatctggcttacttaagaattatttgaatatgaatctacagatttgtgttcagctctaccctttaacagctttgcaatcatggagacattatttgacctctccaggtcttatatgtacccaagtaatgagaataataacaccattctgcttaacttgtttggagagggagataaaagtgatatattgtacttataaatgatttatgcacctgaatatgctacacaatgaaagcaaattatatcatatgtttatgtagtatcaaacttacatgttaccaataatttcacctatgacaaatatctcaaaagaaacttttaaatccaatttactcttaggacttctggaaattatgttaaaaatcccttttctgcttacctttttggctcaatatcattaatattcttctttctaccaatctccaaataggctttagagtatttggggattatttttaagccacatatgtttaaagaggagcaaattacaaaatgcaggatgtacagcacataactggtgagatttgttcctgtagctaatgcaaagattattggaatacatccttcattgtgcagatttagatgccatttaataatgctagaataaaggaggagcctgctcaagaaaattgcatttgaaggagagaagaaattgctgttcagccttgctgtaaccccttctgtgacaggttggacaaacaatacagcttccaattgctatatgtcctcaaaaccttttttggaggtaggcctcttcttgcatggtcagatggctacatggagtgatcaatgtttctgcccttccacctgcctttatgttccttcatacaaagccatgtgagtcactagaatccacttgtgcactcttgcaattcttccaggaactggaatggagagggttacttccctcttttcttaatcatagtacatcacactgtgttcaagccccactaaaatttgctattttgggagtcctctggtatatagattggaaggtagaccagtctatgtgtttatatatgtatacctatgcctcaggagaacaataccaaactaccttgtgtctctctctggggcctctgtgtgggccttctgcttttctcagagcaagtgtgttgccaagaaagaagatgtcagtaggttcttcttctagagattttcagtttttaggagtgaataacttaccattttatcatctcttttacttgtcagagaggagactggctcttcctacagaaggtgatagaaaactttaatccaatggtttttcccaaatatctatgtcctttttcttctccccagttatgtacttaatttgggagggaatagtttaatgagattagttctgctaatctactgtaaactaatctaagtttttggatgcagaaagatggctgatccaaatagcaggtacttctttgaacttagcctgcagagcctttagcacattttagttttaattatgaactctagtcaaattattgcatgttgcactcataatgttctcaactgggaaaaataactccccactataaagcattttaaaatatgaagagaatatttggttgttagcacgcatagagaacactagagacactccgtgagtaagagcaagagatcctaagtatgctgaaatgtgtgggactgtctcgcctagtgaggaattgcccttcttcaaatataaatagcatatcccattgaaaacacttcactgaatatcagtctgtaagaattcttaataatttatgaccatgagataaatttacaaaatttttgtttcatttgaattgaattgatttctcttaatcaagagaccaccttttatgtttcttgactattttcattgtgaattgtaaacttatatatatccatatatccattgaagttattggcctgctttttacttattgtatatttacatagcaatccttttgtaaatttgcaaatctaatctttatatttgtgttgcttgctttaactcccttaatagtgtgctcatttaacatccttatttgtctcagaaacataggtatgtttgtatgtttggacaagtagctaccctcaatatatcataagggggaaatacttacaagaacactatgctgtggaaatactgtgaaatgagtggacttgagaggctaaatcattcatcgaggaacattttactaaagtttgagtggttttattctagagcaagttttctcagcattggtactactgatgtgttttggcaagataattattttttgaggggactgtcctatgcattgtaggataacagcattcctggcctctacacaatggctgccagggtatataatcccccacttgtggaggaacacaatttctgtagaaagcacacttccaatgctgtttttgaaaagatcaatggagatttttagggagaaagtgcaagtaaatgttatccaagaggcaattctgtagctaacttgaatatttggtttgtttatatatgcatacatagacatattgattttttgtattataaaaagtgccatttagtgtctggtgccaagtttgctctttctgtgcaataattttctctaattaacactacatctttaataagtcattttatataaacaaagcagtgttagtgtgagtggtatatggaattaaagtacaggacacaaaaggaatgatttcacattattcttttacaaaatccagcatgttaatagcactatcgttgaagatgatggtagttctaggcttcccagtggagataaataacagagcatgcaagtgcttgtctaaggtgattcataaaagagaaaatattttggagaaacagctatgaaatatgcaggtataagatagatattctcaaatttgccaaacggaagtaattctctaaatgagagagctctgataactggtttacgtagtcaaaacgctacataaatatgaccatacatctcccaaagtcgtagccattgtcgaattcttaaactcttttttttttttttgctaattccacaggagaataataattgcaatctaattaacagtgttgctaatagatcttgtctgcccgaattctgacagagatgtgtgaacaagggacttcattacatacaaattctcagattacagaacttgagtatcttagatattgctaggtctatcacattcttttaaaggtaagctcagcagagggaaaatgactaagattacatagctcattatcccttctagctctactaatattttttcctattgagagtaaaaaaagtcttccttctcttacattaatttcttattaattaaaacctatgaaaaaataaaatcaagtgtgttaatcttttgtttagagacaactgtaatttattaagtgtttcttgttgaaaaaatcattttaatgagaaattctataggaatatttgtaaaactgtacaatatcatccacgattttttttacatgtgaaaaaatttctgacaatctgcagaatgggagacaacttttgcaatctatccatatgacaaaggtctaatatcgaaatctacctggaacttaaacaaatttacaggaaaaaaatattaaaaattgggtaaaggaaatgaacggacgtttctcaaaagaagacatttatgcagccaacaaacatgaaaaaaagttcaacatcgctgatcattagagaaatgcaaatcaaaacaatgagataccatctcacaccagtcagaatgacgattattaaaaattcaagaaacaacagatgctggcgaggctgtggagaaataggaactttcttcactgttgatgagaatgtacattagttcaaccaagatagcgtgacaactcctcaaagacttagaaccagaaataccatttggcccagcaatcccattactgggtataaaagaataaaaatcattctattataaagatacagacatgtgtatgttcattgcagcactattcacaataacaaagacatggaatcaacccaaatgtccaccaatgatagactggataaagaaaatgtggtacatatacaccatggagtactatgcagccatataaaggaatgggatcatgtctttgcagggacatggatggagctggaagccattatcctcagcaaaataacacaagaacaggaaacaaaacaaaacaccacatgttctcataagtgggaggtgaacaatgagaacacatgaacacaggaagaggaaaaacaacacatgctgtggcctgttggggatgtggggaaagggagagcatcaagttaagtagttaatgcatgcagggcttaatactaggtgatgggttgataggtgcagcacaacacaatggcacacgtttacctatgtaacaaacctgcacattctgcacatgtatcctggaactttaaattaaattaaatttaaaaaagaaaaaacaaaaacattcggtctgaaaaccctcacaaagctttctctctgatgacacaaatcagagatgagtggtaaacatttcgataggaaaaaaaaagaaacacagatctaaaaaagataacagggataaatatagggttctctggttgaaaaaaagttgtgattaatctgaagagaattatttcatagcatcatatataccagatatttaggggatttaagtaatagcacacttaatgtgagttgaaaatacattgtgatcaccagtggtaggaggtttaaaggagaataaaaagaatgagtagagatgtgaaaattggatcccataacaaacacgaaaaggttttaggggtgtttcccttaaattagagaaaacattgtaggtatcttcatttaattggctgccatgtgtctttccctgacaataatgtattcaaacgttcctcaaatgatttatgtcatgttctcaagtgtgactgttacggctgtgctagatgtctgcaatagttaccatggcctttgtagaatttgaattccaaaggtacagactgtgaactgggtgagtaaggaatgaatttggcaggaggatggtgaattgagacttttgatcctcaatcttatgttcctgaatttaaatatctgtgtgtatgtgtgtgtgtgtataatatatattataaaatataatattttatattatatatatttttataatatatatattatattatattatataaatatattctatataatatatattctatataatagatatacacacacatatctattcacaatgccttttaaaatttttttatttaataaattttttatttaataaatttttatttaaagaaaagattaaaagtttaaggcttaaatgaactttttttgactacaacttcctcctagcagaactgagaatagaatgctgtttcttggattcagacattttcctttcaacctgtggcaagcctgagaaaatagtgccagaatcatcaacattaaccacgtctatagatgctttatttttgcaacatttctgcatgaggagccttaacctgctatttctcaggcattgtctcctataggtggcattcaagaaactgaccaggtctctaatgatagcagtagatcccacttctgtcttagcttaagatgacacacctttgacaagaagggtcagcaaagtatctttaaaaaaatatttaatccacagcaagatggccgtgagttgttctgttgtgttacaagtgctggtaaataaatcatgagcaataatctttaaatacataagggtgtggctgtagctagtaatgctgatgaaaatcagaaagggaatccaagagggtcacaatagtgttagactttttaaacagtaagagctgtgtaggaatccttctgtgaaccataaaaataataaacgctgagcctattggaacataatctcaatcagcaagatgccaatgctttccagatttcctcacagggccctgctaattccatgccaaaactggcagtggatttcttccttctaatctcccttaatgccttattcgattattgtcactgctctccgaccatgcactgtcccttcagactctcctttcccaactgagtcagtcagaggagcctgggtgtctgcaggacataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagatttctccagttgattggcagagaagagctggctagcagggaggacgaccctaggagggtgaattctgcatttcagtgcactgcaggatggcgtcgtctctgccctggctgtgcattattctgtggtgagtaagatcctttttcctgatttttctttttatctcagaggaaaggaaaagtatacatccattgggtgactcctatatcaaatcatgaaagaggccagaagtggtgttgcatgtatttgtaacagggtggaatagagtagattagacaaaacctcttctctgagcctgggagtaaggatcattgactgtctacacacaggctagaaaatgccctagggaaactcgaagttgaaggcaacttctactcagaaaacgtcagtcggatcctggacaacttgcttgaaggctatgacaatcggctgcggccgggatttggaggtaagaagctgcatctttgctacacaaacacctgtagtttccttcctccgtttctgccctttgaagacccagaagagtcagaaactaggtagtgggaaggggcagggtacgggagagagaccatgggtatgttcccatccagtctctgcctcatccaccattagtagccttgttcaagttatctgaactctctaagcctcatttcctaaattgtagtgtgggtatatgatcaatgtttgcctcatagagtggtatgagtgcaaaatgagattattcatgtaaaacagttttattagcactttcccattaaagccatcaatatacattagttattatcattttcgttagaacgaatctagcttctttcattctttaatgttctcccaattgactagaataaattctaaataaggccactgacatgagttttcagagttgagagacccaaggatccccactactggaatgcaataggacacattgcagatactggctatgataagtaaggggtttggtggtagagggctgagatcaatccccttaacatcagtggtgataattgtttcatccctctgggctaatttcaggtgctgtcactgaagtcaaaacagacatttatgtgaccagttttgggcccgtgtcagatgtggagatggtgagtaagttctaagtgagttgggtgttttcatttcggggaggagagtggagtcccaaaactaatgataatgggcattgccgccaagcttggctccagattcatgacacaatatttgtattcatgctgggagggcatgaccattagaatggattcctggcttaatcttcacatttcactaagggcttgaacattttaagctgagggactttttaaaattatgtcctctcttccatccacatgctatgcactaattcttccctccaaagagaagagattttcccctttctttgtgaagctccagcaaatttattggaggaagaaaaaaaacacacagatcttattccatataaaagtttattgagtatgtctataaaacctaaagcataattgtcttttgtggcaacatcattatcagtatattttattaaaacagtaaagaggtcatttggaaaggctgatgctctccaccttttacattgaggatggaccagtaggtgttctggggactctgttccaggtacagatggctgtagcattcataagagggtatttatagtaagtagcaatgaaaacttgaactcatcttttagaacaaagtgtatcatggtattcttttacggttctcaggtggcatttctctctaaaacggaagtgtaaatatgaatgctgaagtaaacataactgtctttaaagaggttcaccattagattttattaaggaaatgtaattctaaagaaacagttattggagactttttcattttctgcttttttaagttggcaagaaaagaagatgtaaagaaaggaaaaaggaaggagtaaaggaagaagagaaagggatatggaggaaaagaaagaagaaataaaattgaaagaaaaggaaagagggaggaagggctttattcaagagataattatcttactatataaggagaaagaggagttagcaatattcagaatcctgaattattttagtatcatatttttcattcgtgttctaagccactccaagtataaacaactacaacaatttgctattgaattgttgaagtctgagtatacttagtgttctatcttatgcttgtgtctgtttttacagtttatttgtgcaataggtccctattatatcatgagtcattattgtatggatatattgcttgtcaaattatatttttaaaatgtaatcactgcttgccataatacgtttcataaaggaatttatatagtaggcaaagcaattattggcaatactttgatataattacaagttgttatttgttattgacttttgcaatagctcttattataattcttaaacattttaatgctatttcataaaagccacagattaagtcataattttgatgatacatacttaaatgataccctctttagaatagtcacggtaacacttgtttatatgttccctgagaacaatataaaataattttgatgtgcagctatagtgtgtttatcaagtaaggtttatctatgtgtggaattttactgaatggtactctgaagctctgaaatacctttgagggtgaatgaggtgcaaaggggaatagttagtctaaccgatggtataaaggccagccagcacaaaggctaaactaaatatttccatattttttttctagattaagaaggacatattgatagatggaaatatggatgactggatagataaagaggaagaatattaaggaaagtcaaggtggaggagggaagtttacatatcacagcactatcttttataacaatgcaaactttctgagtttgagaacaataataactagctaaaattatagctttgtgagaaattattgcgataaaaagttgctttattgcttaagttttgagattgggtgtataggctagtgaataaactattcttagcaaactatctttccagcccacacaaatattttattttctcttaggagtatacgatggatgtttttttccgccagacctggactgatgagaggttgaagtttggggggccaactgagattctgagtctgaataatttgatggtcagtaaaatctggacgcctgacacctttttcagaaatggtaaaaagtccattgctcacaacatgacaactcctaataaactcttcagaataatgcagaatggaaccattttatacaccatgaggtgaggtttctccaattctatttcccctgcctaaatgatatgtccataatactaactcagaaccgttgatttcaatgtttctaggcttaccatcaatgctgactgtcccatgaggctggttaactttcctatggatgggcatgcttgtccactcaagtttgggagctgtaagttacaacaggcttctgagagtcaaataatacatccaaaatatataattacttggttttagttgatactggaaatcaaggaagaaatagaatcatgacactatcagtgtgattctaggaatatacttaatcattctgtcaatctcataaattgaggctttagtcaccaagattaaagaaaacattaaatacaatctatgtttgtatttccttttttatagacaatgtgcactttgaaggaaaaaaagacaactcgtcaaattcactgctatatttaatttgtttcaaatatttagatgcttatcccaaaagtgaaatcatatatacgtggaaaaaaggaccactttactcagtagaagtcccagaagaatcttcaagccttctccagtatgatctgattggacaaacagtatctagtgagacaattaaatctaacacaggtaagaatttgaccaaaggatggaaataatccctcaggatgactccagtgcacattttcaaaatatctatttctttttccttcgccttagccattctcagctaagcatgctgttttgcagtgatgagtagctttccttaaaactgattttgcaaccaggtgcatataaagatttgtgtaatcttggaataagtagttttttttatgtatatgatataaagaaccctactgaaaacaataagttgatgtgtctcttcgctctatcatctgctgatcaagtagctttctcatatactgaaatgtacctttgcttgttttcttccagtcaatgttaatttaaaagttgtcaagatttatattcaactgcattctttttgcagactgtcagcagtaataatactgatgtatgtgtcttccaacaggtgaatacgttataatgacagtttacttccacttgcaaaggaagatgggctacttcatgatacagatatacactccttgcattatgacagtcattctttcccaggtgtctttctggattaataaggagtccgtcccagcaagaactgtttttggtatatgtcacattttgtacttcacgtacattcatcctccacctttcattgcttgtgtattttgagtaaatatttacactggtgcactttttcaatccacaaagaaaataggttcctgtctcatccagacatatgtatcatgcaaaatcactgtcattatatcacaaattgtgtgatgaatcaaaaaaaattttgtctcagtgagaattatggctggtttcctatgactttcatgtgtcctatttgcagtgctttatcttgattttctttgtcataactgaggaaaagcagaaagttaaaaactgcatgtaaatccatgaaagcaaaagattaaggtattgaacacagtaatacataggttgtataccccttttattaggttgaaccatataaaattgtcatttcgtcaattttttatgattcaacctacatatttagttccacttatagatagaatcactactaattttaataaaacaaaattaaataataagaaaaagagcttcaactggaaacatcagtgacacattccagtgtttttcctgggtttaatgtttataaatttagtagtctctaagatagacctgaattgaatagaaatcataaatcttgattttttaaatttactaagttaaaatagattttttgaaaattacaaaagaatgccaacataatgatgttgaccatcaatattatacatctcctaatagtataaattccccaggccatagttcaagaaggaaaactgccagcaagtgagtgataaattttatcttctaatgagtaaatattataccttaaaatctagctagaaacacaaattaggtaacctaattttatgctaatatttataccatatttatttattaactatcatttaatatgttagctggtaaaattggtctgaaattcaagttttttttctttttctttcctttttttttttttttttttttttttgagacggagtgtccgtctgtcgcacaggctggagtgcagtggcgggatctcggctcactgcaggctccgcctcccaggttcacgccattctcctgcctcagcctccggagtagctgggactacaggcgcccgccaccaagcccggctaattttttgtatttttagtagagacggggtttcaccgtgttagccaggatagaatggtctcgatctcctgacctcgtgatccgcccgcctcggcctcccaaactgctgggattacaggcgtgaaccaccgcgcccggcctcaagtttttttttcttaagtggtaataatttgttacaagttctctcaagccctaaacaactagaactatttacgacttaaattttacaataactagttcaattcagcaaactcaaaattttttgagcagttataatgtatgtcacttcactaaatattgaaagattcagaaatgataatacttatgataataattatgaacaattataatacaaaaaatatttttaaaaatgactttgccttggtagagttttttgtcttctcctctgacacattctcatttgattttgccataggattcccagtactaatattacaattcctattcttttttattttagggatcaccactgttttaactatgaccactttgagcatcagtgcccggcactctttgccaaaagtgtcatatgccactgccatggattggttcatagctgtttgctttgcattcgtcttctctgcgcttatcgagttcgcagctgtcaactactttaccaatcttcagacacagaaggccaaaaggaaggcacagtttgcagccccacccacagtgacaatatcaaaagctactgaacctttggaagctgagattgttttggtaattgtttactttttctatcattacctaccgtaggaaaaagcagcctaaatagtgatcagaaacaacgaaagtgtccaaaagtaatgtgagttgagcacaggttatataactgtagtttcaagagcaaggccagtttctgttccaacttcacagagaaaagctatggaacaatccttcatttatctttgctgtaaactttgggcattcttctttcatcatcctcacttatactggcagattccaggctctcagaggagactagaaaattctaagcctttagatgtttcttttgaacaaaatcacttgtaccaagtaggggcaaaaaagttaaaacaaaatgttttttctaatgaggtttcagagtgcaggaaagacacaaggacttctatggaatggacaatttttgttataaatctgcttgctgctttatttcaagagggcaaggcatctgtgaataatgaataatagattctctgaatgttgagtcataacccaataatttgattcatattaaaacattttcatattcacatttgtatattaaatatatgtatatcaatgagtttatagtcaatggcttacgttcagtgagaaatagttataaatttttgttaaatttgctgtggctaagttctggtccccagaggtttttgaataagaaacaaatggtaacattaatatttcaagggccattaatatgcccccagatttcaattttgcataaaattaaattataacaacaattaagctgaacatacttattttaatggataataaaactgattgacagtcataaatttttattttaatacaaatcttaaagagtagctgttagaagaggaatgttttgctctgtgaattcaagtaaggcagacactttgaactgaaattttttttacaactgatccattctagtaagcatttccatatctgaaaactacacgcagcccagtaatcctcagtttaactttatgataaaagttttaaagcgatttgttttttacttttcagaatctgtggcacttgttgactgaaaaggtgatcattttcttattgacattttgtctttgataaactaagaaacttgtttgagaatttatattttctccaagaaatgagaggcatccccataatatgtagaaatatataatttaaggattttttattagcccttatttaaaaaaataaagaaaaaagaaaaaaatgccattcagtgatccagtttaattaccttcttttataagtgaaaaacacagtctaggagagggaaaatattagtttctagttggtagaaaatctaggaattgattcaaaaactttgtataagccgagtgcagtggctcacacctgtcatcccagcattttgggaggctgagttgggaggatcacttgaagccaggagttaaaaatcagaatgggcaacatagcaggctgacccccatatctgcaaaaataaaaaaaaaaattgctctgtggtggtggcatatgcttgcagttctagctattcagggaactgaggcaagaagattgcttgcatgcaggattttgaagttacagtgagccatgatcacaccgctgaactccatcttgggtgacacatttagatactgtttttgtaataataataataataatcagaagaagaagaagaacctttgaaatccacaatattacagagactgaggccacccttcccaagaattccctaaagactgaaatatgccagggtgcataccacaggataaaacattttaagaaagtagttgagtcccaaaattcttcctttgacttaataatatattctttatgtatctgtagtttgaaaggttaccaaaatataaattttgtaacaaaatatcctagtctgcagacttgctccacaatgttaaaaccattttttgtcatgataaattccaaatgtttctgagaattttttcatattagtagaaataagtgattctgttacaaggtatccgtatgcatataagtatataatctatatattgtccataggtcatctatatattaatatatgtctataaatgaaaaaagtgcttatcaggattcagcttaccagtttcttatttgagtaaagtagtaagagtgaaaaaaaaaaagatcgtcaaaaacagaaaaaaaaggatccattttgaatatgctcatagatcagatattgaaataaaaacaaagaccaattttttgctttaccttttttgaaatatgcagtactgagaagaggatgatttcaaatccttggagaaaacgtaatcaccccctcaggctattattttaaagatataatttattaatttaagatggaatttaagatctcaggttttgatataaactgtctcctataaacctaaaatagtaacatataatgagtaggtcctctgggaagctagattttaaaaaatggtatgtaaattatctccaagtacttttttcctgcaggtagcatttattttttcttgtgaaaaattatatttctgaacctggttttacttaaaatgttttaaagcaacacatagggaaattttgattctaaaaggctgaagtgtaaaaataaacataaaaacaacaatgaccaaatcaaacaatgtaaaccttgaaggtatcaaaactaaatataggtgattacataggacatttgcattacatttgttcgtgtcaaaccttggcaagttgtcttatatgatatagaggaacaaacataaattacacatttgcaatttatactacacaatggtatattttgattgcaagacattttctcccaaataccatgacatttaaaaatatctattcagttgtaatcaaaacaacattatttgaataagtttgacattgaaacagcaaactaatgtggtgaagttgaaatgaaattaagtgcttggatatttcatgtgattctatgttgtatattttaatatgttcattgcttttcacaagaaactacttacagtgaatgtgggtaaaaatttattcattttatcactttgattctgaccttaaaacatgatagtaatggagaaactcaagcatttaaaatctagatctcaaacccaaaaaggcaccttaaagctaaatcttcagaaatgctctatagactaattatctttctgtttttaagacatatggaattggatattttattttttattatttatttctggaaaagaaattgtcaacagtgtttttcccgcttatatggtgattttttcttattgtttttatctagcatgctaccttaatattagagagttacttatatcttcatgagtttcagagcctattaacatgtctggagtatacctgtacctatactgtgtgtaagaccaactttggtccttgatttgtttttgcatagtttgctagtttccttgttattttaaaggcctaagcccttatcactatgttcctgacagtcaatcactcacccattccatctgcaatcctttgagcagtgtcattactctcaatgtagcttctcttctttacatgggtgtgatgccttttgtaaattatataacataaaattaaccaaaatttcattagtcaggacaattactatatttatgttgattgcattatttattcatttctttttttttctttccatctggcacctatttattgactatttatgcattcgttgaattattcataccatatatatttgataagtgcctttatgtgccaggccttttgtagagtgctgaggatatattagtgagtgatatcagagggcctcttccctcatggagcttcttgtccagcaggaagtgagagagatcaatgagccttaataataccttggaataaagtccgtcattagagatgtatagtgagctgcagaagagccatgcaaaagtgtctaactcagtctggagaggttttcgtttctagcagagtgatgtctaagctaagaacaaaaaagaaattagcctggctctgtgctagaaactctaaaccagttgctacaaacttgggcatagagagggaaataagttatatacccttcctgtgctcctttttaaggtggtaaggtgcactgggccattaccatgctgctttcatctatgtagagagatgtgaagaatagaatactgaaaggtttaccttgcctactccaaatattgcacagatttttttttttttttttgaaacggagtcttgctctgtcgcccaggctggagctgattttttttgagtactgtcattcctccctacaattaaggactgaattaagaccattaaagactctatgtgccagaaagatcacagtgcccttcttggttgtgccattgtatgatttatggggaaggcaggatggattagacgagggttgtaggtggttagccccttccccataccttctatcaaatccccacccaatattttattatgaactctccaaacattctgatatgttttctagagatgttccctagcaccgtggatcaattattcaatatattgctgccaataagctgtgtgtctgtagaaattctggagttgtgtctgttttcaactctaccagctgaaacacaaacacaggaaaacccaacagagttctaattttccccataacgattaatatgatgacttttgcaaactatcaatactgttttcaaaaaaatattttctctcatctgtgttgtccctctttgctctttctaaaaacaaatgcttggttgatcccttcagtaaggcagccctggttagaatatcgttttaaatggtgggggtgataggttacctctcagacctactgagactcattgaattacatataaaaatctgtctaaatacttcctaaacatcttttccctctatcaaatagttgattgtcataaagtccagtttgacttaaagtacctttgcaatatgacattacttgaaacaaagcagcgctctataaatacctaaagcaggatggcactcagcagcaggggagccctgcaaaaattcaaaaccacaggcgttccactcaaaacagtgacagccccaagctgagccctcatctggactctgacaaaagcctattttaccatcagctgaagctgctatgcttacaatagagcaggaagggactgaagcaaacctgtagcttaaacggctcacaaaatttgctttcttttcatttcagaaattcagcgtgttccttctaaactgatgtccaatctccttgttctgtcaattgccagttatttagcagctgattatccagatgtagagtagccaggcctcttgcatttcctttagcctatcatatttgctgcctgtagaaatttccccaatcactcccgggcagtgggacacttgtgactctaagccagtgatttcctatggggagctatttcccccaagagacattgggcaatgtctggagatacaacttgaggtggaggtggctaatggtatcatgttggtagaggccagggatgctgctctacatcccaggacacagaggatggtcctccataacaaagagtgattggccccaaaagatcagtagttctgagcttcagacactgtgcccaaaacgctaaagctgataggaagaatagcataataattgttaagagcgcggtctgtggcatcagagggaaattgaattcaggtcctgccactcattatctttgtgagcttcctgcttaagcctacgtttgctcatctatcaaatgaagataatatgacattgtggattttttgaagaaattcgtgaaataatatttgaaaattgccttgtaatgctagtcaacaataaacatttagaaccggtacttataatgtaatataaaagtgcattaaaatacaatgtaacataatcataaaacttttcatccccctctttgcctacttcctccaacaaatcttgggaaatgtttagatttttttcatttgttgattcggcatttgtttattaaagaaatactgtgttttaaatacttgctaggcactgtggaatgctcatacatatgaataatgtgccttctaccattaaagagtttccatgctaggaaaggagataagccacaacaaaaataattatacctacaaaacagaaaataagaatatctacaagagtcataataactaggcagaaaaatgcataaggctggagaaatcagtgatggtaggtgttaatgagtttggtagcaaaagatatgagggaaagataaaaatgggtggcaggtggatgttatttcagacaaagaagaaataaagataggtgagtggtgagaatgagaagcagacatattttgaaaatgatttaaaaaatagatatagctaagattcctgagcaaaaaaatatgtacatatgtatatgtgtatatatatacacatatatatgtttgtgtatatatctttaaatcatgcctttttcttaaattcttaaaaacataggaaaaaagttacttgttaagtaatatttgtccctaccttcacagaaacttgaagctgagagagaattagagcctatagcacctaggaggtgtttaaattatattgcacgcaattagtagctatgaaactgtaatctagggatttccaactctccttgttctcttaactcctagaaaaccctccacagagattgtttggggaagtagatgaggcaaaagggaatgctaatgtaggaaatctttaatttcaatataatttaattttaattttttaatttaggtaaaattacagtatccattttactacaaattttttgtggtgtttggttctgaatggtacttctgacttccggaccataattatttgggaatcctcattcagtcttttgtgacattgtgacaatgcacagattcacaaatgactgcccccaccacatctctaaaaaacggggagaataagcaaggctttacatttttatggtatttaatgttttataatcactgctttattccaaacaactaggcatgtcttccctctttctacctaaaatagaaagaaaaacatgtttcagacagataatgcatgctgttaaaagtcaaaatgagtgtagaaagaaaatctgctctgaaggctggcttctttctactctatcatgattctcataaatgtttgctagaggaaagtattttagtgttccatatgtgggaggaggatggctctttttagagggtgaaacagtgacaccttttgctctttcaggtagagaatattttaatactatatttaataggtgaaaatttagagtctgagaaacatgatagaaaattcttgaaaatggttctgtgttctctaggagaggcagcatgcactgagacagttactctgcttctatccacacacagcctggtgatcctgggcatagtagtcctcagctgtcatcttttttttttttttttttaatgcagtcttgctctgtccccaggctgaagtgcagtggccaccataccagctaatttttgtatttctaatagagacggggtttcaccatgttggccaggctggtcttgaactcctgatgttgtgatccacccacctccgcctcccaaagctgggattacaagcatcagccaccatgcacagcccatctatttttaatagaaagtttccctcatctcctcttcaagagcagcatactagcccttctaatatcttaaactctcttctacctctaagacctatgactaatttaattctgtccagagtaccacagtactgggccaatagataataagaaagatagcccttgcttggaattcactgtggttttttcaaatcaaatcttgactacaccatttgtttttgcttttggtaaagaaacacatttctccatggcccctaaaaacagtgaatttaagctctctgcaataactattattatttagatacccagtaagtttcatggcaaatcaaacagcaaaatcaagaggagaatatagaaaagaagttttgggagttgttgtccctttagtccaaatgtcaccacatcggcaggtcattttggtcctgtggctcaaccagcacaggggaggaagctgtcttatactgttgccgcagtgttgctggctaaagccacgggagtttgcccacgtgggtcacataccctgccaggcagcaaagtggtgattttgctgccagcaaggaaacaaggccattttacaatatcaggggtaatgcacagcaagtgtttgaaggcagaggcccagcaaagacaagctagccacaaggagggtgtttgttacaggatgcagacaagaaaagataggaatcagaggagggccccctagacaccaacggcatgaaaggaatctaaatcaaacagaatcagagtctctgaactaggcccaatactttagaataaagatgagaaaaatgttggaatgaaacaggcactgaaattgaccattggagtttattgctagccctgccatcatggagaaggcatttcccctatctggaccctagcctcacttgccagtgattgtgttaaacatcccattcaagactatagttgattgtgtcatgatttcagtgagacaggaggtttagagatagaaaggagcatataacaagtctgagtttagtaaatgaatcatttttagtgactgaagatagagaaagaccagttagaaagttctgagcgggaagtaaggagtgtacaatatagaaattctgagctaagaggcagctatatttcaaggtatgaacagtcatcctactcaatgtaaggatatttattctttgtcactggcctttggcatacataggctaattttatttattttttaaatccttaaatcatagctgattcaagcttatgagtgtgcaaagatgagaatgtaggctgggaatgtgtacagaagaatggcgtcaataaaccaggctgtaatttttttgtactaattgtccacatattccaaattggaattcacccctcctcccaatacacactattgcccaaacccattgccctacagactaatgcacaaccaggagtggctaggcctctgcaacctggctcgtctttccctaaggatacaatgcttaccgtagttctatgacatgaaacatgctttgtgttgtttgctgatgtattgagtaatagaatgtcagatggaagcaagtaaattattttacaatgtattttaagccttacttggaaaagtaacaccaacaaatactattaagaattcattgatgtttgaccttacatagaaagtaagtcgtcaataaatatttgtcaatggtgaaagagtgaataaataagcaattaagcaatatctattctttcatttgggcttaatatttgtcttttttccacagcatcctgactccaaatatcatctgaagaaaaggatcacttctctgtctttgccaatagtttcatcttccgaggccaataaagtgctcacgagagcgcccatcttacaatcaacacctgtcacacccccaccactctcgccagcctttggaggcaccagtaaaatagaccagtattctcgaattctcttcccagttgcatttgcaggattcaaccttgtgtactgggtagtttatctttccaaagatacaatggaagtcagtagcagtgttgaatagcttgcggccaggacaacctgaattctataagttcttgttttctgtttcctatgttttcttaaaaaatagcattgagacttgtgtagatgcttctcagaacatgaaatcaaattggaaatctgtaacgcagcttccgtaagcatgtgtgggcaaaaaagcaataatcctactcctcaaaatagaaagttgaagattgctgaaaaatatgacttttctgtatgttagagaaaaactttatgaggatgaaatgggttcaagatgaatttgtcaacttttgtcttccattgttcagtatttttaattgtcactgtaaataacatttaccacaaggcagataaaataagaaatgctgacacttccaaaggttgccttaaaatatgtttattttggcttagttcccgagagggcaaaatataaatacagtctaaatatttatcagtaggttaataccagcatgttggaggcctttatgctagtaaaatggctttcagtggcattgtaaagcctacattgagcttagccatttgtttttaacctcgctgtgctcttttacctcaataaaatgtggtgtttgtatacatataaattatacatagctcataaattatgtatgcatatgtacatagctgtagttggactaaaattcagtgtgttttatcctactaaattctccttttaaaataatacacttaccataattctatgaggttgtagaaaaaagtactcattataaggaagccttgtatattatgactatggttatctcttgtgttttccacatttccaattataacactaaataaaacaacaataaacatggttctctggatctgtctcatacaactagagagaaaccttctttaggtgtgaagaagtgaagtggttacctctaccccaatgttattgcccctggtgagaggtaggagaaatgggacaaccaggctcagttacctagtgctgataaaagatttgaatttatattcaaatagttaatctttcctctattcctgctcaatcaacaatgaaaaatgaataagactactcttctccctttccattactcccgttctttcctgatgcttcactctaacagtatttctcccacacagaattcttatagggaagtaggaactaagagtaggagaaagcatgtggtgtgatttgttgaaatggacaaacccctcattagatgttcctgggtcttaaacatcatagagatcaccttgagaccagaacccagaaaaaaaaatttgaatactactactgtcttatttttacccagaaaaatgcaaacatactacagctaaacaacttgaagtttaattgaaacagcactctactaagtgtgaggagactgaggtctctgtgcaacttctgtatcatttagctccttggcccaatatctttgttttggggagactcagctttattctcatctatagaatgagggagctgattagatgctcttcaaagaccctttcattttgaaccatgtacgtttgtttcataattattattttctgtctaaataaaattggtataattatacagggtatattaaataattaaatgtcaggtgggtgttaatcatcttatatgctaggtctcatttaatctacctcacaaacctgtaaagaatatactgctattatctccatttaaagatgaagaaactaaggctcaaagaagatgaataattttgttcaaaatcaaagagcactcaagtgctatagctgataatcaaacccaagcgatgtgaatccctagctttttcatttaaccatacctatagatgtcctcatctaatatgatatgaccctattcttttatcccttcttctattctctagcattgtttcacttgtatgccactttttgtaataattgtcctggggttctgacatcacctgtgcccctcctcaacattcattctacatctcactcattacgctcagtcagcatttatgcttagagctggaacagatagataaaatcaagtaaataattatagaccttatgttcctcccctacgaagggatctttcaagaacaaaactttatacaattataaaactttcaaattctcaggattccagagaatgctgtttctcaatgtatgtcatgggatggtaatagtggttaagtgaaaataaaacagtttccttagttaaaaaactggaggagagatgttgagtcaaggtgagacaaatgtcttttctgctggacttctcacagccatgatgatacttatgtgcactataaatctctaatactgtaacatttcccaaattcatataactctaagtatcattttgcacggaggaaatcctgggagtggcattttccagaaaacaatttagaaaacaccacataagattctatttattctattccctctgaggaggggctcatcagagcaaagtctcagatctctgtggtttgtccatggctgctgaaatctcaggagcctgaaggagaacaattgtatatttgggctcagcttcttgaagaagggctgcttggctgaaactgttaactctgggaggacacaatgaggctggttctgggaatgaaaaaaactggagactgaaaccaactgttgtcacaaggtgaaaggtaacatcgagagaaaaagcaagtcaatgaaagagataaaattcctttccttttcctcctgtctttctgtctcactcctctgctatcagcagaacctcacagaaatccttgtgtcagagaaaaaatgaaaagtacagagttccagcccaggcatcaagaaatagagtatagaggttggatatagagctgacagataattgcttactaactagcacagcttgcccctttgtttattcagtaccatacacacacttttgtatatattaatatttatactgtttcacagcaataagatgcaagtatccttcatacaaacaaatatgctctcatcatttgtccaaaaaggaggtatacaaaaatcccaacagttacagtatccatctctaggcaatcatcacatctatttctgagtgatgctatttactctttgacaaccacagtcccaccagaatattctgtttcctaaagactcaattacaaaatattgtattagtctgttcacatgctgctaataaaggcatatcatagactgagtaatttataaaggaaagagatttaattgactcacagtaccacatggctggagggcctcccaatcatggtggaagatcaagggacatcttccatggcagcaggcaagagagagcttgtgtaggggaactcgcctctataaaactgtcagatctcatgagatttactcactatcatgaaaacagcacaggaaagacctgcccccataattaaattacctcccaccaagtccctcccacaacacgtgggaattatgggagctacaattcaagaacagatttgggaggggacacagacaaactgtataaaatatctaagataaaaaaactttatataaaatagtaaggtgacagcaaaagggggataaaaaaatgagaccttttaatatatgcaaaggcaaatatatctaaatatctatttgacaattgtgcatatatagctttatctataaaaaggataatcagtgaagagtaagatttgtataggcgctatagtcttcatggctgtagttgatatttacaaattccttcttccactagccttttctcttagtatcttagctggttgaattgaagttctttacctggcagagttactgaagggtcttaatccatagtcttgtcagatccaggaagagggattcctttcactagcaagaaaatcttagaaattcttgagtggtaagattctcagtattaactgagtccactcagatgtcatcatacaagtttcagcctcattgttcttcacaattcaggtcctgaaattttcctaagtggcatagcaagtgcaagatttcaatttatattggaattctacaattagcacaaataaaatatgcatctgctttttaaagagaagacagtcctgcagctacaaaaactaagaaattattttggctgccataggagcgcttttgttcttttttcattcaaactgagaactaaaagtgccaaactcacacttctctgtctgtagattctccagtcagaagaggacatcccacccacagtttttgtagtcatcataactgctataataattaagtgtagaagacttagtgtcttttactgcactataataaactagaagtgattttaattaactgatgtgacttgatgtcatgaattactagtatctcatttcccatttgcaaggaagtcagtatttcattaaaagccatagacatgaccaaatatatcctagaatctcttggtatcaagtgcattcaagacagaaaaatagctaccgttcttaagactggggcacaagagaagaaaggagttgggattatcttcttgggggaagatccccaagaagctggggcccaaacctttaagaaagaagtaatggccgggggcctggtggctcacgcctgtaatcccatcactttgggaggctgaggtgggtggatcacgaggtcaagagatcgaaaccatcctggataacatagtgaaaccccgtctctactaaaaatacaaaaaattatccaggcatggtggcgggagcctgtagtcccagctacccgggaggctgaggcaggagaatggcgtgaacccgggaggcggagcttgcagtgagtcgagatggtgccactgcactctgggactgagcaagactccgtctcaaaaaaaaaaaaaaaaaaagagaaagaagtaatatctgtattagcctaatgaggctaatcctggaaatataataagaatttagagcccgaaacaactgctgctgccgggatggagggccattatcaggacggtcctcatgcaggaacagcattaggatgaatcaaagaagtcttttcttccctttttctcctgcctttttatctccctatcctgccttctattctcagaactgagtaggaagcatctgaaaaggagaaatgaaagctgtgcagatcagcaccagcattacaaagtaaactatagaagcacctataagagacaataccttaaacacaaacacaccctgagacctgaactatttgggcatccagtgtaaatcttttaaaatgcttccttaatggttgaatttcaggagccataatctgttgtaagagccatacaggagaagacacactttttgtcataaagtacttactggttaaaaattcatttccatatgctacatcaaatgaatttattatgtaaattccttagaacagtgtttgctatatgtaataattactgacaatatcatcatcattcatcctatatcctagcattaagcattgatacgcaattgatacaataaagattagaagcatttcgtgtcagatttgtgaaatatgtaatcatgaatgaacttgcttaaaataaaaatgagctaatacaaaaataaaacaactgctattataccagaaacaaagcaaagcaaaaacccaaatcactgctgaaatggttgagttgtgtgcaatgctagtaaccaaatgggtacattttaaagagcttctcacaaaatttcactatttgattatgtttcattgtttaataatgtccttagcccacaattttggcagtctagtgctttctgttccagaaaaatcgataacaattattgttttaaatcttccagaacctgggtttcattcatctttctgactgcatgtgttagtgagcatttgagtaaatactgagggaaaacctgagcatatttctccaattacataatgcttgtttgaatgggattcttcaaaactagactctttacatacagagtcagaaagataatatgcacatatctattcttagcatttcttaaattagattgctttcttttcagtgattacaaaataaattgacaagactatgttcttgcataacttctacatttttgttctaattgcacacattaaaatcccataattttgctactattctgggattatttcttcttcttgttttggtggtggtttattaacttgttttcaatgtctaaccttaacatttatccaaatgtttatgtagcaatccctcactttcatttgcagttcacttttcttaatttctcagaaaaccaattatgttatactcaggccagaatcttcccaactcttgccaccatctccaactgtagaacatagtcaaaataaataaaccaaaaaaaaaaaaaagaactgaaacacaagcattttattcacagtagtccctacatcctcattcaaagattactcactcatatattaaatctagttcagatagtttatttgtttcttagcccaaactggataagaggaataaaatataaagaaataggggggctttagaatcagagcagaagtagaaatgacagcgtatgagaagtagtaagacaaaagaatataaacatcaggttcaaaattatggactcatttttgcattgggggcatacagccctccattataaaagtaaaatggtgcagtcttaatggcctgatgccatcagtgcactgtaatagatcctcagtctggatcaggaaatccacagggaatcacttacttctcagggccttcaaccctatatctttatactttgggagtttgatttaatgacttccaaaatccttttagaatctaaatttatattattttataataattttataaagagttttcagtgacatttaaaatgtcagaatagtgacaccttttaaaatatttctactaaaattattaaagtcaatgaaagtagtttattcttaatgttaataaattaacttgtgatttagcatgtgtctgaaatttttccatgtttatatatattacttggtttaatctttacaacatttctatcaagtagattgcattgatgcatattgtacaaatgaggaaactgaggctcagatgggtggtgttaattgcataatatatcatggtcagaaaaggtccagaacttatttttttcttctagaaaactttgtactgtttccctaaatagcataggtaattttctgttttacagaggcccagacaactagaaattttctggttttcaaaattggacatgcagctgttgctattccaaccatggtcagtggttaggagcattgctcctgaccttggctatgtgcagctgtagattctgctgttgtactaggtggcccaagtttctgcagaaatattcaaatgattgaatgtgattcccactctaagccaccgctggacttcaataccctcttattactaagggcttgctgatatatggaaagtttttttctctctctttttcaatatgactatttacttatttattttttgaaaaagcatggtatttctatgtattttgagtaaagaagtatgcacatatattcacccatgacatcttgatcataagttattatctcctttcttcaagaagttatgcgagagtggaaataacacaaaagaggtaacatttcatagcagtgagcaagggctataaagatggtcttaaacacccaaatactttctaaatacgccatcttagacaagttacataaactctactaaccatggttttctcatctataaactagtgataataatattagattggtgcaaaaataattgcggttttttgccattaaaaataatggcaaaaaccgaaattacttttgcaccatcaattaatacttcttagcttattgggctgttgtgagaattaaatgaataaatatatataagtatataaaatagcctctgacatataacaagttggaaaaaaagttatacttcttagcttagtgggctgtcgtgagaattaaatgaataaatatatgtaagtatgtaaaatagcctctgacatataacatgttggaaaaaagttattatttgctgtgtcagaactacctcttattagcccagtgacaattagagatacctgaacactacacattgggatttatttttctttactgctctagtgcctaatgcagtatctggtatattatagatactccatgtttattttaaatacatctcatttactttctcaaagatttttttcatctctagtggacccaaaataccacttttgcctacttgaatgggttattacaactcatataatatgtttgcttttataaagcctgttgaggaatatatcattaagatacttgcctcacactttaaagacaaagagacagatcacatgacttgctcacagtcaacaaagaaggggagagccagaatttgaatccaagtctgtcttgtgtctgcactagaatgctttgttgcttttctcaattatcctatgcattacaaattcgtttgtgagaaggggcttagaatactgagaagcattacttgaacataaggcacttgtttatgttagcgaatttgtagcagtactctcttaagaacaaatttccctcattgaatcatgcaccctctttctgcttatgagtctattttagatattgagaagcaatatgtaggggagagtagatgaaggtggagtactcttgctattgccccacagacaatccaaatgggtctttatctagtatatgcactattcatactgtttcatctttctagtaattgtccatctactggctcttatctcattgttattatcaaaaacagatttagatcagaccattaggaaactcattagcaggtcacattggagaaaaaaactcactaacacatttgtaaaattatctatgaatttagtattgccatttatcaccagaatgcttcaatgtactaggttgaaaaataaggataccaaaactcctttattataattgcaaggattaaaatgtaaaatacagagattcttttatagtgcctgacacatattaagagctcaataaactatagcacattgggaatagcaattgagatgaagtatgtagtttttttaaaccaaagtacccatagataaatcaatgtcaaagaaagtgccacattcttcatatattaagcaaatattaaatagggaatcctttccccattgcttgtttttctcaggtttgtcaaagagcacatagttgtagttatgcagcgttatttctgagggctctgttctgttccattgatctatatctctgttttggtaccagtatcatgctgttttggttactgtagccatgtagtatagtttgaagtcaggtggcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgaagttctccttgaagaggtccttcacgtcccttgtaagttggattcctaggtattttattctctttgaagcaattgtgaatgggagttcactcatgatttggctctctgtttgcctgttattggtgtataagaatgcttgtgatttttgtacattgattttgcatcctgagactttgctgaagttgcttatcagcttaaggagattttgggctgagacaatggggttttctagatatacaatcacatcatctgcaaacagggacaatttgacctcctcttttcctaattgagtaccctttataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtccaaaacaccaaaagcaatggcaacaaaagccaatattgacaaatgggatctaattaaactaaagagcttctgcacagcaaaagaaactaccatcagagtcaacaggcaacctgcaaaatgggagaaaattttcacaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggctatcagagaaatgcaaatcaaaaccacaatgagataccatctcacaccagttaga

SEQ ID NO: 282 - DNA, 58904 bp, Homo sapiens
gatgaagtgacatgggaacgcagaggatagagacttgactttcttttgaaggatcaagtctttggagaaagtagaattcaggtggagccatgaaggatggatgggatttgaccaaaggaaataagggagcagagcattctaggagagacagcaggagctgaggccagaggtgcgcaaaggtgggcagagcttaaaccaggagaaagagttcggtgtggctgcagcacaggacacacatcaccatggaggtgaatgaatgttgtgggcatcaccctgatttccttatatctagatggcattttgcaatttcctatgttcttttatgtgcactatcacatttgattttcacaacaatcgtataagtaggcactagcagggattatcatacagttgagaaaactaagactcggcaagttaaggtgctctgccttaggggacgaaggagaatagcagaagaccaggatgagaactcagattttccaacaccctgaccaggacctttcccctaaaccatgcagtggcagggaggctgcgagagagcctaccccacagttattcccatactgtgtgtttgtgggtttttttgttggcttgctttcaggtttattcattgattgttcctgtgtaaaggcaccatgtggtggccattcctggatgctatggtgtgggtccttgtattcacaatagggagacttggggaacagtctctttccagaagttagctctgtaagtcttggatgtggcatcaaaggcacaaagccggcagcattgtgtcaccatgcagagcactgtgtggggtttgctgaccttgtcccctggtagtcaccctacaccaggatgatggagaggatgttggtcctgcagacagcaatgagtaactccttgggccactcaacacccagactgacgttatcattgcagtcccttatggtgacaatcactttgaacctgatccgccggccagccttgggctgcttttgcacaaacatgagcttcagaaccttgtccttgaggggcacccccaggaggaagtcagtgacctcaaactccttgatggacagagagaagagatagaccttcagggatttgatcttcatgtccttgacctggcaaggtgacttggtgatggagcaccactccttgtcttagatttgtgtccacaagatctggagtctcagtcttgatgctgaccatagccaagaacccagccacagctgagctgccagagcctccccattccagggccctaaggttctctggcatcatcagaaaactgtttgtgcatttttgtatcacaaaactgccatgcttggaattaattctgtgagcccacttcccttaggaaccccccctgagagtgcctgaaagatgggggattagacatctgagctattaggtactgggtaggctcatcagctttgtttgctatcccgtttggcaaatgagccagaaaccagagcatcactgagtgcattggaggtgagagctttcagaacggagaaggaagtgactcgaggtggctttgcaattgggtccttgaaaaatggcacctgctgggcaaagccgcacattcacttgaggccaggtctagaggtcagaccagaacaacagagggaaattccgagcttccctcaaccataggccggttttaaattctgacgcgttgccacatcacaagtcagatgggactgagggaaatgacctgagacgagaatgaaatcttctgggctgtcagcctgtggaggggtaggagacacctgcaggctcagtcctagatggctgcacctccagctagatcccaggtgtgactcgtaaggtccaaggtggctggagatgaccactgagcccatacccagagaacaaaggcatggtggtgctgactgttaagaggagttggcccagaaacattcagattttccattttctgtttgttttcttttatttaggagaggggaatgagtgagttatcaaattccctttatgtggaaccaggggagctaattttgtctaacctgagtgtggtaagtgaaagggagacccagaaggctcagagacaagggtcagcctgttgccttgggatcctgcctgccctagaactcctccttccttacctgggggggactctgaggcagctttactcagtgctggtgctaatccttgtccctgaaagccagcagcagcttccccactcctggctccagggccattcttttcagagaaaattcgggtgcttggctggcctcttctcctccccatgaaggtctgaggggcaatgaggggaacagttgggacagtttctgggaagcaggctccttgggccagtcaacatgttagtctgaggaaacctcttatttcagacaagggttaaagttggtttcatttctcattttggtctcagtaggtttctcagtcatgccggaggtgctgaaaggtgacagtgagaaggcctcgtgtgacacttctttttcatttgatttccaaatgtgtgaaatttggtacttttcctctttacccacaagagctttaattctgtgaaggggcagtgtgggctctgtcataacacctcttccccagctccccacctttcctccagagaaaaaggcagacaagtggggaaagctggggctagatggacaaaaacaaatgaatctactctcctggcccagaagccacggccgcacagatccagaatcgtttttctgaccctgtgatccattgagtaaggtgaagggagtaggaaaggaggagatgggcccagagtgaggaacctcatttacttaattgcccttacatagaggaaaccttcagcagcccctctgcctggactaactggccctgcccccagataagctcagggacatatgccactgggcttgtctgggtgggctgactgcaatgacaaacagccccaaatcttgatggcctaacatactacaatctaacatgggttggcaggaggctctgctccacacagtcattcatggacccaggccccttctgtcttgaggttccatcatcccttggggctttggcattctccactgaccatgtgtgtccaacatggtagatggaggaagagagggtgtgaaaggtcttatgggcccatcctggaggtggcctgtgttacttttctccacattaccttggccaccctaaacatcaagggaacctgggaatgtagtcttgatgtcttataggttgagttgtcactcaccagcaaaagatatcttgaaatcctaatttccagtacctcagaatgtgaccttatttggaaatatggtctttacagaataatcgagttaaaatgagatcgttaggtgggctctaatctgactgacatttttatacaaaagagaaatgtgggtgcagagggaagaccatgtgaagacaggcagaaggccacccacaagtccagggatgtctgaggctaccagaagctgggacagaggcaggcagagtctccctcatggttctcagatggaaccaactttgccaacactttgattccagacttctggcctccagaacgatgagacaacaaatttctgttgcttaagccacccagtttgtggaactttgttatggctgccccaggaaactaaaatacactatatgctcagatttgaggagcatccagccagctgtgctgtgcaatctccttgtctgaaagaaagagaataggtggctcttagcgcaatagctaccatcttcgctgataggtactttctggttctatgattcttgccaagcctctccacccatgactccctccctcccctgggttttctctcaccttctccccacttctgacactaatccctcctgggagagagcaagggagcccagtcatttctggctagagtccccatgtggagaagagagaggaactttgccgttctcatctcattttttttctcttctttggtccagagttgtacaaacccttccggcaccttcctaaatgaccttgagcaaaacccctgactcttgtgagacttagtttccctcccagtaaagtgggtgtgatcccactgagttctttctcaacagaaaaaccagttataaaaatgatgctataacacttcagaaaaacagcgtgctgcatccgcccacgagagcagtaatcactgtagctcaagaggttgtaaattctccacagctgactgttgggagctggacaggacccagcacctggtaaccttggctggcttggtaaatggggggcagtgatggtctaccacagaggaagggaccctttgccctggcagacctcctccccatctagacttgggggatctgactgtagccacctgagccaggaagtgatgttctgcaccagagcccctgggcattagcagctgtacttgctgcctggatgagacctggcacagctggtgcacccgcagcagggaagatagagggctgtggggaataacagtggtgttaacattgccatttactaggacttatttgtgccaggttctgggcaagtgctgcttctgatagtcagactatcctgcaaggtgataaatgtgggatggggagttagtgtgtgggtctgtgggggtttgcatccaggctctcctgggctgtctcaatacctaagtgcactggggatcagcatcctcatttgtaaaattggggtaaaaaatgggccgggcgcggtggctcacacctgtaattccaggtgtgggaggccaaggcaggcagatcatgaggtcaggagttcgagaccagctcagccaacatgatgaaaccccatctctactaaaaatacaaaaattagttgggcgtggtgacgggagcctgtaatcccagctacttgggaggctgaggcaggagaatcacttgaacctgggaggcggaggttgcagtgagccaagatcatgccattgtactttagcctgggtgacaagagcaagactccatctaaaaaaaaaaaaaatcccactctacaactcagggttgctcccagggcagggtctgagaagagaagcaggaggtggaggggtagagcccttacctaaagaggcatcctctcgtgatacccccctttgcccccaggacttgctggcagccaggttctcctggcagaaagtggattcctggcccactgctgaggtctctgccttctctcagcagcagatcttcagactgtctggcaagggccagcctgagggcgatggtgagcattagatgaaataacacatatacagctcctaaaacagtgcctggctcaaggcaaatgctcggtaaatattggttcttattactggacccattttataccaaggtttagtgctattaaggatacagagtaagtgactgagatggatttgactgtcagactctaaaaatctgtgtttaggtatgtgtatgcatgtgtgtttatatcaggttgaaaaaaatgctggctctttccttatttcatcactcagaagatgaatgtggtcttgaactttgggaagtaaatgagtttcttagggacatggagcttggaaagaaacctgaactatgcgtgcaagagatacctgtcctggccgggctcagtgactcatgcctgtaatcccagtactttgggaggctgaggtgggtggatcacttgaggcgaggagtttgagatcagcctggccaacatggtgaaaccctgtctctactaaaaatacaaacattagctgggcatggtggcataagcttgtaatcctagctgcttgggaagctgaggcacgagaatcacttgaacccgggaggcggacgttgcaaggagctgaaattgcgccactgcactccagactgggtgacagaccgagactctgtctcaaaaaaaaaattaaaaaaaagaagagacacctgtcttttctagcaattccctttccttccctctcctcctctccactctacaacctccctctcttttcctgcctctctctccctcctgcctcctctcaagtgaaagatctgtcctgggccgggcgcggtggctcacgcctgtaatcccagcactttgggaggctgaggcgggaggatcacaaggtcaggagttcgagaccagccaggccaacatggcaaaatcccatctctactaaaaatacaaaaattagctgggcgtggtggcaggtgcctgtaatcccagctactggggaggctgaggcaggagaatcacttgaacccaggaggcgaggttgcagtgtcgccactgcactccagccctggtgacaatatgagactctgtctcaaaaaaaaaaaaaaaaaatctgtcctgtccactgacctggtcttcctgctagggacaaggttttcctgttgaagacaaaagagggccgggtggcctgctctcaggtctgcctccttggcgaatgggccttacagcaccttttcctcaggagcacacatcagttgctcccattcctatttctgaagacaatctcaataccacattttcttagtggaagctgagggcaccccacgctagggtcactggagaagccttgggcctaagggtaaggagcaggacccggagctctgggctgtagagcgaggtgctcccggacaggctggctgagctgcagcctgcatcctctgtgctgccacaaattcagctgcctattgggggtgtcggcaccagctctcagggcaggtggacctgggatgaatgccctgtttgcttttatgggcaactcacttttcatacctgagcctcggtctcctcatccataaaattggcacaataacacttgtgcataatactggatgagatcagggtacaccaagcattcagcagctcctggcccaataagtagtagctattgtctttgttttcaagggtttttgcttgtttgtttgtttgagatggagtcttgctctgtcacccaggctggagagcagtggcatgatctctgctccctgcaacctccgtctcctgggttcaagcgattctcctgtctcagcctcccgagtagctgggattacaggtgttaacagtttaccaaacagtatgccatccattcaaatctctgctcttagggagctcatcctttcctctgctctaaggagcctgagtgagaggccctggtaacagcaaggggaaagaaggaaactgtattcccgagtccatactctgtcctagcatcacagcaaactcagaggtttttggacccccagatgttaagaggagggacaggccctgagcttcctaaataccctcatatgcccactgtcttcagctgggctctcccagaagcagatcctgagataaggatttaaggacaaattatttatttatttttcatttattttattttttgagacggagtttcactcttgttgcccaggctggagtgcaatggcatgatcttggctcactgcaacctccacctcccaggttcaagcgattctcctgcctcagcctcccgagtagctgggattacaggcatggaccaccacgcccggctaattttgtatttttagtagagatggggtttctccatgttggtcaggctggtctcgaactcccaacttcaggtgatccgcccaccttggcctcccaaagtgctgagattacagacggtgagccaccatgcccagccaaattgtttatgtgaggtgtgaccccggaagcactggtaccctactgtgggaaagtgggacaagtgaggaaatgaagccaacacagggtgcattactgagcaggtaactgctgtgggaagctgggctccatcgcacaggggacctctgggagactgtggtacacacctctggatggggtatttatccatccactcctgtccatccatggttgacagctgctcttaggggtacctaccctgcactggctgaatgcaaaaatgttctccaagtcagagaaagccccctggcagagaaaacatggccttataagtactgggggcatttgcttaccataatagtgcttacacaattataaatgactccaataattatttaatgtttccctcctgtattagaatataatctctctgaagatagggacagcatcaccaattgtatccccaggacctagaatggtgtctggcacatggtaggttttcgatagatacttgctgaatcaatgtaatctggaggctgacaaattcatgataaagaccccagttctgtctgaatagcttctctatctcttcctttctcctctctccaccctaaacttgatatagcagtgcctaaaactcacttccagtatcttttttaaaatttgccttcttctagagtataaaagcccagtatttaaccttgcccatggttgcctggaatagagggtgcttttcccaccctcctttgcagctagcagtgcctatgtgactaagttctgagcaagaggtgtggaattgatggctgccactttcaagatgtgtctttatgggtggaggtgcacccatctccttcccattcctccttcctgctggttggaatttggatatcgtggctggagcagccaccttggatcatgaggtggaaatcttggaccaaaggatggtggaagctagaagacccaggcaccctgatgatcagggagcagccactccaaccttgggctgaacctctggccttgctttacatgagagagcccttggttatgccattgttgtttggggtgggattttctgtcactcccaggtgaacaacctaatcctaagtgatacctagaaggtccctgctagactgacctcttgggaggggagggaataaacgagtctcaggtggtggaaccagagcttgctggagaggagagtctctcctggtgaatggaagccaggggcccctcccactggctgtctccttccctgggctcaggcaggtccagccttcctcaggactttgagaagttcagttctctccccaggagtagctactttcacaaacttcctgtccctttagtcgacatgccccacggcaggtccgaggctgggctctgccacaactcatctttcctaagagtggcatcaaggttctttggtgggggatcctcttttcccatccccacttctcaagagcattagggaagatacagtcagtgccctcttagcattctctttccacttgttgggtgtaagaagggaacctgagggccctgcagtgtttaggggtgggagtggaaacagacaggaaagatccagagtccccaagaagcgaagcagggagagagataaagaaggcaggaacaaccatggacacacattatcacacatacacaggttacaagagcaggaggctggagctgcaagaggtggcagggaagcttccagaaaggcagaccccagcctcatccctccctgccctgcaatgctgaagtttccaggtagaggggaacctctagacccttgcgactgtcagagttctgtggatccatttgtcagtctccccacccccaaccttgactatcctgggcctgccttcaggacagaacatgggaatgagaagaggacctgggaaggggtaatcctgggaaaaaaaagttcttattagtcacccctggctctgaggatactttccaggagtggcctgccaagccgtgtgaccttggacaagtcccgtccattcctcaggcctcagtttcctttgagggaccctgaatgggcgggggttgctgtagctttcctcagctgggagacccgggaggaggtccggggtgccagggtgggaggagggcctggcttgtcgctgaaagccggccaggcgcactgtcggcgctcagagctggtggccgcctcctgcgcttcctgattcccagccgcgctcgctcggagagcagtgcccgctatctcctggcccgggaccggcagaggggtgcggcggggcgggcccaggggtctctggcggccggaagaaccgggaccctgccaggcccctcccgcgggcagggcggcccctcgccggctcctcccccaccgcccgccaccagcccgggatcagtctccgcacgcggttccgcaggtggcagcgatggcccagtcctgaactccccgccatggccggcgcccccggcccgctgcgccttgcgctgctgctgctcgggatggtgggcagggccggcccccgcccccaggtgagatccagggaccccgacgacaccgggggaggcgggtggctctgcgggctgcaggcgcagtgtcctggtggagggccccgggacttgaacgaaactccgagaccgctggcgggggcatccgaaagcctcggggggagtagggactggagacttggtgcccctgggctggaaggcccaggtgagggcttggactacagaggattccccccaaccccagcgaggcgccctcttcctcgccacccgggtccctctgcccgggcacccgctgccccgcggccgccctgcgctgacttctgctccgcttctcctttgtccccagcactttcccaactccttctaaaccgtgtcagcggccctggcacagcccggcatcctcccggactccctctgccccacagtctgacccagacccctctcccgcagtgcctccccagacaatccacctgctcaaagaccctgagaagaccctgggaggagctgagagggccagggtgcggagacccggctcctctccctttctcatcagcccccagcacagcctttgattcatggctcctggggccctgcggtggcagcttgtccttcccagtgacctcccagatggaacctaccccccgtcccctaccagcctctgtagcaaacaggcagaaggctcagtgcccccctggaagcagccaggcgcccccactcacccactctgctgacctcccattctcatcctgcactgacagcaggccccaagagaaggcatactgggacacgcaagaacacctgggctccttggtgccaccagagagcaggccacaggtggaccaccgcagcccctctctcttgcccttgttgcttttcctgccctgggatcctgggctagggacagtggtcagctgcttttgaagaggggagctgtccaaagatgctgggacttgcttgagcagagaggagacatagacttgggtggcctgtcctgggtcaggaaacaggttcttcctatcacctcccactgctacccccagacctaaagaactgagatctgtggggagtggacctgaacgaaccttgaagtttgtcccagaaccattgccttggtgagggcagactccacctcggcggaaaccccagatgtggacagacatacctctcagctaagatgccagcacatttttcagcccccagattattttccagacgcatcctctccctgcccctgttccccagcccagctgctgtcctgagccccaggagacaacctcccccttccaagacaccttcctcacagcgcccccagccaggccttggttttcctggtgcggctgggatctttcaggggccagggctgcagacccaagatgtggttcttgcccatcgttccctcctcttacggactgggttgggataggggtggaggctctgcttcctggttccatcctcctccaggccaggtttacaggtctggtttgaatgaagggaagaaagcaaagggaagaggaaagtttctgtgagctgtcttcccagaggccttattcccagaagtgtcaggctcctgaacccacactttcctctgatccgattttactccttagccccaggcctaaggcaaaagctgggcatcctgggggcataacaggattggggtggtagagaaggataggaggggacaggtcctagcagggaggggagctttgagggggtgctcttgtcatgggaaactgagctgccacagagatctgagtcacaggaggtgttaaggatagattgcaacaattatgacacaacatcatgcgtgcttataagactaaaaaatagtgtattttgcattttgttttctgtctatgaagtcaaaagggttagagttactcccctcatgttgctgatgggggaatgaaagctcagaaaaagagggtcccctgtataaagtagcccagcagttcaggagcagggaagagaaaggggtgaagggctgggctcttgacctaacacctcctactcagacgggactgaagggagacctctgagagtgagctgctcactgtcaggtctcgtgaggctggaaacagcatccctgcaggtagggggatggctgagttgacttctgaagaaggtgccctaggctactctttcattgctgctgggaaggctcattcccctaccctggtccttacctctccaataccctggtgagggagcgggcctactgaggagacaggcaagcctttgacactcaaagttaaaatcagacacaactggattcaaatatagggtctgctattagctggtgatctggagttggacacttggttatccccaatacatgtccttatctgtaaataaggatcataagctctatcacatagggttatggaggggattgagacactggcccctgaaatggcaactttagtcactttagtcaaatggcagaactgacccatttgtccttggggatccagaagtgttttccagggctgcaggatagtatgagagaggggctgttggagaccctgggtctctgtactctagtgaatggcaggtggagtccagggctgagccttgatcagtgcggacattgttctaagctgggtttcctcctggacaggacccaggctgggggctggggcaggagcaaccaagaaaccacatcctgccctcgaatgccttgcaccaaggcaaaacaggcttcctcagctgcagcctgcccctaggaaaattcctatgtgtgtgtggtggtggtggtggttggaggaggggacagagatacagacaggtagtctgagacagaccagggggagaagggagtaggctatatgaacccccagttcccaggtatgtgtgagtgaccctgtgtgtaacagtctgtgtgggaatgagtccctgtgtgtgcaacatctcagcatgcaactgtacatctgacagtgtctatgtttttgtgaccctgcatatgatactgtgtctgtgggagggtctgtgtgtgtgtgtgggggggggggcatcttggtgtgtgaatgggtgtcaactagtgtgtgtctatatgtgcaggagagatagtgtgcatgtgagagtgtctgtgtgttcctctgtgtgtgtgtgttggggacagtgtctcagcatgcgactgtgtacctggcagtctgtgagtgattgtgtgtggtgggagagagtctgtgtcagtgtctcagtattgggaatgtgcttgggggcgtgtgtgatgatgcgtgtgaccgtgtgtccacgtgggggtttttgtgactgtaagaacatgtgtgtagtattccttttcctgtcctttcgttcagatatctaaagcccttagggaaaaaaaatggattgtaagctctgagcttttgaaaaaaaagaaagaaagaaagaaaaacaaggggcggtcaaagagacaggggtctgttgatggaaggggtgatttgacttctgggaggtgacacagaggaaggaggttggggtcctgggaggagatgccagggaacctgaagggctggacttagttgggggactccagaaatttgagttggaatccctccttcctccttctgagaggccttcctgcatgtctcccacctctgtgccacctccttcccgtcaccaaaatggtccccagagaaagaaagaatctgatacacttattcgcactgagaaataggagtgcctttcagattggcagccagtgtttggagagggagccccttcctggggtgttggaaagcccaccaccccgggggcttccactccacctgcttccttctctgctgtccttccttccaacgctgcctgcttgtacagggcttgagaagtcacaaagattttcacctgctttatcttgttggatctgtgcagtttgagaagaatgatatgcccattttatggacggcagaactggcaactgatgaggaaactgaggtcctaaaagataaatcgtgtcccacagtcctgcattaacagagctgggatttagaccaagaacttataaatcgctgtccagtgctccttcctgtagaccacaccactccctcctggtgtcctctttcctgtctcctgcttcctccaaaaactcctgaatctgagggatgccccttccttcttgtaacctccaacccaggtgtcgtctccacgtgccttcatccacctcagagagatcccatgaagcctgtcaagtcttgattctagaaactgccatcctgcccttcccatggccctttagaccccctctgaccgctgctttgctctcctggtcagctctgctgccttgtgagggacagggacatctggattgcatccttcccgctacccagaacccacagccccaccttgtcaggcttgcagcagggacttatgttgtgggaggatgaaatggaggagtgggggacactggtgggcagggccttgcccctcctcacagggcatggggtccaaagcttcctccctgcttcactttgccattggctgtggttactgctggaagatctcacaaattaagcagaatgattggtcattggacatgaacatatattcatttcctctttctgggaatatgttgatcctagaagtgaggaaggggtggggccccagtccccaggaagcctggtcactccctcccactctgccctttccactaaacagtagaaatcatggggattgctgccattgactgagccttctccatgtgcccaccatcctaagcattaactcagtccccacagccatcccatgggggaggggctgctgttcccttttgcacaagtgtaagctgagcctaaaacatacaactcttgcactcggttgcaaacctaatatctgggtgacccaggtccaggcccagatctgagcccaaggccagggttgttcagcctccactatgttacctgggcacccaggccctatggcactgggtggccctagcctcatttactcagtctttccccagaccagaacctcccatctgtcccagggcccaccaccactctctccctgccccaaaaaatcctcctgataacagtccacagctctcctctgctctccggagcactgatgtccccacctttgtaccttttccctgctgtgccctcctgctgaagtgcccgccctcctccttgctagcccagtctgcctccaacccccttcaccccagccccacctcacagtccccaatccctcaggcctcttgagtctgcactgaaccctgccccaaccactccctgaacactttcacccactgccttccctgttatgtcacttgtcctgtaaagcattgacccccgagtagcctgaagactctctcaggcagggctcctgcagtcacctttatactccctgcattcccctccacccacgaccacccagaacctggcacagttatggtttctgtaaatacgaggcgtgggagaggccagaagtctgggtagtttgcactgtgtgtgcctgcaggggtgggatgaaggctcgaaggtatttagaagccctgatctggtgtagggaggggacaagatactcttactgtcaggaatccctcacctaagggggagccacagccccatcctcaggaagctccagtctgaggggagacacagccccgtcctcagggagccccagtctgaatatagttttatgtccacagctctgctcagagtaggtgacagcgctgccctggggtgcaggaggccagattggccttcatggcgctgtcgttaacccctccccccgcctctgggaagaactggcttccatacctctctgcctgccccagacacaccttctgccccagttcccagcagtgaccttgtgtgtggtctgctttcattctagaaacagaaaccaagggggatttctccgtctctctgccctccacccccagcagctgctgcatttaggggcagcatggaagagccctttacccggagaagagggaagaagtgagaagggaaacggggcggtgggggttgatccaccaggacttgctctgatgaaaactgtgccacctcctcagctgtggctaatatcatggacaacacctttgcagctgttatgtttgatttcttgttctttttttccccaagcaaatacagttgacctttgccctcagaagagctctgtccttcagggtagcccctgccgccttggcacacttatgccaaggatgctgctggggcttaaagtgagctgggcccttccatggggcctccgaggcagcaaggggtgagcaaggcaacccaagtctctcagggaggtgtgtgataagccagctagaacccgagactggatccagcatgtgcccagcacgctacaaggcaagggggcaagcttctaaaaagaagctattttaatttcagcacacgtggacatttttgtgatttcaaaaagcaaaatgttgttttaaattatgtatgggtcctacattttatacatggggctcttgggtcatttcagcatctgcagcctctgaaggacgaatatttataatttttaaggctgttcaggaaaaaactaaaaagaacgacaaccccaagacatagctgaaggaagtgcacaaaaacactcagaaggaatggtggattctcagtgggatgggtctgtttgggtctgtgtgctgaaaagccatttcggtgacctcactggaagtggaggctcagctctccctactcacaggtgagagggatccctcccattgcacgtgtgacttcagtgttctggaacctccctgaccccttcacctcatgtcctcaggactcttcctttgggtggatagaagctgggttgaatattagatttggttgctgtgtcagaggggagcacggggagggggtggggggtgctgtgttgagtgcatctgtaagtgagtgcgttttggaggaggaatgctaatggcagacatcccagctctttgtagccctgaacgccactactctccccggcccccgcacaccttgcgatattctaccatggtcactgatctgaaggactccagattctagccttaactctgcttcctgggggggctgtgcacccttgattcagttcctctcccactctggcctgtgtgtcttcttctagaatggttgaaagtgcaagaagccctcaggcaggctgactaggcgccagaaggagcttagagtcctgggccctcagaaagtctctctcctaagtgagatcagagatcacaaatgagacacacacgctcctttcctccttcacccacccacctccccaaaagcatcaatttagcagacatttgctgggtgctcgtgacacatcaagctatgcaccctgggaggaatgaagatgtcaaaccatccacctggggcccctgggtggcagtgacttattctcactctctttcagaggtggctgatgcctggcagaatttggggctttgaggtttcatggagattgagaaaccaagtgtgttagggggtgagggggcaggagaggggctggctgaacccacaggcctcccatatatgccctccccccagggtgccactgtgtccctctgggagacggtgcagaaatggcgagaataccgacgccagtgccagcgctccctgactgaggatccacctcctgccacaggtgagtccatgtaggctccccacctttagtgctccccacccaaccaacttctggaggactttgatgaactcaatgtccatggctgggagccatttgcctctataggatgccacccctgccctctgccttcatctcattgtccaagctactccttcacctggataccttcctttctgccgaccaaaatcttccttttcttcaaagtccgcggaagcactgcctcctccagaaaatcttccccaggacttctgccatcatttggcccttactcgtttgctgtagtctgctttggggttgctgtcttatttctgtcttagctgtcttatctgtgtgtccttccctgcaccgccggccagccccccagctagagcctctcagagcaggcacccggcctttccatttttgtcctcagcacctcccagcctgtgcatggactgagggctccacaaacatatttataggaataaatgtttcagggagttcacaaggtggtttaaagagcacgggattggagcccgctgggcctaggttgaaatcctgactgtaattataacacgtgacctaaagaaggttatcttaagtgagatcagaaggaaggtaagctaacatttccctctaatctgtgaagtgcaatttaagaataggcccatagggatttttcattgagcacgtactatgttccattatctatgtagcatatagtcttgatcccacaaaaccctatggggctggaaatactcctgttttacagatcaggaaacagacattaagttacttgctcaaggtcctgccactgataagtggcaagtgcccctgcttggctcttgctgggtggggaaagtgcttggcatacagtaagcattcagcagaggttagtggcatgcagcctccgaggaggggaggggtcttggggaagggagggaaagggccatggccagtcacaagcagggactcagagactgttctttctgctcccagacttgttctgcaaccggaccttcgatgaatacgcctgctggccagatggggagccaggctcgttcgtgaatgtcagctgcccctggtacctgccctgggccagcagtggtgagccccctccccgacctggtacctgccctgggccagcagtggtgaaccccctccccgacctggtatctgccctgggccagcagtggtgagccccctccccgacctgatacctgccctgggccagcagtggtgagccccctccctgacctggtacctgccctgggccagcagtggtgagccccctccctaacctggtacctgccgtgggtcagcagtggtgagccccctccctaacctggtacctgccgtgggtcagcagtggtgagccccctccctgacctggtacctgccctgggtcagcagtggtgagctccctcccccaccgtcccctgtatcgaggaggctgaggtcaaggcgctgcttcctttcctctgagacacagccctccccacccagaatgtctttaggcctcctagtgagtggtccgcctgcctttcctggggtgaggggagcagtcagtagtgataagtttcatgatggcctgaggtaccacctgggtctgggcgtgaggccagtgctggccagtgtgtggggaagggaaagtaagtgtctgaagagaaatgcgaccccttccaattcagtagtcaggaaaagagctgggtggggacagactcttgcggggagggaagctacccagggtgtctgctgtgtgtatacatgtatgtatgatatgtgtatgcaggtggcccatacctggcagtgacatttagctacttcctcactctttagaggttcactgggagaagtgatcagggcattggtggggtgacgaaccccaccagactcagccctcctcagctcactcctgcctgcaagggggaccttgtactggggaagatgtgactgggtaggtgggaaggtcatttcattgggggtacagagatttgcagaggctgcaagaggatccctgactggagggttagttaatgtgccccgctatctatcccagcctcccttgctgagcccagtttcacccaggcaccgtggaggataacaggagacaagcaccctcatggcaaggagctcccagtctccataaggggagaaaagatatttccctatcatcatcatcatcatcatcatcatcaccatcaccatcatcatcgtcatcatagccagcatttattgagtacctactgtgtgccaagtcctgccctaaaagcagggctttataactaccctgtggttatacctgctgtacagatgaggaaactgaagcacaaaaagtttaagtcacttgttccaaatgatgtggtcaatggcagagccaggatttgaatccaattcgtgctcctatcatcacaccttgaaggggctggagcccaagcagcaactggcccagaaacaagtgcgggcatgaggttatgctctggggaagccaggtgtcttcctggaggaggtggcctggtggggcccaatgtaagcttcaccttggcacgtgggactgaagtcagatgaggcccaggctggtctcctaaaagtactgtctccttgtccacactcacagtacactcacctctccccaaggagcagggagagcctgggcctagaaggaggcaggagcctgggcccatcagtggcctgccttctccaatactgcctgttggaagcactttccgtgctacactcttttcatcctcacaaccctctgaggcaagtactctgattaccctcccattttcagatggggaaactaaggcacagaggtgctcagtgacttttgcaagctcacacagccattagtgggcgacccagaagcttggtttagagtcagtgtggctaattgctacaccaaagtcttccttgggggtgtgtgtgtgtgcccttgcatgtggctctggcctggagacaggtgagtgatctggatgccctctgctgtctgggcacacctctagggacaggggtgagctgtctgccctctcctatgaactctgcaatctggtggttctgctgactagccgtgtaagcaggagcaagttgccagacctctctgtgccttggttgactcatctgggagatggtatagagccaagtgacatgggtgtcgggaggaccacagggccttgagaaatggtagctgttaatttttcccacctccctacatacctccctgacttcctgcaatacacacactttctctgcctcccatagatttgagactggcagcttggccagcgtctgctgggcctctagaccccagggagccaggcgtaggacagggcccatcactcagcactaagccacccccagctctgcctgccgcttgcagctccatccatcacctttaattttatttgagcaggaaataggtcctggtggtgcccgtttatgagcaaacatggttttattgctttctccatgaagataacggccactgcacaggccccctgccagcctttccccaaccccgtccccctgccactcaccaggctaatttactcccttttttgacacttggaatcaccgactctgctgccctctcctcactccctgagttacggatgctcagagacaactaccacaggctcaagctgcgtaattgctgcctctggcctgtcctggagctttccttggcaaaggttggcagcggaggcttccctgacccccacccaggtgtgtgggagcagttctgaagaaggggacagttctggagctttcttgggctgatcaagcgagtagcctgtggagaaacgtcacagtgtgccctggtgtcaaggagaaggaagggagttatctcaggcagggtcctggcagaaaacatgctcagttggcaatttggagagaatttaatgttggggaggggtcattttcagaggctggcaaggtaaagggaccaatgaggcatataaagcaccagggactacaacaatggaaagcttgagcacccctagacctgagaaggaagggacaagaatggggctggggggtccccatgacagctgggctacaatggagaagccacccagcagggctgtggccacagaggggacaaagtcacaggcagacttcaaatcaaggcagggagggagcaggggagaacacccagcctctctctccctctgcccttccatcttctgccaatgcctcccactggcccaacccaacagaggccagggaagccgaggggtgctgtcccatggctcaggcttctagagttcagaatggagcagaggagtggtgatctgagaaacagcaaaagtcaaaacaatcaccagacccctgagctgggttgtgttaggagctagggatgccactgagaccttagaggtgtgtgagtgtgtgcattggggagaaggggtaacccccctccatggagctgaaggtcggctcagcagcccaggcagtggtactgagggaggccagagccaccccttctgccaggagtgtggcggcattaggaaggcttccagggacaggtgacactggggccagacgtgaaagaacaggcagatgcagaagggaaaaggaagctcctccaaggaatgagggttccaggcagcaccctggacatggggccaggccacgggcctcggaactacgcagtgtcctggagaagccagccaagcccttgaattctgacccctctaattgagaacttgggtctcaggattgtgcagagagagcaggagcagatgagtcaaagacagaagatattcaaaggaaatggctggtacaaacgagactgggaggagaaggctgaagtggcttcagagagcctgttggccgcccgagggcccttcagcagcctcgtttacccacaaacagctgatctgcttgttacaaatcattccagcctcattagctacacctcctcctgatccctacctgtttgttagcttagttctaattatatgagagtcataaaatgctttaaaaataacctataactcacagttcttggaaactctggcgggtgcctcccctgagtaatgtggagcctgggggtttttacgacagcctggggttgccaaggggaaactgaggcccaagcttgtccccagaggagttctggctgaagtggtgtcacaagctccatctccagcctcagtgaaggagtgccccttcaagaaaccggcatgggggaggatgtttcaaaggtctactatgtaccgggcacttcacatgctttatcttctgggaagtcattatgcttcccattttacagataaggaaactgaggcctgaggatgtgaagggacatgctcaacatcccacagctggttgaaggcagaaccaggatttgaacttgagtctgtgttgttcagaacctgagctccttctcctaagccctgatgctctacagtacccttcaccctggccttgagctgatgccttcatttcgagcctggcctttgaccctcacctcactcccttggggaggccctgtgcctggcctctctgagtctcagcttctgcatctgtaaaatgggggcccagtagtccttgctggccacctcgttgccagggtgcaggagctaatggattcatgagcagctctccacagccctgagtgccagcatccacgtggaagggcggctgttagcttgattacaggcgccgcagcagcttccgggaggggaagtgtttaattgggggttttatttccagcagcagggtctggcttaatgaaatatccctgggcctcctggcatgtggctgccctgctgcctccctgtgttgacaagccttgagccaaatccctggctgtgatttaccagctcctcccaagtcagataaagctgggttgataagtagggctatgccctgacccaccccacctccagccaaggtgggcatctggggatcatgggcccagccaggaaccagcctggcttttaatatttgatgttaatgaagggtaattgacagatgcacttgcacaggctcactgagcgagggacacagtgatcctttgactctgtgctagtaatgcacacatctgtgcacacaccacctccccaccctcccaactggctctgaacagagggagcaggaatggtgcagcggccgggggtccacactggcaagggggcctgctgggaggagactgaatgttgagaaatctgagcccagaggaagggcagaggagaatggcacatgccacattctttcctattaacagcaagtttggctgctaacttgggacctccggaggcaaagagctggcggattttagtcttgactctgctactttctagttgatgatcttaggcaagttgtttggcttctcagaggctcagtttcttcatatgtacaatgggactaactgttcctaccttgaaaggtggttctaatgtccaaaggtgtcaggtgtacagtaggtgttcaaaaactgattctgtgaaggcacagcctatggaaagagcaagtaaggagcatgttgtgaaggaatctgcaacaaggcagtgcctactgtatgccaggccctgtgccagctgtgggaagtgcatcttactagcatcacacggttgcaggctgagtcctgggtatgcgggtctttagatggtttgtgtgcctgtggttccatggctgtgtcttcttttctctggtccctcaaccttcttcctttctccccatttcctcccatcaaagcaggctgctagtgcaggctctgacaccatctcattccgcatggagtcagctcaggtccccatcactgcttttgggggtatctacaggaaaacactgattttgcctcacgtcagaagacttggccccagtgaagaatctcaggcatccatgcagcagataagagaggcatttgtgggcttgagaggggcccttcgcgttgctaaaatcagaccacgtgcctccccttctctgccgttgggggtacacctgattttgttcataaatgcgttcgaagggtattggaacaccatcgttcccactgctgtcagtttcaccattagattttcaggtttttgtttttctcccaggtgaagtatcttttaaaatgcaggttcttccagaaggagtcatgctgcaagctgacttgccccactgtgttaccagataatttctgtgtcttgaagggggacctggttcagggtttgtttgggaaaggagctgggaaggaggagaagaaagagcagggaggctgtcctggtgtctgggatcagggttaggggagggcaaggtccattggcaggccttgctgacagtgctggaagaggctgtcaccagactctgcagtaaagttgtccctgccacattttttgctagggtgaaaaatagaactcccagactagatggttgcccctgtcctgcacccctgagggtcaggccctggggctgccacagtccccatcgtgtacacacacacacacacacacagacacataacacacacacacacacacacacacacacacacacaccccacattaatgaagcctcttctcaggagactcagttctttttttttttttttttttgaggcagagtctcactctgtcgcctaggctggagtagttagtggcttgatcttaactcactacaacctcctcctcccaagttcaagtgattttcgtgcctcagcttcctgagtagctgggactacaggcgcacgccaccatgcctggctaattttttgtatttttagtagagatggggtttcaccatgttgcccaggctggtctcgaactcttgagctcaggcaatccacctgcctcggcctcccagagtgctaggattacaggcatgagccaccacacccagccgagacccagttctgactgctgtctctccacatgaacactgagcagccactgcccccagtgggcctctggtgccttctccattctctggccttcactccctccttcctcccacagctgggaaaactggtctttaaaatcttctagtcttttagaatgttgaactcttttaaagtttgtcctggctgcagcttctctccttggtccccctgttcttcctacaggtcaatatccccccaccctctcattgtgcccttttgtcccaagttcattggccctggtgtcaaacttaagttcccctacagagaggccaggaatgaaccatttcctcctggacacaagtaagcagtggcctctatcagcctcacatcaaacctgaggccacaggccagccatctccctggtaggtggacatggggcatggtgggggacagcctctgctgggatgtgaatgggcacaggcaatgccccgccttgcctctgcagggcctgtgtttgatctctgttagtttccatctatgctcttcctttctcaggtcttttttgttttttctgtgtgagtcttgattctctgaagacagggacggtgccaccatcctcagacaggggagctccctgaggacgggggctggatccctttcctctctccaagggctatctccatttccaacctataattagagtctatgtgaaggtaggagctgggtattccctttttctatgggggatctccaaaggccaaggctgcatacgaccaagaggccgtgtactccttttagaccagggggtccttgcaggtaggtctgtgtctcctccatcagattagaacttcttatgggcagggctgtgtctctctctctctcagatcagtgctctgtcttccttcccttctcttgggaactcagtgccaaccttgttcccagggtctgctctccccaaggagtgtgggagggaggtgggcactgagtcctaaaaatcagaaatagcgagtgactgcggggcaggcacggctgctgctggtcggtgccagaccttgtcagtagtgtgatttgaggctggaggcagggacatggaactgagctaaactcctgtcatctcaaaggcatgaattcattaaactgtgtcctagggttgccgagaggcagggctgagggtggagctgaggagcccctgccttggtggccccctgtcttgtccctggaccaacagcgtatatgtcaggggaggaaggtccaggtgtgtgtgtgtgtgtttgtgtgtaaagaagggaaaaggatgtcactaactcagagtagtccattctgggggagcagggatagccctcagaatggggaggaaggggagcatctagcactgggcaggctgccctattctgggctgaggctcagggccaggtctccccaccccagtgccgcagggccacgtgtaccggttctgcacagctgaaggcctctggctgcagaaggacaactccagcctgccctggagggacttgtcggagtgcgaggagtccaagcgaggggaaagagtgagttgaggcggggttctgagccagggagcggggagccatgtcttggagcacttcactggagcaaagacccttggctttgatgggggcatctgtggtcatttcatccatctccttgcctctgggggctttgcacaccatgctttctggacaaaggtggtgtgtattcacctctctggccttggaacagggcccaagatatccaagaaccatcgccgtaggttacggttattctctttcttggtcttggtatccccggtgagtcctgacttggggccccagctctgtctctgtgccatgggaaggaagattgtgggaagagggccatgggctgcccatgtacacgtatgtcccccgtgtgccacagagctccccggaggagcagctcctgttcctctacatcatctacacggtgggctacgcactctccttctctgctctggttatcgcctctgcgatcctcctcggcttcaggtaaggtggcccggaccctgggagggggctgcttcatcctaactcccccagatagaggaatgaagcagcccaacaccaaatcaaagcaacagtgcagcacattcgtccttctctcaagagctctctacagagccctgaccgtagaatatgaggttgaaaacacaggatgtgatactgtgttcttggtctagtctccacggtgtaaaagtgtgcgtatgtactgcaaaaaagaacaaaaataccacgcaagcaccaccaacctcaaaaccttaaccgtcggtgatgggattacggaaaatcccaggagatcttctccaatgaacatgtgtaactttaataatcaagaattcagtatgattttagaaaagatcttggggattagagatcttcctccctttggagcttttcagccccagtggaaaagttcctccttagatctaacctagatgagacgttccttccaaactaggagctgggaacagagtaccaggttcttcccactcctctgcacttggagaaggggggccagggggactgggttcaaagagggaagggattctgagagaatgagacctcaggacaccaggcagcaagagcaggagaggtggcattccctctcctaccttcaaagcacctggcacagtcctgggcacacggtgctcaataaatgcattcactcaatgaatattctcctcttttattatgaattattccagtgattcaaaaatgcaatgactgatactatgatcactcatgcacacaccatccagcctaagaaataacatgtcccatagttacacttctctgggtaaccctctctgatcccatccctctccctgccctacacccatcagaggtaagccctgaatgtgcctcttttaattccgacacatttccttgtacttttaccacatttgtgagtagctatagaaatatatagcaaggttctgtgtatttttaatagtgtattgaacatatttgtcttagtcttttcctgctgctatagcaaaataccttagactgggtaatttctaaataacagaaatatattcctcacaattctgaaggctgtgaagtccaagatcaaggcaccagcagattccatgtctagtaagttcttgtcctctctttccaagatggcaccttctcactgtgtcctcacatggcagaggggcaaatgggtgaaaagctctcacaaacaccctcaggtctcttataaggtactaatcccattcgtgagggcagagccttcatcaaccttatcacctaaaggcttcaccttttcatactattgccttggggactaagtttcaacatgaattttggagtgacacaacattcaaaccatagcattctgcccctggcccccccaaattcctgtcctcctcacatacaaaatacattcatttaatcccaatggctccaaagtcttaattcatcccagcattaactttaaagtctaagtccaaagtctcatctaaatattatttaaatcaggtatgtgtgagactcaagggatgattcctcctgaaggaaatttctctctagctgtgaacttatgaaatcactgaagttatgtgcttccaaaatgaaatgttgtggcaggcattctcatttcataggacagacattcccatttcaaaagggagcaataggtctgcatgtggtggctcatgcctataatcctagctaattgagaggcgaaagtgggaagcctgcttgaggccagagattggagaccagcctgaccgatgtaagagaccattaaataaatacaattgtttatttttttatctggaaaaaaataaagaattaaaattcaaataaaaaaagagagaaataggaaggaagaaaggggtaactggtcccaagtaaatccagacttaatgggacaaacaacattaaatcttaaagcttgagaataatcttctttgactcagtgtcctgccttcctgatatggaggtgggagttgggtccccaagtctccccgaagccccactcgcacagctttgctgggttcagctcatgtggcagctctcacaggctggagttgtgtgctggtggctctaccagtctggggtcttggaggagaatcttgccccccatgactctgctagtcattgccctagtcaggactctctgtagcggccccacacctgtgccttaactactatagatttattagaaacctccactctgcctgggccctgaggctctccaggatatcctttgaaatctaggtcttcctggatttcaaagaagtaactatgttccctacagctcgtgcactctgtgtgtctgtagagttagcaccacgtgaacactgccgaggtttactgctacgtcctccagagggacggcctgagttatacctgggcccacttgagccgcagctagggtagccaaggagcactgcacccaagtgtagggagcagagacaggaggtggccctgggcagtgacttccaatgcctcacagtgtcctgggctcctcccccagaactgttctgctctcaagaccctgacatctggacctgaaagatctctgaagtgcattcagggtcattcttccattttctacccatactaattttattaaatgttcacttggccacacccttggtattgtctcctgaacatgcttttgcattctttacaatatggtcagactgaaaattttccaaatctttaagttctccttctcttttgattataaatttcatctttcatttctctcttctcatattttgctataagcagtcaagggcagccatgctgtaccctcaatactttgcttagagatttcttccaccaaatattctatttcattgctcataagtctttgctcccatgaaacacttggacatagacacaattcagccaagttatttgccactttgtaacaaaaagatggcatttcctctggtctccaatgccatgctcctcatttctatctcagacctcatcagaatggcctttactgttcatatttctaccattattatgttcacaaccacttagataatctctgtgaagattgaaatttttggccgggcgcagtggctcacgcctgtaatcccagcactttgggaggccgaggcaggtggatcatgcggtcaggagatcgagaccatcctggctagcatggtgaaaccccgtctctactaaaaatacaaaaaattagctgggtgcggtggcgggcgcctgtagtcccagctactcgggaggctgaggcaggagaatggcgtgaacctgggaggcggagtgagcagagcagtgagcagagatcgtgccactgcactccagcctgggcgacagagtgagactctgtctcaaaaaaaaaaaaaaagactgaaattttctacatagctctcatcttcttctgagctctcaccagaatcaccttgtatggcccatttgtggaaatatagacttttttctatcccaccacccagttcccaagctactgctacatttttaggtatttgttacatgactccccactctcggtaccaatttctatcttagtctgtgcctgctgttataacaaaataccttagactgggtaatttttgaaaaatagaaatttatttctcataatttagagggtgggaagcccaagatcaaggcaccagtgggtttgatgtctagtaagggcttgctctctgcttctgagatggtgtcttctcactgtgtcctcacatgatggggaaggagtgaacactatgccctcacatcacagaaggcaaaagggcaaaaagggctcacaaactcacttaggcctcttttataaggacgctaatcccattcttgagagcagagccctcatgatctaatcatcttctggaggcttcacctcttaatactatcattgcattaaggattaagttttatcatgaattttggaggaacacaacattcaaatcatagaaatatttttctgtaattttttggtccaacattatgtttgtgtgagattcattcacattgacacgagcagtcctgttttgtggatttttaaccaccattccatattccgttgtataatacagcacagtttatctgtcaaccttttaatggacatttgagttgttctctttttttctttctgaattacaaatgttgggtgcaatgtacattcttacttgtgcatttctctggggcatataactaggagtagaattgccaggtctgactaccacctgctttcgcaattttactatgttaagttgttcttcacagtggtcacaccagtttaccctctcatcagtaataaaagagagcttcctttgtctagccttctcaccaatatttagtgtcttcagacttaattgttgctaacctgaagtatgtgaaattgccttatgattttaatttgcatattccagattcccaaagagatcaagcattttttttcatgattttttctgtgagttgctttttcatatcctttgcttactttttcattggcttatttgggtttttcttttctattttacatattcattatatattctggatacttatccaggatttaccctctctttagtctgtggcttattttttcactcattttatggttttttatgcacagaagttcttcattttaatggaataaagtttatcaatttagtattgataaataaaatttatcaataaagattaagcagttgataacagttaattttattgattgctttaaaattattcattttttccaaagaacaaattctggacagtcttattaagaaatctttccttggctgggtgcggtggctcacgccagtaatcccagcactttgggaggctgaggtgggtggatcacaaggtcaggagatcgagaccatcctggctaacacagtggaaccccatctctactaaaaatacaaaaaattaggtgagcatggtggcacccgcctgtaatcccagctactcaggaggctgaggcgggagaatcacttgaacccaggaggtggaggctgcagtgagccgagatcacgtcactgcactccagcttgggcgacagagcaagattccatctcaaaaaaaaaaaaaaaaaaaaaagaaagaaagaaagaaaaagaaatctttccttaccctagtgtcataaagatggccgtctatattttctgtaagtttcagagttttgctcttccttgtggttctttgatctgcttggaattcatattgcgtatgatataaataaaggatttcatttttttttctgtatgtggaattagctgcctgagtaccatttattgatagcctttccttcccccttggtttgcaatgactgccattccatgcagcaaggctccacgtatgtatgggttggtttcagtcacctacagtttttttctgtttatctttccctgtccggataccatggtgccttagctactgtagatttactagaaatcatatagcaaaatctcctcctctgtgattctttaggagtgtctggaatattcttagccctggctcttctttataagtttttaaagttctactttaaaaataaggtagaatttttatgaatacggagagacttgactcctttaaggtagcgagtctttctatctgtgaatgtgatgtatctatctcccactagtttaagtcttcgctaatgattttaagcaagatttataaaattctccatcgagatcttacctatcttctgttagactcatttcaagctagttaattaaaaatattgcaaaagaattatttctaaacatttacttttaaatttttttaacgcaggcatatacaaacatacttatcagcaaccttgctaaactgtcttattagttctaataatttgtccatagatttcttgaattttctatgaagataatctaccatctacaaataataactattttgtttacttctgattcttgtacatttttcccttgccttattatagtgggcaggatctgtagttacaatgttgactagaagcagtgataacagacatccttattttgttcctgatttcaaaggaaatgctcccacagtttctcagttaagattgatatttgcccctggttaggtaaatagccttcattaggttaagaaatgcccctgtactttcaatttgctacacattttcacatgaaaggatattaaaactctatccaatagtttctgaattcctaccaagtgcctagtcctgctctgcctctgtgaggcatttaggatgtgggccctgtcaacaagaagcagtgttcccactggggaaactgatcctcatgcataaatctctttggttatgcaagactttgtgtcaaagaagatgctgcagagagaaggatagaatgtggatgggaggagggggcagtgactacatagcggaagccttcatggagaggcaggatttgagttggacagaaggattttcacgatgatgaggaagaagggtattcatagaagaagacacacgcacagtcccagggctggaaacatgcctaatgtgtgtgttagcttgagagcctggggttgtagagcagaactgttggctgccttgccagggaaaggccctgctttctccctcagacacctgcactgcaccaggaactacatccacctgaacctgtttgcatccttcatcctgcgagcattgtccgtcttcatcaaggacgcagccctgaagtggatgtatagcacagccgcccagcagcaccagtgggatgggctcctctcctaccaggtgtgtggtgcatccaggaccgcctcaggagggatgggcggttggaggaggcctgcctctgccaccctagacaggcctgggacaggagaagacaagagccgaacagtcctggcccttcgggagcccccagtctgatgggagaggcagttcgccttgggaccctccagtctgctgagagaggcagtctaccttagggagctcccaatctaagggaggagacactgccctagggaattctcagtctgacacaaaagagtagtctttggagacacacttgagtttgaatgtcagctctgtcacttactatctgtacacttttaggcaagtcacttacttctctgaggctgagaaataggtgagaagtcacttacttctcacctgcagggggatacattactttcttccaatcaggatagtgaggattcaatgagctaaagcagataaagtccttagcactagccctagccagagatgtgagctctctcctcctgcattaaccatggcaggatagtggctggagcaggacggggagtggtatcaagagaggcagagggcagagctgttgtccccatgacacccttcctctacccccaggactctctgagctgccgcctggtgtttctgctcatgcagtactgtgtggcggccaattactactggctcttggtggagggcgtgtacctgtacacactgctggccttctcggtcttatctgagcaatggatcttcaggctctacgtgagcataggctggggtaagaaccgccatcacccaccctggacctgtggcacgggggtgggagaccttgacccctcttctaacatggtacttggaacgcactgctgagcaaggggcaaggcccactgggtaaccctcttcctgggcacaggaccttctgccccggtgctgttaagatgccgtagggggttatggtcctcccctcctctgcataactctcctcccttaatggaagcctccaccgcatgtggccaaacaccaccctctaccactatcatgcacaccactggaggtcatggcactgttctcttaagaccacatggggacataagttcacacccagtcccgggcagcccgagggcctgagggaaatggtgagtcctgggcctcaaggtggggaggggatcaagagggtagggggctggctggggggagcctgctggtgctctgtcacatgacgatgaagaggagggctcagaggagagccaagtacagtggggcaggggggccagaggccagccaaggaaagggtggacggcggatgtgcctggagcccagctggaaatgttctagccaaaaaagtttgccaagaaccattgtgtctttttttttgctggaacatttctggttgtgcttctgcctctcaccacgtgggattgtaatgaggggcagcattggggttgggaagggggctgggatccccttcacccctgggaaaacatgcaacaggcctttctggagggacccacggtacccagagaataggccctgccctctgtcctccctaatctgccattgaatccatgagttttcctgttccacaccatcccccgccctgcttgccactccttcattcactcctccttccttcatgcgcccacctcacgctgctctgaccacggctgcccctgccacggacctccggggactttccagctcagtcacatccagactcctcttccctgacaatggtcctgtccctgagcctttgcaaggctgttctccatgcaggaatgttcagggagcatccttcccacaccagggtgtccgctgcctcttcaggaagctgcctcaggccaccagtcctcgtggttctgtgctctctgccctctcaagctctccatcccctgtccttgcacttcatttatttttactggtgttcctcagccatttttctctatacagctccccccaccccccaggagaagagtagcctgagagattttaatgtgaccagtgtcttgaggacaccaaggcccagagctggcagggccttacaggcagagcaggccctggaacccaggcctcctgactcccaggctctgggcctgcggccatcatgccctgttctcttgcctgggctgcatcccttcagtcccctgcagcacccctgagcaggctcaggcctctgcacaggtgggcaggtaggcctggctcctgctcacagatccctgctcctcacctgcctcctccactcccagaacccagtcccttccttggccttttctccccgaggcttcttcctcctgctagagcaggaggagggaggccatcgagggcagctcagggaaggctgtcttcagggtgggggacggtgtctgtccattctaggaaatagcatcagcgctgttagtgcctgtcaccatggcgacccgagggcaggaacaatcaagggacgtgtgtgatgtgtgcagaggagcgggggtggctggagtttggtggggacacactgccctagaggtctctgagtgggagatgggggagggagtgccaagtccttttcctaccacctcacaccctagctcagggctcggggtctgtgggagcacaagggcaagacccggaggacaccctgctctaatcagaacacctttttcttgaggattggggtgggggagacggagagagattcacaggttgctaggagctcagacgtgatgccaggaggccttgcccaagctgggatacttgggaaacaactttcagcttcatgtgcaagtggaagaattaaaattaggactctgacacagttggagaggtcccccaaagggcatggcagcttctgctgcagtccccaggcagttgggggcctgtagaaacccacatggaggctgtgcaagagggaggcaaatgatggttgagggaatcattacttcctggagccagttgtgtgtgtcttaatttgagcttttttctccaacctgtcttgctcgttttctaaatgggagaaagatgaagccagcagggagtgcgtaatgtttgcatgcagcagggctttcgtgactgtgttttttgaaaaggccttgttaaggaaatgctgacgatgagtgaaacttgccaggtctggctgataacatgggtgagtgccctgatcctggaaggaggtctcagagagaagggacagcagggggcgagggatacccagaaggaagcttctgcatgtgtacgtggttcaggaaatcggcatgctcttgcccagacaatgttccttcccttattggtgtgttgactcacccatcattcgttccattctcactgggcatcttctatgtggcagggcctgtaccatgtgctggggcctttggagaccatcccattccttgtccagtctcataaaggcctgttactaaagcaccgtagatgctgagaggtccgatttgtgtagaaatcaatgggccaggagagagagagctgatgaagaatgctggtccgctgggggctcctttgcctcctccatctctccctgcatcatcaggcacagtagatctgggcacacaacctgcttagtagctgctgttgagtggacactgatgtgctaaagacatagacaatggtgacaggaaaggctatgaagtggttctgtcctggaaatgtgctccaggcagagattcccaaagtcatacgtgcacactcatggtccacccaccacaccctcacacacacatgtctacataccttaatatgcacatgcttacctatctcagacacatctccaacactgagggaggggccaacggagacgagcatggagacagccagtgcagaaggccattgagggcggtgggagtgggtatgggattgcagccctgaattcgagccccacctgtgcccttctgagtccctgatccatctcctcatatgtcatgtgaggaaggaaaatccaattttaaatcaaccaacacagaccctgagctctcagggtgatctgggcattgaggctctgaaggtgagtgaggcccaggctctaccctcaaggaactgggaaccagttgtattaattctctattgctgcagaacgattaaccctgaaacttagctacttaaaacaacgaaccattgttatctcacagttcctgtggcctgcaatctcggttcaacttagctgggtaccttgtggctcaggatctcacagagaaaactctttaggcaagagcatgtggatttcctgaatcacatacacatatagaaacttccttcttgggcatcccccaccccctgctgtcccttctctctgagacctccttctaggatcagggcactctcagagaagcagccagctgtcaccagggttgctgtcatctcaaggcttaactggggatggagaatctacttccaagctcattcaagaggcagttggcaggaagccgcagttgctggccaaaggctggaggcctccatttcttgctgcagagacctccatctaggccttctgagttctctcagcacatggcaactggtttcccccagagcaagtgatcagagaaagagaaagagaatgcaaaacaagccacagtgtcttttataacaatcagaagtgacatgccatcacttctgccagaggttcctgggtcacatgaaacaatgctgatacaacgtggactaactacccaagggtatgagcacaggaggtggggatccctaggggccatcttagaggctgtctactacacaagtcaagtctcagccgagtggaaagtagtattgttgtagctgttgttattgtaggccactgcggacagttagttggtcagctggcatcaaggactgggctcctgtctccattccaggattctgccgagccctcttgaaggtgcacagtggtagggaagagatgactgaaaggacatccagtgcctttaggagttgactggcaacgtgggctgaagcaagagagaaaatgggcatcagagggttcgcctgctccttgcctcatccgtcatgctgtccccaccgcatggcccagtcccgctgctgtttgtgtgtctgtggcctggtaacttagccgggactctgagggcaagtcctgacagtgtgcctggcacacaggaggtgggggactgatgactgatgaggacctctctgtaaggaagagtctgggggtccgcatggggctcctgctgcctctgttctcccaggtgcccagaaaaaaactagaaaacatagttggaggccaggcaaggagaggggctggaagtgtgaggggcttggggcagggagaggcctcggcatgtagactgtggctctggcctgccagcccctctccccttctgtctttccctctctcttaggtgttcccctgctgtttgttgtcccctggggcattgtcaagtacctctatgaggacgaggggtgagtgtcctgctccaagggggcgggtgtgcccaggtccccatcctcaaggtccatgggattccttggtacctggggcacccatctgttgagaggataaaggggggtaccaggagcttagaaggtgaatttagttctctaatctcccctccctgcccctgcccctgcccctgcccctgtcccaggattgtttgatgactaacggaactgggtctgtggggtacatggtgccctcctgcaggtttttctgtaatatctgcaagtgaaatgtttgtgtcattttgtatatgatgctgggtacacacatgactgtgttggtaggtccttgaaagcttgtttgggggctgtgtgcatctctgtgtatgactgtgtatttggactatgcgtgtgtgttgtgtggctgtgcactggcagggctctgtgggtccatgggactggtttttgggtggctcctgggagctgtgtgtgtggcactcaacatggccatgtgcattggcggcctctgtgcctgcacctgagctgggggtcctgtgagtcctgctggatgcatgtgtgcatctctctccctccccagctgctggaccaggaactccaacatgaactactggctcattatccggctgcccattctctttgccattggggtgagtgatggtgtcagggatgggagtggcagctatgatagggctgggctggtgccccctgccaatccccggccccaccccgcaggtgaacttcctcatctttgttcgggtcatctgcatcgtggtatccaaactgaaggccaatctcatgtgcaagacagacatcaaatgcaggtgatgtaactgagctggctttactgaggaccctcagcaagtgcccctttccttctagcagagagagagagagagatcctgggatgcttagcttagagccctacactaccctctccttccacccaggcctggccttggaccccaaacccttgcttttgccctgtctctgggcagcccctggacttgttggggtcttgacctctattctttccctccaggcagcctgtcccagggtatttggggtgggagaacatccatgacccagatatcaggacttggtaggaagtggggagggtagagaaagggaagaagagtccatgggagaggtccagaatgactcgagatctctgccctgcccctcagacttgccaagtccacgctgacactcatccccctgctggggactcatgaggtcatctttgcctttgtgatggacgagcacgcccgggggaccctgcgcttcatcaagctgtttacagagctctccttcacctccttccaggtgacttcatgcttggggacacttgcttgtaaagtcctagagtgggggtgggacagacaccagcctgcatcatgcagatggaaaaggtgggaagactgggacctggaggggtgatccctgcccaaagtcacctagttggagcagagccagaactagtatccccaggtgtcccaatacctgggccagtcttctctgtaagcacatgggacaagaagccttcctggatgtagctctgggtaccagcctggcattgcagctgccatctacttggtggcgagcaccctgccaggtgctttacatgcattgtgcatttactcctcacagaacccaggagatgtgcagggttagcctcactttacagaggagactcagaggtgttaaaaccagagttacggtgtcacagtttcaaagaaaagaactgatcctctccactagcattagatgatgctaagggggtgtaaaaatacaaaaaaactggtccctgcctgcccctcaagagtgtcatgagatgcctgcacacatgtgggctcatgtgtgtgtatttacatacatgtgcagacatacagaacacaattctggagccctgggtctccttcatgaacagatggggctggagtggggaatattctccatgatcagagtcattgtacttcactggatcaggcctcctcaaggagaggttggatgtaggatctctacagcttctgggcagcttctgagcagggtctcctggaccccatggcacatgcctgggagacccatggggagaggctagctggggcctgtagccaggcctagtcgcagaggtgcaaccctggtgttccttcagaaaggaaatgagagggaagccactgccccattcctggatctgcctgggccgctggatttggggagggggttgttgaggatggagtcccaaagtgcttccgaccagggccagtctgcagggcacctccctcctgcttcctccctcttgatgtgactcttgtttccaggggctgatggtggccatattatactgctttgtcaacaatgaggtaagctctgaggagggacggtggggaccctggtgggtgggtaccatcagcccgtctggagtagtacaatggggactcccatcaatcttgccagctgaaaccccctactcacctcactgaggcactagggttgagaagccatcttgtccacagatttggttttctgtgcatggtctctctcacacatgaacacacacacacaagtacatgtacaggtataccctaatggcatgtgaccctaaggaagacccagactcatgttaaggggatcctgaatgaccctctttgcttggtggtagtgactgtcacttacaaagtgattcaacacacacatacccaagccacatgcttggggctttaataatcactatctcatttaattatgacccccacatccctcaaaaaaaaaccctgctaaaattcttatttcatattcccattttttatatatacatgaaaacactgaagatcagaaagagtcaggaacctgccctaggtttggaaatagtggcacacatcgcttcttagccttttggctaaggtgaagtgtggaaatagtggcatggcagagccaggattcaaattaattctgcattaaagcagaaagtaccccattcttcatacacacaggcaagagccctggctcactgtggggaagggggtggctttctggtgctaggatgggagaagggggttctcgctggccccacacactctcctgaaaatgtctgcaggacagcaggcctccctcccatccctgagatggtcagctcctgggaggagggcatggctgtgttcatgggcacctggaaaaggccccttccaccaaggtactcagctttggaatcccagagctcagggatgttggagtcagcacattaataggcttgtctttttctatgggtgtgggggatgcagaaaggacagtgggtggggacctgggtgtttcaaggagctatgagatggctcaaagaagcaatgtgatgtagcagaaaagatgcaaggatgcaggctttggcatcttatttggtctgatctgggccccatcacttaatgagctgtgtgactttgcctaagttacctgcccactctgaaacttagtttgctcatttacaaagtggggataatcctgtgaggattaagaaagtctgaaaaaggtgcgaaaggggaacagagaacaagtccttccttcaaggtgggatgctgaaggcccatcctagctcctcacaggtgctgcttggcatggagaaacacacaccattatctccagatgctcagtaagcaatcactattagatcagtattcagtgattcccagagacaggggcctaaggaatttcagaggatgccgtgcagagaaaatgaggctgggtgaaagggaagggaggggaatgttcccttgtccctgaggcctccccctgcttctgctgaactggctacctgtgggaagtgtggccctcagatctctaaatgggagggaaaccaaggtctcttaagggtttactgcatataaggtgctcagagtgtctcattacatccaatgctgtgcagcagatggtatccccaattcacagctaagaacgttaagcctcagcaaaatgaaatgagtagcctaattcaatagacagaagatggtagagctagtgggctgtggcgggggcaagatcccacttaatgcctcagggaagcaggtgctggggaggtgaaggcagcgccaggcaaagagtggcccataaatgggattctggctgctcctgggacaggtcttagaggacccagcggctccgtttggagggtagggcagggaacaggctcgtgacccacaggaggcagtcctggtcctcctccactgccatatcctcaaaatgagtttctttaaaactgatgcaaacgaggaagtgcaaaaacctaagctctgtgggtggcctcccctccaggaatgctctcagccagctgggtgatgcgctacccagccctgagctctgctgctttccattccagcccagtggtgatgggggcaagacagggtggcatgtatcctgtgtggggatgaggagcagaggcctgtagggagagactgaggctccctgctgccaccttgtcatcttgacccccccacgtccccgtttctcacttctctatcctctgacactgtcactgcagccctactagcagacacgtgtgcttggcttcccccccgccattgtgaacagtctcccctgacccctggctcagctgcctctccagattccatccttccaagcctagtcatctcatcacctccctcctcatgcaccacctatggctggcccacctttgtaaggggatagtacttctttgcccttggaaaaaaacttgatcctgaatcaccagggttgcacctctctgaccaggcctggctacagaccccagctagcatctccccgtggatcttccaggctagtgccacggggtccaggagaccctgctcagagaacgggagaacctgtctcccttcagagcaccagccagttcctttaaacccaccctgagactcctcatgccctggctgctccaggcacaaggacagatacatcattgtcactgggccacaaaagacacatgtggctctggggctaaggcctctgtccacaagagctgttctgcagacccagggttgccatggcaatgccaggtacttgtgacctgaggagaaaagatggcttgaatattggttctgtgtggctgccaaggcctgcaccagctgctggtgggcgtgagtggggacagggagggggaggcctgaaggtggttttgctgtagcttgtgcctgagagccacagtgaggtgactcagagccctgagtgcttgtcccagccctgccactgccgagctgtgtgacctggggcaagtcattttgcctcccttgcctctgtctccccagccgtaaatgaaggtgaatgagcttcccaattcaccccgaatcctgaggctggcatggtgcctgctggagagggaggtcaggaggggtgtgctgcactgcagaggtcgagggcagggatgaggataaaaatccgatggtggaggaggaagtgtggtggcctaagtcccagcccaggtgctcagaatctgtggtgttgtctttgtgggttcattttcatagctgaggaacagaaggaacctgatgtgagatgctcatgcatttatgtgttcattcatttggttcatttaaaacacatgtactgagcacctgctgtatgctgggcactgtgctaggttcagggatgctgagatgaagaagatgtggtcccagccctcgaggtgctcccaggtgagaggtaggagatggaccagggacaagcaggactgcaagagccacgcaggcaggaggccaggggttaggagccgggcattggaatcaggccagatctaggttcaaatcctggctgagcgacctgaggaaataaacactctgcacctcagtttcctcatctttaaatgtggagctactttgcagggttgatgtgaaagtcagctaagataattaatggaaaattctgtgcatacagtaagtgcccaataaatatggtgattttcaaggacaatcgtgattacaggggtcacagcagaggttcaggaaaagtgctgaaggagatgggggcagaaggagacactgtgtgtcagcaccctgagaagtcccataggtgtccctgaaacctctctttggtctctggtttcccggaggtgtgcctcagtttaccatctttccccccctctccagcggaagggctatgaaacaagcctggcctcctggcagctgcacaagtgggggccaccactggactcagggcccccatcccagctgtcagcatgcgctcccttcacaaagactcagccgggcagggagctggcatacaacagggtggctgtaggtggtgtctgctcagcctccttccctcccccactcaagcttgggttcatgacgctgcatgggacactggcgtcatcctggcaggcagcctctgggccatctcaactctactcagtgcagaaaatgttcttttaagggatggcatgcagccataccaggcgtcttgctgggcatagctggatggacgacaaaggaggagaggagggttgtttgcacaggggctggtggggagattggccccttatccacagccgctggcatctggctgtcttggtgacttggcctaaagggaagggcccagaccccagacactctggtgtgggaagggtggggacttcaaagaagctctggaaagcaaatgtatgggaacatcacccagaagagcagtccagaccccccaggactagcttggcaggttccagctaggcctctccagggaccagaatcactggccaccaccgggagccacagcattgccacaaaccctcaagggatgggggctccacagtgttacttggatttgtctctttctgccccaacaatctggcccccaagcatcagccctcctgagaggcttttcctgatggggaggccagagcccagcacaacagggatcctggctgactgagctcccctgggctgcacccccatggtcactgcagtgtctctctagatggcatcagttgagaagccctcactggctgccccttcctccctgctgtttcccgtctcagccacattccttccttccctccctcctcccctgtgaggtgctggggcctggagagaagccctcagggagtttagaagggtctgctgtagacaccaggaaggctgggggttgccgtcccccttctcaagcatccaagctgaaactggactgtgcgctgtaaagacagagtctctcttctctctcccatctcctgtctccctgtgtttcaccctccctctcattctcttccgttaaataatactgtgatggattgtaaaaggtacttagctgaatcacagagtttagagatggaaaagaccaattaggtcatcaagctgatctctctcctgaggagctgcagaaaataggagacaacaataaacaattttattgggatattaatttaggagcccgaaggccttgacttgtgtctcttaatataatgcagtggatttcttcccttccccactaatgtaatagtggggccattttgttagccattggtttgcatgatggctttcgtttccctccttttcccatggaaggtccagctggaatttcggaagagctgggagcgctggcggcttgagcacttgcacatccagagggacagcagcatgaagcccctcaagtgtcccaccagcagcctgagcagtggagccacggcgggcagcagcatgtacacagccacttgccaggcctcctgcagctgagactccagcgcctgccctccctggggtccttgctgcaggccgggtggccaatccaggtgggagagacactcccagggacaagggaaggaagggacacacacacacacacacacacacacacacacacacacatacatcctgctttccctccccaaacccatcagacaggtaaatgggcagtgcctcctgggaccatggacacattttctcctaggagaagcagcctcctaatttgatcacagtggcgagaggagaggaaaaacgatcgctgtgaaaatgaggaggattgcttcttgtgaaaccacaggcccttggggttcccccagacagagccgcaaatcaaccccagactcaaactcaaggtcaacggcttattagtgaaactggggcttgcaagaggaggtggttctgaaagtggctcttctaacctcagccaaacacagagcgggagtgacgggagcctcctctgcttgcatcacttggggtcaccaccctcccctgtcttctctcaaagggaagctgtttgtgtgtctgggttgcttatttccctcatcttgccccctcatctcactgcccagtttctttttgaggggctttgtttgggccactgccagcagctgtttctggaaatggctgtaggtggtgttgagaaagaatgagcattgagacggtgctcgcttctcctccaggtatttgagttgttttggtgcctgcctctgccatgcccagagaatcagggcaggcttgccaccggggaacccagccctggggtatgagctgccaagtctattttaaagacgctcaagaatcctctggggttcatctagggacacgttaggaatgtccagactgtgggtgtagattacctgccacttccaggagcccagagggccaagagagacattgcctccacctctccttggaaatactttatctgtgaccacacgctgtctcttgagaatttggatacactctctagctttaggggaccatgaagagactctcttagggaaaccaatagtccccatcagcaccatggaggcaggctccccctgcctttgaaattcccccacttgggagcttgtatatacttcactcacttttctttattgctgtgaatagtctgtgtgcacaatgggcaattctgacttctcccatctagtggaaatgagcgaaatcatggttgtagtgatgttgtttgggagagtgcagtagtaattgatttgacccactcacacttggagctaattaaggtttgccctgcctgcagcctcccccacaaataatgaacagcagaaagactggacggggaaacctatcaatcctgcccccagccatggtgaggaagccccaagccatggtgacacacagcagcactgcagatagccagacacatggctatcctagagaggctggcaaggagttcgtggctgcaaaagaagtttctggagcaagagagagctcgctcttgggagtcaggacctccggggagagcagagggttccgacggattcctttatgagtcagtctctctctcccttttaaatggtgggaaccctccccaaaacctttccccagacacattctcctgtgcccctcagagaggcatgtgatgtgcaaggaaaataataggatataaaacacatcaagtagaaaatttcttatacttcagcttcagtgaagtgttgtctatgttaataggcaagttgaacctcgggctaaagaaaggaattgtgtggatggctgccttgactgagacaatatgggcaggggggcgttcctgcttccccagaacaagggcaggcttcccaaaggcaccccttatttgctgtctcttcgtaagcgtgggcaccagtgggttgatgtgggaaacagtgctggtgcaagtgtttaagttttggataaactgaggattttgagaatcattattacattacatagcaacaaagaaacagattgatataatctgtgtgaaataaattgctgaggagagggattgtagggaagaagttgcttagttaggcacctgggaagctcaaatcatttagtttaaactgtaagtagagttgtcttcccaacgagaactggtgattcctgatttcagaaggctcatcagacccctacacccaagtcttttaacacggaggaagtttttccttcatgaatacatacaagataccgaactgaagaaatcttttctttgctccaacccccgctcccccggccccccgaagctattaatagtcattcaaatggcactgcactctttccaagctttcctaagctaaatatggctccaacaggtctgggaactattgaatgcaatgtactctgaaattccagcagctgtttacatgcctgatgcctaatgccatacgcctggaacttgctgagaactctcggctgcctctgtcctggggtactattgctgaccagcagggtgtaggcgctgcttttgtttgagctttgtagccacaaggtctgatgtctgttgtgaacagcagctgacttcagcactctggccagcttcctcaaacttgttagtggcttgcattttgtcaatttttctttgccatttcagtctttcaagcagctgaatcgcagaactgaaacaaaacacttatattgcaaagttccttccctttaaaatgagcttctggattgcagagatgattttttatggtcttagcgtgcctcatgctgtagaccacatcgttggagctctgggagagctctgagcagagaaagaccttggtgatcccccctggcccgatctataggattgaggaatgaggcttgtagaggtggcttgcccaaggtcacaacactagagggtggttgagctgggccaggacccagacaagcccttttctctcagtctagtgaggcctctgggaaggataggtgaaaactataaatagctgttcaagatactctgagtaaaagtcagtggtgttatctggaatttctactgaagaggaaatacagcagcaaaggtagactcatcagatggtgaaagtgtcatctcctttgtaatttatactggtgagaggaggggaaggatgtgctttcctatttttacactggtacttcattcatccttgtcttaaacttaagaaatgaaatgcatcagggcacacatatacatagaaacagcacataagccattttggatggcaattccagcactcttttaatggattggcttaatttttttttctgatgcctctctatgtgtttgaaaagttgtattgatagtcacacagagtgtactaaaataacctaaaaggtcttgaacctcccctttacctctttagaacctctgaatttggagacagctagcaaacggcaactgtagcctagcaaagatggcacagcaccacaaagggcaaatggagtcaactcccttccatgctctgaaggtcttggccactctcatcagggttggctgtgtactatccagcagctcacagtcaggagacctcccctcctcagtccctcccatttctttcttccgcaaggaaagaacattgcatgtgggcgtgtgtgtgtgtatgtgtgtgcatgtgtgtgtgcatgtttcttctgtgcatagcagcataaagttaggagatgatgactccagaatcatcacacccgctgtgcaggtcataggaccgcacacccgaggctgggagtctaagtggtagatgcttcctctccatgcgcagacagggctcccattatttgctaatgcctgcgacgtgctcagggaaggcaaaatctattccaaaggtttattttccctctgttgaattgattctaatctacagtgcttaccctgcttttggctcctacgaggcaaactataaaaattctcaaataaaatacagaggcttactctgcaaagacacctgtgtgaatgacgtgctaaacattcagcagaaaccaaattaggatcaactcttaacattttttccctcttttgtggctggaatgagttcccctgggaaagaaaatcgcccaagtgagaaacttatgccaaccacattcccatgcccctacagttacctgctggcccagatcagctctctgggtctgcagagggccgagacaggaagcattattaagcagtataatttcaaacactttacttagtgccacagtgtgtctgcagtatctataagtacttccgctctgtcaaggaatacagactggcaggaagcagataagcataattgttttccaataactccccaagtctcttggaatatatatgtatctgaatctctcagaggagagagttttctctcttctttggccattttagcctattttccaggaccttgtctagcagtggctccatttttccccgatgcatccaacttccctccctgcactcctcctccccgacagctgcctcaggaataggtgaccctgctggccatactgtgaatgctgttctttcagctgtgaccaatttgggggtgcagctgagagtgaggtgctgtcagggctgaaaaggacgcacctcattctacatttggatgtgatgaggagcagggcagccaccagcttggatcctaacttacattgggtggtgcaacctttctgacggggcctgccaaactatcagtaattagccagcctagacaatgtagcatgactaattattgctgtgtcaaagcaattcaggacaagaaaaacatatctaaatgagaatgtttagatgtggtgagaaaagagctctcaccacaatttgaaacatataaaaagttgagttctttgcaggggagccaacgggggcattgagggaagggcaaaattcaccccagacagccagtgcttgatcttgccaaacagtttacactttacctccaaacctgcagttctaagctactccactaaaataatcatcccatcctcaaagcagaccaactccagcatcccatcggttctggagggatttgatgcaaacctttaaatgcaccaacagagaggtaagccaagctctcaggagggacaaagatagatttctatcttcagtgctcttgggggatgtttgctcctcatgagtgtttaaacaagatcatttccaggtgatttcttaacatataaattcctgcaaaataggaccagcttctataggtagcgaatgtgtaggtcatataattccttgtacagatgtgaatggatgcagactctttcctaatttgccttgtaagccaaataaaagtctgtctctactgtctctcttgctcttcctttgcgaaaggaggctttctgcaatgtcaatccaggtgactcacagtgcagtgggaaaacacaaaagatgccgtttccagccaaggaaaaaaaccttgctcattactcacaccgtgattttcatcttcaaagcactcaccaagtactaatttatccatcgcagcctttatgcagggactgcaatgtcatttaattagagaagttgggtggtcgagtggcttaaacaataactgatggccaaatggatgtgtattttaattccgctcattcattcgatctctcctgtctaaatgaactcagtccattaaatccattaaaaaaaaagtcataaaagcataagctttgtttgcaaagcagccacagaatttgaatggaactgctgtttagaaattcatcttcagaaaaaatgaacttttctccaatttaaataatcactcactctccagatttgcaactcactcttatagaagggcagaggaattgcagattctcctaattcccccatcatttcagctacacctatttgaaggtcggtgtacttacctgaaagtatctttaaacatccgctttttagacaagctgtggtaattgtccctttcaaacataagaataattcttaccctgagagcaagttatacctacagccaactcctgatagcagcaggtggaacatctgcatttgtttctctgcaccaatcttgcttttgagttaattccctcccctatggatattcttacctttctgtgcccttccccttccacttaacaggaccaaaatagaggtttttatcccctccctaccttccaggaaaacatccacccaaaccaattaatgaccaccacatttctaggtagctattacaaataatagaaatcaggtagaagtgcaccttctttctctgaggttgcactgtggcttaataagggcttgacctcagcctaaagaaagggggttggggagctgccctgctgttccgaggcctagccactggggagacaaatgagaattcttggcttccagactcattcatcctcacatgcaatataaagccatattctagtgactgctgcccccagatggggaagactgtgttccacatagagtttgtgaaggatctcactcacatgccatgcatatcagcattttcaaggtttgagaactcctgtccccttcccttattatcctctcaaaaccctgtgccatgaacatatggcagttcagtctctttcaatctctgtctctgtctcttcctctgtccttcctttttccctccttccctacccaccctcccaacacatacacacaaagagaaagactggaaacagtgaggttttccccatcagaagtagagaaatagttggtggggcagagagggagggctgggaactagcagcacaagctggactacatgacaaatgcagccagatggttggagaagatgggaacagagatccaatattgtgtgactacaaggaaggagtcgaactgagtgtccccaaggtgggaagggtaggtgaggaagagaagatgaagaggccagaacataagtagataaagaaaaaagaaaaatagcagactgtttaactgtgaaaaagggctgtagtgaaagaggggaggaaattgcagaggaggaaaaaagaatgagaattacaagtggcatgcgacaaggaactaggttaggaaccctatctccagtcagtgttattaactccatcttccataaatctgagctctttccctgtagcgttctctaatcctaagcggtgatagaatattttcttttgtacaaaagctcattttaactaacacaatgattttggaaagagaaaaagacccgcggcccagagtgaatccaacaagacttttatttttttcacactgacactgggcaccaatgtgagaatgaattactatggctccccctcatgtaggacaaatagaccttagaatttatttgtggtacaacctccaactacaaacaaaatcaatagctgagaattacaaacactggggagtcccatgctgagggatggattgccttagagctaatgcaggctggtaacacccagaggcgattagcaggcttttttttttttttaactttccaaatctttagggtgaaagagcaaggacttgaggcagtaaatgatatttacacaaaacttttttaatgccgatgacctaaggttgcattagaaacacacttggcaactacacaaactaaatagtgacaacaaaaaggccatggttactttaccctttagctccagtctttgacaatctgtaaccattatgtacatttctggctgaaaaaaaagcagtgttttaccatatttttgccctccagaacccttctgaaccttcaaaattcctaggaaattgaatttacagctttaataaaaccctctgctacccatcgattagatgctacttgacaataaaaccaccctcaagctctttcatctttcaaatcctggtgttaaaagtagagactagagaagccaaaccagagacacacaccaaagcaaagacatttccccctagttaagttaaatcaatgtccttccaatggcatcctttggaaaggtacagttaaaaatacagatgaagtctgggcgcagtggctcattcctgtaatcccagcactttgggaggccgaggcaggtggatcatgaggtcaagagatcgagaccatcctggccaacatagtgaaaaccaatctctgctaaaaatacaaaaattagctgggtgtggtggcgtgcacctgtagtcccagctacttgggaggctgaggcaggagaatcacttgaacccggaggcagaggttgcagtgagctgagattgcgccactgcactccagcctggagacacagtgagactccgtctcaaaaaaaaaaaaaaaaaaatacagatgaaaagatttctcatgtacactcattatatgaaagaaccatgttacattaagaattatactgtgttgaaatattctcagctgtcaagaaaaacatctataacatcccagctacataaagcatttacaaaaacaccttctagaaattggtaaagattgtgaagcctgccaaacaaggcatggtggtgccacaagtccagaaagaatgccacccgtggggtctcagaatcagctgtaacggcagtgctctcactcactctcctagccttgaacaacatctgcttctcaaatacagaccttccttctggcaggaaggggcccttacctctcaggctccatgactgagttagtcttgctgtcacttgttacatgagaaatgcaatagctcttgagacattctgtatccatggtgcatatctcctgggagcatgccaagccacccaaatcccagtaatacccccaagttagagtcatctccataatgaagtgtggggctcatgcaccctctgcattggccacccacatgaagaacagctttcttcagccgcactaaaaatgatgcatagatgtagatttccaaaggctatagcagcaagatcacagaaaccttacatgaacttcagaatctgacttctctctcttccttggggctggatcctccaaagcgatcagattctaacatgaatttccaaaatgatcatgtttcttcaggaaatgtctcttacagggcccctactcaccctgcattgcccagccttttattaggccatgaggattctgggaaaaatgcaaattgtctaggaaatgctcctctttgcagaaatagttttttgaaaattatatatgggacagaacctgataataatctatgagaagagccagaatagccaaagacatttttttttattgatgaggatctagaacaaggcgattgtttcataccaatctggtgccatttcacaatatgtttggcactgccaaacttagtctaaatctcagaggaaaagtcattagaagaaaaatgattaaaacaagctctgcaaaacaaagctatttctgtccctagagatggtccactgtaaatgaactgccatgtatataaagaatactctgcctgtcagcacatatgcttttctctaagagttattaaaataagatcaatattattagtgaagcaatcaatgaaatatttaccgagagagaaaggcagtaaaggacatggagatatgggggtagggtgctattttaggctggatggtcagggaaggcctctctgatgaagtgacatctgagagaccccagtggagtaagggagcaagacctaggatcatctaggggagtgagttcccagaaaaggcaacagtgaaaaccctaaagcagaaagaagcatatttagtttgttagatcagtaaactatggttcaccacctgattttatcaataaagttttattggctcattcatttacttatatattgtctatggatgcttttgctctacaatggcaaagttgagtaattgcaacagagacagtttggtcaacaaagcctatttaccaactggccctttacagaaagtctgccaaaccaaggaggtgaatgtaacctggaaagagaggcaggggccagatcactttgggcctggtaggataaaaccacctaaacaaccacctacctactgaacaacatccccaagagattaagagtgcagatattatttacaaattgaggtccaaaggtttcttttcactgcctcattctaaggtacccgtctgacctctgctttatttctggtctcagcctttttttccatgtgacagggatgtacacatctgagagggttccagggacatatccacaataagcccaaacaaatgagatttaagaaaattgtaaaatgaatgttcacaaataataattatatgctacaagttattatgatacaaatgtgatattttaaactgtatcataagacacagtgaaactactgctatagactatgttttccagcattttgtttattcaagtagaattccctagaaatgaaatgtattcaaagaccttgctatgcaaagtgtggtccaaagaccagtggcatcagcatcacctacgaggtggttagaaatgcagaatctcaggccttgacccagacctatttaatcagaatccacattttcacgagatcaccaggggatttggtgattaaagtgtgagatccggttttaatagggattggcttctaattactcttttctaagagatggaaatatagaattttaaatttcaaagaggttagcctggtttgtactattcatgctagtgacaactgaatacaactgaaatgtttaataataggggattggctaaataaaggctggcacatttatccatacagaaatattatgcagctgtcaaaatcaatactataggacaataacatgagaatatattcagagttaatcactaagtgaaaaaaatcaattgtagataggactaagactaaaacaaatgtagagataggactaaagaacagaatataaatgttataaaccttaacaatagggtataactaataaaatgagggaaggaagagaggaggcataaaaggtagtggtggtatgttgatttcattatctatcaggtcaaaatatatcatttaaggctgataactcaagtagtaggttgtaattatatttaaagatacaaagtcaatcaattagtcaataaatcagtagagctgggggttggaagatggagaaaagtaggaagaaggtggaaatataaatttattacacttattttttacagatgttaataaacattgcctaaaaatatcaatttttaagtaatcaatataaagttaaaaatataaacttgaaacagaaatgtaaactttctagattattgaaagaaacacacatacacagaaacaaaacaagcaaacacaaaaaacccagagaccatatggtaaaagaagctacctaaacagaataatataaaatgtgatgagataagcaagactttcataaacataaataagttaaactcacctattaaaagaaaatattctcacaatagattataaaagaaagcccaactagtctttatatacgagcagcatacctaataaaaataattcaagctgaaaacaaaactatgggcagaggcacatgaggcaaatgcaaacaaaaagtaagcagggcttccagccttaatatcagataagaataaattcagggcaaaatgcaataaagaaaacaaagagggctttgcataatgataaagggagcaatctataatgaagaccttaaaaatatgctttttatacatttcaaaatctaaagtgctaaaaaatactacaatctcatgaaaatcactgataaaaaccataaataaaactattaacaaacagaatctatcagcacatcaaaaaatagtacatcacaatcaagggtggtttattccaggaataaaaggatggttcaatatataaatctgtaatattaattgattatat

SEQ ID NO: 283 - DNA, 185003 bp, Homo sapiens
tttataaattaggagatgttcgggtctggctgacataaataggcactattattagacctgtgtaagtgctgtcactgttccccctaactctctttgatggttatttccccagtctttaacagtttcctcatatgcatgtgccaattattaattggaatactcaaaagattctctgcagatctttggggggctgaggcgggaggatcacttgagcccagaagttggaggttgcagagaggcaagatcgcaccactgctctccagcctggacagcagagtgagaccctgactcaaaaaaaaaaaaaggaaaagaaaaaaaaatttttaagttttttatatacatacattaagcattttgttttaacctaaaacatataaatatacattcacgaaccagactttttttttttttcttgagatgaagtcttgctcttgtcaccaggctggagtgcaatggcgcgatctcggctcactgcaacctctgcctcccaggttcaagcaattcttctgcctcagcctctggagtagctgggattacaggcgcctgccaccacgtccggcaaattttttttttttttttgtattttttttagtagagacggggtttcaccatgttgtccaggctggtctcgaactcctgacctcaggtgatccacctgccttggcctcccaaattgctgggattacaggcataagccaccacgccaggcccatgaaccagactttcagtgaagagcaaagatgtattcttcgatgttatttgattggagttccgatattctctctaccgatttctaaaaaacttaatttttaacttacaattggataaattcataaatccttggttccttcatgctcatagccactagtatctctaaggttatgaaagcatcatgctgaattcctccatcccctcaatgacaccctttcaacaagtaatagcaactaatatttgctaactgagtgactggtaggaagtaagtgaagaatcaggagaactgttagagccataccagagaaaatcacaagaaaggcaggactgcaaagatctagtggaggctgtgagaaaaggtaaaccccttcttaagctcatctgcccctttagttaccactggctgtctcactcctggatttatgtgactcccttagctatactttcccagccccctgggatgttccccactcatcctattcacccacaaagaaatattgtcaaaatcaattgggtgatgattaggagccattatctgcctgctgtgctgaaaaggatacagggctatctgcagaaacctttcatgacgggctaaaaaaatattccagtatatctaggagtggtgtcacttctaagtgggaaaatcaaagtcaatccatagtcttttcatactattggcttgttacgtttacaaggtgttatatttctaaagcaaacactatacgaaatatgaaaaattcatgcttgacttaaagggaagaaaaaagtaaagggaaccattttgatagtggaacagatatactcagattcaaggactgaataaatagatttgtaacattttcttgctttgccctctggagctctgccttctgtaatcttcccagtgtcagtcctccaggttctctgtcctcgcaactcggatttagaattacggataaaagatgcctaaaatccaatttcttgattgaggaaactgaggcctggaaagtgaattaagtctcccaaagttggccagagactaagagtcttgtctcttcattctatccagtgttcttttcactctgctgactttcttggtattacttcccttcagttttgaaaattactttcatttattatttgtccaaacctattgagactaaagcttcacattatatttaatagttgcatatcatctactgccaatttctggttttcacctttgagggagcagatgctgcaaaacatggagaatattctgataaatatacactacaaagataatctattctacttttaagagctaggaatgatttattggaatagatatcatgggattgtaaattcctgagtaaagttcattatgatgatcaacaatatccaacaaagtaggagaaggattactgagtaaagtaaaaacccactaaaatatgaatagcataattggtgcctgtgctatttaaaaaagcaactgagatgaaccttggatcttcgggaagtggcatgatgtggcagaaagaacactgtcttggaattcagaaaattaaggtgtccatcctgattactcaatttatgagctatgtgatcttaggtaaatcacttggacttctctaagcttaatttcattatgcatgcaatggaaaacagaaatcctggctatttcaagtagctgttataaggattgaattaaataatatatgagagattattacaattcaaaaatctgagaccatatgcctctgcatgatggcagaggaccatgtgcgttgtattcaacagtatattcccaacatctaacatagtgtctggcacatggtaagcatacaataaatatggaagacattcatgaattaaataaatgaagataattataggaaaaaatatcattcttatcactatttcttgctgtggaaatgtttatggggggataaagccaagtacatgaatagagcagaggcgggggaggcaagaaaaggaacaaaatgattggtatcacttccttcctagaacagaagcagaggttacagaatcaaaaaaaagaatgatcaaagtgaccagtctctaaacctaccctttttctttcattgcctcattcaccccacctctcaatcccaccattgatttttctttttaagattgcctttgggcattgacctcattaatttcagagtcatggttaagccattgctttcagtgtttttattaagacctgtatatgtcctctctgtagttattagaaacagtgctgtttttcatttatattggatgtaactaattcagagttctttcctcttagccctctccaaagactacaatggccagggggagagacagtggacttcagggactacttgagaggaaaatcagtatagttcatttctttttacttcaactaaaatgactctaggtaaaagtcctatgggataggtgcctggttgaaaatgtatctctcactgagttgtccttttttagttttatagatgtgctccatcacacacacaggaatttcataaaaatgtttttctttgccacagaggtcagggttttgcaggcctttggagaatagataacacacctaaatgtcagctcaactaaagaaccatgttacccgactggaacgcctcaatcttggtacttggcagactttgggaacacctcaaaccacatgtactttagagaatgcagacaagtcacaaaattaattcagtctagtctggccaaacactctcaatgtacttctaaatttgaactaattgatagcctctcctccctcagttacacttgttatagccaattcaattggttttaactggattcacataaaattcacctactttttgctttcacaaatataactgacaggaacaaacaaaaacagttctatctgtaaaaagcaatgcagtaataaaactttggaccttgaagcttacagaagactaatgagataatgtctaaaatgtgtttgagctgcatgtgtgaaagactctatggagatagaaaacatgataaataatgcaactaacctttgtgtcaggaaagctcctgtcttctggaggatataataagtattaaataaatattttacaaatatgttcctgctaatcttttctgtcaactccagcccaggtaggttgaaaaggactattactcccatcaaaacaaataagaatcttagtttctaatgaaaagttttccaagaaaattccaattggaatccatgactttaggtaacgctttcatattaagccaagcttctgacttcaatttcagctcttggtccattttattgtcaatgtgaaagcactagtcttggccccctccaacttttcactctattcaagccaaaggcatccctgtgggattctctagctatcctaaattgaaaaaaaaaatcacaaagcacaccctctttggggttcttcaaccatcaaagaacactcaacaaattatgttgtcaacagtgaccacataatggacttcaataacttaagagctcaattcaattacctataaaccttaatctgctccttcatgaaaatcccttcacttaaaagtacacaaaacctttatttcttcttatgacatctcttatccctaaaattataaataagaaaactaatttttcatgaattctacaaaataacaaaatgggacacaaaattgagcaaaaaattttctgacgggaatgtcaaaaacacctggcaaacactcttctcacaagctggcataggcctataaatctcccatttgtttgtttaaaatctgtatcatttcatttttcagagccttacttgaagacaagccattacctttttgaactcatccaatcctaagcattttctagaataatcaagtaaaaaaaattctaccacaaaaataaaaaagtctcagaggtgggaagagctttgtcacattgtctgatttagcccttgctaaatcagcccttgtttagttaacaaatattgaaactgatgacttatgggcagtgggccatccttgacctttggggatatatacaaagtaataagacaactctgtcccctaaaaggagtttacagtttactaatgttttcccaaagtacctgagtacttagggagaaggtatgaatgtaaaaatgaagattcctaagcttagcctcaaacttactgattcagaaattctagggattaaacccagaaatctgctctttaaaaagcatcttgggtaattcttgtgcacaacatttgagaaccaccactctggtaggtctgagagatgtgcacaagtatgagttagggaaatgctgaatagaagactcatcttttagggacataaaaaaattgatcagcaccttccctcattaatgccagatacaaactggaaaaaaaagaaaagtcatctcttagccaaaaccagacattcttctaaatcatattcaccactaagttggattgtgagttatcaattttataacagaaacacttagtgcagaaacccaaaatttctagtgacctaccattctccctaaaatgcctaattcactgcgtgcatgggctcacacctgtaatcccagcactttgggaagccgaggctggcagatcacttgaggtcaggagttggagaccagcctggccaacatggtgaaaccctgtctctactaaaaatacaaaaaaaagtagctgggcatgggcgctcacctgtaattccagctactcgcgaggctgaggcatgagaatctcttgaacctgggaggcggaggttcctgtgagccaagattgcgccactgcactccagcctgggcaacagagtgagattccgtctcaaaaataataataataataataataataataataataataataataaaatgactaattcactggatatttagtttcatttaggttatgaaccacatattttagcctattttcttcccgtgagagtagtattcataagcaattttcatagtttttttccctttcacagaaatacaaaaaaactactaaacataaaaaaatgttgaatttagaaacatttgaggtatctgggctttaagaaagtaagctcttaacagaattaactggcacatacagattctgcacaagaccaaactctgtacacagaaaaatcacctggggagtggctatcaatgcaaatggctgaagaatctgagttggtaaaagtaagatggataactgaatttttaacaagcaccccagctaattctaatgtaaattgttttgagaaaacattccagaattttcaagatttcaagattccaagctcatgacatcccaacctgtcttcatgtctaaatcaatatattaaacacagtagactgccaatgcatacatatttaaataattaaagtaattttatatttaattaaagtataaaagggaacaaacaggggaagtcagtttacctaatcagagcccacattctgtaagtcagagctggggaatcttattgatataatgaattgccctccagatccaggagccacatgcagtaaagggctttgccgttgtttcttttagagagtatataaaatactctgattacctacttataaaattaaaaatatactgaatgatgtatgtgtgtagcaaagggaatggctgaggttggagggagagttattctctggacatcaacaataatctgagaaataaaattctgaggatcatataaaataaaaccaaatagaatctgtccttggtctaagcatctcccactgctgatgttaggatagtaatttcctcattcccacaggaattaattgtgaacaattaaacacgtggtattatctaattactaataattcacagagaactgagagattcttatcctcacgtcctttgggggaacctgaatatgagtgggttctggggttgtatgctttctgtaagtctgggaagcacactttatatgtgcatatagcatgcagtttctcagatagtccacaaacatgtgaaaggagcactggcttactacttacaggtagtagtaaggagaataactgttcgtgaccctaaacagtggctcagcttcttcagctataaaatgggtactcaggttgatctgtattcatggtccaggttctttgcactcagccatgatgcttcccacgccatgtgcttaactgaggtttatgtgggaggatcacatgagacaatttttgtaaaagtgctctgtaagctgtaaagcactatacagatgaagcggattattattagtcttttacgaagcccagcgataaagatgcaaagtgacccagaaaaagaaaactgagtagacaaacctgaaatacaacatctatagcccctagaacagttaccctgtacatggtaggtaggtgcttaataagtagagtgagtaaagaaaaacgcaaaacaggtttgtgcctccatcatactaggtctgataccaagaagaaataaatatacctaaggtcaatgatagtttcattcaaccatacaaacccaaataatccaagagcctaagattttaaattaaaaattacttcaaagaaagagcatggaaacgtgaaatgtgacccggaatccgcaattaaatcggtatattcttacctcttcagtctttccaacgcagtcttgcagggatacaggacctgggtgagggtgtggagtgcttccctgcacctggtagatctacataactgttcctagcaacctcttgaggaaataatacattctatagaatgttgggtacctaagctctctgttttggatttgaaaggctgcgttttagtgatttttaagccaaacaagatttatcccataacagccccccaaaaacacgcacagaaaagaagaatgagaggggcgggtaggtagagaagcagttattcactttataaaacaattctctataggattcttttgtcagtttcctagactatgtaaaatgtgattcaaattaaaatatttaaatcacatacccacatcttgacatgggcagctatttgtaaaatgaggcaaacccacactgggaaataccaaattaaaaaaaaatcagggaaaaaatattttcttctgggtggccctaaactgctttctttttccccattgcaaatgtatttttatgctgggttacatttccaaaacaggagtgttttttttctatcgttgaaatgaaacaaacaagtttgctttcagagctacagaaatgcccaactgttaggaaaaaaaaaacaaaaaaccgttttccactggccgcttgcctctcttatccccatgcaaccttgcctattggcccctttccctaggagagcccctggggctgtctgatggaactgattgtaaaactattttgtgcagtaaaaaagtcgtttcttcaaaatctgagaccacccagaacatgcccaatctttggcaaatatcgactggtttcctcagtatttgactagctgtacaccgagtaactgtcccgggtttctgggtctttatctgagaagaaatgagggggaaatgtttcagaagatgaaaaaaggaagaaaacctctcatccaaaatctgttcaaaattcattttgtgcgtttcgaagggggaggacaggagaatttagtgcaaagacggcctccaccaaacgaaaccgtccaacatttgcaaaagcttttaaaataaactgctcagggatcaggggtttgctggaaactcccggtcgcttgaagccctgtccctccactccgggcaccctggcctccccagggtgggcacccctcctgcacggagagcggcggctgggatctcggagcagggtcggctatggccctggaggcagcggctcacagagaaaaagctctggcttttctccgcccgctgcgttcctcttcttacagcctcgggtgtcacatattaggtgctcaataaatgtggacataggaaacgaaaagtccgaatctgtccttacgcccccaaggcgaattctggggcgcgcgggtttattccgacccactaccacatcgcgtttcctgaggtaacccggcctcggctctgcggccccagcggctggagagccacggagaaggcgggctacgggcgacaagatggagagccggcccgagagggacagaggccgcgctggcagcgagctggggggcccacctgaccgtcctgcgggcagcccggccccgcgctcccattgacaaggaggtccgcgccgccggcgcgtggggcgggggcggaggcggggtggggcgccccggcgcgcgcccggccccactccccgcccccgccagtcccgcaagcacccaccccgggggagccgcgggccgggagggcgctggggggaggggcaggccgctccgcgagcgcgtgtgcgcgccgccgccggctgacgcgaactccggcgcgcgcctcccccgccccgcgccctccccgtcccgggggcccggcgcgcggccctgctgacgtcagctggcggcccgcggagccgggtgcgcagagccgctggcgcactcgcgcgctgcgctggcctcctccccgccccgggcccaggcgcgcgcgcgcttgttcgctctcccattttttttttcccctccctccctgcctctctctctctccctctccctcgagctcccggctggctgcggctccctggcgctctccctctctctccggtaggctcaccgagcgatgcgagctctgggagacagcgacgccgcctcccgctagagacctgcccctcggcccggccccctgcccaaccctgcccagcgcgcgggggtcggcgaaggcgccgcggacgcaccgacggctgaagagcggcgatgcacatgcactagcagcaccccctaactcactccctccacatcccgcgccgccgccgccgcctcctccacctcctcctccgccgccgccgcctcctcctcctccggcagccgcggcagcaggacccaccctgccccccaccccaccctctgtcggctccggctgcggctccagcctcgactattattttatttattttgggtcgtgcacaagcctcagtgcctgcagtccgcgcctcctcggcccgcgggcgcctcctcccttggctccggagccccagaccccggccaccctcgattcgacaaccccagacccctgccagctgccgcgagtctccgctgctggaatcttgttagcggctgtctttttggagggttctggtttcccgacatttttgtttccagcccaggagaggatatcgtgattttccccccttgagcccaggctctgctctctgggggggtggggggcgctccaagccggggagccgtgccagccgagtcgtgcgggctgtggcagggaaggggccaccatgggatgtactctgagcgcagaggagagagccgccctcgagcggagcaaggcgattgagaaaaacctcaaagaggatggcatcagcgccgccaaagacgtgaaattactcctgctcggtaaggaccgccgctgctacccccatcccccgaccccggccactccgcaccccctgccaccagctcccccaccccactcgcgcccgggagacctggtccccaagttggcaccaccatgtgcccaggatcgcccaccccctcgcatgccttagtccccccctccccctgttcccttaagctgacactcaccagtttttccccactgtctgtgtcccaacaggggctggagaatcaggaaaaagcaccattgtgaagcagatgaagtaagtccctgtggcattgggattcgtacttttattaagaataatttttaaatcgtttttattacattgcttactccacattgctctccaggcctgttttttaattcgtgcacacacacacacacacacacacacccctatatttgactcccctcccccactccctacgttggttctgggtcctccaccctaactcctgggtgggtgttttttgggagggggaaggggagcgcctgtagttgtatgaatgacagtgtccgccatattgatcagaacatcacactattggcatgattatgatcattactcttgcttgtggaatattttctgtgtctcactgcctccatttctgtctgtgtctctgtttcattctgtctctatttctttctcctcttccctccatacctccctatcccccaaggtccgtaatcccacttccccctgctcttttcctggggcagtgattttgaacttggctaacatggaggggacccagccctagactggggtggaggatcaagtgtctgctgttcatgcgtttggtgctgaattggaggctgtggtttctacatcccctcgcaccccctcccccgcaaaaaaagagggccagggttaggggaggggtcgtgtgctaggggaaggagtgggtttccaaacgtaggtgacgggcacagttttatccaaggtagaggtggaagggggagggaagctgcctgtgaggctgaatgtccgccccttgctgcccccagctcctctcctcccccaccctcccagcattgctctcctgacacccgcagttttcgttcgctccgtggcctttatcagtgtatttatttacactctgcataggccgtgttccatgtaatctacccacaatgcggatttcaggccccacttgccgccgcccccttctgccttagctatcagtttcccctcctaattaactgggggtggatttgagtgatggttgaaaattaaaacaaaatgggatattccttcccttccacactttctcaataaggagcctcgcccctcctttccacttgcaggctcgcttcttgccctatccactcggcagttcctggtgatcccacaggcaggtttgcttggggagggggtggccggcagcgaaggggtgtgcgccctccgggcctcctgtttcggttggcctgtcagttcgagacggaggagttcgtttagaccgtttagcgaagattccacgtcgctttgctgtgacaccttcgtgcacacacagctcctaattaggggttgctgtgcagtaaacaaaaatgattatttttcaacttgacacaatagccgaaataattgcatcgcgtagggaaacaatggaaaataaaaacccctttcgtgggaaggtgggagtgggagacgaagcatgcttgcggtttcagaaccaagatgcaaaaaatcttggatgtgtaacaggcatgacaagcgggttctaggcggcgccatgatggtagggagtagcgactcggagacaattttcccatctgcttgacatgttcttatttttattcgagagctccctggggctttcttcgcagagccccccttggctcgccgcacccttctgagccaggggtaatttagcttggggcttctcttgagcttgtgcaacccaaattgatggggaggcggggcctggggaattgccctttgcaacaaggtgcatgttgcatctgtctggagcccttgcagatctgtaaatgcaagccgcgccacccctttctcccgaggggggacgttttaaaacttcagaagtctgtaatcagcagtggcggactcggagcccagtagaagccccagccacctgagctggatgaggtttcaggcgttgcaagtggtggacagcgcccagccgaggccggaaaagtcgatggggctcagttcggcgacgctcggctaggttcggtgcggtctgggcgcggggctcggagggagtcggcggtgttcggagccgagtcggtgctccggcggagagagccgagccgcttcggagggggtcgaaagcattcggaaatactcgggggaggggagtgcgcaggaggggaaggaggagggggagaggccagagtctgcaaattaactttgcatccgccaaagcaactgcttttcctgaacatgccccataaattaggttgatttaatgagaagtttaaaaatatatactgaatcccccaaaggggtgcctcgcctttttttattcaaagagagctgagctctctgaggaaataggtgtgccactttaggatgaaaattcctaattatgtactgggcaggaaatcttaaatgaaggctggatgtagacttccccaggaaagtcctctgtgtcttgtatttggttacaccgaggaggggggaaaatgaagtgagtgatgtttgagattgttaaatcagaaatcagagcatttcttctctttccctttacttctcctttttttttttttttttttccaaccttacaggacacctttttcaagaaaaatgtcaggaaaacagattttgtaggtaaaacaattttttttttaaagcacaatacaccaactctctttaggaagtagggtaggtctgttcaaaaggtccatcacaaaagtttctggttcctggtttgccacaagggaccctggcgtcctgtcctcctgaagcattcatgaatggcagttttccctgtgagccttccagcttggcttgaaatacatcagatcagggccttgtgccaagctgaatgcaggacttgttttgttaaccacaaaatgtgggattggtgtcactgtatcctagtaacaaatttttttgagtcctcccttgcagagatggtttttgagatggccacttgactgagagtcactttgagtcaggagaattctactgtggatggggccaggcccgaaaatctaggtggcatttatagaaagcagtttccaacttccttgtgcaatacaattggtgaccaacctatcaggccatatgtacaggttaattaggaagctgtgttgtttcacctggacagatgaaattcagcagaaagccctctttaggttacaccctgtgataacccagtgatttcctaatggggggctgcagtctaatagctcagcacattggattgagaggaagaatgtggatattcagacatcactgaataaaactccttttatttagcatttccagaagagcaaagagtcattccattgagcctgtgttctcatccttgttgtggtgtgctaatttgaagaaactggcttccatatatttccatagtaactgaagtgaaataataaaggaccggctggcaattgctgtttagaacaaagggttaacatcttcatcagcctaggaacattgcagagatactgacataaagttcttctgcttgataagtgttgtaaggggaaacgtgcatctgcttaagagataccagtttagagtgtcatttgaaaagcctgattctcagtacttatattaaaatttttatttgaacatagtgttttgggttcccccccccttgtgtgtgtgattgtgaattcgtgtgagggagctctgtgtcagacaatccaaaatatttcagtactgagaaataaacagtgataattgagacagcacaaatataattttatacataccatgtgtgagtaatcagtgactctttttttgcatggcattttaaataattttgcttgttagggggttgtgacctcacctgtgatacagcctcatcattttgtagtcagtcaataagactctgagttattcagactaatcagaaaatttttaaagaattgtcaattttatttaattgccaaacccttacaaagaaatcccataacaagttgtaattttatgaggtgtagaattgacagaatatcactttaagtgacttcccagttctgaacaaatagtgacacccacttggaccatgtacctggtgaaaatgtaaaatggactgcggaattgctctgggagccacagtttgccctcattcgaggtgctgaattttctgtaatgttgagttcaggctatctgtctctggagcattaagtggaatttttagaaagggagttcgaaggtggccatgaggcattgcatgctagctggtagtctttaccgaaatgggcacaataaaatcgagcactttggttgtgcgtccattcccacagtacctgcttagtgccattttaaaacaaatttaagaatttgcctgatgaagatgtcattgctcatacaaatattccagcctgacaagtgggatgtgattcagagaacagaccctaccctgtcaggaaaggctgtcttaaaaggtcacctgtcaccaaaaagctgatggctttttcctcccagctgaccctgactttgtaattagggtatctactgtttggtatgggttcagggcaagcttgcagtcttcacttgatcttagccaaaaggctgagaagcagtcaagcttgcattctttcagcacaatgctcttcagcacctactaaatgacaggcattaatggaggtgaatagcaacctacagccattactccatgaaagtgcgtccgtctaaaaggacatttcccacactggcccccagggtcgcacgttgggttagtattctactgagagccactcttctagatttgtagacttgttatttctgcagtcatctcaatggctgctttgcctccctcccttcgtccctctctatgtttattcaaatggatgcaccttgctctctggagacagcaagagtgcgaacggaatgtcagatcaagtagcagatgagttctcttttcctgatggatggtgctctctccctccttactgtgcactgagctgtaaataccagcagaccttcctgccagaagagtggcaaatagtccacccgatctcctcaggagtcagctgtggaattcttgagcctgggttacctattggattctaaagtagaacctatatgcttgttgaaaagggttgttgccagttagattaaatgggtgaagcttcatgagaaccaacatggctggaaaagaatgcagaacgtctgttctatgtgtgaacagggctggattagatttacgatgctcagagtgggagtgtgtcttgtttcttttaacacatggaactcgcagattattttgtgcttcttcacatgccacatctgctaaagataggacaagatcactcatgtttttcagctgctcacaataccctatctccgttaacactggagatttaatatgagtagaatgaggccctatttttccgatatgtgctcagcccatctggatactgggacttgactccctgtctcctagggtgttttcattctcatttcttatggagccagacaggccattatcaccagaatacatcttgatctgaaagacaacagaaaagctggtgaaggggtgattccaaactgaaaaaaacaaaacaaaacaaaaaaaaccacattttggaaagagttaccctcagaattgacactaatagagaaaacttttgattctgaaaaaagaaagtgtgcctgtttgtacatacccacagagtgtgggtttacaaatggcagatgttgagaagagcactcacctcactttcttactgattgcatcatcttaaaaagcttgaagatgctcaaatgaactccatcctaagaatttcttcaaatctgtgtcacattcttattttcttccatccctctcattcacacacagcattggtagaaaggaagctgtccaacagatctgtgattagcactgaggggaaggagaggagagagcagtggcttgttaactggttcagataaataggtagtttcttgtgtttagagaagcagtttagcatgcttctctaaaattgagagttggttaagagcatagactctgcaaacaggctgcctggcttcaaatcttggctctactgctaactaaatatgtgaccttacacaaggcccataacatttggtgcctcagtttccttacctgtaaaatgggactgataatgaaaataactactaataggattgtggagagcatgaaatgagttaacatatgaaatgtgctttgagtagtgtctagaatgtagaaatcattatacaaatgttagctctagtttttattcctttgattagtgggtgttcccttcccatgtggagttctcttgtcaagtaagtatgtgggacttagccaccctgagaagcagaaggggggtgctgtggttcatgttcatggcttcttccccttgcctgctctgcagcaccagttatataacaaactgtgttgtcataactgatgtgacatttttgatggcgcagctgcttcagcccaagagctggggtgacatttcaaagggtgggaaagagcactgaaccaggagtccaggtcagtagctctgcctctgcccctccgagggctcggtttcctgaaagagttggaccagggctaccccaggctcccttcctgttgtcaacggtgtatgaaattgggaattccctttgttttcagggtcttgatgttctcaatattaaagcatgaattatggttttatcccatgggggtgtagggtatccatgaaagttcttttaagactaagttaattgcagaatagcaacctcagccacagagctttgtcagccaggaaatttgtagttctgagagtcaatttgagaaaaacacctctaaccaaacttttcatgcagacatggttcttaaaccaaagaggaggatctgaaagtatctcattagtaagaaacaggatgtttctgggaggagagagccagtgacattagaagagaagtggtttttccgtggcttccaggatgctcagaagtggagacagccctagcgttcaccagaaatggctgcatatgaagaaacttgcctgggttaaggtgcctaaaacccagggagcagagagatttgcagactagtaaaaggggaggctcaggagaactgtattttaattttgattcactctctcatttaactttgggcagatcatttggccaccctgggcctcaatttgttcatctgttaattgggatgtgggttttcaccatagaatttctcagggctctttcgggtttccagctctaagatgcagtaaatgcaaagagaaacttagaagcctgaaaggcggtggggaatagtgggagtatttaccacccacagcttttatctgctgagccatctttagttctaattttctttacagagaagaggaaaaacattgtgcttttcatagcaccaaaaaattaaagtaaaataaaatcttgcaaggctaatagttggtgccctgaatttggccccttactctcttgatttgtcaaccatcctagaaataagtagaatggagaaaagagaaagggagaataatacataagactaggatttcatagctaacaatttaccttggattctctgcctgtgtcttagccaacagataggttttctgtagaatattgttacttatgagaatagcttctccatgctttaaaattgatcctggggtcacctgaccccagggtctcagagcactaatgcatattgcacattgtgaattaattaggtgtttatttgtctgtatcccttgctagcctgggtgtcccttcccaccagggctccctgaagcaaggatgttacttatttttgctcatagtacagcaccatgcccaatgcctggcacaaaggaggtcttaataaacgttagttaaagaaaaggaagaatacgaggtatataaggaatgaaccttattattctccataaaccaaaataatcatgttgaaagcttttggtggccatggaatgtgttcatcattttcaatctattatattcatttgtttatcaacctgtgagcaaatatagtcatcaattccattttacagatgaggaagtgaggttcaaagaagtaaggtggcttgctcaaggccacacagcttagtaggtgacagtgttgtattcagacaatgatttgtctaattctaaaacctgtgttcttttcgttgtaactccacacctttcttactagaccacccccagtatgggcagtagagacctggcagtctacgacctcacacccagatgttgatggtgccagctgtggttgaggtcagtggctgagagaatagaaagtgcctaattggtgctgagttccttctggaggtggtagtaatggtcatcatatatcacattgatttggataccagagtattccctagcaaccatctggacaggccttgaaatgatttttcattaccgcctcaaaaatgggggccattttcagattgcaacagagagaaggctctggctttggtggaggcaggtgtcttggagaactatggaaagacaggatggtaggggatccatccatctgtccatccataagcatttatgattgcctattttgtgggtagcatacacacagtgtcatggaagtagagaggaaggcctcagtccttgtcctgaaggaactcatggtctggagggagctacacaaaaaagactcttgcacttcaggtaggaagggccacaatgtctgtatacacagtgtgctatggtagaacagaaggcaccttctctaggcaggaagttcagggaagacagccaagagacaatggcatgtgaactgagcctttaaaacaagtggtagttcaccaggtcgaaaaaaaggaatgccaggcagagggactggcatgtgtaaaggcattaagatgtcaccacatggaacatgctaggagtgtaaaatagtttgatttgactagagcaaaatatgtaagaggagtgttaagaaatgaggaatgaaagattggacagaaaccagatcatgaaaggccttatctattgtgctaaggactttggattttattctgaagataatgagatgccacctgagggttggcattagatcacctacgtagactggaggagatcagctctggaggttgggagaccagatggaaagttacttctgtgacccagttgggaaaaagattaagaactaagttaaagcagtggtagtgtgggtggggaaaggaaacagattcaagagatatttgggcagtggaataattgaacttatttgttgatcagttggaagagcattgaggaggagataaattttaatgagtatggacaaaaatgagtccaggattcctggtttgggctactggtggatggtagttaaatgcaggaggaagagagaagacttggggagaaaagtgatgactgcatttggtcatgttgacgattcttgtggatcatctgagtgcagctcctggtagtgggtcagataggacacacctggggagaggggtcaatttgaaattctgtggtgcttttgagtggcgagagccatagaagttggtaaccttagtaggctgagtgagaaggagagagaaggcaggcatgcgtctcccatcacacacacattccagctccaggaaatgagaataatttaggaagaggaacctgtgagggaaactgagaaggggtgatctgagaaatgaaaaagaaaacccaaggcagagtagcatcatgaaagccaaggaagaaaagactttcaagggcaggaagtggttagttgagtcagatatttcagtagacaaataagatgaagattggcaggtgtccatggagtctggcaagttgttggtgaccttggcaagagcagtttcaatagactggtgggagaaaagccaaattgcagtggagttaagaaatgtgtgggattgaggaaatccatgaagaacccccctcccagcccaaaagaaatgtgggctacagaaaaaaaggagtgagaggtagggagggagagagccctcctggaagggctttgcttttattgttcatttctacatgggagtagctggatccattgagaagttatccagatccctgatgaatggaaaagttgaaggtataggaaggaggaagtggtagaaggaacacaaccccttaggggatgggtagcttgagcttgacatgaacgtgcatctccttccctaagacagacaggaggacagtaaggatgggaagtctgtagagaaattctagggcataatgatgaggacaggaagttgagggagctcctgccttagcatttcttttctctgtgaagtgagaagaattaaaaagcagctgtgcttatttactggagcaccaaagaccaataacatttattctattaaaaccactcatttattcatttatctaatatttgtctcacacctattatgcattaggcactgttctgggtgctcggagtgtcagtgatgaacaaatcaagtcccagaggaaccgggtaataacctcatacacaaacaatcggacgcagtaattgcagactgaaagttttttctggggttacacctttaggggaggcctcgtactgatcacagagggatccaatttctgccttcagagagttgcaccagttggaggagacaaattcaattctcaaaggtgcagaagaagcagtgatggaatttaatttggacacaggctcaggattaagctgggagggaactgggtggagaagtgaaagttgcacagacactgttgttttactccaccgagctttactcatcacaggctgctccagtggggctgccagtcactgccccctgctgcttgaagagagaagtaggttcatgactcaggccttgccattcacagcatctcattcctctggccacagtgattggcccagggatgggcatgtgactcaagtgaggccaatcatcatccttctctggaattttatagtcactatgagaaaaaagctcttttccctgggatcccagcaaggtcctcactgggctggaatgatgaaagcttgagctagctgtctgtggccatgtttccacatctcaattgccctctgcaaggaggaagcgtgcttatcatgggagagactgaggctttgggagactggaggacaaaagagagaatggagagaagaaacacaaagagagagggagccagaaagacatctgatggtgatactggtatctctgaagcaggttctatggagctgacagttatgtgaatcaataaatctcttcttttacacaaactaatttgagctgggattctgtcccttatgaccaagatcacgctgacgaaaagcacaaggccttccaggatctgaacaactagtatgagctaaagtacagaagtaggcctggaacattcaggacaccaccagggagtagtgggcaggctcatgtggctgaagagctggggtttgtgggaatgtgaagagaagtgactggaaaggaagagtagggctagattatagggttccctgatagtttttctaaggggtatatagggtgccaagtcaggagagcctaccagtaggaggccagagatgaggctttagagcaaagagatttctgtagtctgacctaaggaattggtaggaaaggcaatgagaagttggatgggggagagattttggaggcaggagagatgacccctggtgtctagttgaatgaacatgagaaggagagagtatatcagagaactcctccccattttgaacctgtgagatgggatttagttatgccatcaagttaggaaacacaggagcagggaagagatagcagagaggatatggcaggtgaacccataagcatgaatttcaggtccttacagggtaacaggaaatgttgagttgtttgcttgggaggtagttctggcatttagaagagagatctgggctagaaggaaaagtgggcttagctgcccttgtggtcgggccatgagagtggatgtggtgtccctggggtgagcatacatatggccaggagagggagggcccagggaaggggtgcaccattgtggcagtgaggaagggaaccttccttcagtagacccacaggtagctccaactggcaaaaggagccagagagcagagtagcaggaggcaaacccagagcgccctgccacagtggatccccaggaagggaatgtgcttcaggaattctgggtggcgagcagggttctgtttcatggcattgccaagttagatagtactgaggaaagaccattgtatttgaagctattgcgggcttttaaaagtgcagtttcagtggagggagagggataaaagccaaactcaaaaaatttttatggtagaaataggtctggactgggagtcaagaacccaagttctcatcccagctctgttcctgtttagcttgatggtccccaggcgagttccttaacttccttaggacttagtatcctcacatataaaattaggaaactggatcgcgtgatctataagcttctactcaagtcttgaggtcataatttatatctttctctccagcaaaacagatgttcttgtggcaaaggaattcccctccttctcccttggccacccccaactgacataataaattataaaaaaaattaagctttcagaactctagtgctaattgagaaagaaaactgggacatcagctcagggaattgtggacaccagtgcatgttgtgtccatatgtactctccactgagaatgtggggccctgcgatgtaggaatttgtcttgtaatactgtcagagttatgagacctggatggtttgacgctgttccacagggagaagtgctgaaggtggttccacagtacaaagacaaaacaactcctggggtccctctctgaattcacgtggaaagaaaaaggaaggctgtgaatctgagctggctgtgtgcaggagctccagccagggcagacaacaagagctggagggacccatgcattaggagatggacaagcctgagggcaccagtgggcaagggcaggagaggcacccactctatctccctggtactctgtggcctcattggtgggaggaccttggggaagggatggtagaatggtgatgtgtggagagcctagttctgagctgtggccattcttcctactcttaattccccatgtgctatggaaggcctgtttcttctttgaatcctttccttagagtttcgaccacatggcccttgctattccctgtcttctttggtgtgggtttgttcattctgtgaaggccattggaagaccagccatagtttggcactttctcagtttctaggaatagattctttactaagatagacaagctccctgcctcaaggaccttacagttttagagaaggaagatggtacaggaataattgaaggcaaaggtcatttcatatagtcatgcgttctaaaggaggaaactgggattaaataatggagagggattggaggacatgaggggtaaaaaagcagatcaggaaagatctgaggaagagggaacagcagatccaaaggctgtggcacagacatgagcagaaagaaggccagtggagctctagaccacagggagggaaaaatagcacacaatgaggttaaagaggcagttagggccgggcgtggtgcctcacacctgtaatcccagcactttgggaggctgaggtgggcggatcacaaagtcaggagatccagaccatcctggataacacggtgaaacctcgtctttacaaaaaatacaaaacattagctgggcatggtggtgggcgactgtagtcacagctactcgggaggctgaggcaggagaatcacttgaacccggtaggcagaggttgcagtgagccgagatcacgccattgcactccagcctgggcgacagcgtgagactccatctcaatttaaaaaaaaaaaaaaaaaaaaagaggcagttaggagccaatgttcaaggaaggcctgttggctatggaaggacatttgggtttcattttgaatgccgtgggagattgacaacttgacctgacttatacattaaaagatacctctgcatcctggaaaaggcaaaaccacagggatggaaattacatcagtggtttccagggaattgggtgtggatggagcttgcaaaggggcacaagggaacttttgtgggtgatgtaaatattttctctcgtaattgcggtgatggttacactactgtgtatgtttatcgaaagtcatcaaactgtatacctaaaaagggtgaattttactctaagtaaattatacttcaataaacctgacttacaaaatgcatattttttaatcaaaaaaagaattgcagtaaggcttaacagaatccctctggccgtcctgtggaaggtacatggcagggagcaagtctggaaacagggacggttgcacagtccaagccatacgccccttcaatgctgtgcttacaattcagcctgtattatttgctgatcccagtggcttccttacaccagcttattgatgtgtgttcctagttttcctgtttacctagcttttccttcaaaactggtttgaaacctcagtgtggatagaaaccatctgcttcttttgtatgtgcccatgggagatggcttattacatattactctccttacatttaagtagtctttaacatttgcaagcaattcatgatctcctttgagccttacaacatcaggctgcacatatgttaccatgttcccattttacagatgaagaaactgaggcgaaaataattcagtatagcagtgtgaaagaagcatgaactttggagattttggctttgccatttgttggctatcagtgtgatttgggaaaattattcagtctctctgaacctcagtttactgattgttaagaaaagaccaaaaaaataaataaataaacacactgcagatacactgtgaggagtaagtgagataacacagctaaaagcaggtagcagataattgaaattccctaaatggtagctatttgtatcatttttgctatcagagaaaacatgatttatttaaggtgatgtggccagtacgtggtagaactagagcctagtttttctgattctaggtgtgtttctctttccatcacaccactcagaacattcttaattgttatcaattaattgttccagggctaactactttttaccaacttggatgcttaaatacaattgttgattattcagcaaatatttattgagcactcaccatatgttcaacactgttgttgacacaggatataatagtaagtcaaaataggctccacctctgcccctacaggtaataaagcagaatggtgagggagcacctacctcggtgtggggtctgggaagacttcctaggggaggtaacattgacactgtctttaaaagaaacatttttgttgtgatgtagatcaatatacatgcaaaatgtacattaatcttatatgttttacagatttttagaaagcaagcactcaggtaaccatcactaggtaaaaaagtaggacattgctagtgcccaagaatgtccctaaatatccctttttgatcacagctccctgcctcactccttactaccttaactttcgtggtaagtttcatgggtccttgcctttctttagagtttaccacctacatatgcatcctctaatcatttagtctagtttctcctggttttgatataattggaatcatgctatttgtatcttttcttcagtattacattcataatatcccagttgtatgtagctggagttgattttcattgctatatagtattctatggtattcattttatgaatatttttaattttcctatgtagcattcataaatattagtgaatattcatgaatatgctatatattattcttcacctcattgctatatagtattctttgttacacaccagctgtgactatactgtaatttatttatccattctactgttgatgtggcattttatcattttgagtttggagcagttataaaagatgctgctatcaatgtgtgtgtgtgtgtgtgtgtgtgtgtgtgcgcgcgcgcgcacgtgtgtgtgtgtgtattctggggcacatgcatttgtgaagggttctttgaagaggaattgctgggaatcttcaactgcattagataatatacagtgttttccgaagtggtaattccatctttatattcacggtagcagaaagaatttctgttattataaattcttgctgccaatatttggtactgtccaattttttcaattttaccaaaccaataggcaagtagtagatctcattgtggttttactttacatagtctagattgctaaagaggttgaacagcttttcctatatttattggacatttggatttcctcttttgtgaggtacctgttcttttgccactttttaaattaggttgtaattttctcattaatttgtaggtgttctttatgtgttgtaaatactagtcttttttgtttttttgttttttgttttcattgcaaatattacctcccattccctggcttgtcttttcactttgttaatggtgttttatgctaaacagatatttctcttttttaatgtagtcattctttcagtctccctctttttggttagtgttttttttgtgtgtgtcctatttaagaagaagtctttccttatcttgaagctcaaaggctaccctctatttcccgcctctttaaaaagctttggagatttattttattttctatttaactgtttaatttacttgtagttgattcttgtgtatgatgtaagttgttttttctctaatggatactcattggttccagctttctgtcactgtttctgtggggccaccactgtcataggttaaacatgtatgtgataagcatgcagggacctgtttcttagctcatatagcatcccattggactctattcttatgacagtgccacactgtcttgattatgatagctttgtaacatgtcttgatatttggtttagcaaatcccactccccttggtcttcatgagtgtcttggctgttctcagctctttgtgcttgcatgtaaatgttagaatcagtttttgtgatgcatgcacacacacacatccctattaggatattaggatctgttgattagtatttattcgaatccactactctgagtagaattgacatctctaaatcttgagtcttcctgatccatgagcatgatatgtttcaccattatttatcataatttcttttaagaaatatttataatttttcccatgaagagctcatgtactttttgttagatttataactagatacttaatgtttacaatggtcttgtaattgcttcttttttttaagagcagttttagattcacagcagaattgagaaaggggtacagaaaattcccatacgtccctccccacacacatgcccagcctcccccttatcagcagttctcaccagagggcacagttattccagttgatgaacctatactggcgcattataatcacccaaagttcatggtttaccttaggctttactcttggtggtgtacattctatgggtttggacaaatatgtaatgacatgtatccatcattttggtatcatacagagtattttcactgccttaaaaatcctctgtgctccacctgttctttgttcttcccccaactcctggctaccaggaatgtttttactgtcgctatagctttgccttttccagaaatgtcacatagttggaatcatacagttggactcaaaagacttctaatatgtagccttttcagattggctttttctcttagtaatatatatgtaaggcccctccatgtgttttcatggcttgacaacttattttcttttagcactgaataatattccactgtctggatataccacagttgtttatccatgcacctactggagaacatcttggttgcttccaagttttgggaattatgaataaacctgctgtaaacattcacgtgcaggtttttgtgtggacataagtttttaaatcctttgggtaaataccaaggagcacaattgctggattgtgtggtaagaacaggtttagttttgtaggaaactgccaaattgtcttccaaaatatatagatatatcatcttgcatttctaccagcaacaaatgcgagttcctgttgtctgcaacgtcaccagcatttggtgttgtccgtttttggattttgtccattctaatatgtatgttgtggtatctcgttgttagagaaatttggatttctctaatgataaatgatgcggagcatcttttcatatgcttatttgccatctgtatatctcctttggtgaggtgtctgttaagggctttggcccactttttaattgggtcatttgtgttcttattgttgaattttaagagttctttctatattttggataacagccttttatctggtcttttgcaaatattttctcctaacctgtggtttgtcttctcagtctctggttaattgcttcattttttgaattgcattttgtatctgtttctggtatatagaaatacagttgacttttgtgtattgatttttaaattgatccaccttaattgttgtataattctaatagttaatttgtagattctaaggcccagagaggggagtgatctgactaggttcctatggctagctagtagcagagcaagcatgaatgtggtcctatttctgctgacttccaaggagagaatattcaggaagggttagggaaagccaggtggggagtaggaaataacatttattgaacacctgttatttacaatgcttaatatgcagatcagcttaactctcattggaggcagattattgataacccctttttatagatgaggaaagtaagattcagagagatgatgaaataaacgtgttcaggcacatcactgaaagaacagtctacggttggaggagtgctgttgctctatcaagcatacaccagactacatgccttctgcatttgagcatagacacccccagaactccctgggcctcctacctccagctatgccgtcctccagggtcccctcccagcccagctctggggctgcctctattaaggctctgctagcatctctagacttgtgcaggcctggttactgtcaactcttgggttgagtttctgcccaaagttctgaggtcagtctccacccctgcccttctacatagttccctcccaaccaaggaaatgagttcacaacttgttgagttctaggaaccaaattaggagttgctctgggcatcttgtttcagtcgcgacttgaaaatgcggttgaggttttatgactgctttgttatacagtggcctagagagaatttatggtcgcagtgcttcccagcaccccctcccgcttctcgttgattgtccagagctggctgcatacaaggagagggtttgcttctgctggctgtgcaaaggcatggggaaatgctctgtgtgtgaacacagcccagcagtgctctattcagcgtgacaacttcctactttggaacacatggctcttcacagggtgactgtaaattatgcaactccagagtcaaagaatgaggaataatgggggaaaggaagggacaaactgcaaacttcagcctggatctgaaatgtgagtgtggagacccaggctgcttggcaattgatgggaggagagtcttcaacgactgagaaaaaccaggaagtcctgtcgggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatacatggtatgtaacctttgtcccgatggctccaactcgtccttttttattattgcttcatgctaaaaattggtgctcctaagggcaattgtacagattctcaccttctcctccacccgcaatggtcctggaatgcagtgaactctgcttcgataagctttgtggaatgttcctgtctcttggctgactgtcatctctcatgacttgctgctttcagtggtcccacctcaagcattattccccttctcttgttctgctctgaatctgcgatggcccagaaaactaaacgaccagatttgtcacaatagtgtgtagagcaagaatgaataggatataattgaggacctgaggaactcttctagaagtagagtgtttgtgctttagtgcttggacttgtctgcatttctgcctatctatgacacaggattaagtatgtaaaaatgaattggcagttactatacagatgtaagtgatggtgacaaggtcgctgttgtgctatgtgggtgctcagagttcttcattgtgcttgtccttcctggctcctggtagggtttcgattcacagaaattactggacaggtagcttccagataagagtgatgaactatcatttctgacaaaagatgttggacaggctgtggcagcaaggaggtgatcagaagactccctagagcacaggggatctggcaggctttttctataaaatgacatggatacacacagggtcaggctgcctgtgggcagagacgtccccaggagccctgcccggtggccagcaccacggacatctgctcacctgtggcagaactcggagtctcacagctaagccaggccagacccagttgctactttttggtcaagacccgctctaggaattcttccagggaagagggaatgtgaatttgtctgttttcagatatgtgtagcctttacacaaaagtgtttgaaattatttggttaaaatgctttccatcgaggttattctttctttcttcttttttttttcccactctgcagatatccattgagcttctactctgtaccgagcaccatcttaagtgttgtaactgagcaagacacacaaaatctctgccctcctggagtgttctgacattcttgttaggggagacaggcaataaataaggaaaatacatagtagtattatacatcagctggtgacaagtgctatggagaagaataaagcaggcaaggggcatgagcgggagggaatgttagttttggttttgggggtgtttttctgagatgggatggcggaggatgagtcttgccatgttgtcaaggctggttttgaactcctgagcttaagtgatcctcccaagtggctgagattacaggtgcacaccaccatgcatgccttgatattacagttttttaagtcgtcagggagggccatactagaagatgaaattggagaaaagccttgatggaggtgaaggagccagccatgtgcacttgggggaagagtgctccaggcagccagaaatagacagtacagaggctccaagtcccgagtctgcccgtgtgcaaaccacaaggaggtttatatgtctggagtcacaaaaaaaaactggaacaatgggtgccctcatggagtcagtagtttctctgggtgtggtctcactaaagacaggggcgggaaagaaatccccatcacagactcgtgtagacctgtgacttgtgggcattcagactgtgttattccgctgccaggcctagggcttgggggtggtgtcctgtggatgtgtgtgtgtatcctgacaaaggagggacatggaagggaaggatcccttccatgaatgaagggggttgactctggcataatctaggaagaattctaggaagactcagttatttctggttggtttacaggagacaaacactgaacatgttgggctgccttgccttgctggtctcctagtggaggaggctctcattgctggggcttcccgttggccctagctctgcatctgctctcccatatcagcattaccagaccatgagcactgaggctgtcacaggacaaggagcctggccccagacctcattcagggctgctgacccagctttgggctccaccgtagacgtgctcagtaagcaagcctggggtctaggggcagacacctgggagcagagtcacaggggcaggtttccccaagtgtagcctgaaagtttagtggtatacaaatacacactttattttaatgtgttttaggacaaaaggttcctaacacatcaaaaccatagttttacagataattattgcttaggatgaagttaaagtaaacaggacgtttttaaaaagacactaaaaatcatgtgggtggcacaaaaatcctatctaagtagtgctaacctcaagtctgccctcagcatgggagtaccaatttctgtctaggggttcccatctcttagggatgagaatgccttggaagaagtcctcctctgccatcctgggaacacagtagctgtccctctgtcccaaccccaagcctgtgagctgtccacaattctcacttcttcccaacacttgcgtaccgggtgtttctgtcccatggcctgtgcctggcctgggccccctcactgccatcacctcccagccttcctctgggtccggtgcataaagtctcctcagctgccttctagaaatgctgtttctgcccttcactgccatgctaagtcaccctctgcattgggtctgggcattggcttggcttggaggacataccatggtgtagtgcaccacactgatcctgagttggctccccctactacagaacgccttctccctggcacccaccacctcctgcctccatacccatagctggtggctgccaaagcatgcttcctcctctttctctgtagatctggcctccaagggccgctcaagtctcatctggtccatggggtgttcctctggaagctgaaccacactggtctctccagttctgtaattcttttacacaggatgtctgtaccccaccattaagagtttttatatgccctcaaggtcccatagagatgacttctttgtctatctgagtttcgtagacacacgagcaaacacacacatgcactactaccagaacagaatagtcttgctcaccatgagcctgacacagagctctgtgcgggagccaattgaagagaagcggtttcagcacaatgaagggtaccagcctggcttgaatcctggcagtgctaccttctagttttgtggccttgggcaactaggtttgaggatgatatgaaacagtgtagaaattactgagcccagtactaggaacataataagataattgtggttgttattgttcactaattggcaaacatttgctatatgtacgtttggttccttgtctaggctgtaaacctcctgtggattcttggggcacagtgaatattcagggtacatttacataataagtagagtggtccatttacattgctgtgggttctctcataaattggctgttaggtgtagaagtttttgcaagcttatatgaaacttcagtatacatacatgatatgtatcatttgtgtgtttggttcacagtgggttaagaattgttgagcttatcaaaccacagttctgtattgagtacttactgtatacaggtgagagggaagtgtatacccccactctcttcctgatgagaagactgctgtctctgactgtcccatctcctttctccacagcttggatgtgtacctctgctccctatctctacagatcttggagtttttagctctccagcaggtgctaggaccaggtttcagcaatagaggagtgggtggcagggttgtagtgctaagtgcaccattctttacacttatttctactgctaggagcaaaaaaatccaaaggaaacatcatcttggtttaggcagtggttacacaggtgacacagctataaaaatccactaaaatgtacatttaagatgtgtatgttttactataggtaaataatatctccattttttaaaaggtgatcataatgctttttgttaagcaaaggaagtcccagggaattaagcattgcccctctgagttcaccagcctcaattccactgggagggccactcagccgggggaggtatttgaacccttaaaagtcaaggatacaccccaggcagcctagttttccctactcaactcttaggcattggccatccatgaaccttcttcattcttcacatttgcaccagggaagagatgccccagcacctgcttcaggccacagctctttctttggcacaaacctgcctgccattgtgaatcattaagtgttcaagtcttgtctctgccaccttggggttttttacccactataaaatggcgataagacctgatgtggctgttaggagtatcaaatgatataatggatgtgaaagtctcacaggactgtaaaatataagctgtcaacaaagtgcacctccaagcccagcttatttccacagtattcaagagccacaaggtttggaagagtagtaaagtctagtggttcagcaggtaggctctggaggcagacagcctgagttcattggtcctggccctgccacttaacagctgtgggacctcagccaagtgcttatccccttggtgcctcagtttcttacattgtcaaatgggaataatgatagcacttacccacaggattgtagtaaggattagatgagttaatccagataaagcacttggcttagggctcagctatgcagctaatattgctgggagcaagggtctctgctgagccttgagagaggacatctttattgggcagaaacagacaaaaactgaacagatctcatttggatataatgcttcatgtcctggctatattttccataatttggagctcaagattgattggtaagttttttcatgctgaaaccattcatctttcgagttttcctaataaataaaggtccctgtgacatgttcttgccttcagagttttgctgcaccatctatcgtgagccctctgatttacaattcagcaaaaaagtgacagactgggtattcttgttcaatccaaggtgattgctgcatagtcatttttaataagacatcagatttagctaaacgcttgcagtgaggtattgtgcatattaaattcaggatgctggttatacgggctgaggctctgcatctttctattgtgagttgtgagtttaaaaatcacataaaactgacatagtggattctttgctgcctaagggggcaagagacccttgttattagagtcaagtgttgactctttctccatctagtgaataaagtaagtgaagtgaagtattgaatgagtgtttgtgaggccctgggtaagggggttacatttgttgaagggctggtgagtgacaggtgttttagatgtaagattatttaatcatcaggcattataacatgagttaggtattatgactccctgtctacagatgggaaaactaaaactagagaggttaagtcaggtgtccaagttcactctcttagggttgagccaggatgtgatcctgagagctttcctaaagccccatattgcactattttagggttaccattaacagtatgttatgtatgaacgatcttattcctgagtagcttaaaatcaaataggagagacaaaacatgtaagcaaattaacagcaatgcatggtaaagtcccataagggacagagaatgtgctgtgtatgttcctaggaggaaagaggcatttgttcagatggaggcaaggaagatgccaaacaactcaccatctgaaattcattttgttgggcctagcatttttatcctaatgtccaagtatgtatttctgatattctaagaattgccaaaaataattatgaagctgtgcctagccccaggtgggcgagagatcctctcaaatgtcccactgtagcatgtctctttatttcctttctgtcctttgctgaaaatgaaaaatgtcccattgtactgagtagagctgctctctccctaagctcaatggccatctggctcacaccttcctgaacaaagaggtgagttgtatctgggcctccactgccttgtgtagtagttgaggacagaccatcacccaccagtcttttggttcttgcagggatgttgaggtgacagtatcggtggagaaaacccaagtggagcacacgtgccctgctgcagcaggctcggcaggagagattttcggcagataaaatgagagatgacgagacctggtgaacttggggcccaactataccatcaccgtgatacttggctcggtgggccaccagcacttgagcagggcatgtactctgcccctgtgagagcttgacagcaacccgctgcccagtacttcctgcctggtgtgaccctgcctgcccccacccagcttcttcccttgcccattgccatgtctctctctatgctggaaccacactggtcttccatccgtgtttgtaagattttgtgtgtgatctctcactcatctccaggcctttgtccatggtgtgccctattcctggaggcatcttcaccctgctttttgcttggccaaaggctactcacagcccatgcctcagcatagatgtcacctcacggaagccttctttgaacccatagaccgctggtgtttcaattgcacattgaacagaccgcccctcactttacactgctccttctattatcttttcattgtgggcatgcacccacacattttttaaaatgtgaaacacaccactttaggggaatatgctcagttggagctgttcttgccctcaccacacccaccccccaacccagctgctcttctgagttggcccattgtggaaagaagccattgcaccctaggaatatcatggggcatgaccacctaatgtcaaggacacgtgccaacggacatgttagtgcaccccgggagtgtactggtgcccaatgaccataccttttccatcccactgggtcttgtttgaaaccaccacattgggtttaggtctgctattgttaacccttcctattgccctgccttcttggagctccaaagaccttctggcagtgagttctcacctagccctcccctctctggcaagaccctaggtcagggaggaaggtcctgtgtggcaagaaagcctgtcaggcttgggaagtcaaggcaccccattgcatctcttctcctgcttaccattctcacagcagaaagcttcttgggggagtccttagtttgtcagctcatcatgactgtatgtcctccagaaaaaccagggtttttaaaagagttttttttctttggtatcggatattaggaaatgtatccttcacctaccctctgccccttctcccagaaaaagagactaatgcacagagtggaactttagattttcttaaggtgtacagcaaaccagaggtcaagacttgaacccacatcttttgacccttgatacaggccctgtccattgtcccattccactttttgtgtggctccttcatggctctgacctcccccattctcgggaagaagcctgaaacccccggcctgcaaaatagcccttgagagagaagcatctggaagtgtgtgctaaagctcccagagcaatggggggattctgccacatggctgctgtcagtagggtaaggttctggactctctaaagtctgagaatttgaattcctagaactagagaaggcccatgtcagttcaaaagtcagagcagaggaaaattaggaatcttgtttttaatgcagaggaacaaaaggagtggaaccatagccccagaaatgtcaacagaaagggcagaggtgaaggtggcccctgacaaaacttctccatacctattatttttgtaaaatctccccatagctctttggacagccatgtgaacagatatctttggcctctttttgcaggtaaagaatctgaggttggaggcaggctgggacaaggctcctgagtcctagcctgggggtctgccatcatacctacctgcttacaaaaaaatcacctctatatcctacatataccctttcctcccacgtatgctgtttcctcccctctgaaaaaaagtacctcagaatgtgctttcagagatcattctttcaaaaattgttcactagagcctactgtggccaggttccctggtaagtccaggcttccagtataaaatgacatatggactttctcctgcaagcattcacagcattctggagaagtttggggtccaaaactgaggttcttaatgtcttttgggtcacaaacccctatgagaaactgatggaaactatgaagaatttccttagaaaaatgctcctgcattttttaatttaaaaaacaaatgtttgcgtatgggggttgctgtggtttgaatgtgcgtcccctacaaaattcatgtagaaacttaatctctaatgcaacagtatttagaggtgaggcctttaggaggtgcttaggtcacaagggttccaccctcgtggatgggattagcgtgggttttttgttgttgttgttgttgttgttgtttgagacagagtctcaccctgtcacccaggctggagtgcagtggcacaatcttggctcactgcaacctctgctgcccgggttcaagcaattcttctgcctcagccacctgagtacctgggattacaggtgcctgccaccgcgacctgctgatttttgtagttttagtagagacagggtttcaccatcttggccaggctggtcttgaactcctgacctcgtgatccacctgccttggcctcccaaagtgctgggattacaggcatgagccactgcacccagccttggattagcgttttaataaaagagctcaagggggcaagttcaccccttccatgcccttttgcccttctaccttctgccatgggaggatgcttcaagaaggccccactagacactgaatgccagtgcctcaacgttggactccccaacctctacaactgcgagaaaataagtctctcttctttataaatgcctaatctcaggtattttttttatagcagcatggacagactatgacaggggttagcagtctcccagaggcagtctggggacccaccacaccctgcctcaagtgttcaccgatttcagatgaagaagtcatggggccaggtgcagtggttcaagcctgtaataccaacactttgggaagccaaagtgggtggatcccttgaggtcaggagttcatgaccagcctggccaacatggtgaaaccccatctctactaaaaatacaaaaattagctgggtgtggtggtgtacacttgtaatcccagctactcaggaggctgaggcaggagaatcgcttgaacccaggaggcagaggttgcagtgagccgagatcgcgccactgcactctgcagcctgggtgacaaaaggagactgcatctcaaaaaaaaaaaaaaaaaaaaaaacatgggaccagatgatgcagatgatgaaattatagtcttgttcttgagaacagttgttaattctccaaaggaagcttgtaccacggggtacaaggataaaagcatgggtatgatttttctggtcatcgtcatcattgtttcaggagtcaaagttgtacacatgtcaatgtcctgtggtctttgattttttcccaggttggaggggaaaccaaggcaggaggggtagccagcaccagagccagtaatggtgtctggagagaatgtagccatccaaccccagtgctctgcttctatgcagggatggcaagaggctaggtgggatgttgagggaaacttaggaaaagagctggaagtcaagcacagaagttttgcaatggagtttacaagagtttttaagataactcaactttgagatgaacaggagattgagaaagcctttataaggtcttcctaagtgatgctgacagctaagagtggcatgcccctgagagtctatgattatctcgcaggagagatctttatgggagccttattaagaacagagcatgtcagtgggagggagggagggagcagcagcgtgttcacagctctggagggcaagtgaggcagcctccttgatttgcaaagtgctttgcagtcctttttcattatttctgcaacagacccatgagatgggtagagaaccaccctgctccccacaaattgtagaacactaggaggtagtgggctgtccatctaaaggtgtccttataataactggatggtccctgggtttgcccctctacaaccaacatgatgtgataacctagattagaatgcctccccactccccagaccttggagtcttgtgattgcttgtatcagtggcctcttcagaacaaaagcatacaagcttgtccttctatgagattgtaacccctcaagcatgctcactagttggaggaaattctgacagccctactccaggcttgaggctcgccctggagcctggtaacttgagcctccatcgtaggtgtgtgtgagaaaggaaatgcagaaatggagtgagccgaggaaaaacccaggggcgacagatcctcggagagcatttcatccagtcctttcccttgacacgtgggagagcaatgtgacacggctttgctgctagatggtgaagactggcgatgaggtgataatgatagctagcatgttttgagtgccatgtcccaggcatggtgcctgatatcacctgtgcaccctgcgagatgagctttgcagcgtggttgagtatctgtgttatatacagagaccctggtgctagagccccagcacccagctccagcaccttctgggtgtataactgggtttcttattgtggctgtttcaattggccacagattttgtggtttaaaacaataagatgtattgttttacagttctattggtcagaagccccattcaagttcaccagcctaaaatcaaggtgtcagcaggctgtgttcccttctggggcttctaggggggagaatccattccttgctcttggagattttggcagaattcaatgcctgccgttataagagcccccttttcatcctggctggaaaccgagggctgttcccaggttctagaggtggctgccacatatcttggcagaggcccctgctttcctctatcttaaaagccagcagtggcaagttgagtttttctcaggcacatctgactcttcctccattgttatatctctctctctttctctgatccagccaggaaaggttctctgcttttaaggactcatgtgattagattggacctacccggataatccaggataatctccacatctcataaccttaatggcatctgcaaagtccctttggccctgtaaagttccagggattaggatgtggacctctttgttgggagagggggcattattctgctcatcacagtgacctagggaaatttgcttgacttcttggtttaagtgggaaagatgatggtacccacctttgggttatgaggatgggatgtggaacccctcatagcacctggaatgttggtaaatacttagttggtgttagctgtgagggttgttatcaaacctgttttacggttgaggacactgagatttaagactttgagtaactcacctgaagaacaagatttaaactccttgcgagaaaggacaaactgcactgtattcatctctttcatcccccacagggctggcccacaaaagatgttcagtaaatggatgttgaatgaatgaggggaaccagaaagagtaaatgacttgtctgagtgctgttagagaaggtcagagatgaagggactctcagaagaggtcaagttcaagcctttcatcttatacctgggaatctgaggctcagtggggaagcggggcctgcctcagaagatgggcagtgcagagccccaggatgtggccagtgcctgtctggccagtacgtcttcctctggaccaggccgtattcatttccctggaggtctctagatcctgtggtctaagccaagccagaagctggtccagtgggatagaagtattgattctggcctggcccctggtacagcgtcaggcagaggagctcagtagaagagtgagaggtgagagtcctgcctttcttcctgcagtggcctttggagaagcctatctgaagcttgttctcaggcttctctagacctccttaggctgctacccggtaggatagcagccagatagatgcccatggcccactcatgcccatgttaataccttctgctctgacctaaggctgcatggcatagatgggggactggggttttatttttatttatttattttgaggcagagtctcactctgtcacccaggctggagtgcaatgttgtgatctcagctcactgcagctttgcctcccaggttcaagcaattcttgtgcctctgtcagcctcccaagtagctgtgactacagcgtgcatcaccacgtctggctaattttttgtatttttagtagagatggggtttcaccatgttagccaggctagtctcgaactcctgacctcaagtgatccaccaaagtgttgggattacaggcacgagccaccgtgcccggcccaggacttgggttttagtctgcccatttacacttacggctttgtggtatttagggcatttggctccttgggactaatttcatctgtagcccatctggacacttataaggtctcaaacaatcctcgtttcaggtgccctttagaggatggttcaaaaactttcacatcagcctcagggacagagctgtgctgtcattccaagggcttctggctccactgaggctgaacacaacttggcagccagtgaaatctttctggacagctgatagtgtcccccatctccatgggagccagctaaggtaggacagggtgctaaccagtaactttgctgtgctaggctgcccctgacacaaggcagccacaggaaaagccattatatctctgtagagcaggatgtggcatttatgctgtctcattggaatcagggcttcgttgtctgtttgtttgaggaggattgagcaaaatctggattggttttcctaggcaagaaatgccaagtgtcatgatgtcagggttaccaggtaactgagtagaggaatggaatatatgggtggtgcctggaaaggggagctaatacgtgttcctactacataccagctccaggcttggcacttttgtgcattgcttgccatggtttactgcaggtatgacttgcccagttttacagaagagaaaatggaggttgggaggtggtgactctccctgatcacccagagggaactagcagaaattgtttgggctctagctagttaaatatgagcttagttcagttgccaagtcaacatctgtgtgtgtgcactctgttgagatctgatggggctggagccatcttctctgccttctaatgggagggtggagttcattctggtggatagggaatcaataaaacaggggtataaaaatgatagccccatccattagtaagacagtaagcatttattgagtgtcttctgtgtgctctgttctagtcactggggacatacctcattcagggagctgccattctagtttcatgaagacggagaaacacacaaagttaactaaatgagatcgttgccagcactgagtgccatgaagaatgtgatagaggatagttgaggagctcctttagctaaagtaggcagggagagcttcctgaaggaatgaaatctcagccaggatgcaaatgatgagaatggggcagccatggaaaggtgtggggaaaaagctttccaagcagaaggaacaggagtacaaagacagtacaaagacagagccagtggtgagcctgagtgtgcagggaagccattggaaggagttaattaggagagagatgatctgacttctactttgagtttgctgtggctgctgtgtggaggacgggctgtggaggggcaagagagggagcagggagaccaaggagggggcatcatagcctttcagttgggtgaaagatggtggtaactgggaccaagtttgtggcagtagacagtgagaaattattagaatcaggcagtattttagagttagagtcaatagggcctacttatgattaggatagtggtgtgctggtaaaccagccaagggtgggagggaggcccttgttggtagagcttgccagtttctgtggtgtaatattcccaccacagctggtttcaagctacccatctggccagtgagtgatgcaacgttagctcttgtgagccagcacaactcactccagcacaccactgggtcaggccatggaagatagaagcaagaaggactgaagagcattccatggctttgctctgagcacctgggtagatggggatgccgtctactgaggtaggaaagactagaggtggaaagaaagatcctggggcagtggcaggaaaaaatggttttgctctggccatgttaatttttaaatgcacattagatatctattttataagttttgggcacttgcatcctttatgtcatttaagtgtcagtcctttcaataactatgagtttggtggtttcttctccattcacagaacaataaaccgaggatgcaagggaccaagaaacttaaccaaggttgtacaatcagtaaatgacagagctggatttgaacttgggtctgaccctgccccaagggccgaatcattgcccacactgccctccagaaagcatcccactcttagcttgatgctacatttttgggatttaaaaggggatctttaggaagttttgaacagcctttataccggagaagtaatcacagaatggttgctcagagaccagactctgccctttgatgtgttgtgtggttttgttttttaaggggtgtggcgggtagggaaaaagaggaaggtggggaggggaaactgtttgtttcattttgttttattggcccatgcagtttttttgtttttgtttttgttttttaaagaaaacaagaagaagaagaaagagagaaatgtaattgttttaggcaagtctgcgcgcccccgccactgctcctggcctcctccattccctgctgtctcaccacctgcccatttgacacacgtgacacttgcttggctcaggaggcatccagtgtcccgtgctctagaggagcccaggtgtagtggcctctgcaggcaggctcttggcttcatccttgcacctcagggagtgagcacctggttcccaccctgtctccaggcctgagccagtcactggggcctggggtgtgtttgatttgcactctctgctgctcccttcctgaccactgccagctacctaagacatcactgtgcttcaacggtaagagctgtggtctttggccaggcacagtggctcatgcctgtaatcccagcactttgggatgccaaggcaagacgatcacttaagcccaggaggtcaaggctatagtgagccatgacagtgccattatgctctagcctgagtgacagaggaagaccctgtctcaaaaaaaaaaaaaaaaaaaaaaaaagaattatggtctttctgattctatacatactaaagcaatcccacctctttccctggctttattggtattattttccctggtattattgttgttattttgctaacataatgaggctcggaggcatggtttttctgccttttggccttcttgctggtgatatgttcaatttaatggtgttcttcagtgtcactaggcgtggctggagctgagtggaagctgccatcaggtagtctgagaggagcacacaactgcgtaaatggctgtgtctgcctggctcccttggaccgagaagcctccattccctgcctgggcagtgctgggcttggttacctgaagaggcatagcaggattgacaggaagctctcaccccacggttggcatgaccagatagccctgagcatgatgccagggctggtggcactttgcagagccgaaaagggaggccagcctgcatccatctgcctccgtctgcacagttatgtgttccaagtgcaaccagaagaaggcttccccaggcttagccagggccaccaccaggccagactggaataggccgagacatacccagagagtggcagggttctcctggcatttccatgtatgtacctctttagtaaaagatgtttgagctggtaaccctgtgtatatgcatatgtatgtgtatatacgtgagtgtgtgtgtgtatatatgtgagtgtgtgtgtgtatatatgtgagtgtgtgtgtatatatatatacatatatatttatttatttatttagattatgtatattaaaatacataaagaaaaatagaaaatagaaaagttaactggaagttatcataactagaaatgtgatgttttcttctgtgcccctatggatcctgactcacaccttgagcttgccggccctgagccgggaccaggagctgtaagtaattgcatctctgcttcccaccagggcaatgggaagagcttcatgttcagaaaacttggctccaagccccagttctgctaactcacttgcagcatgctgtgggcacatctcctggccacactgccccacttctgtcaggtctgcatgaatgtcactttaagaccaccctatgtaaattagcatcccactgttaccgccccttcacttaccctgcttcatatatcttaaaagtgcgtagtgctactgacgtgtatatatagataaaagtttattcataggtttgttgttatacatgtttgttagttatctttactcgtgtatgctccatgagagcaaggattatcttttgttctctgctgtgtgtgtggtacatagtaggagctcagtatatatttgttgattgaatgaattaacttttgttttatataacccaatgctacttagtaaacttttgtaatggaggagaaatgaaaaagactttaatgcttgaaaggaggatttggaggctagaggtagaatcattttgaggaatatctgctttgtatagccgacaccattgctgtttttgtttttttgtttgtttgttttgagatggagtctcacttactctgtcacccaggctggagtgcagtggcataatctcagctcactgcgacttccacctcccaggttcaagtaattctcgtgcctcagcctcctgagtagctgtgattataggcacacaccacctcgcctgactaattttttttgtatttttagtagagacagggtttcaccatgttggccaggctggtctcaaactcctgacttcaagtgatccaccctccttggcctcccaaagtgctgggattacaggcgtgagccactgtgccctgcccccattgttgtttttacccatgtgaaaacaagtactggggaccaggagctataaataattggatctctgctgacaaccaggcactgttcatggatgggtgggtggatggatggatggatggatggatggatggatggatggatgaataaatagatagaatttaatcttcacaataacccattgagattaagtttcattgtctccatttcacagattaaaaaacaaaacaaaaatgcaaaaccttgaggcccagaaactcaagtgtatctaattccaaagtacctaaaaccatgactaaacagaatgcaggtacccagtgagtgtctgtggaatgaacgaaatcctagcttgttacactcttagaacttctcgagcttttccaccaagtagcttttgtggaagaagatggtgagtgtgtgcccaggagagtcgaagggcatcgcctgtagcagtccacctcaagccagagttgtgtttttttaacatctggctttttattttaaaaatccatgtgaatttctgtattatccttcatatggtgaaacaaactcctcctgtttgttttacaggaaaaatgatgcttttgatcatttggtcacttatgttccataactttaaaaaaaaaaaatgtcaatgaaagctgctgctctgcatgtactgcgggagtggcatgcttctggcatgaattctgtgcacctacgagctgcccagcctggtgtgcagtgaccacagtggaggctgctgtggggcctggtctcttccatgcccctcagtgggatcttgtgccattcgccccctgtgcaaacacagcttgtccagaggaagcgggacattcacctccaagccccagccatctgttgtttcaggcctggatgagggcttcatctgggtgaatgggccttcagcaaacagtgcctcgcctggtcccctgataaggggtttacctctccagcagattttatagctctgcccttcatccataatcagagcgtgggtggggagagacagagagtatgaaatatccctgaagctattggaatagcctttatggtttgttgtatataaacctgtgttctggtgtggtatgtgaaacggaccactgagactcagcccacaagactttgatgtcacatagctaagggccccttttctggttcatgtttcagtgactgggtttctgagcatcttctctaatataggggtccagactccaggatttccattgactcgcgataaggtttcttcattctttgtgtctttgctttcctcttcctggaaactgagttcaggcatgtccagagtcatgtgtggtttaaaactgaaaaggctcatagagaccatccagcccttgcatttctcagatggggaactgaggcccagagacagaaagggagggtgtgccccgttgtgctctgtcagtctgcaacctctcagcccgggtctgtggagttggtgccctgggtgtctgtccctgtcaggagacagctgaggctttgttcagcatttcttatctggttaatccccaccctgtgggtatgtcatatagccaggacccaaagacaggaagagatgaggagaatgaggatgtacaagtcccaaaacaggatgacaccattacctgggcagtgtggcttatgctttatgtgaaagactctgttggtccatgctcagactcagcccagcctactccatggccaggcccagaccttgactggcaactcacctcccagccctctgaaatccaccgtggggtaggctcagagcagactcacccttacccaagaaaagaactccattcaggtctctgcccatatgtcacctcttccaagaggccttccatgacaccctgtcttaaatagcagtcctcatcacttgccgtctccacgctctgcttaattcttcatttattaccacctttcctgtatttgtgtgttcattttttcttttccttttctagaatatatgttccctgagagccaggtccgagtctgttttgtccctagcacctagaagagtacctggcatgttctctgtgagcggggattagagagagagtggaacttggggaacaactgggagggactaaaagaactgggaaagtgggagggacgtggtcaaggaagagaatgagcacccttttctgaaccacttaaataaatctgaatgcagactgtgtttgaaaagagctgcttcaaggggctcatctgtgattccttgaaaaatcaccaggcttggtactaggcactggcacctgaagtcaggggtttttgattccctggcagtccaacctgtatttcccaagggccctctactcctctgaggctcagtattctctccacctggcaggatagggcccttggcaagatggagcctggtcccaggagaaggtgcacctctgtgacgatgtcgtccctgtggccacctgtcagtgcttttcccatctggttggcagatcagagagagaaagagaatgtgggggctggaggaggggggcccagaccatctgatccattcccatttattgcagatgggcaagtgggactgatgcctagagagggtaaaggacctacctaaggaaacacagcaaggcgttgacggatgtctgctttaaaaaaaaaaatgtttcctttactattgctcatcttttgatgcatcctccctcctgcagcctctcctacaaaaataaaaaaaattccacaaaagcttagcaagggcttcctaatgcttgctgtaacataattgaccctcttgagcctcgtagctctgagaagttcatggatcttcagaaatgcgcccagtaagacgaatagtgtttctgtctagagagagtggctctaatgagtcaggcatttcccaggttcatatcctttggaattcggttctgtgagctttaaacttgtgttctatacctcccctcagaagagttgtaaggtcaagcaagtgtagaaaatgctgcctgctacaaaaactcttggagagacacaatggactttagcatattaaagcctctgagaagttctataattaacaaaaatccaacagctctttttgtgtaattcagtttcccacacttgtttgacctcagaactctttttgcatgaaaaactattggcctctcacagagctggtcttcctccaaccacagacccaacagaccactcacacaagggagtactcagcacttacttttcattttatacagttatggctttttgttatttcagtataaaatacgttggaaaaaaaacatgacatataataggcctcctcaaaaggggttggggtgaagcgccctccaactaactttttacttcttataaccagaaagacaaaagacagcttcacgaagacatctcttcttctttatatccttgtgattctatttttattgctctaagagcctataggccatttccattttgtgagtacaataaaacatgccccttactcaaatggctttcaagacaggccggaaggacttcaccataaggaaaatgcatctatgacactcctgtagcttgggaggtggagtatcattgcactgaatggatttgaatcctgccatcaccaggcatcattacttaatctagctgtgtctgttttctcatctgtaaaatggagtgctcatagtacctggctaaagttgttttgaggattatatgagatctgtgtttaacatttagaatggggtccgatacaaagccgatacttacctgttactgctattatcatagaatgagagctctgtgtaggcagtgactttgttttgttcactatttacatgccccagtgtctagaacagggattagcacatagtaggtgcttagtaaagtttggttggatgaataagtgaatgaaaaaatgaatggaaggtcttctatgtatggagagcaatacacgtttctgagagtcagattctagcagagaaggcaccagattaaaagtgagctgcttgctgtaggccaaggcttttgcttcctctgccgtgtcctctctgtgtatgaatgagaagccagcacccataaggatgcaagtcatggtgtggaactcagaagcagagcgtgaggtgatttcctggaaggtggcagtgtcatctgaatgtttcaggcctcaagaatccaagcttgtggatttctattcctggttactacaggcaggtctgtgtctgcccagccagagagttgccaccatttacccttggagcctcccagcgaagatgctgcccatggagctgcttttgaagggggagtgcttctagctgtctgaggcaggctgagggccccttggccaccttgacactcttgttccccaaaggctccatgcccccttgtctgtgggttggcaccacataatgacatgttaacccttggcctgctgatgttgattttaccttctcttgagggaatataaccaaggcactggaccaaaataaacagcccagatgctgtgctgacccggctctgctgggaagcatggtattgatttgcccccagcctctctaccttcagtaacctcatctctgcctgaggctcctaagctgggaggttgattcacttctttccttggcagtgtattcacccaaacacccacacccactttgtttatattcctaaagaagccagcattagctatttttaaggactgtgagtggccctaggtgcccaaccctcctggtctggctgtaggcaggaggtgacaccccaaggagagtctacctgtctcaacctctctggtgggaaaacccagtagccaccagcctagggaatgccaaaggcctaagcaaacacttgtgcagccagccagcctcatggccttggccctctggccagaatgcccttaggctgagggtactcatggttggtggggtggggcagttcagactgatctccaaagaggggattgacagacatgctcggggcctgcagctgaatactgtctttagggaagtgcagctggaaagagggtttagctgtgattcagccaggcctgcagttcctcagccttgcccatgaggctctaatagccagtttaaggagagctcactgaaagtctgcatgaacccatgaactgtttcacagctgacccagcttcccagttctgcagcttccattttcccctgtccctgggtggtttgcttctcaaatccagggagtcttctccgagggtacaggagtttttgagggagtgtggttcagaatgggaccagccccttcccctctggttcccccccaactcctattccagtgaccacattgggcatgcagggggccctttccaactcaaagatcctccaagagaaaacattctagccttaaaaattgaggaaaacagtctacctctgtccccctggtcatctgcttgagccagagaatctgtttcactttgggggtgggcagtgtgtggccatcgggagctacactggctatttgcttgccccagtggctagttaatgttcagccaccagctgcctgtgaaaatgctgtttatgtctttcttaccccacagcccctcggggagtttaaataaggtgctgcggcacttgagttctgcaaaagacacctattcgctgaccagacaaagatgcttagccacaactcacaactctcagggtgcagttcgaagaggaggaagcagcatggcatataaagctcatgctcccttgaaggctggtgattgagacaagttatgtcttctagcatttgactccctcaaagagattgcaggacttccctctgattgcaggtggctcaatccactcagatcacctagaaacttgatagagatttagaatcttaaagaagacagaagcttagacagagcatgtagcccagcccatcaacagatgaagaagttgaatcctgcagggactacaaggaggtaggtagagctagcagaactgaaggccggcgggacactacgcagtccaggcaaggggctctgctgctgcagcctgtgcctgtctaccatttccctttggctcctggcacctgcctggtcagttctcctcgacatcccctgagagcacaaccagtctgacaattgttcctaaaggcagtgctcctaggggaatgcctgctgagagggaggctttcatttaacatgggacttgggtggaaatgcggagtgtgtcctatcctcccaggcctccctggataatctgtcaggactgtcctgctgtgcagccaacagcctctgtgtccttactctgctgggatcacccagccctgcctgggagctaagagagtggcccagccttgtaggtagccacttgccctttggattaagatgaatatgcatgattctggcaggagataagatatttatcttatttatttgacatgcatggatttcttggctctgtgtgaagtaggaagggaaatggagtggtggaagttggtagatgggcattttatgtacacgacttggacctttatcatttgaaattttcacaaagggggatcaaggctctcccgttttcactgagatggtgattctttgagtcatagcctattttgacttggagaagctgggtaccaggtctccactcaagttcaggcagtcattcttggtttcacttctcaggtaaagaggcatgttctcccattattgcttctgagatctttcctaaagatgatgaactggttgacctttgctgacaagtccacattagtctgctgtggggagaagaagtgagtggtgtgggcaattctggctgaagtttaaattgcagaattgaaccttagatatgagtttcatagtagatgtgttggagaaaagagagcctgggttaactgtatcttttctagtcccttcacaaaacacaggcacgcacacacatacagaaggagagagagacagagaaagagatcattcagtttgaatccatagaattgaccctgggaggtagattagaagagagaaagggaaagtggaggtggctttcttaggagctttagacatttccaggtatgacttccagataggtctggacctcagtgttccaggccaacccagtcaagttcatattggccaacatcagagagacgaagtaccagtcttaggtcaccctgcaaaaaaacctgactcccagtccagtgcccttttcactctactatgttacttctttcctagagtgacctttccaagctagtccatggctcaccagagcaaattggtctcgtggcattatagttacaccagcgctttgtttccaaacgcagtgatcctctgtaatcgccaaatacctatggctttgagggacttttgaacacaaaggcagactcaccaagagaaaacaaagtctcatcaccatttaaagttttcagattctgaatacattctgaaaatggcagttagaagtgctttagccaagggccgtgtcccaggaacgtgtaggattgtgcatttggatatctgtgtctagcttcatcacttattgctgggtgatcctggataagtttacttaatttatctgtgcctcagtagcctcatctgtaagagtagaattataatagaacttaggtcataaaatttttgtgaggattaagtggaatgctgtacatgaagtacttagcacattgcttagcacaaaatgagtactcaaaaatatttactatcagtattttattcttttgttttcaggtaagtctctcttataattgtacatgctatcaaccagtgcaaattaatatggtatcaagaatatgaagaatcaaaagactaaagagtaatgacattagctggtggggtttatgcagtcattcgttaaacagatatttgttaagcatcatctatgtacctgacatggagctgaatattggagctgagtaagatagatgtgatcttaccttcatgaacccctcctcttgtaggggagacagacatttaatgagtaactacggctgtgcagagcaatgccacaggatgcctgtatctgaaagagaaaggagaggaaggagagaggagaaaccatgcgttctggtggccaccccactgctgcaaccagaagaacacagccatctccctggaaatcattctgataaatttaactctaggggaaaaacacagccggtccatttccaaactggaattctccccccatgtgtttttgggaagcacagatgccttggcgttttccctctaacaataacagagattgttcacaattatgaatggttttggttgacttcagctccaacaaaaccatgaatcatttcataacttctgaaattgcaaagaaataacaaacactctggctccagaaaaaaaaaatggacacattatgaagcacaaagtcgtctaaatgaaaatgtgaattcttttttgtttgtttagcagctgcacgttgcaaggccagctggcaacggataaaagacccaagttagtgtctaggttcctggggtaccacttgtatagtctcatctgtgggatccgtaaccagctatgatataaacttcgttctccatctttctcaaaactttgggccagcagcattatttcatacattttacaatattctgagaaagcgagagtgaaaggaggtgcttgggctgaggctcgtgacagagggtctccatcatgggtcccatcacagatccccccccgcccgccccacacacatttgtgggacgactttttttcagcaggcctgctgcatcctcctgatatctagccacaagaggaggttttcaaaacgtgggaccaagaggatcaggcttcccccagtctgacagcctctgaggtaccaacaaggcctggcattggagcaaggttggctactcctcttctctcttaatccagaaaactgcatcctttcctaaaggctggagacacacagctatccttgattgcagtccagtcttgcctgtgcacgtggccagaggcacagcgggttctaacaccttggggctgagaccagattggagagtgggggacaagcacatgaccacagcaccacagtcacagagtcttcctccccaccttgttgactttcttttttcatgttaataatgtcaacatagtggtggccatcccactgctgcaagaacatttgttggaaagatacttcttttggaaaacaggctcaggggagcaattgttccccctcaagtctgcctgcactcctgatctctttccacgctgcagggtacacagcagacagcagtagactcaggcccattggcatagcatgtgcttcccacacacgcattttttaaagtaataattttgttacacaattaatgcttatttctcatagataatgtaggatatacagactttaaaatggaagaaaataaatatagcctatatttctattactcagagcgaatcataatttgcgtttgggtatatatgtttctagacttctttcaatgcatgtgtatgtgtttttaaacaaaagctagtatcaaactgaacacataattttattggccctctttactctcactgtacactctgaacattttcccatatctacatatatgattgcatatcactttatgccctgcagacatctctgtaaatctctggaagatttttccttttgtgtccttctccctaccatcagagatggagacaatagaaaatacacttcagtgtcacatcacagactcacatcttgagcactgatgtaagttttgcactagcccatcacaggcactctgcctgagacccttcctgctttagctgtgattatgagtgcccagttcatcagccaattcattgccaaggtagagcctagctctgtaaaatgcccacaagctttggcagcatgaaaaccatgcaaagttgcattgatgctactcacaagccccaaataggtggtctcaaaagagaaaaaagacttatgttttaataaaactccctttaataattaggtgctttaataaaaggccacttgggtcactgtctgcctcctcagcctagacttcctgcagttggaaaaaaccttccaaggacagagagggttctagggacatactggacaggccctgttcccagccgctgagcccacagggactgacaaggcaccaccccataagaatgtctgtacccttttggagcctacatctgtaggtgctgaggcatcacattcttcaggttctaatgaagaattattgcagtgatgagttgtagaaataatcatttaatgtttattattctgaggaaaatttaagaatttctgtattcagagcagattgacaaatatggcaaccacttcacataatccacacgctagatccttataaatgtcattgttatcactggagcctcagctatggttgtctttcccaagctggatgaataggactgccagttattcactaaagatagagacagcacatggcttctcttaggcctggttgctgggcagaggctatagcattgccttggggtagggggtgcaggtctcagcaactatccttgagcccttcaacagggagtcctgtctccacaaagatgtttataggtcaggcttttgagtcagaagaacaacttgcagttgttttctggggccacaggagttgattgggtaggtggtctggaaaatgaagaagcaggaggcttcacataacacaccctggatttagggtggggacacagccagccccagtgtaatcttacaatggagatgggatctcttcctcaggtgtgtctgaaagccacctcagcagcctccagggaagtgtcctctcattggtctcagctcagtgtgtggagggctcgggagtggttagaggcaggctcatgcagacaccattccctggaatgtgcttgtctgtatggtcatggaaggattttttctgcctcctcacatccaaattcagcttagtagactgttattgggcacccgtgctggtgccttgcctctggtgtctggctggggaggcagtgtgaacaccagggacttcacatcccagggtgatagcagttttcaaccactttcctagaactgcttggtttttgaaccatggtgctgtttaatgcttttattgagtggtgggtcccatatgtgtatacatttgagcatgtcagtttgacagcatttcttctcttgtcttgaacttttatctgagcctcatatcagaatcgaatttttcccatttctctcaacctttgccaagtcctccatgtaatgcctacacaggacctgaagaggaactccatggtctgatttgggtttaattggttggtcttagatttcccctccctctccaggctcagggtgcctcatagctgggcacttagggtgacaagcttatgagctatagagcaggctggggtgtttatcctcgtgcacagtcacgaggagaaggatgcttataaaactagaacaggatgagactctgtgggatatggtttgatttgcctcagctcaggaagcccaccccgatggagaaggagaaggcaggtagaagccaagggaatgacagtcaaggccaggatgcctccacagggaagagtgctccttccaggaggtggcatcagcaccgtccagctctctctagggctccgtactctctgtgtacatggtggcccaggctttacttcctgctttttggagtgggacctcgagaaccaagcagtcctgccactgcagcccaagcggagcatgcagttctttgccacaggccttacagcgctctgacgctgctcccatggaacttttcccaaccaattcagagcactttgagggccacagtgatgctgggagcctgtgttgtgagtcccactgctatccagggaaggccagtgtgaatgagtagcagtgctggggagtaaagcatcacttctcaagccctgtcctcaggctcatgtgcagcactagcgatgcagcactgactgcacacagcatgccactcagtcactgaggaggggaagtgagccccttttagttctcttccagtgcttcccatcgagttgaggagagtccattgggcactagaacagcttaatatccctctaaagcttgccaatcttttgaaacaaatagtctgttataggtttgtttgcattgtatttgtttccatggttatctcctatttaaagcaggtgataccatttaaggcaacaatgtaaaatttcctttttaaataataacaaataataataatatttgtttgcagtgtatagaattaaactaccaagcaaatgaagcataatggtataggctatggccaaaaatcatgagggtaatggagtgactcaagtttgagaaatgctgaaccagacctgctgctttccttatcctgcagtccagtgtcccttcgtgacaaggcatttgagaaggtattttgattgagtgtatgtttataccactcacaaggaggtcccagttacgagcctgtgggagctgggcatgagcagaagctgtgctgcttgctggcagaaactggcctgagctgcaatgggaagctacactgggaagatgaaaagccctggcctcagaagccctgtacctggaaaagggctaaatcccagggtggtcactgctagttagggggtgctgtgtcattcattcatcccactctcctgccagcccaggacagtctctggggcacagcagtgatagcagaaatgctaatagcaaacatgcattggactctcactgcattctggcacttcacctgagtcatttacttctcataatgctgaaaggtaacagtggtagtggtagtaataaggggaggagaagaaggaagatgaaaaaaatgttaatatttattgaatattcacccccaaatcatttatagattgaacataatccctatcaaaatcccaggtgccttctttgtagaaattgacaagctgattctaaaattcaaatggaatttcaagagattcagaatagccaaaacaatcctgaaagagaagaataaggtaggactcacacctcccaatttcaaaacttgctacaaagcaatgataatcagtacaacatggtactagcaaaagaataggcatctagatcaatggagtagaattgagagtccaggaataaacttatacatctatgaccaactgatctttgacaaggatgtcaagatcattcagtgaggaaagaatagtgttttcaacaaatggtattgggacaactggatagccacagggaaaagaataaatttggatccttatctcacaccatatacaaaaattaattcaaaatggatcaaagacttaaacaaaagaacaaaaactaaaacataggggtaaatcttcatgactttggcaaagcattcttaaataaaacatcataaacaacaaaagaaaaacaatagataaattagactttatcaaaatttaaaaattgtatgctttagagcagtggtccccaacccctgggccacagactggtgggaacccaccaggccatacagcaggaagtgagtagcaggtgagtgagcaaagcttcatctgtatttacagccgctccctatcgctcacattactgcctcagctctgcctcctgttagatcagaaggagcattagattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccacaaccccagtccatggaaaattgtctcccatgaaattggcccctggttccaaaaaggttggggactgctgctttagaggatattgtcagtaaagtacaaagacaacccacagagtgggaaaaaatatttgcaactcatatgtctgatcagggatttgtgcccaaaatatataaagaactcttacaactcaataataaaaaaacaacctaacttaaaaatgggcaaaggatctgaatacacacgcctccaaagacaatatacaaatgaccaatagcacatgaaaagatgcttgacgttattggccatcagggaaatggatggagaaaaaaagtagattactggttgccaaggaattggagggagcccaggagggtagggggtgacagctagaggctacagggttattttttttttagcagatatatgttccagaattgactatagtgatggttgtacatatctgtgactgtaccaaaacaaactaaattgtatactctaaataggcaaattatatgatgtgtgaattttatctcagtgaagctgttgaaaacatttattgagctccaggcacagttcttaagcattttacgtgcattaactcatttgcggtcacccagtgaggtaggccctgttatacaaatgtcaccattttgcagctgaggaaactgaggcagagttgcccagggcactattaatatctccttctagtgcataaggaaaatgaggcacagagtttagagtttgtgttctgtctgtggtcacacagctggtacagcggaggcagaatcacagtgtgatcccagaccccactcttggccactcgccatgctatactacaggcaaagcaaagggttcctgcccatggggagctgtaatctacttgagtgtaggcacgtaaatgggaaagaggttgagaaactgtcaggatgaccacctactaattcgctctgagacttcagttaaggcacagaattcctgggcctcagtttcttcctcttttaaaccaagtcttaggctggataaaagagggccccatcctggggttcatgaaagtagtaatgctggtctatggataacacttagcataaaaaaaaaaaaaacctaacattatatttgcattcaggcctggagaccatagagcatctttgctcttggctgaaattacgtcccaccagggtagtaaccctggttacctccagctgatgagaagcttcgattagcagtcacgtatctgactctgcttgacaagaataagaaactggatccctcattgcttgttctgggaccacttgctggggaaggccaccctcaggtctaggggcttccgctgcgattctctaaggtcatttgaccccctgggacttgccctcccttggactccctggctttcctctagtctctagggtcccagctattttttccaccacacccagggttccctgtggcaggcccaagctaaggtggatgtgcagagtgtgggctggccagtatagccaagctgggcaaatgcacgtgctgtcaggagcatggacagagctcccggtgctcagagtccaccaccgcttctgctcttcctacaggcagaaggcaaaggcctgtttcccactgaatagcaccttctccagtcatgcctggggagctctgaaaataaaccagattgggaatagtcaggatgtgggctactgatggcccctcgggtctatccagtgcattttctctggcactaattttcaaagaaagtttcactaaaacattttccactgggcaaaatcatgcctttagaatcagcctacactagagtcttaggatagctgagccaggagaaagcactagacaacatttatttattttatagataaaaaaaaaaactctgttaaagatgcttcatctacccttgttgttccagggagatgtggcctctgctaggctgttgcggctgagctgatgatcagggcaatttatccattcttagaaatctggtgagccctgcttcggctctgtgcaactgctaaattcagtttgtatggatttggcttggaatcacggccctgacgttccatttgattcagcttggctggggtaacgctcaggtcttttgtagaagagttcacaacactggccagttaaagggtggtgtgccctcaggcagtcagaaaatcttgtccactgactcattcattaacccacaaacagaacaggcattgccctaagtatttgggggtatgaaagaagctgatgtggatgtgttcctgtcccagaaggagctgatggttgtatctatgaaggtaagcatttttgtagatacgagcaccagccaccctaagcaaaggcagagaatgcttaggccagacagagggctagggcacttgaatagaaagagagcaattcttgggtacaagaagcccaagggaagttttctggaagaggtggcatttgagctggcccctatagaatcaataagattgggaaactgatatggtgtactttctctgtcaaaacatggcccatggagaacaaaaaacatagcaattgagacacagtaccaagtctggagggtagacttataaaaattgtgaaaagtgttgggaaaggaaaatgcaggccttttaggagagactaatgggaggtttataattcagattgggtgtgtaggggggtaaggggcaccaggattcaaactcggatcttaatgtttccagagcccacacccataattactgccctgcttcctcccagctgagatctctgcagggcccctgggtgaatcagagacagaagtcaggcctcccaactccctgggtcagccctctttcctcacagcctacctgctgcctgagctgctgcctcagggcacatgcctgtctgcctggctgatgtttcccatcagtggctgactccacactgtgctcttggaggtgaggtcagggacagcccaagcacccagactgcttagggcagacatgcaaggctcaggccctcctgaagcagtcgttaacctttcttcaaaggtcatgttgtggaaaacccctacttcagcctcccagctgtaatcacaaagggcatcagtgagaaagccttttcctgggaatgtctgttcttggtaacatgcccaggtcacaatctggaacatcagagtcccgttcacagaaacacggatcctgttgcaggcactctggccccaccatcgcccagtcctggagggtacttctggatactggacgatcaagttcagtgtctcctggctaaaggcagctcacgtaaacttcgcagctgcagcctgagaggcacgaggacccagtgtgtccacgaaccagaggtctttgtcctctgcctagggtttcccataaggaaaagctcacacggcaccgctgtccccacagcgccctgctgtggagcttgttctctgtgtgtccatgttccccgtcatgtgccctcccactccagtgatcattgctagtctgctgctgtcacttccctcctcctgtccctcttcctctctgacaaccctttcccagaatgcctctcctctcccctccctgggtgtcattctcttcaaaaaggttttttaaagagcgaatgtttaatttgtgtttgttgactaaatgaattaatcaagtagggctcttcattatgtaatgccttgtacatgcaaaagattatatgacatcaatagaaggtattaagaataaataaaatgcccactttaccaagttaaggcccctatctatgtggccctctgccagagtaacagcttccttaagtggcccttttttcctcttctccccgcagtctaatccactgtccacctgactgctggggccatctttgcccgcctcagctcccctccgttgctgtcaccagctacccaggtcagcatggcccgtcagcagagcacatgggctggcgccggccatccaggcagaacagaactgcgctagcctgtgccctgtaccctgctgtctccctgtcttggggtgcacagtttcctttacctggaataaccccacccacatgtcccatgtctctgcctgtcacacccacctttccttctaggccgcaaaatgtcatggttttcccaaagctgtacccaatttctccactcagctgtacttcctccttctctgagcccctttaaaacataggtggttttgcttttctcttgcagtgtatctgacattttgctaccttttattagggtgaggtttttttttttttttttttttcatttctaatctcacatactggattataagtgtcttgtggacagccacatgtctttgaatttgtagggcctagtagagcatcttgtgcatacataataggtcctcaacaaataattggattagaatggattgaacagtcctcccctaaagctcacctcacatctccttccctgaaatcctataaaaataagcacttgtctcccgagggagaagggcttcttggagcaggaatgtggttgatgcttaataaataatagctggatgaacaaatatttgcaaacatcctgcctaagatagaggattggactcagtgcttcctggggcagaaagttgtttaacctctatcacttcttgataaataatccctacattaggatatttggaattgccaactaggtatcatgtaaaggcaaaacaattatgatactgaatgtgcattctcacacacattggttgaggattacagctctcagaaggttgttcataaaggcatgatgtctctctgtaggtctctttggggacaggggattttgagggagattctgttggcccagtctcaactgttagtgcctttaagaaaacccaaactgattttctttagacaacactaagaaaagcatgcacaattctttgaaacaatttttaacagtaaaacatatttataccttttaattgtgctgtcttaacatttagagaaattaatatgcaaaaactttcaccactcttaactctcgtttctgttttccagtgctaccttccagtctttgtccatgtgtatgaaagaagctttcatttctgccagaaatgaaatcaaacttctgatgttttcctgttataaacatcaaatctaacaggcaaactttgtgaacacctactgtgtccaaagccatgtactgagaatggcgggagatacaaaaagagtttgttcactacacaagtatatactaaatgcttgccctgtgcctagagctgttctggtccatgataacagctgtgggtgagacaggtcctcagcttccaggatggaaagagaggcaccacacagaaaaataatatgtcaggggcagataggctatgaagaaaaataaacagggagggacttagagggggccattgttttatgagagtggtcagggacattctctccaagataacatttaagcagcctctgaaggaagtgtggaggtgagggaagagtgttctaggcagaagaaacagcaagtgcaaaggccctgaggtgggagtggtttttaagaaacagaagcctctatggcgggagggataggttggggaaatatgaagtcaagagagggagccagaggactgggctactttagaggctgcagaaggacttggacttttattccaggtgtgatgggagcccatgggaagtgttgatctcactgtggagaacagcccagagacaggaatagatgcagggagatcattaaggggctgctgaagtttctcaggagagaggctgtggtggcctatataaggtgctctactaggccgcacaaattcagagacatggggctgtccacaagaaactacggtggtagtgatttagggaggtagcagagcaatcaggtcctggatgtgttttgaaagtaaagccaacagatttcctttcatattgaatgtaggtgtgagagaaagagaggagtcaaggttgaatccaaggtttttggcctgagtaactgataaaatggaggtgatggtctctgagatacatggaatgggggggaacaagtttgggcagtgaagtcaggagttttgtttggattctcgaagctgcatatggctcctccgaagttcatggcaggtgctgctacgacaccgtttccttcagagccccagcatggcctcaccatctcaacacagtgctgcagaacccaatctagaatgaaaaccatcgcactttcctggcattgacagacaatccaggcatatccactggggaggggagaggagtgctggggaggaggctgttctgtggacaactggcatgatcagggaaagcaccaagggggagaggagctggaacagagcttttgtgtcaaggagccactggctgcaagtaacagaaaacccaattcagaagggcttaaaccataccggaaattatgaacacatatatcaagaagtctggaaattaagcaggcccacggttgcccaatgaagctatcagggacccaagtcttttctctctattcattgtgcctgcctcagcacaccagctggctcctccctgcagcagctccaggcattatggtttcaccacctaaatcaagggaaatgacagggtcgagcctctccctattttagaagccctgctgggagactggcccttacgctggacagatttagccctcattgcacagatttgggtcccatgtctcttcttaaaccaatcactggttagggcagtgggtttacatgatgtgcttctgccaatcaagaggagatagggacaccaggacacagctcagacttggccaacagggaagagagagaacaatggtggatggcttggccaccaacagtgtctgctccagccccaaaccatcaggaagaattggtactgagaagtaagaagggagggcgttctaggtggggagaaaagcatgagcagaggcacagaagcatgaagatacaaggtatgtccctcagacaagttggcggggttgatgagttgtatacagtgtggcatggaatgaaggccagaaagaaaccgtaattgctaaccttatttggggatcttcttggcttaccaggggtcttcagaccagtacttaaaaaccacagatctagaaggccaaccatctcaaggaaggaattcttgaagaactgtaagccttggccaattagactagataaagccactgttaatattcctctgagcacttccactttgggggaagatggaatgtcctcagcttagtccctgtgctgatgccaggtttagttgggtggctcttgggtagaaaaaagagcatgcaagacagagctttcctttggaaaacatagccagaagctgatcctgagtatcagtcatcctgctttcattgagattgcgtatcaaaccctttcaggtacaaatggcagaaatcctgcccaatgacttaaaaaataagcttagccacctctctcactgaaaagtctggctcctggggctgtaaggatgttatcaggacctagtggctcctctctaggctctgctttcctccatgttaacttcactctcaggtggattcacccctcagcctcagctccaaatccccatgcaaagtgtttctttactggatatcccaggaagagtcttaatgcttctcactgattctgattgacttatgttccatccctgaaccaaccattgtggttttggggaatggaatatgttgacttagtccccaccttaatgacatttggccaagagctggggagaagtggctcttcgaacacttgatgttggcaaagaggtgaaagaatgaatataaggtggccccaagccacaaatgtctaatctatgattttacccccgagtctaagatctcacatttttcacttcagcatcagtttgtgtgttttacagtctacaacaggctatcataggcatcccacttaatcctaataacacccctataaaggaggctgggtggcaattatcctatttatagatgaggagactgagggttagagaaattcagttatttgtccaggaccatctcgatcgaaattggcaagtctggcctttgaacctgggacttgtaaccctcttccagtgaagttgcccattacactgatgacttacaatgcatctgcctgcatattcgaggagagaagttcttaaaacttctacaagtgaaatcaagttcacttctgtaagtgaaatcaagttgaagagtcagctcaaggagtgcaatatgtaaatggtaaaataaacaacatcattaagctcaagggcatgttttaataacagttaaataacttttacaaaatagcaaatattttcccattctgctgaaatgggtcttaggaaaaaggattgtaatatagaaccccaggtggtcaagtgcacattggattttcctaacagcctcctttataaagaagagcttgcctgtggctttgtttccttactctccagcctcaccttcctccccttgcctatgctcaaaccattgcccactaatagttctgcagatcccaggatagaagttaatctgcttggaaggttggtccacttagcttttccccacaggtgtcattttggtacctggtgagagggtctgcctgtctccctctcactctgcactccagcaccagtcagcgaggctgccatcttccctgatcaagagctggctccagagtgaactgtaaagcacccctgttagatttcctggcatttgtaaggaccttttctggggcccagacagaaccagaggcctccagccagaggcaccaatcctctgaggccctggtgcatgggcaacaaatgagactttttgcctccagaaggagctataagcagaaattataggaagtataataaatcatcctcccgccctcaaagtagggccacaccaaggaaggtagagggaattctgtatcaaatgagctgatcaggccaaaatgtgtgtttacttctcattgagaacatatctgcaggtacatggtaaactacaagtactatactgtgttcctcttggttattagtctctggatggcacagccaattgcagtacaaggtgggatggcccctgtgaacccaagtcttctgactccaagtccccaaggctggccccctagatgccaggctgctggacaggaccctcagacaaggctagggaaagcagtaagtgctgtgcttcctgggccagcctcagcagggcactgggttgcaaggagagcagttcagatgaggtgggcactctagtgccttgctcagagcacaagcttccaagtaacacagaagctcagttctgccactcaccacctgagtgaccttgagcaagcgagttgatctctcttggcctgcatttcctcctctgaggaatcttctaatagtacctttcttggagagtcgtgaggatgaaatggggaggtgcacacaaaccacccagcacgacgtctggcacagggtatttgcttgatactttcgcatagtgaggctgacataggaagaacttctcatcacagctcatccacacccccacatcaggaatgctcaagtagacccttctcccctcccaaccttcctcctggccccggccccatccagctgttccttcttgtgggcagtggggtgggccctgtcttcagtgcagacatgccctgttgcccttgagtgcattggcctgtcccccccaccaaccccaacagctcacagggcctcttggtatgggaagtgcaagtcaccctgaggaggtgccgtccatgctggagccagattctgaggctgcaatggaactttgggctgatgcactcacattgcttgccttctgccaagagttctgctggggagctgccctcggctaacctctgagtgtctgactagatagcagcagcggcagcagcagccatctctggagccaagcatttgagcagagaacagctgctcctggtcctgggccccctcttgcctggcccaggttccagtcagctctgcctaaaagactccccagggcagcctggctctggtgccaggacccttcaccctcctcgttcctccatctcacccgcaacagtgtgtgactgatcgactcctcctgccactttgtcttatcacgaagattagcagggaggaagctgggatgtggagtcagaagacctgggttggagccccagcccggctacttgctggcctgtgaccttgagcaggtcccatcctttccacacttctggaagatgggagaagagaatctttattctttcttcttaattgggcaagtgtgattaattgtaatgcaatgcagagttgcctgatgagaagcttttaaagcaagccagaggtgtgtttgagtgaaagatgaaaatattctttacagccctgtggggcgggtgttggtcactcttcatctgtttggtgttggtaggtgaaagcaggccagctcactgggccactcttcagcctccatgctgagccctgttacctactgggtccctctcaagttcagtccctgtgggaggtatgcacagacatgtgtagccaggatttgacccgatgggccatgcactttgccatcacatggaagcagagtgggggacatgtggcagcttgtgggatgaaggggccagacctgggccctgccttctccccagcctggggtagcagggagatgccaactcttcctgggattgagcttctacttaaaaaacaaacaaaaaaaagtgttgaaattctaattaaaagttgtattaagttccagtgtacacggggcattttttataatgttaaatgttcccatttaagaacatatgccttttcttcaaatctggttttatgcccttccataaaatttttttttattaaacatacattgtttgtttggggaagataaaattttgtttaattaaaaaaataaacatatcttgtgaaatttattaagtttatatctgtgatcaagttttgtaagtgattcaggtcccaacaaatgatctattccagattcaaggaatgcagggccctatatatttctagtaattcaaattatattttttattttctctgttatcttaatttttgcctatatgtctatttttgaaatagacatctttgaaatttcacactaaaattttatttattccatttctaataatggatgcttcatatatttagcttctgtgtttaatgcattaaagtttctgatggtcattaatgtcttcataaaataagtgttccttttatcatcacaaacatctgtatcctctgcagcatttttttaaactaaaattctcccttatctaattaattttgacacttctccctccttttgtttgcacttgcctagtatctgcttgcctatgcatttattttcaacatttctgtatacctttattttaatcagttttcttataaacagcatgcacctggagcttggtttttgttttaatttcttaacccaatctggcatcttctgtttttaatgagtaatctaatctgttgactgatgtactggattttatttcttccatctacagtatgtttataatttctttctgtcgtattttgtttcccttgcttgtgctggtttaatgtagttgcttcaaatttcatcttttccccatattctctatgttcccatagagaacacagggaaagttctctacttttccctttcattaaaggttacattctttttcccttaattcataattaaacacatattgctttaatgttatttgaacacaagataacatgaaataactgttcctccctccaagatgttccattctctccctgctcttccctgcttcagtgggatgagacgttaaaattgtttccctgtccctacttaagatgagaccttggaacacttttcctcccatcctcttcaactccttgattctgttaggaacatttaatatttttagctttgagctgttggtggaatttcccttgtagtatgtcccttctattttcagagtccttctttagcagttccattcccagaacatctaccattctccatttagatttaggagaaaagggaggggcaggtgtgtggcaatcttccttactcctcacggtttcctgaccagttcattttccccaggtcaaggaaaaatgttctgccacatttgttgtttgttgctttaagtattttccatagatgagatgtatgggtgataaactatgaattcttgtgtgtttcctctaaaaaatgatgggcaaactatttgaggtctttggttatcttttctgagtagtgtatacatggtattctgctctcttttagtttgtagtgtttcagatgagaagttcaatgtcagtcttactcttttttccttataggcaatatgttctttctgtctggaagcttttaagattttgtgttcatcttgaagtttagcagttgtaccaaggtaacctatgtgtatgtcttttcttgtcgtccttcctggaactgtgtgagccttttcaatctgtagagtcagttcttttttcagttcagggcaattgtcttctgtttgttatttaattattggctgtcctctctcagtttgtttttctacttctagaactcccaatatttttaagttagatccccctggatctgtcctccatgtctgttatcttttcccttataaattatatatctatatttttactgtatatttggagataggttttccattttgtcttccagaccaccaattcacatctcaacagggactcacctgcaatagttgggaagacattgttttaatatgtgagaaatcttttaagtctgccctgagttgctgtagggctcatgtgatgttctgcttgagttttcatttgtctcttggagcagctgcacttcactgggcttgtgcactgttcgttctgacagatcttcttctgccaggactttgaagcatgttgtgagtgttctttgttctttgtacctctggttatggagcccagagtggcagcagtccacagctggtgggagtggagctgtccttacccttggagccagtggtattgaggcaggtgagccaccagtctactcctgagacatctgtctcccttacttcccattcccctttggctacagggcagggggttgcagcccactggttcagccacttcttggtctgacctgggtcaatcaggcaaagccagtttctacctgcgctccattacgtgccaaattccacccacatacacacacacactagggatccactggtcttccttggccaagttctttccggcatccatggcttttgatccttgctccaaagctctctgaagctggtctctaataagggagatccccacaccagtttttcagccttgtttcccgcatgtacccccatctgcccaaaggcctcagcagttctctaatttaggattgaacagataggttagagatgataatctctttcaggttgccatgttctcaggatctgttgtcttttctcagttactgatggatcaactgagactggaggtcagtctctttctctctgtctctctctctctctctctctctctctctctctgtgtgtgtgtgtgtgtgtgtgtgtgtgtgtgtgtgtgtgtttgtctttttttctggataggctatccctatggctgcactcaggggccactaacactccccattactctttgtctagttgaatctgattagacactggactagcttccagaatcatatactccagagtgcctcaaattacaggacggacactgccagtggcccaagatgagttgcagtggtgcaaggacagtgtttgagaatgttgaatcccgtggtgggaaagttgtttgttcagttctcttttagttcttctaattatggcaaatagtctcgcgtttggcattactatgcctttgacacatctctagcactcattaaattcccttttaataaaacagagatcaaatgtcatgcccagtcttcagtaggcaacagtattttctgtggtggggaaggctgaaaggggactgggtttgggggggggaaattagaagttcagttaggagcccatttattctgccctgcctagtacatatttaagtggagatgttgagtcggcaatccatggtcttagccctggggcactccagtgtttagatattggattccttcccctttgccaaccaatgcagaaggtgcctttcctacttgttggctgaatgtctttgcatcggctagctcaggaggtttgtttcccatcactctgggccacttcttggcagccaaggccacgtgattgtcattagtgttccgtgtgtctgaccaagcagcccttaagtgcaaacatggaccgtggccaaccttccagctgtgtagagccttctggctgtgcatcttgttgggtccttgggggggtgtggtatcccccagtgaggcttcataaaaaggtggaagcaagctgaaccgttttcacaagtttgaacatggttcacactaatgattcactggacctgtcaaatttctgactacagcccgtatttattaggatgaaaaaaaaatcttccattagtttagcacttttccttcttaccaacatgcaggaaacatttattctacctgaaacgtgaggctgatgccattaactgactctgtgaaggagtcctaatgccaacagggccagcaggctggtagactgagggctgtgggcgtagactgacacctgatggggcgtgtggatcacgagagcaccagcctagcccacggcaggcagccaaactcaggcctcacctaaggaggcagaccagcatgtccgattcttcaggagaaccagaaatcagtgtccttttgtgacaattcttctgatttataaatgtttgcttaaaggaaaaaaataaaaagaaaagaaaaactcaaaactactgcaggccaaacaaaatacatctccctggcccaaatccaggctgcagatggccagtttgagacctctgctacgtgactgcaggccagccaatcactctgattcttatacttcccaccattactgtgaaacagagccactaccaggcttgctgaggtggagattatgagtggggttctgttttagctcccagctctgctgcttactggctctgagatggtggccaagtagtcagttaacctccctaagcctcagtctccttatttgtaaaatgaggataactgggttattcattcctatcatgaggacttcatgagaaaatatataaaaatgtccagcacaaagttggtgttttgtcaagaggaactgttgttactgttcagtaacacgtgaaatgtttggaaaacctgaaagggagtgttgggcatttgacagttatgggtagtggcacaccacccagagcagaaaaccccttgcccatggttctgtcatagtgaggggcaacagggcctgatgatggtggatatattcctagagtcctggaacttgccattcaggaagagccctgttccccagcagcttccctgtggggtggtgtcagaagcaggcctagctgttctcccacaaatcggtctggacagacttgcagcctctgggcagcccctgcctgttacagagcgcttcccaagattgaaaggtgctgagaaggcaggggagagtttcctgcagctcctctgggagagacaggggattggggcaggcaatagctcttgggtgggagtaggcaggagaactttcagtctgaagttagacagggaagccctgtgcatttctgacctcaagagccccattgttattgcttctcattttgacacagatgtcccagtcaaggccactcctgtgcacagccctttgttctttatggaaagtgctgccaggcacacatacgcgtggctttagatggcgtatacattcttacatgaccagctgaagagccttagggacattttgtgatcagtgggcgtcagcaagtccatgttggagctggggacatgcaggagccagtgcaggaagaaagccttgtttcagagggtgtggatagcaccactttaggaagcccctcaggaatgagagcaacacacttgaaataggaccaaatgcatcttcagcctcacatgctgtgtgaatgccgcctccttgtcagggaacgtgatctgcaccagtcaaagaggcaaatgccaggccttgcactcaggaggtgttgggtaaatgtttactgaactgaattccattcttgggagccctatttgtgccacatctaatgctggaaattatgtgtattctaccccttctcaccatccttcctggtttccaactgccctgttccataccagcctgacccacatgcatgttggagcttgaagctcagtggatacagaagtgtcttgggacagttgtctcagcattgctggccgtggtgataataagcagatgtgactgtgatggtgatcccgacagtgtcagagctctccctagacagtcttcatccatgcatccattgttcattccttcagtagccatgcgtctggcactggccagggctgagcagacagtgctgggagtggtctgcagaaggggcagggcgggggttcatgtggtaaggattaagctagaaaactggaaaggcctttaaagaggggtaagagtttatgactcagggccagtgtgacaacagaaatcttctgattgttgggaccccttcttaatgtggacattgtttaatgcctttaccctttttcacagttggtcagaagtcttgactctcaccagcctggtctgcttcctctgaatgtgcctgaagtcatcagtattccttggatatttagtctgagggctgtccataaagtggagagctcttgagaacacccatgtttgatagccacataaccttgggaaagctcattaactttcttattaaccagtttcttcatcttcaaagtggagctagcactaacacttgcatagctttgactacagctgatgtcaggaggcaggggttattgggaggattcagtgtggcagtgtccatgaagcccttagcacagtgcctgcacctgaagggattcaacagaggctgccgctactctgttctcccaggcccagctctcgctactgtggcgtggctaagtgacaatgggcagtgtgggctgtgggccttttttctttttgtctctacctgaaatccagatgagagtctgagagagtggacagagtctcaggatggcagcttgaggggcctgttctccttagcctgcttgtcttcaacgtgcaccaattttaggcttgattcacactgaaaattcctcagctgccggctgctgggccagaagcaggcctttgtctcagagagacccagagaccatgatgaaggctgagcatacctgccctcctgctggcctctcagactgcagcagagcctctactgagcccgactctgagagggaacagctgggctctccacagggtctgccacccctacagccaagtatgtgctttggctttggcatccagaacacactgccccacccaaacatccctagagaggggatcgatgtggaagcccacaaagtgatctttgtggactctttttttgggggcatgacccgctatcatggttattaatgaggaacttccatatgcttgagaaggcctggagtgggaagcctgggagccgcggcggggctatttaaatccaccacacagagagtggcatcctttctgggccacgtctaccaccagaaaaggaagactggctgggctgggttttgctgtgtctctctgtgaatgtatttctctggcaagacatgctgtcacctggaattctcccctactcttgttcaaaggcccaacaaaggggtggcgcagagggaaccagaaggatgtggctcacgtccatgtagtcagagatgtttggggacctgacccaatgcagacatagccatctttgtccagcaaaagttggcgtggcaactgaccactgccgtttcatttgaggagacatgagttaccctggagaggaatgtgcattcagacttgcttttggcagactttaccataagcagtcctctcagaggacatgagaaatcatgatttccctgaggagcccccatttggggtgatctgtaccttttgccttgaactctcctaggcagggagctgagaagggcgtcttttgtctgtttcagaacactcacctaaaatggtccaccatctggggcaacgcttaggaggctctgtggcaaatctcaaaggcacgtgtgccaagcagcctgcactggagaatgagggattctgtccatgcccctttgtctcttcaggttgctggtggtgtattggtgtccttctctgcccaatcacatggcaaggagaagaaaaacaagtcttcatttaaaaagaacaggaagggaaaaatcaagagcctatgaaaagcattttccaggctggctaggtctgtaatgtagaagagacacaagggagtgaaattcctcatgttttggggttaggtggagtcgggggaggagtggacagtcctttgggatcagctgatccccgaaatgcccaaaagagaaaatgacctccagtatggcttgcttggctcagccgctgcaaaatgggatgggggcagctgctgtcctatggtggtgtaaccctcagagccctcagaacctgttcagtaaccaggcaccccctttcagatcagcaagtctgtgtgaccgtccgatgccctgctgccatctttccaaacaaacgtccaagggctatgcagcttcaatgccgtcaagactcctgactgctaagaacagaaacctgccctagagtgactgaaacgtgttgtctcatgtcactgactagcctaggggtacactagcttcaggcatggctggatccacatgtgtgtgatactaactgacaggtgtggatcaggaactcactcagccctgggacttaggctagaagtggggagaatcctcaaagtgtgagaaaggatggttcccccaaggaaagttgagctcctatctctcaaggaagggaggagttgcacaggcagccagcagatgtccactacagccctcatttgccatttgcagagctcaggctccctcaggtatattctgcagtgagtcaccaccgcgccccacagcaagtcgcaagggagccaggaggaacccagataggagccctcccacaggctgtcagagccccacctggtctgtttggatgacagagccttttggacttgcctggtgtcagaaaggacaatgtcttaggtaacctgggtttgtaaaagccttgtctgtgagctgtcagccaaagacagcagcttttgtggtcttttctctttcctgtggttcatgagaacacatctaggcgctaatgagcaggaacataaataatgaacaaacataccgtcaacaggaaggcaggaagtttttttttttccccaaagactgaacaagatgagcaaagctctgcagccgtacttgcgcattctccacaaaatataattaaaaagctatgcagactgctcccaatgtacagtattgtttatatactaaacataatgtactaataggaatacctcacttcattatgtcagcagaatacgaaagggagatctagcagctgcccttatcaggcagatgggagaccagaaatgttacttagatctaggcagtaaaattgacattgaaccaatttgcctcactcgtgccgcttttactgtgtttaacaaaagctcatgtctgcacataaggcattgtgaggaggactcagcagccataaagctctctgtcatgtctctgcaacataaccagtgaatttaaccgttgggtttcaaagaacagttttggattttcctggaaataagcctacagaggacagcataaggcagctgtgtgtcctgacccttagaaacctgtgagaaccaagacatcagggttgaaggaggggaacccatgccagtgaatgagggagcgagtctagttacaatcacaaggaaagggccacagactccgggcccaagggggaagactattcagtccgcaaggtggagatgggattggcagccagggctatgagtgggggatggtggagagagatatgtccatctggggccactgtttacaggctacccaccttcacagaaaggagttatatgtggagccctcattttagagccagaggtcccaagcaatcacctgtttcattcagccattcatccagcattgattgatcattcgccatgtaccaagctctgccctgggcactacagtctgtgaactcagtcctcatggagctcacgtcgatatgtggggaaacagatggtatacaaataaaaatatacataccaggtggtgatacatgtgatgaaggaaaataaggaagaataaaggcacagaataatgtagggaaggggccgtagtcagactggtctgaggaggtgacatccgagcagagccctgaatgcaatgaggtatgcaggtctctatttcagagctcctcaatcttttgtccaacaagaacccctttgattatttgccccccatgagtcactatgttttgtgagctggtgtatcccagaaaggatgcatttggcaaagatgtagacgtagacatagacatagatatgaccgtgacccttggtcaacctgagaaacggggcaaccacaggaagttgatgcaacccagccccaaagccaacacctgacctgtccaagaggctgggcaatatacatagaaaatgagtccagagtcccagtggcttgtccaagcttatgccagctggtcagcagcagagctaagacttagaccccgggtctcctgagtgatgaaattggggtggaagctgccacagtcagtggcagtatttcccaaacacacaggcatgaaaaaggcagtggctggaatctgagggtgggtcaggaggcctgaggtcttcccaagaggaggccgacagagctgccttgaaggacttcctccaccaccaagggggagccccaggccagggccgatgatgcaggcctgagaaggattcttctgccctcatcacctggggttgcagtgttgatggccaatctgcataagaatctgagtcttatatctccaaagttcaagtcacgatatctgtaatctagggccaggggccccagaccagcaatgctacccagaaggcgagaaggaacagagctctagcaggcagttctctgagcattacgctgccgctgccgtggactgacagctggcctgtgcagcccccacctccacccaccccagcactgtgagctgagggaaagggcagggttcatgttgtttttcagataatgacagcagaggctctgcactggaatcacaagtcctggccttgcccctggctctgtctggtgacaattggcagctgacatctttgcttctggccagagctaccccttattaaaaatggcatctttataatagatttctgcaagtcattgtcaacaggacatccttcttgttttgtaccaatcattcctctgggggactgattttgcctgttactattattttagaactctttagaatacccttttattctatattattctgatattagaatatcaagttttaatatagtattaaaaatatagtattaaatatagtattttaatatagtattattactaattaatatatttttatcgtatagtatatagtattaatatagtatatagtatagtatactaattatatagtattaattaataattaataattactaaagtggtcataattattttttaaataaatgttcgcataccatacagcttcaccccacaattaaacagctggatttttagctgagtcttctcttctttccaaatagccaagggatccatttgtgcccaagttattcatcctcactttgtaaggcctaggtgtcacccagcctctatcttgtcccatctaggttttgtggttttctgcctcccttgggagaagcaccctcgtggtcagacaagccccccagcccgagcagctgaatctgaagctggaaagagctctcattcgtgagcagcccaaatgtccaccgtgaggggtttggttgaatagctcatggcccattcagatgatgagactaagcagctaatagaaccccagggtcacatggagccacatcaatgacttcttcctgaagtcatctctggccatgctggatggagcctggtgcccctcttatgcatgtccacagctcctgggctagacagcagctccagaaggcaggcctggccatgcaggtcgggctcactgccctgtatccagtgcctggaatgaagaaagcacttcataaacagctgttaaaatgaatatacagttcagtgtagaaaacaacatgtacagtgggattccattttagggaaaataatactcgtgcggactcccaggtaaaaggactgaaatataccccaacatgtggacggtggttccctccagctggtgggttgatggctgaaatttttttcttcttttttgcttagctgtgtgggctataatctataagtgttccaagaacaggcctttcagtcagggctggagaagtcagggaaagaggagggaaagctgccatttaaaagtgatccacaattagagcagaaccactggtgggaggcaagatggtttggggacgaatgtgtttttttttaacaggtgagcatttgttttaatgtgtagctgagaaaaaattttgagtagtacattagccatagtactggtccctgctgctcctctggcctcatcccccactttccctatcactcactaggttcaagccctgctggttcctcatcattagaacactaaaggtgccccggggcctttgctcttgctgctccctctgcctgttgcgttcttcctcaccaatatgcaaggcccacttcttatcactgaggcctcagcttcatgccacctcatggctcttaactctacccttccccactaactactagttttgtgtttattactctgtaatatttgtttacttctttatgctttcccctattgagctgtgagtcctttgaaggcagggcctctgtctgtcctgttcgccagtctcctgggtgctgtgtgaactgcacctggtacatagcagtcagttctgttagatgagaagaggaggatgccgtcagtggggggattgaaggaggccataatctcagggatggctgagctctgccagtcaaggaagcagcctttatgcctggtaaagagcaaagcttctgacttcccatcaggggcctctacactcttggaattctgggaaatcagaaattaagacccagaataattgctttgcaaaacatacacatcttacttctgcccaaccagtggtccctctgagccagtcattcaaaacatggatactgtctggccccccagcaccacattcagttgagtcaaggcactgctgcaccagatggaaggagggcccgtggcttgggaaacaagactagtggtctagccctgctttggcactgaattgcctgagacttttaaataatattagcagctgacatttattgggccctactgagtgccagaccctccccacacattaatactgccagtgaccctgtgaaggacaagatcattgtccccattttacaggggagagacctagactcagggaggttgagaacttgcccacagtccaactgtcagtgaataggagactcagggtgtgccccactcttaacacgtgctcagtatatatatattcatggagggaatgaataaacaaaggaaagagtggtgttctctaggggatttgggctgctgcagttcctagaaagccctcccagtccccagccgccaccgtgtccacatcgtgtgccctctggaccactgcagaccactctgcttagtcctcagtcttgatggtatcccctgagtcaggaagccaggtccctcctgcagatccagcaccactggccacaagaccacattccagggaaaggaaatacaagagcagagttagtgggagctccaacaggtagaagaagagggaggagggtccaggcggggctctctctccccgttcccctggggtgcctgccctctgctgagcccacctccaagtaggtatgctgccagtgcctgccagtgcctctcaaccaggcggtgttggtgacatttcccccattgagtcagcttgctgttcatgccttctccttgagtcaatggaagcctccctcaggagggaacggcagacccgtgccagtgccagctccagggaagcctgctgactggggtctctggcttccggtcccaccggccagcacgtgagctgccttcatgcatttcacacacatttcccgagcactctgtgggacaaggggggctctgggaggtgcgaagggaccacacagcgttgtctccaggcaccggtgctgttctcttgtctggattgtcctaccttgtctgtccagccagcacctgctccgtggtcactgctgtttcctgagaggccggtcccaccctccaccatgcacctgtactgtaggtgctccttcaggtcgtattttccccttattcccattatgatttatagaaccatttgtgacattacttctttcatattgttcttccctattagaatgcaagctccacaagggcagggattgtgtctgtcgcttttatcccagcccatgatatggtggctggcacctagtaggtatgcaaataatatatgaaaaatgaattagggaatcaatgaatagagatgcttacagaatatacccctgccccccacccctacaggaacacctctaaattattgggagctggatcttttaagacagaaggtaaaaacatctttccattttgcatttgattagatgtttttctcacctggtgtcacccatcacctcccctctcccaggggagcatcaagggaggtaagacgcctgtagcacaatggaaaggcctctgggggttttgtccctgctctgccacaaactaaatgtgcctgtaggcacatctcttcctctccatatcacagttttccatctggaaaatgactatttctgtgtgggctctaagcagaaccatttatttggccagtcttcgtggcaaaggaggcagggaaaggaactcttcatgagaagggagtggctttcaggtggcagccagcacatccttcaactggcccttggcagatgccacttttttgttgttaattttcatttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccctagtaggttaaacacgaagtgtctgtctcccattggaaatgacttgttgttcttccagataacaagtatacatttttaaacatgaaacaaaacatacaaagaagaaagtttaaaaaaatcactgaatgccaccacccaaaagtgattattaatacatcttgttacacatcctcacataataactccctctccctccttctccctccataccacaccctacctcctgcccccacccacaaacagttttatgaaaacagctgcacaggacacacactgtaaccagcattttcactttaccgtcctgtccagatcctggtctcgtaggttctgtggagcccccaattcctggcatgtggcttcttccctcactgacatctgacagttgtttgattaaaaatgtgtcatatgaggccaggcaggtctgtccctacctccactggggaggcagatggcttcaggggccacgtcccattactgccgagatctccctgacggctggaaaccattggtgctgtgcatgggagtgaagcactgggccctgaccctaacccaggcagccacagcacagctctccgtcagtgttcagaaacatatttcatgacacgttaagacagcctcaaatcaggaaatccaccttctcatcccacaaccactcccaacgtgttcatttggtaaatggtaaatgagcagattctctgctttggtccggagaaaccccctctgccgctcttcttttctccactgtggcttgttaacccttgctgctgttgttgctgctcctcctcctcctcctcctcctgacaagcagtggtcctcccagccttccctccccgtggacccagttcacatcctcttcctcaagaggacagacgcgggacgcctgactgactgcacgttctcccccgtccctcgtaccaagtatggcaacaataataatagctagcactgattgactgccgactgtgctgggcactctacatggattcattcttttgatcctaaccatgaaccagctctgttaccacgcccatctcccaggaacagatgcggaaacaagcacccggtctcagctagagtctggctctagaagcccccgcttcctgtggatcattaaagggattgtgatggaggaggagcggcagtccagtcccagggcaggagccagggcgctgataaagggagcagacgaggggcatttaatctagctggagatgtagtgaaaaaccatgtatcccaacagcctagggcctctgagtttgtgaccctccagaagttgggggggaaactgtatgtgttggtacattgtcacactgtcagaggagtctatgattcagagaaggagaatggctgctgggccagatgagcctccaaggtcccttccagctcccaagcctgtggttctgtgaccatataaggccagcatgcctggggagtctcactgcagctaagtgcagtcctacactgcaagggggaagcagagagcaaagggagcccaagtccaggcctcctgcagggtccctaaggcagcagagagagaaatggaggtgcggggagaaccagggtttctccttggttgcctcttcccagaaagctcagacctgtgcaggcgggcttggttgccaccctctgtctctccccatacccacgtgagatctcctctcagcagcgttgccaggtttccagagtccagctggcggtttctgtccaaagtcaaacactccacagtcagtccttggttgttcagacctcctgttccttatggtgcttctggtttggtggcctggaacacccctgagcgtccctgagttttgggtggacatgaattcagaatctagcttgatctccctttgataccctggctttgcagtcataagaaatctagtaggtccccaccctgacacacacacacacacacacacacacataacacacacagggacacacacgtctgcctcctttagtgagtgctctggagagggacaggtctggtgcatctgtgtactcctgactcatgtagttatgtcccactttatccaagcactgtctggagctcaaccctatgccaggagatatgggaagaaagcagagataggtgagatgtggtgctttaattttaaaaattaaaaattagtaaacaagtcttctgggagatgatctctgattattattgttatcagggtacaaaatatgtaccttttagtcatgtctctgttggttctaagtggcagaagcccaaatcaaattagcttattcaaaattgagagggaattatttggctcatatcactcaaaagtatggggtgggcttcaggcatggttggacccaggggctcaaatgatgtttctgggacttgattctgcactcaatcgctcagctatgtagatgaacagcccacctggggctgctgcaatgtgagatgccactgactgttgctaaggtatctcgtggagcctcgctcctgatttccaaatcctggccttgtcacctccacaactcagacctgggctgtcacatgagactgaactctccagagctgtatctccaactccaacccagaggcctcctttccttgccagaacattgggcagatacaacagggtgagttccaatgcttgttttgtgggtgaaatctctggattctcctggatatagggactcagggcagaaggagaagccctgcctttcagcatttgccatttaccagctgtatgtcgagtaagtggcctaacctatctgagcctcagtttcctcatctgtaaagaggagataatttatctcctagaattgttttgaaggttaaatgaaatgacacatgtaaagcacttagcacagagggtaaaccctcaaacatgagctgcaattattctgcttatcttatactgcaaatgaaagaaattatgtttgcaggattttaactttagaatgaaaatgctattattttttttggttgagacagagtctcgctctgtcgcccaggctggagtgcagtggcgtgatcttggttcactgccacgtcctcctcctgggttgcagtgattctcctgcctcagcctcccaagtagctgggactacaggtgcatgccaccacaccaggctaatttttgtatttttcagtagagacggggtttcaccatgttagccaggctggtctcaaactcctgacctcgtgatctgcctgcctcagcctccgaaagtgctgggattacaggcatgagccactgcgtccggtggaaaatattaatagctaccatttgttttatacttactatatggtaggcactttacatttattcctcccaactcttttgcttatgaggaaaccgaggctcaggagattaaattgtttaccagggacacacagctcatcctgtccaatgcccaacctctaaccactgctctactcggcctttctaaaatggtgtggggaaatagaaaataaagagggtctttattgatacatttaaggatatttgcctcaaatcaatgctagcaagaaaaaaagaagaggaatgtggcatttaaaaaagccagagggatgacttaacatttaaaaattcagtgttcttctgagttttgggagtatgaataatatttcctgttgtcggtgaaaccccgtctctactaaaaatacaaaaaattagccaggcatggtggcgggcgcctgtagtcccagctacttgggaggctgaggcaggagaatggcatgaaccaaggaggcagagcttgcagtgagccgagattgcgccgctgcactccagcctgggcgacagacagagcgagactccatctgaaaaaaaaaaggatatttcttgttgttctgtatggaccaaattttctagtcttaagtatttattacattgtagtagaaggggatataaaattctacccagaaacaggaagcctatttttaacctaatataagccagtttgaacaacttatagggctaatcatgatttgagcaatttcccccaaattgcaacatttctgcaaactgcaaatgaagcttctttatcttgggacaccccaggcaacagattgagacctgccaggcagtattttcagcccatgaattgaagtgtgatagaaagtactgtgagcttggagacctgtatcctgttcttggcccaggctcttacctgctgagagatattggggcaattacttattctctctcagcctcagttttctcttctgtcaaatgggtataataaaatcccaccctttccacctgatcaagtgcatataaagattaatgatatcaataggtgtgaaataggttgaaggaagtcccagagccagccataggtctagagaacattcccaggagagtggtagggtctgctggtcccaaatgaagcatgagaaactcaatgcactggcttctggggaagcatatcatagcatggggaccagcaaatcctgcctgcaccactcaggtcacccaaagggtcccaccctcttaggggaatctaggtaccagttgcctttcttttctgttttttagtatttacgctagagtttacaatgtgtatcttgacttattacactttactttcaaataatattatattaatactacttttttcacatacaagaatctttctacagtatagagtatactttcattttatccctcccatcctttgtgctatggttgaagttttatttctatgtatgttataaacataatacatttttcagcttcttccctctctttgtttcaatttagatagtttttattgccatgttttcaagttcactcatcttctgtatgtctaatctgctgttaatcccatccagtgaaatttttattttagatattatattttcatcagttgatattcccttttgttctttttaatgtcttccatttctttcctcattatgttcataattcccttcaatttcttagaaatatttaaaatagatgttttaaaattcttattaattccatgatctctgtcactgctgggtctgtttctgttgactgcattttatcatagttatgggtcatgcttttctgcttctttgcatattcaggaattatttgtgtgatgctgatactatgaatattatattgttgaatgtctagattttgttgttctcatgtaaagactgttggactttattctccaggtagttaagttacttgtagatcagcttgatttttttttaactttgtttttaagcttcatgagggcaggtctaaagcagcctttactctggagctagctcagccccgttgctatggcatgagccttctggcgtctctgctgagtgccccaggcgttcaacaaggactcttcactctggctgtttggaacttgaatatctcccagccttgaatgagctctgggaagcgttcaactgataagctccctgatgcttgttctttctttagtaattgttccttgaccagctgtggaatcttaccctatccagccacagactccaaggagacccctgtgcactctctgaagcatctgaagtgctctctcttcgcagttttctcccctctggtacgctgcccttccagctacctcagctttcctgaactcactttttctcttcagctcagtgaaatggctgtgttctgcctgggttccctcctgcactgtggtctagtaaacacctaaaggcggacgcccaggccatcaccggactctcctccttggtctcccttctctcagggatcacagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatctgctttttagagaaattcagggtgaagacccgcaaaccagcaccaagtggaatttgcagcaggaatcattattgtacgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagtggttgcttagggtaggggcagggcatggacagtaactgctaatggatacaaagttccttttggggagattgaaatgttctaaaattagattgtggtgatgattgaccaaccttgtgaatatactaaaaaccattgaattgtatactttaagtaggtagagtctatatatgaactatatctcaataaaactgttgtttttaaaaaaagaagaagaatctttagccattttctcctgcatgaaagtaatgaaggaattggaaggagccttggtatggtagaaaggaggtctcagttattatattggtgcgtgaacgtgtcacaagtagtgttctatctgggactgaaaatatgaccacagaagagtttacatagttcattgagggaggacaaatgtaggatgttaatcttaaaattcatttgctctttctggattactttagttataagaggattcttgtggttttggcgtgagcccctccttctagctttctctcctgcccggatccttgtcagcagtgagcacatgttgagtggctagcaggcagtgccacgtggcctctgaaagttgtgatgtcccctttatgtcttctttgtccctgttcagatccaccagaacgagggtggtatgtggttaaatcctagccaaggatgaaaaagtaggcaaacccttttattgacttttctgttgtcaaagataaagatggttatttgtttgtcttaagtgaatcattttaccttcattaaaagcggtgagttttctgtgaaagaaaaatgcatcatccatttgcagactttttacagggattttcaacaatatgcctctgggtgtacacctaagttgggaccccgaactttgcttaaaatactcatgactaacatacattgagtgcttaatgtatgcccttcctgttctaagtactttcaagtattatcacacctcattgacggatttttctttcattatgtagggaatgtgaaaagactgcatttcttttttccaagattctgttttccagtaatttaggtagctttttcctttagattttatgacattaatgtagcaactcagtaactcagcatctcggctggacctggcccacagtcagccagtgcgtctcatgcctgtgctctctgtgttgatgaggacaatgctctcatcaggtgtggtgtgtgtggtttttctctaggatcatccatgaagatggcttctccggagaagacgtgaaacagtacaagcctgttgtctacagcaacactatccagtccctggcagccatcgtccgggccatggacactttgggcatcgaatatggtgataaggagagaaaggtaggcccctgagcccataagcacagcaacaagaggttctgtctgtgttaccccactgcctcctctttatagtgctgggctgccttaaatgaacgagaagagactccgctatgtttgaaagatatatggtggcacagtcaccaacctaagccattgcatccacccctctggcaaactcccagcaaactcaccaactttgcaagttgcaggggctacaaaactcccggatttattttgcagatgaggaagagttggtgacagttctaaattggagctgccacaacactgtctaagtacctgtccttgggcaattaacttgtacagaaaaaaatatgtattaaacaaaacaagccttgtctggccaccatctcccctccttagaagaactttccttgccttgttgtggagtgaggatagccatttgaattgactgcctttcctcttttacaccaagggctatgttttctgcctcccctgggtaagtatgaggacctacagggctctccttcctgtagaaagtcagtgtcctagaacagggactgtttgggggtaacatttccagtcttctattaagtggtgaatggaataagtactatataaaagcctctaatttgcaaacatttatattaactgttaagactgaactatatacagctacactggcaaggctaaataaaaggagggagggagagagggagaggagaaaatagcctcagaattctttccagaagcagctctttgtccctgtttgggactgaatctcagtgatcctccctctgggacctggagattggagaagggggcggagggcaggtacagcctccaagcacctgggctctgcatctgagcctctggatggagagcattcatctctgattgctgtgtgatttgattgtctattatacacatgtcctgtctttgctaaaaatcatcttcctcacagaggaaaactgtcctggttgtctctgtgtctgataaatcatccatgatagacagctttaaatgtaaaatttgatatgtaatgcacaaaatcctaattccatggggcagagtcatccagcccaggcattggctcctccaggtactggggaattgggtgactgagggtatgtccgaggccagcctgcggtggagaagctgggcactagcagggggacctgggcccatctgccgctcctcctggaggccaagttgggaagtggattctgcaaaggaagcacttcttcctggaaggccggctttgggtttggtcacggagccagggcctgtggaaagagggaatgggggagtggatgggtccattcactgcaggcttatgatgtgcaaggctttgagctaggtgctgtggatacaggaatgagcacagcagggaatggtgtctggttgcagaaaacacctattcagatcgttagaactaacccagatgagtacagtgcttcattcttcttaataacaatagtaggaataaaaacagctaccatctgttgagcacctactggctgccaggcacatactaagcactttacacataatgactcgttttatttaactcattttattacagcccagagcaaggagtgcctcatcttcaggcatggcacaagccacaggcctctggtctgtctgtctccctttgactaagtggggagcgtgatatctgaatctcagccagatagcagacacagtacaaaaggcacaccccctacacacacacacacacacacacacacacacacacacacacacacacacacacacacacacacacacggtgtgtgagatcttccaggagcaaatgtattcatctcccagccagctcttcctaaaaatctcctatactgattataacccagcaaagtcagtgtggctttggaatacttttctccttccattttggaaaacattcattgttcccatgggatttttttttccattttattatcctgaatggagagatgattgcttgggaatcgctaggactatgatacgttaaggactgtactgcaggcccctgggaaacagggtcccttctctggctatttctcctccatggaatttcccagtcaagtcagccttcaagtaggaaggaggggaaggctccaatggaaggagagactgagagctaagcgggactccctggagagtccactggacacagtcgagtccaagcacagttccgttatggcaggtggcaccatggccagcacctggcccatccctagggcaacacagccttgtctggtgtgagcttcctggtgggcaaaggcctccctggcactcaggcacccccttcctgtattcttacacctgtgaggagcaggaaaggagtgaacccgagacccaggccacagcaagccagacaactggaaaaggcgttcccgggagtgggctggtgtggattcgcagcctgtggagctgggcagaagagagtggaagccaccacttggcatgaggagacatgccaggccagaaagggctgcagtacctgctggtgtgggggcagctcagagccaacatccttccctttccatgttctcatggagcttcctatctagcagtacaggcagcaaacaagcccacaagtaggtgactgcataatgtcagataatgctaagggctgcaaggaaaacaaaataaggtgatgtgagagcctgatctgggggtaggaggagcagataattcagagtgggaggacgaggggacagaaagttccagacaagcacccaggccctgagggaggaatgagcctggcgcagaggaatataaagctctgttcagctggagctacctgcagccaggcagctcctgatgtccagatgccctgagcccagtgctgggtccccatatttttctgtctctagggtccccagccactctccacctaggggatctgccatttggatgctggggaaaccaccttatgctgcaggagtccagatccgtgttttggtctctgaagaagagacctccttccctctcatgtttttttcacctctgccacccaccaccactcatcaggggatgtctggaggaagacaaccccactcccagcacctgccggggccagccagccttgcactctccacacagaaaagcgcctaagagcttccttgctgtacctcagtgtcagcccctagaacaggtaggtgtccctgagttcccccggcagctgactcaccacctgtcctgtctgtttcccccagaggaaagaggactggctggtttttccttcagcctctctggtgtggagtcacttggggccccgtgactgtgcgtgagcctgaacctgaaagagcctccgtgcagagcaaacagcagggacctccttacatccgtctgtggtttccacaccccaggccccagcctcagactacagacctctcccaggggccccatgtactctcactcctctgggccttcgctggggtgtgctctctgcctctagtgccgtcctcttttcttcccctcttccacgtggaactgccccactcagtaagggcccactatgcttcatcttgtccatgaagcctccttcccttttccttccctgaggaagaaactcagctcagggctttctccatgaagctcttatctcacacactggcatgaagatgaattgtttatgcttctttccatagagcagtgggccctaaagtgtagtcagagtcctttgagcagctcatgaaagccgcgagccttccctccagaacaggggacacagcacacatctaggagattctgcatgcaatttcaagggggcctggcccaccaatggagtccagcctaagaaccccttcatcatttaaggtcttctgatcaaggcgtatgtcgtttatctttgggtcacctcctcactccagcagccaacacagtgctcagcacttagtaggacttcaagacccatcccattaatggaatgacatttctaactttcccagttttcagagaaaaaaaggcaaagtgcctgtaactttgtcactacatcaacagctgttgattgagtacctaccatgtgtcgggctggtactaagccacgtgtgaagattcaaaggcatgtgagttggagcctttaaggagctggtcatcttcttgggaagatggagctcacaggcagagtgagcacagcccttgcacatggtgggcaggaagagctgcttagtgggagtgaagatggaactgtccctgaagcacaggtacagtttgacaggtgcagtataggtgagcaaaggcccttgaagccaggaaaaaaacatggttggtaatgagggaaaggagagttaattggcagaggaggccagtgggcagaacagaggactggggtctgagcaagatgtgggaaaactagaaggtccagttgggtccagatttggtgggccctggaaggtaggccatggagtttgggttttatcctgttagcagtaggcagccgtggagagattttgagctgggatgggatgaaagtgaaattttaggaaattatgatgatggcatgtgcagagtggacagggcagggagggggatggcagggggagactaaagatgggaggcaggtgaagaagctgcagcaacagaccacgaataaggtgcaaggggctaggtgaggggtcagaaaggcagtagagtgatgcgtagcaacaaaggaaatacaggggcctggtgattaattggctgttggaaaaggatgggcacaaggtagaacctcagccagaaagccaggaggccgggtggggccggaccacagagggtgagtccccttccaaacctaaggggtttccaggtgggggaggtccgcacatatcagatggatggattcagagaactgaagctctgggaattactgactccaggataataacggctttctatttttatgtttcagagcctttattggaaaagggtgggcctaatttgtcctgttatttaaaaaatattccttaatgcttaaattatttaatcctaacagctacctgtgctgtgggtgctattgttgtcctcattttataggttaaaaaaaaatgaggcatggagaggctaagtgacttgcccagggtcatgcaatacaaattatatatgtatacagtgtagacatggaagcctaacaagactagaacctgtgtggcctgggtccagagcagagtcccatttagataggcacagtatgatgaggtaaaacaaatcattcaaagaatcccatccttcatcctaagtctctctaagaatatgaaaagggaccagagacagctccccctgctgttctcaaacatcctctcctgcctcccacatctgtcccaccccactcccttgagctgccttacccccctgggttctccatggaccctcttctccaccccagcgagcaaggctggtcctctctttcccactaaaggggttcctgctctgcctctccttcactcctccctttttcttcatctccctttcccctccccttctatctctccctttcccgccttccctttttcccttttcctctgtcctcctccctccttctcagtccccttttcctcctccccttccctctctccctcccttcctcctcactccagctcattattatgtaaattgtcttcaccttctgagccaagctctccccctcctccttcctctagccttagcccagggcctacatctgcatcacaaaagcagagggccttgttctggctgagctggcctaaactctgacactggaagaaagggttgaggagaaactgaacaattacaggattagaagattcactggaccagtgggggggatggggaaagctttgaacaagcctgtattaatatagttcatcatacacacacatgtgtctatataaacatatgtaaaatatacgtgtgtatgtatgtacatccttgcatatgtaaaatatattgtaaacaaatggactagtagcagtcatgcattgaacttgtatgaggctttattcagttgaaaatactccagttttcattttttcactatttgtgcctatgcctgtttctctcaactataaactccttaagggcagagtgtagatcctgttcctctagcacaatgcctaatacaggaagtattgaatactaagtttaaaccccaattctaccaccagctatatggccctgggtaaattatgtaacctctctaagcctcagcattttggactgtaaaatagtaatgatcctgatacctccctcattcatatctgccgtaagagtaaatgagataatgcctgtagcgtgcataggatagtgcctgtcacatagcaacttctcaacatgtgttggcaattattctcatttatttgtctaaaatcattatttttgataaagtgttgatgaattctactcacagcaatctagtgaggaatgggcaaggttttatctgcacttttcaggttagaaacagaagcacaaggttcttaactggccacccaaggtcatattaccaagcctgggtctgctgaacctgtgccataaagccaaacaccaacactgaagtttacaacaagacaaaagactgcgtttatctgcaggaggctgagcaaggagagtcaggcagctcatgcttaacatctcacttcctcaatggccctacaagcaagggcttttaaaggcaagggtacattttaggaaagcagaagctacaggcaaaaccgtaaacctatacatggaggttatacattggtttggcccaaaaaagcaggatatcttgtggggcaggctttgaggtcatacgtagatccagagattctgtgatatgcagttgattaaggagcaagcctttgtctaaaaccttggggacagccaaaatgaatgttaaggtctggcctgtaggtatgagtctctccaggcccctcaggaagaaattgagaagaaagaccggcgatcagtgttctgtccttagttaccactcttctgaggtctacttgactgcaatgggcattttccatctggtgggggtccaggtttctgaaaaacaactcagggacatatgttaagatgttatctttagtttccatagggaaccaaacatcttgtggctctgacttacttgtgtggctattattttaagctattacaacctccttgcttctcaagttgctcatttacttctcaaggctacctaggtgcctggaatttcccttgaagagactcaagatttttctgtttccatgctttttcagggtgtggggggcagcacgaccctaacagggggctccctgctctatctcagtcacctacctaagcaggaggaaagatgggtgccagctgggcttgccgcccatgctcttgttccaccaggggccttcactggagctgtatcccctagagataatggtagctctttgggaggcagaatcagatttcacatttagttttcagaatgtcattggatctcctctggtaaaagaaatcttgacatttaagtcacacaatggagctcaggacactatgttttttaataatcatggaaatattgtggtgccacctctacagtgcagtgcggttcaccttgtggtttgcatgaattctgaaacagataaaaacaaggatgctatctggcctgtgtctccctgagtcccctggggcttagagatactttagtggtagttgttagatctgacgagggctggaggatgtaatagatgaaggcttcatactcccatagcccaaacacgaggccaggaagaggatgtagatgtgtcccatgctgggtgctgaggctctccacctacaacagccccagagcctgccctgaccctttgccagccaggtgaatagagcttgaaactgctccattcaagcccatctcattctgctgctccattttgcagatggaacataggtttcatctggtccaaactggaaagagacttacccaggggaatatgtggcagatccaggactagagcattcagcttcctgcatcacagctcagtcctctttccatctcagcaggctgcttccagttacccagccaatttggggactcattttctttcattcagttggtcaatcaatcattccacaaatacttatcactcaattacttattacttacaaatgcttacttcctggggaagtgcacaagatggcagaggtgggtacaaagatgcaaagatcaagaggctcccggtcttgggcagagatgccagccccagaatgagaaggtaaacgccttggtttccagggcttctcccagctctgaaattctagctctccagggctcagtgcagcatcagcacagctccctgatccaaggctggatcgggccgcaagctcctggtttgagggaaggcatccaccatctaagccctgccacaaggagcctgagacccggctactggtactttggcccaggatggcagcatcagtggctttccttgaccatcatctaaaaggaagaaccaacccaaaggaactgcagttttcagtatgggaaagaaagaaggactaaagtgtcagatttttgaaatgtctcttagctgctcctcctcattagagtcttgggtttccttagctaaaagtggtgccctcccccaagcccctcccagctgccccccagcagcacactctacttcatggttgtcttacccttggggccagacagcaggtctggaagaacaggtcagtcttgttcatcatgcccagtgctagcaggggtcagtgaatcctgtgcctgagtgattccattcatccaatgggtgtgtgcttctgggtcaagtgctggcttggtactagggatatgcatggcctgaacagatgtgtccagggaagaaaggatgaaagatgcagaatatgcttctttccatgccttcctgatccctccacagcgtttgccatgcgtgcttccattcatgtgttcccacagcggtggctcagcctggagcaggcactcagcctccagggctccagcacattggcccctgcagaggccccagccagcacctagccttcatctggcctggcctgccttctcttccgtggcgtgcagagttgagtggatgctcaaggctgggctgccatcagtctctacatgttcattgcctgtagaaaagggcatggaattttaaaaaggaaatttaaatgaaagacttcaacaaacagtaaacgaaaactgcaagcggtgatgccttgcgcttgtgtgctctctttctgtctttcacactccaaccccgccccccaccgccaccataagccctaatgactctgctctgatggtgggaaaatgttataaccacgtaaataaatattcctcggcatcaggactgaagtggcccccaccaatcttggatgtccaagagccaccccattgcagcccctcttctacccccaccaaacccccacctggcagctacacagggggaactgaccgcctcccctctggagaggggccattgtgtgagcatcctttgggcttgtggtacctgtttcaaggtggcaaaccagctgccaagcagacttcagccttagaagccataggccacagcagagaggggcctgcctggccagtgccctgtattttgggactcctggaatattgaaaattgaagaattcccaaaacaaggtcacaaaatcgtgttgtattttaaatgcatctacttaacaaatcagtactttgggcctaccacaaatgcaatggaatataattgtgctccctaaaaagacaattataggatttacaaaaatattaattgacagtgcagtgctggccctgtggtcctgtagtgggacacaagtcagagccctgtgctgagcactgtagctttcactgtgagagatctctctcccgactatgtctgggacctcatttggtccaagccccagaattgagccctttgtggatgtataatccctttctggccaccagatataccgtggagtagcctaggaaaccaggaaggtagattttagtttgctgaaggaagaggcgccagggactgagaaagggttaggtttgaggcagcagcaccacgtggggaaggctgtgtggggtggggacagccaaggtggtatctgcccctgccctgctgggagtgtagtgggggtcacagtcccacacatgtgagatggagatggcttccctaggaaaaccagagccactttccatcctcccgctacacacatctgcacacacgctcatcagcttctgctttactcagctccgttccctcttctttctttgccgggcaaccaacagtggtcttatgtcactgctgaagcccccactctgagtaagttaggacatgttggttgcaagtgatggaagatacaaccacactggcaaactggcttattcaaacaaaataaaacacaaaacagccacaggcccagagagtcagaaattcagacacacatgtggggagtgggggcttgatcagcagctcaggggacgtccctggcttcccccatctctccactctgccgcactgtgtggttttcaccctcgactccacagcatcactcctgcaccaaggaggaaaatggctccagcagctaagtcatcacttgtaaccttgtgtgcatcctaggacatcaccaagcacaaggtgcatctgagcaaccaccaagtcctgcaagtctctctctctctctcagtctctttctgtctctgtcgcctctgtgtgtgtgtgtgtgtgtgtgtgtgtgtgtgtgtgtatgtgtgtatctgtctgtctgtctgtctctctctctcattgcccctccttgacccaatcaccatgaccaagggggctgaggggttcctgggataagagtgaatcccccagaggaaaaccagaagctcctgaaaaaggaaatagaataggaggaaatgggtgctggggaggccaccagccgcccacagatctctccttgccattggggctaccagctgtgctgccccgtgcaggagatgactcatgtcgtagggtggagggccggccaggctgagtccactgcagcaggaccatgagatggctgagctcggcagcaagccagcactgctgctcccatggcagcctctcccctgaggtcccaggtggcaggacacatgggtgcacagcccccagcccaccactgaccaatggtctcgcctttccactgtggccgcagcagggggccagggaagagtgggaggtgaagaggggagataggctggtaacagaagaggcctccactagaagtcaggtcccttggagcctgccccagccagcaacagccttagagctagtcaacacctcgcttcaaagctggggaggcactgccccagagggcgggcagcaggagtcagagatgtgactttgaatcctggccctgccctctgccaggcagtggacttagcactagtcacctgactgactgaccctcaggttcctcatctgaaaactggagatcataataatacctactcacagggttgttgtggctaaaagaaatgatgcatgttaacagctaagcaaggtgcctggcaccaagtaagtgctcaggaaacagctactgccatctccctcctcttgcccatacctcactgcctgttagtgaagggccaggacaggagcctgggtgtgacaattgtttcagaaccagagcaaagggttggtgtcaaggcctcttagctattacaggtcaaagaggtggtgtcatcccctcccagaatcagctgtcccttctgatttcaggctggaagacagtatgcctcagcacctgccctcttgctggctttgcaggagtggagctgaggagagctgcttctgactcagggcccagcatggcctgagagagaaacccaaagagatagagacaaggagagagcaggagagatcacagagagggaggagagtggcagacactgtgtgactgagaaacactgagatggcgcgctgcatagaccgtgcaccagtgtccagtgtcgatggtgcactcagcatagcatctgcgcagagtaaatgctgctgaaatggctactgctccattccttttcattagggccgcctatgactctgtgaatgtcattccacagcccctccagccagacgtgtcttctttctccccctggatgccctcagcacctggctgtctcattcactcactggtttatttacttgagaaatatggacgtggccttctctgtgccagcagcatgctgagtgctttgtgcaccatggtgaactaatgcaagcaggtgtactgctgctcagagctcagctggcgagcaggtggacagcctcagtgattccagagagcagagtgtcctgacagtcggcctgtcctagcctgtgctgaggacggggtatctgacaaagagctgaagggattggcaccggtggggtctcaccagccaccaggataggagggtaaaaagactgctcccaagtgtccccatatggggcacgccaggaagtaagaccagagcacatacttgggctcctggctgtagaagttcccaagctatataaggagaggagaatcaggcctggcctctaaaaggaggctgcttcctcttggggaaaagtcagggaggtgggaaaatgcagccttcacagccctgtgtcttaagtcactcagctctgatagcaagagtggccagcgtgggggccggtcttccctttgcgttactttctggcctctggagagtcaggagctcaggtagcctggagtcccctggaactcagcagcaggggtggaggcgggtagggtctttgtcatgaaccggaagcataccaggccttcacttagaacactgacccctcacagaaagaccagcccctaggccctgcctcggctggcagggtgacctcaggcccatcccttaccctacagggtctccattttttcatccattagatctgaggaacgacaccgaagatcgcccctcccccaccctacctcctttttagttctataaattcccctggcagaacttaattgctaagtttaggtgattgccaagcacaaggttcttcctttgtatccaaaaaagggggggggagcggaaaaaagagaaaaaaacacagtttcaaagttagggcacctgtgttcaattgaagactgactttctcttaaggagggagttgatgttcccacagccgctgggctgttagcagcaaaagcagcctagcaggaggggcagccttggtgagcccccagtgcaggccacttgggccacttgccccacagtatccagcgcactggggggcagatcagcctgtcactgagaatgacacactcaagtttggagccgggacctcttttttgccatccatcaatgagagtggttcagggttgtcagtctaagacgggagtatagcccagggctggggactgtagaaatgggcatggtccccacccggtggggatggggacaccggtgtggactggcacacatgggccacggagccatcggggtgaagacactaaatcaggcagaaaaacactgtcaagtgttaacactgcagcatctgtgtcaagggtaaccatgtctcagggacgcaggagatgagcggccccatgcaaagctgtcagttttagtctgatcagtccaaaaggctcccggtgtggggagaggaaggatggatttcagtagcagcttgctagatgaggatgagatggcagagcatacggcgcaggcttgaggagggggtacggaggccagggaggcctttgggcagctggctgacagcactgttacaaacattttgcacacattttattgattggcccactcctcaaacccagagcacataaacaagtgtcccatggtaccattggggtacctggaacccagagcagtggggaatgtccctgccccagtcccccaaacaattgcaccagcctctccagcttcccactgcctctcttgcctcccaccccgtaatctgtgctccacacaacagccaaagtgagcttttaaaaatgcatatctaatcccctgcttaaaagcgctcagtggcatctttgctctcaggataaagccagccttatctcctgtagctcctgccacaggctctgctgctgactctttaaatgccacgacctcctggcctcagggctttttagtgagttatctcctccataggggacttctccaccactgcttccctcccccaggcctgggttccaccatcacttcccctcccttggaagcctttcctgactctccgaataggctgggcctcttgtcctgactctcagacccctggtatgtgtgctcacctgagtatttgatcaatgtttgtgccccctgacccaacaaggctgtaagggacagggacagggcctatatgacttcagttggagtcagtctccagcacccagcacagtgcctggcccagaattggtgggtgctctattgaagtctgcagctagtccgtggtagagctgttcttgatcccagatgtttgaacacctggcccattgctttctgtatggccccttgtaaaatcagagcaggtagttaaaatcagatcctggagacccagaatgagtttggaacctgagttctagaacccacttgttcataggccctcttgcaggcctcaattttttcacctgctgaattgaaaccacacctgcccacgcactgtgcaggaagcaaggagtaggggtcacacacgtgaggcatgtgagagggggtgcctcctgaaagctggctctgtgcatccactcctggaacccggcccctctccaggcaaggcacagaggcaagcacctccaaaagaaaccctatacccgttagcattccctccctacccctctgcctgcagcccctggcaaccactaatctgctctctgtctctatggatttgtctattctggacattttatataaatggaatcatacactatgtactcttttgcatcttgcttctttcacttggcataatgttttcaaggtttttccgtgttgtagctgaatcacatttcattgtatggatataccaaatttcattcatctattcatcatttgatggacattgaggttgtttccaccttttggctactatgaataatgctgctgtgaacattcatgtacaagttttgtacagactcatgttttcatttctcttgggtacataactaggggcaaaactgatggttcataaggtagttccatgtttgactttctgaggaaccatcaaactgttttccaaagtggctacaccgtcttacattcccattttccgcatatggaggttccagtgtctccccgttctcactaatacatgttattgttcatcgtttttattatagccatcctcgtggctataactcattgtggttttcatttgcatttccccagtgattaatgatattgagcatcttttcatgtgcttttggccattggtgtattttcttcagagaaatgtctattcagaattagcccatctctaaatggggttatttgtcttacggttaagttgtaagagtcctttattctggatacgagtcctttattagatatgcgatttgcaaatattttctccccttctgtgcattatctttcgaattttgtgatggtgccctttgaagtctcacctcattctgcccttgcctctgcccccttgccagagttcctcactcccccagacctactcatctgtctctgttcctttatgctgctgcaacaaaataccttagaatgggtaatttagaaacaacagaaatgaattgcccacatttctggaggatgagaagtccaacatcaagataccagcagatttgctgtctggtaagggtttcttctctgctccatagatggtgccctatcactgcatcctcaggtggcagaagggacaaaaggctccctcaagcctgtttataagggcactgatctcattcgagatggcaacactcttatgatctaattgcttcccaaaggccccacctcttaatatcattgccttggggattaggttttgagcacgcgaattgtggacggacacagatattctgaccatagcaccattgcctgccctgccttcgggacttacactcttttggagctgaaggaactggctctttcttgctccacattgctccacattccccatcagcgttccccagcaggctctttcctagcagacaatctgaactgcacccaggctgcagtcatccctgagtttgggggcttctaaggctgtgtgctgagttgtgcctgaagcaggaggagcctacaattcactgagcatctccctgtgcccacgtgctggatgcctcgcaggcatggatatatcccactgcatccccagaacaatctcaaaagatactggtatttttctaccctgtggataaaatggagtcagaatttaaatttggatttttttttaagacaaggtctagctttatcacccaggttggagtataatggcatgatcttggctcactgcaacctctgcctcccaggctcaaaccatcctcccacctcagtctcctaagtagctgggactacaggcacatatcaccatacccagctaatttttgtattttttgtagagatagggttacattatgttgcccaggctggtctcaaactcgtgagctcaagtgatccacccacctcagcctcccaaagtgctgggattacaagcatgagccactatgcctggccaaatttagaatttaaaatggagctgttcgctgtcttcctacacagcatgttcatggcttatgagctgcacgttcagctctgctgtcctgtttgataattgcctactctgaaaagtatttaaaaatactggagaaagtattaatacctccctaggtataagccctagtatggtagcaacagaagtttcttgacactctggaaaatgcccaactccacctgctgtaaccagcagccccgaaatctcagggcctcaacatagtgaacgttagttccttgctcccaccacagtctaatgtggaagtgctgggggttgccctgtcccacgtaggcccgagccaactcccctgtggtcagtggttcagcctcagctgagggtcttctgctggactcctggtatcaggccagtggactggggaaggtcacaaggggagtttttggggccgggccagaacttggtccctggtcacacctaactgcagggaagtctatgaaatgcctagctgtgaccttggaagaagagatgaaatacttttgtcaatagggagccagtctctggcatagtgctcaggtgtgaattttagccaaactgctgccaactggaagcagcacctctgctggggtgacaggtccattttcttggctctgttggctgttttctgctcctcacttgggcccagctgagcagttcaacagctttgcttctctgtgacatgacagagcccacctgaaaattcatttcttggtggctatggtggtggcttctcaccctgtctcctgtcccagctctaaaaatggattgcccttctgatatgaacatgcatgacatctctggaacatgagtcccatgttctgtgtgcagacagtgtgccagcagcttctcctgtgtgatgtcagtgtttccctggcatggcacacatactttggtggaatatgagattaaatggtacgtggataaaccttttattcctacttttgtagttgcatatcggttttaatatgtacttgaaaaaagatcacataacatatcaaacccataatttcatatctatgactgaagatgaggctaatttcagagctgtcctgatatcaggttggggaaagcgatgaatgaatgactgggtttgggaacgttgcctggggtgaaaaggctcagatgcccagccgcctcaccggacttgctagtgtgtgacctctctgcacctttcctcctctgtagcatgttcccacatgaacatagggtataggaaggttggtgtgtcaagtgattaacagcagtacctggcacatatttcatgcttagtaggtgatagctcctaatgttcttaggaaacaccaagtcatatcacttaactgtgccaacagtgttgagacagggttattactatactttatagatgagctgagaaaggttaagtcgcttgcccaactggcagcagagccatgtgctgacccccagtgtgcctgactcctacctaggccaggctctgcgaggggagtttacttgcaatcctggctctggcactaacttagcaggacactgcaggcaggccccgtcgctctctgggcttcaagcttcccataggcgggatgggggaccagcataactctttgtgcaggataagtctcacagaatgtgggggctgctctctttgctccaaccacagcagaaggctttgctttaaaaaaaaaaaaaaaaaaaagtggactgggtgtgagctaggtgtctgcatgcaatgcccctcccagatcctctgcttgtctctggattctttctgctgcctctcttgtcacacttctttatgaccaagcttccaacctaccccaagtgtaaacatcatttgtttgtccgtcatctggtgatggacatttcacttgtttccattctgggactcttatgaataatgctgccagaacattgatgtacaagtttttgtggggacatatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagaggttttcgtctgcagataaagaagtgatcatggtatcagaggttgaacttgtggactctggggtcagacagtcctgggtccaagtcccagctccgtggctcgcagatgggcaggtccttctcgtctgttctctgagccttgcttttctggtgtgtaatatgaggataataagtcacctacctccttgtgctgctgggaagattaaatgagatgatgatctcaggggcctagcacctatcaagggcacacaaaggctgggctgtacctgttaccactcctgttgctaaggcacgctagcaccccagggccagcccatgtgaaaccactctgcacaaagcaggcttcttctcccttccacctttaaatcgaaagcaccacctttctcccagttatccaagcagagaccctggactcctccttcccctccatgtctcgcttcctgttccagaatggctcttgaatcagcccttcctctcgctgcccaggccactgccccagtgaggcagccttccctcttcccagtgttcgtacggtgctcctcaccaaggtggtctccctgcctcttcctcccaatattccaccctgtttgccgctgacactgttgtcaaaggcttcctttctgaatcagaaacctggggctcctgggtagttgtttgggggagaccaccttgcacaggcaaggctcggctgtcactggcgtcttccttggttataaataacaggctctattcttagccaaacagcagttaattctcttcccgtaccttccagagcctctattagggaccttggccgtccttactggagacaggccattccttggcctttggcaggacccattcctttgatacgtgatcagaaaattcaattataaagccaattactgatttcctgagctttacaagggagactggaaagtttgattaagtttgaatttgtgtttggctgattgccagccaaaaccgaatgggcttgtgggagagttctgttgttgctgattctgttcctgttttgtggcagctctcttggggtgggggcaggcacactggtgttgtgttgtgggttttttttagacccccttacttgctgaatggctattcctctgttgtgatgcatgagatgtaaatcccccaaagactggttgccagagcgacgggctggaattgagctcagctaaacaaagtccttcagctttgaagggagaagcgcttgtttcccatgtggagttgagttatagtggccctcaacaaggctgcattcaaggatgcctgcatgaacaggcatgcagagggggtcgctgagcctgctggaggatcttaagcggcgtgtctgggctctaactgcctctaggacctacccagggggacacacagatgctgagcctgaggatcaaggctattcagggtgcctctgcccagctggtcaccctcaccctagaacctgcaggactggccttcaaacagtgacagcctgctgggctccagctagagcccagcacaggtggggattgaaaagcaaccctttgtctctagccaaagtacttgcttttttagatacttctgggaaaccaaacagagcccgtgatgggaccaggttggagttccaggtcagaatctgagttgtttctggagacccaagttccttccctagcaataaaatgagggaatcccagttctctggaagctgtagccatcccacaactcttcctacaaggtatacattattcaggagagatggtggggccccacttcaaagcgtctccctcatgcctaaaatctcccagttagagccctttgggtgttaaaggtttttaggtctctaagaatcctggttaaagtactaatactcctggaaggagaagcgtctaccagtagggattagccatcagctaactgagaaaaccgccctttgggagtaggacacgggattccctgtacccagggtggggtcagataaactccacctgcctcccagcttgcttgaggcaagatccaaatgtgacctcttgcaccagaaacattaatatctctaacattcgtatctggtgtgatgtaccagagctcacagaacactcacgccctgccctgtaccctcatccatacagcaagctcatgagccggcaccaccttgacccccggttgcagacaaggaagccaaggctcagggaggccaaccaccttgcccagcatcacacagctgggagtacagattttggactcagacctgggatttctaaatccaaacccaaacctgttttctgtgcgcacagccacccacccggtggatgacatggacactgcgcacctgttttgtctaactggtgtgtgtgtgtgtgtgtgtgtgtgtgtgtgtgtgtgtgtgtgtgtgtgtatgcatgtgtttaaaaggtgggaattttttgttaagtttgaatttcagttcttttcttttcttttttaaatgaaagtgttatagcatcctggtggagttgtaattaggaaattctgggttagtcagctaggcagaattgaaaaataacccggcagtgctggttggagtactttttcccctccttagaaattcaggttttgtcaaactagggaggagggagttgtgaagatggaaaaatgtgtgcagctgggctgggtcagggagtgtgtattctcttctttatgtagaactagacgattaaaaaaatagttatcgagtgggagtgctggctcacgcccataatcccagcactctgggaggcaaaggtgggcggatcacttgagcccaggagtttgagaccagcctgggaaacacagcaagaccctgtctctacaaaataaaaataaaaaattagccagccatggtggtgcgtgcctgtggtcccagctactggggaggccgaggtgggaggatcacttgagcccaggaggtcgaggctacggtaagccatgttcacgccactgcactccagcctgggcaacagggcgagaccctgtctcaaaaaataaaataaaatagttatctttgtgtaggatgatcttccgtatgtgcagacatgaggcagcctgtgaaagatggtaaggaaacaggtgaagaggaaccctggctgggtcccaggctttggcaggaagaggatgcgagccccagatgtgggttaagggctctcaaaccaggcgcatgcagagagactccattgtcacctcccttccagcttgcccttattgatcagcgacagtgatgatgacaagggcagtaacaacttcccccacacgtggggcatatatgccaggctctgagacactccgtcatttctgtgttaccctgacagtcttcattttaatagtgatatgcttattttaataagaatccaaaacatagcccatctagctcatgactgcccagatattagaatggggccaaagtatgggtttaactttttttaaaaaatgagttaattaggctgggcacgatggctcacacctgtaatcccagcactttaggaggccgaagcgggcagatcacgagatcaggagatcaagaccatcctggctaacacggtgaaaccccatgtctactaaaaaatacaaaaaaaattaactgggcatggtggcgggcacctgtagtcccagctacttaggaggctgaggcaggagaatggtgtgaacccggtaggcggagcttgcagtgagctgagatcatgccactgcactccagcctgggcgagagagtgagactctgtctcaaaaaaaaaaaaaaaagggttaattaaataaaacatatgaatataaggacggggtgtcatgtggattgggcagaaattgtgaaaacaagacagaaagatctggagtttgggaaggcttgcctcatccatatgagcaggtaaaatgattaacctcattttacagatcaggaaaccgaggctcagaaaggttgagtaacttgcctacagtcacacagctgacagatggcagagccagcaacaagacccaggcttgcctaactccaaaggcaaggcttggggctgccatccaggtgaacattcctaccttcactctccagatgaagccctcagcgctgggttagctagccttcctggggctgtccaaccctggagagagaaggcctttctcactgctttctgaagcatgaacagaggcggatcccactctagggaggtagggccctggggcctgcttcctccgatctgctgcgtctaactctctcaaataaaagccttttcagaaagggcctggcatgaggctgcatgtgactggcagggctgtgactgccaaggcttcactgtgcttcctcacccttgccccagccccacccagcccgaggcagcccccaccttcctttcttccctgatctctcttagctcttcctttctttcttttttgtctctgaatcattttttccaataagctgttgattgtctgttgaataattctctgaatgatttctaaaagcctcctgatcactgaaacctcagagttggaaacacatttatatttatgtggaactgagcttttagaacattattaaatttgcatggggaactagcagagtagccacttccacacaatccagatgatgaggaagcatcatcttcaggaggatggaaatagttccacaagccactctgcctggcttattactctgctgggagaaatcagcacagtctacctgggggtccagaggcagcattgacccagacaatctgagcaaatgctgtggcttagaaaccactcagatgcctgtgttttataattggccagcttcctaacctgggattctggagctgccacctcagaaatggaaggcagattggggttcgtgtgtgtgtgtgtgtgtgtgtgtgtgtgcgcgcgcgcgcgcgcacgcacatgtgcttgtgagtgtgtctgtgtccacgtgtagctggatgtgtagttcctgtgggtggtttagtgtgtgcatgactacatgccttctctctctaaggagagaggctgtagcttttgtcccatgtcaaaagggccacttgcactaatgacctactatgtaccagctgtgtaagctgctagctgaggcctctgagcaggataattctcatagaatttagagttgagaaaagagaaacaaacaggaaaggctgtagatagtggtcaggcggtacagagaatttaaataaatgagtggcttctctcagtcaaagtggtaccagctggcccctggctgcagctcaccacggccaactgtgtgacatagtaacagttaacctccactgactggtcaccgtgctccaggcactgtcttaagtggcttgtattcattcctttaatcctcataacaccctgagaagttgggactatttaaacagattagaatgctaaggttttgtgaggtcacacagagagcgagtgacagagtccagactgaatctggggttactcacctccaaatgcttccctgggtaaaatactggcctctccagactttatttttctcatctttaaaatgggttgattcttatttggcctatccctgaccaaaaaaaataatattttttaaaatataaacttttacacaaatcgatctgaaaatcagcatcctgctcccacttggctctggtgcccttgatggagctgaagtctgtctgggtggttcctgagttttctcagattccttcagggctgccagttgaaccaccaatgtgtggagttttacttaagcctcattttataaatcagaccatttgacttgtctcccactaacttgtcaaagttccagcgagcaagttttagttccagaagccagatgcttgccactgccagctccctgaggtgggcgttctcaccagccccattccctgctgagcagccacgggcccatctcccagcccagggcaaggccacatttcctcagacctctgagagctctgaagtcagcctgtgtggctggggtggatacaggccagctgaagtggacagaggataccggtgaacaataaaaataacagatagctatggcagtcaggtaaacagagtttgggcttacgctaacaatacgattgatggggtgggtttgacctttttttgtttcaagccataccaagaataccagtggaccgtgtcacatacctcagtcaaaacaaaagtgacttggatttgcttttgagggtcaaagaaaggccttacagaagggatgtgggggagccggaagcacagacttcgggggtcagaaagatctagactcaaaccccagctcttgcttccagctctgagccctgggccccctttttcctctgacttgctgtcagtgatttcttcagggcatgaagaggctgcaagaagggctttctctgtttgccctctaagcgcttaccacagaagcttggcatttttccattatttttatgtatgtgcatgtgtgtggagggagattgggtttttttaatttttcagttgcattttttttgttttgttttggtgagttcttctttaccaaaaccctgacgtgtgcttgttttattgtgcttctcttcccagtggaacacagctaaaccattctgcccggcggagtggctcagtcagagtgccagatgtgggtgattcataagcgtagtggccatcatgttgaattgttactattgtcactgagtgtgctgagcacctgactgcactaacttgtttagaactcagccgtctgtgaggtgcacactgtcaccacccccaatttacagacgaagatactgagaccctaataggcctgctcccaaatgactgctcacagcgttactcccttgatgtggaggtgtgggcagaaagtcctggggctctgaacgcccccgcccaggggtcctgcctgtgggtcatccagcagcagcacctctgtccagtcccacactgatgtgaacagtcttctctgatctacagctcacaatctacttcagccccactgtcaccctctccccacttgtgtgccgtgttcagtcctcagggaccccagaaccagcccaagcagactaaggttccctgggttctagaatcttgatagctcaaaccactggcctctccctgaagggtttcgacacacccccccaccacccacctcctctctagcctctgcttcccagccagccctacctccttcccaggatccaccagctaagccaccagtgaccctggaacagtgaactagccccgcctctctgtgcctcagtttcccaacttgtatgatgagggagcatagacagaagcagttctatgggcccctccagctcagacattctccaaacccccatcatctctcatttgacaactgcagtggcctccttggagtgctccctggagccactcttccaggcctcccagccccatctggctatacacagcagccagcatgagcttttgaaacaatattatttcattcccacctttaaaaccctccgtgacttcctaccacacatagaataaaagccaaactccttcccatggccaacagtaccctacatgactgggggtcacgcccgggctccctcttctcagaaggtgctttgaacacagccagcccgccagcccctggctgctaggagctgctgccgtgttgccaataccatcactgtgtgtattgatttctcacccaactggtgtccttaacttcatatttatggcttgccctgacatttcccttctcttacatgttccaaattattaaaaacagctgctttataattaattgagcaaatcacagaaaaacactttttttctgtctataaataattccaccttaacttttctgggaggataaaatgctgtgacaaggaaccagcacacacctggtatctactatctcctccccagcctggacttgaattcatctgaaccatctctggttctctccccggcctgaaacgggacctccacgcgcagccgaagtggggtcggtggagaagggtcgcaggattcctgagcagcttttgactgctcgttctgcctgcctgtggactgcttcccatgatttcaccactgccttttgtatgctgagctctgtgccctgtcccatgctggggtggggtgtgccaggggaagacatcactcctgccccagaggaatcacagtcttgttttccagatggacacttggagacccaagcaaccaagtggtgtgatgctgagctcagggtggggtcagaggagagccccatgtggaggctggcgggcagccttcccatagcaagacccccaccagcgaggcttgccacacaaaacgggtgaccagctgccccaagagtcagctctctgtgttccctgcaaggggctctgctgaggccagcattttctgtgtggacagaccctgacatgggagaggctgggaagcaccagagcatgagctggcatcttgggtgggcagtgacttcaccctctggagcagtagagcccctcgtgactgtcagacagtttatggacttacacccttgacaaagcatcacaaagcatgatggctgacagcgacctcagagatgatcacatctaaagggtgacacggatttgtcttgtgtgcttgctatcattgacccccagctcttgtccccggcagtcactgtatttcattcatggcactgaatctgccctcagagttctctcaggatagccattgccccaggcagccactaccggttggttgcagtcagccctcaagttgaagccagtttcccacctctgatctacccaatgcgacaccctcattttatagacgctggcaagggaaagggcactgaagagccacagcagaacacctatcttgcaccccgagctttctaaccccctacttcattgctttttagatctttccctaccaagccctaccaagttcattcacttggcaaatgtttactgagcacctactgtttgcccagtttgttggtacatcctggatacaagagggcgcctggtataggagcccagcatccagtggagagacttgtaaacacagaacacagaggctggtgggagccacactcactgccaccctcaccggggagagcagagaccctgctgccccagacttcagggagccccctgcgtctgcttttcttgatcctcagggctttgcccatggtactgagggcctgtgttctctttaatccttcctgccatcccaggcaggcagattgcaggtccctcttcaagctggtgctcttgaaatattgttcatcatttattcagcaggtccaggaagatgccattaatgaaacttgtttctttattgttcaaaatacgggatatattagatgtgctggacttaacataacactttaacattgttgggagctggctttcatgtccattgttcctaacaagagaagactggtgcctcacagcccctgaaaggacaagagcccataattacacaattaggctcaaacatcagtttacaactttttttttaatgtgggcaaacttcacttttctgtctagttcatgttttttcttgttttcattcacaacattccaaaccaggtaacttcttaggaggaatattagtgggtttgaaatttacataataaacaaatgcctccaccccagaagacagccctgtatcatccatgactcagtttcagagtttcaccgaccaaccacttcggctggctgagagctggtggcctggcccatgcctacacgtgcagtctgcacaggtggggttgtgttgatactcagctgaataggtgggtgacaaggaaggacactgtccacctccactggagtgcatcagcactcgtttctccagttgctctggaagcatccaggacaggtagggttagccggccccttattctgctccccctgtgacattgcagctaccctcatggctggtatgccccacagcctggctctcttggatctcctgttgaggtaagcagagaccttgagaacaggctctgggccatttctcctctgcttcctgaccccactttcagctcaccccgccagaccttgcaaggatgaggagatggtacctagtgcccatctcaacgtatagcctggagtccatttattccatgagcagcatcttgtaactgaacacaatagttaatgaagcagatgtaggccctgccctcacagagcttacaattcccctaggaagagaaacagtcatcaaggaaacaaacctgtctaattacaccttgcaataagtgctgttaaagaaaagaaaatcatgttaggatgagaaaaacttttgctttagattgggagatgggggtgatcagggaaagccttatcttgggggttaaagtgagactggaaaaataagaaggagacaatctggcaaagactcgagtccaggaggagccagtgcagaggcccctagtggaaatgaggctggtgtgtgtgcaaagcctagaaagggatgggcggagggcagtgggtgaggctcaggggaggaacgaccttgaccccacatggccttgtagatagagtttggaatgatggagagagaaccccaactcccagccccagggagagctccacctcaggggctgtatttgtttcccagggccgtcataacaaagcataatcacagttctgaaggctgggagtctgagatcagggtgctggcagggttggtttcttctgaggcctctgctccttggcttgtagatggctgttttctccccatcttcacatggccttccctccgtgtgagtctgtgtcttaatctctataaggacgccagtcctattggattagaacccatctaatcattttaacagaattgcctttttaaagaccctgtctctaaatacagtcacattctgaggtcctgggggttagaacttcaacctgtgagttttgggggaacacagttcagctcctaacagggagcttccctgccgtcctctgagatgaagctcgtggatcagcatattttgaatgctgcagcaggctgaggagcccagttccactgcttgctccctgctccctctttgttgaaaggaatgattcacaggtgttgatgggtgtcaaagataaaagggcaccaagcagcctttcttaccgaaggtcagtcagaagccttcctagcgtgagttagtggtgttaatgcagggtcccagaacaacctggaatcttcagcggcccacactctgggaaatccccttcatcgttgtggcggaatctgcagagtttaggcagggaagtgagttgactggccagggcgcaggagagctggccaagctgcccccgctccttcagggtttcctcccaacccctagcagaaccctttgctggagagaggcccagaaagggtagtgctgaattcagtgaggtggacttatgaccagctgtccccaagacccctgagatcagtgtttcttcagcctccagggctaacctgctgagggctgaggtgcctgcagacacacagaccagcctccagtcactgcctccaccttatgttaaagataaaaataactacaaggcgggaaatgtcctagagaaactaccttgaaattcagaaaacatgaagccaggcttcatctaattaagatgacattttaaaaggggggacggggggaggcttgggtggcattttaaattgcaagctgattgtgcagcctaattttggttctgagcaaagattccagttggaccagaaaacaggacttcaaaggcactgcctactgctggccaggcaaagggagtgaaaagggcagcgtggggcctcgggcacaatgtggccgggaactctgggcaaaggctgggggccgcggggggctgcagcccttgggagcctgctgtgcctctgaggagatcagtggagccgctcctgggaggagagctaattgaggtagcgacttctccttggagagtgagctttggtccaccccagcccatcttgggggcagtcactggacagaactctggcctggtggtcccaggcatgcccccacccaagtctcccccaggagctacagaaacaggcctggttcttatgcagagcgcccagtgccctccccaggagggggctgctcccttccggggacttctcctgccagcctctaagattcaccaggcgaagaaggccagctccctccttcccagaatcccgggaggggcagccccagtccctttcagattggagggcagcggctgggcctccgcgttggtagggagatatggcagccagctagcctgggaggtggagcatctgcccccagaggctcctgcatgtctctcctttttgtgcaccatagcttatctcacaaagccagcttcactcagcagattttgtagttattgttattattactcattctactgacatagatctgggcacatgcacacaccccacgatttaagtgctccacagtcagaaagcccattccccagactctgggttctctcacaggagccctgggaggagagcatggcatgaagaacaccatttacggttgaggaaactgagtcacaaggtgtcacatgactaacccagatcctctgaggccacaccctgacacttcccacaagtgttgtgaccttggtggagtcactgcttcccacttgacatttcctggtggagacaccatggtgtctgtcttccattccctctggccactgtctcactctctctcagcagaggtctttccccagctcctccataggaaggatggtgagatgagcatgagctaacagatgggaagagtcgaaggagctggtgggcaagggaccttggttcttccatggctgccagtggggagcacggagggttccactgtggcgccattgaaagactcagcggtggatgagagggagattaggaggccagtctggagtcgctgccctcatccatgcagggaggcaggggtgtccttggaaggtaagaagaagggacagattcacaccttcctgagggtaaatgaccttgggaatcagccagctgcaggaaaggaggaagagtggagccaactttggggtccccagcctgtgtcatgggaagcacagaaatgccattggaaagaggctgtgtgtccccaaagagtggtgtgcgctttcctggggcacacaaatgacctggcagtttttacagaccaacagctttggttttagtagttttattattttagtgtatattagaaaaattagcacacaaacctctggttctgtggatattgtggcctagggtaagctggcttttttaaatgagtccaatttaataacattttcaaaaatattgagtcagcagtgacggtgacttgctgatagggcagaaagctggagaatgaggcaggaaggaatgcgatgctggagccttggatgggaaaccaggaggggagtctaactggggacacattgagttgagtctgaaaggccagtgacccagaggttaggtaggggtaatccagttgttccctgcacagaggaaaatcaggcaggatctggctcagggagaaggtggctcgggaaagcaagaaggggtttgaggactgagtccttgggaacattggcacctaaatgttgggtggaggaacaggaccacagttggagacagaggagggatcacagtggactgaggtgaaccggcacccacggggctgggcgcccagagaagaggagaagtgggcgtgatggagagggcactgcgagccctcatggagtggagagggaggcagcaagacagaaggaggaggaaggggaggacagtggcttcacggggaggccagctcagaggacgggttaggatggaggggccagagacccccacccccaccttttcatcaggtcaagtctaacttggggtgaagggtacagactttccttttggggtttccctgaagttcatgtagctggatggggctttagaggcttgggaggaagcagccctggacttggtttctatggctccccgcaggccctctcccagtcacaggagacagcccccttcccacctgcttcactcaagctcaagtgctctcctagctgctgtggggacagacaggcagggtgggctccctcttgctccttcccagctcccttctacgaggacagtggccactaggagaccagaagttaccatgacaacaaagctccttcacagaacagagcccctgggctccctgcaactgtgtccgggatatttgaggtgatcttctctcaaaaaggatgaggccccaagttggcttttagagatggggagagatgataggaggaggtagggacagattcatgttgccagctctcccacccagccaaggaacgtgtgggtgccccttcccttcccataggatgccacacactccttggggagcccaccagtgggctcattccaccttgaaaccaagaccaaggaaccaagggtggggacaaggacagagaagggagcaggaggtctgcgggcttggaagcctggactcagtggcatgaccagatcactgccgcctgcctgcaagcactgtacattcccagccaatcagggttgttctcaggcctcacaggaccagaagccaaggcccttctgctaggagaagagggaggtgaagtgacctgtttccagtcccaccacccaggggccagacccggacccactgctcctgtgcgtgccgctctgctccctcatagctgaggaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattaggtcagatgcagtggcttatacctataatccaagtgctttgggaggccaaggcaggaggatcacttgaggccaagaagaccagcgtgggcaacatagtgagaccccatttctaaaaaacaaaaaaaagaaagaaaaaaaaaagaaaaaatcagcaggacattgtggtgtgctcccgtagtcctaggtactcgcaggaggctgaggcaggaggattgcttgagcctggggggttcgaggttgcagtgagctatgattttgccactgcactgcagcttgagtaacagagcaagaccccatctaagaaaaatattaagtaaattaaagtacaagttttatacaaacagcagaaatttaatgatcatttattgagcacctattatgtgctatagtgttctgtggatacagtggtgaacaaaaattatgcgagtaactgaggcttgggagatgctgctgtggagcatgacttttacccttcttagggggagtattggcacagcacagatctctaagactccagaaaactcacctgtgctctttcaccagcttacagtcttattgagagggcactctattgctcactgaagcattagaagagggaccgtactcagtaatccacaatgcaggataaacagaggtcagatgtcaaatagggaacaaaagccaggagaagaaggacaatggcagaatgtgttagtaagggtgccctagctgctataacaaatacacccaaaatgtttcgtggttcagatgcaataggttatttcttgctcatctactagtctggggcaggtgttcttggtgggtgggtggctctcctccacacagtgactcatggaccaacaccttccatcttatggcaccaccaccccctaggattttgtcatcatgtgcatacaggagacacactcacatcttaagagccttgacccagaagtggtatgcttcattttcacatttcattgatttcaacttagttacatggcaggttgtggcctacagaaaagttcccgactagcagaccatgagagggctgaaatccagtgcaccttcccttttctaagccttacaacctgcagaaaggaactccttttttctaattgtaccggctggcttctatctaccctggccagggtgtggggcttgggggtggagatgggggagagaggcatggaagggggtaagaggagtgacagggatgaaggaaagcaagaaatgccttggaggggagtggaacctgagcccaggtggcatttggtggccctgtagtttcagagagtgagtgccaacctgagctggttccccctgcccccactgggttaggagctgcagtgccaacctctcacccagtgagccctgtgcagctcttccccagcagagggcagagttgatacccttccccacccgggcctgaccccatacccagagtcacccagtgtctgtcagggaagatgaggatggcaggggctaagtagaggccatgcaccctgatcccagacctcagagaaaaactgttggggtgatggcgccttggctggagcaggccacccacctggccctgcgctgaactgagaacccgaggagcgcgtcccctccctcctccctccctgctgacatagcttggcagatgagtccccggaggcttggctcagcccctgaccccctgtaccccaggggccaggctctgggagtcagaggagctggcatccagccctggctccactgggctgtccacctcctgccccgcccagcacggcccgctgggacctccttgcctggcccagctgctgcatggccatgggtgccactctgcctcacctgtgttttagttgacaggagtatttgtcacccttgtttttacacctgtcaccatcccacctgccgcatgtaaacactaccagcatcaacacggtaatgccggttcccctgggtgggcaccagccaagccctctgggagctgagaagagcaggtgatagcagctggagaggtcccaggggccagccttccctgaccctgccctcggggagacagggctgccgggctctgggccagctctgcccctggcttgctgatggccccacctcctactcacgggcctccatttcctctcggaagaccaggccactaaatcacagggaagcagggctgcacggggctggcgatgtgggctccggagtcaggcggctggcgttcaatcccagctctaccacctactggctgagggaccgtcagcaagtctcataacccatctgatcttcggtttgtctgagtataaaatgggggaaacgataatacttgtgaacatcaaatggagtaagcctcctggtaagtgctcgacagatactggctgctgtcatgatctcttggggcctctctttgacaccaggcccctgagtgcatgtgtgggtgtttgtctgtctatctgagtcccaaggctcacagcaaacactgaggcggccacagcctgggcttgctgtatccttctggactggttggctcagccagctctgacccctgaacccagaggtccctcctcgaccccaactctgacaaccttcctgccaccactgactttttgcaaagactcataattctggatttcctacctgaggtggtggctgtggccgaaaggcccattctcacccatgagaaggtctcctgagaatgagccgcacctctgcaggtggaggccttgccatccagccctgggatgtgctgcatgggacggtctgcccagggccttccaagtggggcacgtgccaccgctctgtgagatgagatggctcagtgggacaaggctcacacatttaatagcatgggctcaccgagtcagaaagtggttccttctctctcagcttgtctgagagcctcaaaaagaaagtctcaggctggtgcttggaccttcataacacctctgaacctatctcctaggtcaacaaagagagcaaggcctcaagcccagagccttctacaggcaggggatccagagaatttagcatcctattctgctctcattgtagttattcttatgggtgttttctatttaaaatactttatacaagttcttcacttatcatagggatatgatgtttataaggtaaaaagatgtgtctaggaaaaatagtaagtattactcattcggtgatgcaggactttggcagaacttatgaagatattagggtatgatgcttgggaaagaatgctcttgtccagcagctcttaaacattttggtttatactcctaaaaattatcaaggaccccagtaagcattttgtttatgtaggttatatctatcaatttttattgtattagaaattaaaattaaggaaaatttaaaatatatatttatttgaaaataactataagtccattacacattaatataaataaaatttttatggaaaagtactgtatttttcaaaaatattttagtaaggagaatgtcattgttttacatttttgcaaatgtctttcatgtccagcctgatagaaaatggctcggttctcacacgtctctgccttctctctgttgtgatgtgttgtttggttgaagaaaaatttggccccacacgaacagggaaggagtattttactagccttttcagataattattctttgaaactcccaggacttggcaaatggtagtttattaaaggagagttgcaatgtggaatctgaaagtatatcaatgacccttctttttttactttttttgagacggtatctgtctcgcccaggctggagtgcagtggcacgatgacaactcactccagcctcaacctctgggctcaagcaatcctcccacctcagcctccccagtagctgggactacaagtacacaccactcccagggggccaccatgcctggctaattttttttaatttttatagagacggggtctcactgtgttgcctgtgctggtcaatgaccctttcctgttctgttacattaaaattcactggcctaccttgcactttgaatggatctcttactatgaatgatttttaacaccattttggtcatttggaaaatattggttcatgagttacacagatctgaatgttgacacatttcagcatattatatcaaaaactcacatttgttaatatcaacactgatctttgagaaaagctttaggtattgggaagttaccaagtttacagtggtaaacacaagtcttccacaattctgcattttcacttgaaagccagaattttataattttggtaacaaatatgtcagtggttttctttgaaatcgtggctcactggttcatttttgggagaacttctgccagagaccccagtctgaaatcctactgcttgccgctcaggcttttcaaggaaaagcagtgtcccatgaaggaagggatgagtccggcttgcaactcagcctttccccagtacagccgccacccttacatttgcagcacgtgttttgtgcttacttcccatgtcatcatctcacagaattctcagacgggtactcgagtggagttttttataagtcgtaatttttacttcttcaccaacgacattcttcagtccagccagcatttgctttcttggcatgcatggtggtagggagtgcaatggcagctctgcagcccggcgccgagtccagcgccggcgcctggcttctggctaaggagaccacgattgtatctgctgctgctacttttgcaccatccgtgcaaatgttaacactgttaggaaggcaagtgacatcttagttttgttatgaaaatagttttgatttcatggacccccttgaaaggatctcagagacccctcggggtccactgaccaccctttgagaaccgctgatctagccaatcccttccttatgcactagggacactaagaccccacaaggagaagagacttgcccagggtcccaaagccagtcagaggcagagtgacctgaagcccaaagctctgagatcctggaagcaacgtgatctgcaccttttctaacaaaacagtatgtgcccactctgatgaatggcacaggagccagtgtccccggggaaaggatgaggaggcaagagggatgaaccagcctggggataggcaccagttggccaaccctgtcaacttcaggacttgcctattcccaccctgcaccttatgtgtagcgctgcatcttccatcttttctcttccatagctgtgttgctaatgtctcccagccgaggcggctgtaattaaactattcaccatcgtcacttcgtgttctgaagagatgaggtcggccattatcatttttccttccctttgactgagctctgtgtgggtaatttcattctgccttgttcatttcttagaaattttgtctatccaattttagttcttttttcctcttagaacactgggctcaggggaaaggaggtggaggatgagggcatcatggatttggaaatttctgtcccattcaccttaaagcttttttgggacaggatagtgcctgcttggtggtgcagctatccagagagcccccatccaggagagatacccaggaggtgtagaacaggggtctggacccactgaggggagaagggcaccaagacaaagaggcaccacgtaaggctgtcccagaggggcagtggttggagctttggacagacagcgtccccacccctttcctggtggtcagaagccttgctgacataaaaacccccctgcctctgggggcccaggacaggcttctgttgctaatgaaagtgagcaggggccaggcacagtggatcacacctgtaatcccagcactttgagaggccaaggcgggcagatcacgaggtcaggagttcgagaccagcctggccaagagaccagcctggccaacatggagaaaccccatctctactaaaaatacaaaaattagccgggcatggtggcgggcacctgtaatcccagctactcgggaggctgaggcaggagaattgcttgaacccgggaggcggaggttgcagtaggccaaagatcttgccactgcactccagcctgggcaacaaagtgagactctgactcaaaaaaaaaaagagtgagcagggcctccatcctgcgtttcctctccccggcgtgccctgccaggcctccactagctcccctagggcccccatgcccactctacacagatgctggcagggctgacagctcccctgctcctgcaggaagaggccaggagcccacgccacacagaaaacgtgaatgtcccaggccccaacacatggaaggcctggcatttcctctgccaggctctatggggaagcattttctctccatcagggctgccccaggatggacactggcctgcccaccaggggtagggcaccccctcataggcatgaccagcaacctggccgagaggctgtctgtgcttgagcccctgagccatctgtgtgcccacaggtggctgtcctaagtttaaccttctagggctgcatgaccccactgctgtcctcaggccctgctgatggctgccagagcatctggtgcctccaggacccactcttgcccgtcaaggccctcagtgttgcctgggtctcgcctcacctctctttaattccctcctcacctcccgagaagccccatgtctcccaccatccacaaacctgttcctcctgaggcccagaccctgcctccctggggtggcctccccactccccagctggtgctgatggatctgacgcccctagtggactgcaggcacgggcagggcagggtccagttcctgctggcagttctgtccccagcactcagccctgggcttcacacagagacgtcctccaatctgtggggaaggaagattcttaggtctcgccctggctcctgcttaactgtggccagggccaggagtgggaaactgcaccagccactgacaggtggtttctgggtgaaaactttcaggtgtgcgggaaccagtgacagggcctcagaggacttgggccacagtcgccttcccaccccctggcccctggttctggaaggaacatagtaagcagtttctgtctaggaaaaacctgcttctcagtcattggaagatccctgagttctgaggctgaaaaggaaagaaagttaggatcaaaaaacccaagccttctttactccacaggagacatcctgggtccaggcagggaaggttctcagaaaggcttaggacaaatcctggggcatccagaaggtttgaactgctttctgaacccaggtggggacttcaggaacgccttgcttaacacagtcacagacccctgacacagaagggaccatgggacagaggcagggaaaacctcaggggctgctctccctccaccccgatgtgttcaaggcaccaactactgagctggggagattccctttgtcaaatgttaaagtccttaaggcccagaccccactcagtgtctgccacctagcaggtgtaaatggatacatagtagatgggtgaatggatgagtggatcaaggagagaatgaatgggtgggaggcgagttggatcaaacaggagtggatgagtaactaagggatagatagatgccagggaagagtggaggggatggtggtgggttggaagggatgtgagtggatggatgaactggggtggctgatgggtagatgatgtatagatgggtaggtgcacaaggtttgataggtaggtatcctgggtaggtggtgcaggatgtgtggctggctggctggagaagggatgatgggtggatttgaaagaagagagtgggaggatcatcatcctaaatggagaaggaaagcaagattagagatggcactgaatccttggttctgctgcaggatctttttgaggaaccaggaaggttcccttccctaaagcaatggtgagcccatgaggtcccctacctcctcaagagaccctgtgagctgaggacgttctgtaggcgcaggccttgctcagaatcctaagcccaagcgaggaaagagccccagccgccaaatgcctgcagcaccccagttgttgccactaccaaagactggtcacaaatgtctaacgtgcgcccggggtggcaatttggtaccacttccactgagagtcacaggcagagagccatctgccagcccaaggccaggaaagcagacccccgccccggaagggagtgctccccactgttctgacgcccagctgcagagagggaggggcggggggctctctcctgtgccggagagaacggagagaacgtgacggtgtttcctcagatgtgcaggcctgggtgggagcgctagttactaagtacccagaattcttcgccagctggaattgtagtggccaggctgggcccccccagcggctggggtctctctgccccttcgcgttgaagagcaagtcggcagcccaaggaaggcgcgatggccgccgggcccggccctgcaatgcctggtctctggctcggcgggtccagctcacgctccctctcccattggcctgtgcactcctgccccctggtgggtacagggacaactacagtacatggggcagggtggggccagatggaggtttttccctgcaactggaggactgggtttgtgtgtgtgtgtgcgtgcgcgtgcatgtctgcagactcacacttcacttggcctaaaagattagagatggaggaaagctctgaatgatccaaagcagctcctcaaatggaaggggttattattataattactatgattattgttatcaagattatcatgcttgcctagaaagtcttgtacaaagcaggcttattttgtgtcagcttgttgtttgtgtctgaggcatttcatctttgcttataataactaacattggcaggcttctttcatgttgcaaagctgtgtcacatcctcaccccgttttatctgcacaaacagccctgtgcagtggggagtagtgagagaacagaggctcagaggttcagtgttctgtccaaggtcacatggctaaaaagatgcagaagccaggatttgaacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgaggtcttctatccttttcgctcaggttctcttggtcaccaccaccacccctggggtgtggcacaggacagacaggcatctgctacatctctgagaagcgcggaagaaggtgctatgacaggagaagctggtgcagggggactgtctgtgtcctggtgggtaggagctgggtacacagggggcagggccctgactgggctctgggagcctacgcccctccttggagcatgggttctatctccagggaccagctggctgactggagagagctttctggaagcagcacccctacctgctgcgcaccatgggctgttatactgattgtcaccagggtgctgcttccccagcacactcgtgaccagccgccagcagcacatgtcctcgtggcaggacacagggcctgtgtgccaggataagggaccccctgtgtaatgccagttccggagcatcactaccctaccacctcccaggcatcctgctccccagcaacagcccaaagcaacccacttctggggggtacctgtaccatgctccccacccctctcaatgctggaatgtcccctgggccctgtctccacaggcctcttcctctccttgcccacccctttctccagctgctgacaggtgccatgcaaaggtttacatagggggttctctggagccttgagcttccccaaaagtgcctcatctccactgtggcagctttgagccatttatttgtcaacattaagagtgagatatcatttaaccagaaagattgtactggttactatgataaaaatatgttcatgctgtctttaaatcattgatgtggaaaagagtcctgtaggtggccttgagaaatgacaacctctcctggcctcctgatcctaaacccataagaatggcatctcgcttactgttagcattcagaaatatacagtcccagccatgccccatagaagagtcccatcctcctcccgtgtgcccaatcatcatgagggtgggcgggttgctcttatctctatgtggcagccctgggcagcctatgacgtggagccgtgtatactcgtccactgggtggacagcagcgcagcccacccctcagggccatccctgtgctaagtgccctccgtttgctcacacaacagccttgcagagaaaatgatggtgctgtcatccccattttgcaggtgagaacactgagcctcagaaagatgataccccttgctcaagctggaagctaaagctggagctcaggtctgggtagctcctgaatttacagtctgaagcccgcagaaagctgcatggagcagcactaaaagtccaaggagggagtgagcaaaggaagctggcagaggaggctcctcgaagggtgtggggtggcaagagaatcagatgttggattccatggtgggttccagcaggtgcggaatgatgaggtgggggcattctgggcccttaatgattacaaaacccatcccacctgcacctatacatccgaggaaatgcagtcaggttttccctcacacacacagcagagagccccctcccttcctctctgtagctgggccttagaaccactgtaactgggacagtggtgggaagagggacccactccttcatgcctcaggcagacatgcatgtccatgaactccttacaggactgcctgctactgaatcccccagactgcctttagtgtgcagcatgtatgtggccagtgctcacaacacagctagtgccataccagtcccatgggagagagaggggccacccacacaggaaacaccacacggcatgtgggcactgtgcacggggtgtggtcagatagtaagagaggagcgggctcagaagccaggaaagccagtggcgctgcaggaatgggagggggtcttcctgcaggaggtaggccacacattagccttggccgactagggggcataataggactatttggggtacaagtgcaaaaataaaccaaccaaacaaacaaacaacatatcctccaatggatttttaaaagcaggggattgattgactcaagtaactagaaagcccagaggtctctgtggctgcaggcgcagctggatccaggcgttgacatattatgactcaggtgcctccctctcagctctgctttcctcagtgttggctgcacactcagagggggcctccctttgagagcctctctttcctaatagctgctacaagtgtcctggggctggctgggactagagactgattgttagtctcatttgacaaatagggattctttgtccaccccagactcttcacaggccagtgagatgggttggccaagcccagagcatgtgtccacccctagaatcaggggagatttagctcaacgcagaccactcagactgggctggagaagggtgcttcacttctgggaactggggctctgctgccgtaaaacaagagaaaaaagccacaaaggcagagagggcagctgcccaggagaacaggactgggcagagaggagcgggcaggccttcactgccacctggtagcggtcactgctgtctctcctgcagaactgcctgggcgggagcacgcagtgagttttctaaagaagtcagctctagccgtctgccccgcgtaaaatactcacaggccagacctggtatcttcatccattcaggctaccatagcagaataccataagctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacatgcatgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcctggcccttctatcttatgcatctcccttccctctgcttgggggctgggctgggtacccgttagttctcagcttgggcctcaggtggccaggccttgtctgagatgtgaagtccagagctgctggctgtggcacaagaggaggtcgactttgagtccaggctctccttactggcgatgtgatctttagcaagctccctcgcctaagcaggatacccacctgccgtaatcattaaatgagacacaaactgacaagagctggaggatagataggattgagtgagaaactggggccaagcctcatattaaaatgccaaggatccatacatcctgcagacgtggctgagcaccaactctctaccaagcacggtgtgaggcccaggtaccatgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacccagcttatttggggaacaggagtaaggctgtatggctggagccccgtgagagggggcaagttggaggatgtcaggacagagaggcagtcaggggctttgtaggccccaaggagtctggaatgcgggaatgatgggcagctgttgaaaggaagagctatacccattatgattaagtttaactgaataccagaaactctggaaattatgccttaaataagatagaaattgatttaagtattaagaaaacacacactgaagatagtgtgaggatgacttcagatagtgtggagtctgatccttgacctaggctgtttttggatcactattccactatccctagggtgttgaccttgtcttcatgatcccatttagttgctagagctccagccatcacatccaagttccaggcattaggaaagagggaatgagagaaaaagggtgccccttacctttaaaacaacctttcctgaggccttacttcacttcagcttacctttctttgtgcagaatttgtcacatggtcacaactagctgtaagcaaaaaaaaaaaaaaaatccagccttttagttggatatcagtgtgcccaaccaaaaatttctggattctttttgtaaagaagaaggggagaattgatgttaataggaaactaatggtctccttctgtgtggggagcaggctgaagaggagaaggaccgaggcagggagcccatgggagggaaccatggaggcctggacttagaagtcggggaggagatgaggaggagcagacagctgaaagcagatctgaaagaagaactgcagggcactgggcatgggaaggactcagtgaaatcaagcaggtctcctggtctttgaatttgagcagttgagccaatgtggaagacaggagagagcgggaagggcggggggccagggggtgttgctgccagcacaggacccctccccgtcccacaacaggaaggcctagacccctgggctatctgctggagaatcccaggaaatcatttatcccagatgtccccaaactgtagaatgcatcctactggagtgggacccattaaattccaggccacacatggaagctcaaacatgggagcacagtagctttgtggcctcggtttgtaaatcacaccgtcttgagtgtcctcctacaaagcctgttgtggctccagggcccccacattagcgtgtgatcctcaggtccagggaaggtcttgcctcgcaggcgtccccaaccctgctctcaggtcctgacttgttctgactcaggtgctccacagatctacagaaaccatgaaggtagggcccaaagaaggaagagttggaaaactcttgccaggtccaccacccgcattcctcagatgggaaagtaccccaagattgcccgaggtcagccaggcgtgaggagcaggatcgctgcaggtccctgactcataggccttgcactgtttttagccccaggtggaggcgccacccctgctcacccacctgctgctgccctgagtcatccctgcctgcctggggcacccaaagcccaggccccagggctggctttccaggtcactgctgccaggggggcccggacagccttcatgcccagtgagggcgaagtcagaccccacgggctgggttgttggcgatactgacccttggatgctgggtcaggtcagcatggggacttggccttccagcctctgcaccattgtagcttccttcccaggacaggcaatgggaggggcacagcttccagaactttctcactgcccttctgcagtggacaggctctgacatgtaaatagcactttagctggacagctcaattctggaagagctttggcctcacacttcttttgtacagacctttcgttggcgacaaaacttccagatgctgacctcattttctttgtgtctctcccatccccaaggatgcctgcagactttcagtacctcccactcacttctagagccacgtgccatgggctgggcagtcagtctctctcctccggcctaatcagagggttgggagttgaaggggtttgcggcagaaaaattatctaataataatactgcatgcagctgggcgctgtggctcacgcctgtaatcccaacactttgggaggccaaggcgggtggatcacctgaggttgggagttcgagaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccgtgaaatcggggagatggtaggcctggtgtatgcgactctcagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgcttctttctggtagctttattctgagagtcttcttcatgggttgggggacgcttgtctcagtgatactagcgactctggggccacattctcctaagcttcccactttgaaaaatcccagggaaagactacaggtggcccagcatggtcacatgctcaccagccacctcctccactcatcgaccctcttccttgccttggcatcccacacctggttcccagggcctggcatggactggaagctggcctgggctccacaggactcagggtccagcacactcctgtcctggccctgtgttcccagccatgcctcttcctgtcgctgggacatctcgcagtgccactctgctggtgcacaccctgaggcgtggtgccccaggcgggcagtagtcactaggcaggggtgttctcaggacctgctaggattcagccaggaatagaggggccactcggatggtggttaccttgcattttggttaggagagtggtctgagcaaagtcctgtcagccacagagacatgtgaagagcaagaagacagggtatgtctggtgcctgggctgagacaggggcttgctgtcctcaagacagcttctagaggtttaggttcctttagaagcttatctgagaaaaggatttgggtgagacaaggagtttatttgggaggtcatttcaggaagcaccgaggaagtggggaagccacacaggaagggagggaagccatgaaggggagctcatgggtggcctgccacgttggctgctggggctccatcccatggggatcctgtctgaatgtgtagcttgtctcagaattgcctccctgggagggcaaggaagccgggttatttgcccattcctgtctgtccggggcaccgactcaaactgcagccagctatacacctgaggcagtgagctccatgggcagaggcaggagggcggcccggggcagcacctgctctgctctcacctactctgcgttggacattaaaggctgtggctgcctcagacggagcacatatcttcctgggcaaggccacttcagctgtggtctagacccctctaccaggccctgtcagccgtccagggagctctcggcacaggtgggtctgatcatagaggctgggcctggagtccgaaggcacctcatcttgagtcccacccctgccactcaccatcgggttgttaagtgagtgccttcctctctgtggccctcaatttccccactatgaagtggagatggtaatactacagcaactgctgtattagctgtgccacagcaatgctgtctactgagcctctcctaaacccagccacttagttctgcagatcagagacccagggcaggctccactctgtaccaggctccccgagtcctcttcccaggatgaatgacagagcccgggcgtattcatggcgatggcagggcccacgaggaccagcagaaacacggcctctcaaggagctggcacagtgccactgctgcaccattctgtgggccacggcgagtcctgtgccatactcaacatcaagcagacaggacatatactcagcctttagcaggaggagctgaagaggcgcagggcaaagggtgtgggcagaggaggggtgaaaggcccaacgacacagctcttgccactcgctcctgaggtgggggaggttctgaggacggagtgtgttcaccaaatcctttgtacgctaagtactactcccgtgtgcaaggtggcggtgacggtgcagtcctgggatgtctgcaggagccttcttatcttcaaagaccaccacactcctggttgtgatgttacatgcatgtgattgtagtctttgaaaaggcgaccccactttggtatccaggatgaggggaaggggaagaaacctgttaattatgcagtactttttctgtaatttcaagaaggctcagcctacacgtgtgcaccttaagcaaattcatctacacccactcagacaaggaggaagggaggaggcagaggaggagagtgctccaagctcattacctgtcctttcccatttccatgtttcacctgacctaggagcttcccctgcccccagagaaaggtaggccccaggtcacaaacaaatcaagaaaaattaataaaatggacttttggctttgagcagtccaagggccaaagttcttgagatttagtgttggcatgagatatttttgccatctgcactaacttggcaaccagcccctcccctcccccagtcctgaggcacagccccgctgtggcccatccctcagctaaccggaattctctaccgaaacgtctgctcctctacatagcccagttctagggactgcattccaccctgtgtaagaagtatagaaaattacagctcagccaagaacattgatttttttctcccccgaacaaaataaccgagttttcaggatgaaagcagagctgctggttgagttggagggtggagagcagagccaggcccactctgccttcctgctggttgagttggagagtggagaacagagccgggcccactctcccttcctgccccagaaaactctggggccccatgggctgcagcttggagctcctgctttaggacatccatgtggtagaaggccccacgggccccaggaaccccaactgtgcatgctcaggtcgtggccctccctggagcaggctgtgggctgagctgcggtcctgctgcactggctgggctctcatcacagtccccgctaggggagagcccttggctggcagaggtcttctgtccccaccaaagcgtcaaagcccaccatccacctctcctcacaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagtgagtgtcccagcgggcgcatggcctggagccgggcagtgatgcgggagtggaagggactggtgatggggattggcagagcaaggaggattctcggctgaggtcacgcctgccgggagatgttctcccataggtagagggtgtcaggaaggaatgagaaggggcctctcttcctgcaccccaggaggagaaagaggccagaggaggcagaggacgcaagagacaaccaaacagtggaaattcccagagggccgggaccttgtcactggcttgtcctggagagtgcctggcactgcaaaaagacagctttcaagtgtagcagctttgtttttttatagggagcccctgaccgcataaatacaaaccaaaacaacagccatataggcagaaaagaaatggtgccattttgttttattttagaaaaaataataagctttccattccccatctttaaaattaagaataaggaatatgtaagtctaattaatataataaatgtatactttaatactatttataactaaataagggggatgacaggagggcaggaggacggaaggaagaaaggaaggggagagagggagaaagaagaggacagaagagaagacggagaggtgggaagtggtaaaagctggagctggttagaaggtgctcccggctcttcccatcacagcaggtcacaggtccactggctgcagctttatcactctaggcatctccaaggacatcctcactgcttccgtgcccttggcctctagattggaggctccagagccctgggatggtcagcgttggtcagggacatgtcttctgtcatggagatactgggattgcccccttggctttcgggaaatgcaccccacctttgcaattgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacggcccccacaacaaagagttacgtggccccaaacatccatagtgccaagattaagaaaccctgatctacgcaatgccaatggacagaggctgaggccaatgttcactcctggacatttccacgggccacatggcagccaacagactagggacttgagcaaggccgggagcggcttcccatttctgcacacctagattgtccagagggcaaatgccgaagtcctgtgagtcccaggtgatgactacctaggcccccgggcctgatgagctcccagggacaccctggtggtcagggcagtgagcccagaagctcagtgtccaccattccgtatgcacaaatcacagaccagagctaggcaggagagagtgactttcagctgccctcctcccttcttccactccctgtccctgccctggagtccagggcctcctccccgagggccagcaagaccctcaagggcctttagggccagctggcccaaatctgtcttctagtggctcagcaaattctgctctccacttacatttttacccatttcactaattataacatgaatccattaccaaaaaaaaattaaacaaatgcagagggatgtaaaatgagaagtaatcttcctactccccccaccagccctgcccctcccacttttacccacttccatttatttgtcccagtggcatccagaaaaacttgatcctctgactcaaaatagtatttactgccacccactctggaatcgagggagctcagctcaccttccttccttccatcgctctccaccttcacctccggctttttgctagttacaggattatttttagttcttccggtgcttacctttataactttaaataagaaacttgagtcagtatttgtcaactccccaccaagtaagctgaggaaattctcctccctgcagcctcatctctgccttctttcaaattttccacttcccaggttgatgatgttaccattctcttctgtcactgtggctgggccttccgtgtctcccctctgggagagggcaggaaagacaggggacacacaggtggccagggccggaagggcctggcacatttcctgtcttagcagttagacctcagcttctgacaaagtcttgggcccagtatagaaagcagatcagagtaggtttgttgtgctggaaaggagagggaggactcacagggctgccacagcacgtgcttccagggggtgccattgacaccctaatgccccaaccaccaaagcacttctctgcccagccctttacaggggagggaccagggcacaggctcctgagcaggctcttggtgcaccccggcctctgtgaacagggctggctctcccttctggataactacctagaggcaggtcccagaaaccctgggcacatccaaccaggggctgtgaaaggtgctctggggcctggttggcattggctttcctcaaatccagttccccactgagttgtccatgctggcgtccgacgtttcctctcctcaccttctctcttgaccccactcctatcgagctcttgctcctccgcctgctgagatggctcatagcccagtcctatcctgggggctgctccatcagcctcctcccactcagggttcagggttcagtcccctagtacctggtacctcctttcactcccagcccccgcctcctctcgggccgccctttccagactccctcgatgcctcctgcccacccacccaggcaactggtgatgggggaggtctgctgggggctgctgtatcccgtccccaagctccatcccagaagcacctcctctcaaggcctggtgcctggtgaccttctcctgtctcgttttaaacaccttgtacacttggacaactctcaaattcatatcgccagcccagccctccctcctgacttctgcctactcagtgcctgtttggacatcaaatgagtctcaagttaacatgagcccgtggaacccctggctcccatcctcccactagaagctgctctgtgtgctcctccctccctctaaatgtgtctcattccaccacgtggaggtatctctacttctgctcgtcctcctgtatcccacaccgaggccaccagcagatgcagctcccctggcaggtacatcagattctgaccactcacaccctccacagccacccccactgtgccagtgccatctggtgacgacagcagctctgcaggccccacccgctgacctgctctcatggcagcaacagggccgttgtcaacatgcttctggccagaaccctcgaggggctcccatctcactcagagcaaaagctcaagccctgacaatgacctcaagggcctgcttgccccagccggactctggccaccctcacctccaccaccttccccagcctcacccaccacctggcccctccacgtgtgcttcctgccgccatgcctgccagtgtttccactgggccactcgaggcccacttgctccctcattcccctcagtctcccctatccagacgccttccccaaccaccctgcatcaaatagcagcccccagcagctctcccccatcactaatagcctgattcgttctctcacactacctcctgacatatcatctctctgactcttctgtttaccacctcacacacgtgtgcacactcacttggaacacaggccctgggaaggtggggctgtgtcgactgccccatccccagctcctggaacagtggctaggtgggatggacagcaggtgcacagtcagccttcccgactgggttgttaagcagttctcccacaccttgcccaccctccacagccgtctccttgcatgaggctcggccagcacagagaggccagagggccaggttgcccatctaaaggaggtttgccctggctgggaaaggaagagcaggaccaaacgcttccaggctggtgtccagctgcagatgacagcagagggcgtcctcacagcttggaagcagaggtcatgggcgccagggcggggcaggcacagaggcttgggagaggctccttctggctgagaccagagcctgcccagatgccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcgtggggtctggagccagtcagaactgggctggaatcccagccaagtgcattttctttttttcttttttttttttttctccccgagacagagtcttgctctgtcacccaggctggagtacagtggcacgatctcaactcactgcaacctccgcctcctgggttgaagcgattctcctgcctcagcctcctgagtgctgggattataggcacctgccaccaggcccagctaatttttgcatttttagtagagatggggtttcaccatgttggccaggatggtctcaaaatcctgacctcatgatccgcccaccttggcctcccaaagtgctgggattacaggcgtgagccaccgcacccggctgccaagttcattttctcgcagtgtgacttcaagcttacctccctgagccttggaagccacccttctgttttcttttcttaggggcattctcacaaggattgtcactgggttctatcagtgaacaccctagctggcgaagtcatctgccctttccagccctgtggacatccatgagctggtcagcatgcccatctctcatgcagtggtaactgcaggtccagccagcaagctggcccccagcaggtcctggagcagatgcagcctgggaccccacatcgttctgtggttcagacacttggggctcctccctgtgggctgcttgtggtttgccccggcagcagggatgggtggcctggcaggctccatggatcactgagtcttccttcaggcctggcccagctccccacttcctgatttcccagatcctaccctggctttaggttcaaacttaacccacaatgaaccccaaagcccttgcaggcagcgtcctctgagtgcttggcctgaggcctgggcaggtgacttgcaaaagcctggtctgtccccacagcaggaggtagcaggggtaaagagccctgattccaaagaccgggtcccagggaggcccagccgctgtatggctgtgcagccctgagcctccaagagcatcaaattggaaggggcacacagaccccttggtaagtgagaaggaagtgtggagaaggcagggaactgctcaggggccgctgaagccccagacagtaataaaattatggcctctggagccaagggtccgggtcacagcctcaggcaaggtacttaccttcgatgagccccagttttagtacatttaactcagggaaattacacatgaaacatggttacacatgcaaagaatagaacctatctgttggccattattatcttttaaatgaaaaaatgacaaaacagtattataataaacatggtagtctcatataaaagcttgatcttgtctgagtgtcccgggagctgcatgcgtagcccttttggctgtgaatgagtgcgtgaggccaagacccctaagacccacttcctcagtcgcccccactccctatggcctggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggctggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggaggagccaagagtggggctgggtaagcccaagctacctctgtgagaccctgaggacccaagtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtggggaagagaggccagcagagaaggggagggcagggacccctgctgggagagctggattctaatattccctgcctcccatgtccccaactcctgcccgctcctgttcagactgaggggccgaggctctgggcccaggaacccctaggcctccgcagatctggggagcaaaaccttgggcagagcagccctgaggggcctctcttgccttcccaggctccttggtctctcctgctcccccactgggagcacaggatggggatctcagctcaacccagcccagcaaggcggggtctgagaataagcattctggaggggccacagaggccatctgccaacgcccctgcatttcagatggggaggtgggatccaggggaggatcccctgattgatggaatgagaaccagacccattccttgctctgagcccacactaatctctgcctgcagtcactccgttgtgtccggtgggaccagagatccttccctgtccccctctggcaggctgtgtgtcagcaggcatcccagatctaggaggctacaggactcctcgctctggggattggggtgggagactgaccttttacttccaggacgtaagtcccacctgcccacagtctcttccagaatttttgtgccccctcgggagtagagtctgagagggggaagaggccaggctctgatctgccagaaaggggccgtactgggcagaggtgagagcgccagctttgtccacagccagacccagctccaccacagctggactctcgccagcttgggcatgtcctaagcccatgggtggctcacttctgccatccacataacaggtgacatctcctgcctgcctccctcccaggctggtttggagtttgcccagagcaaacccaggaaggaatagactgagaggagggtcctcatgcgaggaggactctcagaggcacttcctgggggtggctcaggtgcgccctcttagtaaaatgctcctcagatgcaagggcaggtctttgagtcatgatctgtgagcacagccagtcccaggacagactccaggggtagtgcctggggatggcagtgatccagctgtctgtcatcacctggagtgacaaggtcttctagtgagggcttttagcaaggctctgagcaccatggcccccatcctctgcctctcagcgtgctcacagcttaatccccaggcagccctcacctgcctggaccctgcgcctaccagctccctgcctcctacaggctgtttgacgtcggaggccagcgatctgaacgcaagaagtggatccattgcttcgaggacgtcacggccatcattttctgtgtcgcgctcagcggctatgaccaggtgctccacgaagacgaaaccacggtgagtggcctgggccccccgggcagggggcagcgctgaggagacggccgcaggataggccagccctctgagcactgggcctcgggtgcccacaatggctctggggtccagccagctgttgtggttagaggtttccatcatggacaggccgtgccggcactccaccaattctgtattgccaaggcaaatgcctcatgatgccagtgtggcagagcctgtgtatgcaacctgatcacacagagccgtgcagaatgtgcctcttccataaacttggtggagtcacagaggccatcaggccatagcaaatttaagcaaaccctaaaaaaaccaggaggcagccaagcaagaatgtacaggcaacagaaatagcagtcttagcctgacagccatccctggggcactggcgtcagatgctgctgaagcagcatggggccggggatgctgagggagaggtggggagggcccaggatgctgcaggagagttgcgtggggttgggggtgctggggagcagtgtgtggggctgatgggccaggaagggcaatggggatgaggcatgctggtgagtgacagtcgtggctctgggctcctttgccaaatgccagaccaggctcctaccttctgtcttgcgtcacattcagcctagggcctcagtgaggggacattcccctgggagagtgcagccttcctctgggtctagtcctggctctgctactcactggcttgctgctgaatttaggcagcaccctttctggctcagttactattttccataaaagggagataataatagtacctgcctgtggggggctgttggcagtggggtgggtgatgcgtgtgcagcgctctggagctgtttctgggacagcagcgccaagctggtggttgtacagttgctggtgattgccctgagcctgcaggtccactgcgtggtccccttctgggctgcagcccgccaggcaccgagcatggcccacagggtcactggagacaagccccaacactcctgacagcggggcccataggctatggggtcacagcctggcgtctgtcatctccttctgtctggaacacatgcaaatcccccaccccacgcctctgaaggctggcaccgagggtttgaggttggaggtggggcttgttgtcatgctgggccttgagcgaggcctgtcctctctctgggtctgtttcctcgtcatttctggcccagctggtccactgggctttgtgaggatgggatcaactttggggtgtgggctacggggcacagtgctatagggaggaggagccgccgccctgaggggcttacacagagtgatggggctttgggctggtggtgtgggtagtctggacccgttccgtgtacaggcttacccacctgactcttcctatttcaggcccacctgtacccctgacttgggtttctgctgtaattgttctcaatggcatctgcaggcagtgatgtcagtcaccagcccagtcttgatgctgagtggggcaagggtggatgcgcttcctgggccgtgcttggacccagactcactgaccacccaaagcccaggtcagcttcctggccatgtgcccctcacagtgactacccagacatttcccactccccactgctagactctatgctattacggccactgctccaactcctggggtctgagctccacttggctcatcttttttcccccatgtccaccacggtttcaaagagagcaaaggagctagaagcaggaagccaggagggcccttccccctggaatccagcctctccctggacctgccctgccaggcctgtggatggcttcaacccaagtcccaggcccaccggccatggggctgggctctcgctcacctctggaagatggaagcaagggacgtctgggtgagcctagcagccacaggccctgagctctgcagcccatgggtccccagtgagcatgagcctggtgctgggcctggcactgggtgaccttccagcctgcgggccttgctgcctggagcacttgccctccggtcttctccaccttctctcacctccctttttccccatttcccccacccttccacacaagggctggagcagaggaccttggagaagccaaagcaaatggagccaaggtcacaggcaggctcttcctgtgtccttccttccccaaggctggccacctttgcagcccggggaagagtagcagctcgtgcagggaatggggatgactttgcaacctgacagcagccacaaaggcagctcattgccgtggtggcagcaagaacaatactggcgctgtagaactaagcagtcatcgccgtgcgctgggggcgcatgcagaggtggacagcttgggagtcagacagatctggtccagggtctagcatcacccctgccgcctgtgtgatcatgggcaaccgccccaccctgcccgggcctgcacctcctcctctgtagatggtgacaatggtagaatggaccaccgggctaaaagctgtaaaagtgcctgtacacaggaatcatcactcagtgaatagctcctgtggctacaacattcagatgccatggctagaggtcaggttctaggatgtgggagctctgtctgcctcagggaggcaagagccaggccccaggaactcaggccttggtcctcagccatcctctctggtcagcgctgtgcatccctctctggcctggggtgagagcctgcaacaaaggtgtctggaagcagcttctggagccaggccaggagagccctggggctagtggctgccactggccatccagccgccctgtccgctgcatcccgggagcccgagagcctggtcctggcctcgtacctgctctcagcaccgcccagccgggcctgcggctgccacagcttctccactaccacggtcgcctccactgcctgcagggccttatcttgccaaaccaaggccaaaaccagttctgagagaccctccaagcccggaaggtatgaagcacctccctccaactgaatccatcagctaagagttgaaagcagcaggttctcagggcaccgctgggtgactttgctgtgatgcctgcccagcccgcccctgcgcccacactcctctccagccacttggcctgggctcatcccacccatcctgcatctcttgccctgcaatccacaggcccaggatggccatggcccctgtgagcccgcaccgggctctctgcaggagctagccaggatgccctggccctgagactggttgaaccaatttttcagtatttttctctctttctcttgttgggtttttatcttctctgttttcatctgttttgctgtgtttcatcttggggttcctctggcccctctactgagaaaccagccccaacaaccagttctcccagagcctcccccgctccagcccaccaacgagaccaccaaccacaccaaggccacagcaagctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcgttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattggccgcggtgggtcagggccctggatgctgccgcccctcactcacccctccactctgttgcagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggtagagacccctccagggacagcaggcccccgagggagcgggccccgttcccaaagcccagtccacccttcctgtgctctgtggatgcccctgactctgccacagagaatccacacaaacggtcccccaccctgcccccagattgtgctctagagaggaggggcagctagccggggcttcctcatcagggaaagccggtagagccctggctctgccacttacgagctgtgtgaccatggcggcctctgggagcctgagctccactgtctgcgcacaggggctctctgtgacgagacgagcaaacgccgagaagatgaggggcggggcacagaggcttggagttaggcagcccaaggtttatgccccagctccgccactcacaagcagctcaggcaggtcatgcagcctctctgaacctcagtctctgggtctgtgagatggggtgatggctgtgattgccctcgcctccctcaccaggtgctatgaagagggaatgagctgatgggcacgcagagcttcgcgtggtgccgcacataggaagcgctccctgcctgtctgctcttgcctttagggttatgcctgtaactcacacggggctgctgcaagactcaaatcacagagctttgcaagcagcagagccctggccccctatatagggtgctggggatgagaggccagccctgccagtgctgtggtgggtttacctgaccatggggtgggcgggcagccaggagggcagcatgaccagggcccctgaggagctgcaggttggcagctctggtcagtgacaccagagcggttacagggccccagcatagctcgggtgcccatcagctcttctgagatggccagaccctgtccagagaagtgagtgggaggagaagtggggcaccctcagcccgacctgccctgaggccttggagggcacagagcaggggcagacagagtcccagtggggcatcccgggggcttggggccaggcaagcagcacagctctcctacctcctgcctccgcccatccccccatatcaggctgagtgcctggcaggccaggacccaggcatgtccagctggagttgagtagggctcagcctccctggaagctcccagccagcttcctctctagccatagttgagggcctgtggatcctgccctagtgacccgggcttgtggcctgtggggcagtggaaacaggtggggtcggtcagttaccaaggccagtgtgggcctggagtggggaaggaggaggggacaagggaggctgagtagtcagctgcagtcctaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcctagactctcctctccctgagcctacctgagaaccagctcagtgtgttgccccctgaggaaggcagcatgtgagccaggcggttgttaatcccctgtgagtggacagcagaaacaagaagtttataggcttcttctcccatctggcccagcagtggccacaggaggtgatatcaaggcctgctctgtggactcccaaaggaaaaggcccacccacagggtgtgcatcgaccagggctacctgcatgagcccagtgccctcaaacttccttgctcatgacccatgataagatataacatttgccttaggagtccataaatggctgggcatggtggctcacacctgtaatcccagcactttgggaggccgaggagggtgggtcgcctgaggtcaggagttcgagaacagcctggccaacatggcgaaaacccatctctactaaaaatgcaaaaattagtggggcgtggcagcacgcacctataatcccagctacttgagaatcacttgaacctgggagtcggaggttgcggtgagctgagatcacaccactgcactccagcctgggcgacagaacaagactccatctccaaaaaaaaaaacaaacaaaaaagaaaaacaaaaagaggagtccataaatgcatgtataaaaggaaaatggaagtttcacaaaacgtgctccttttaatacaggtgattggccgggcacaatggctcacgcctataatcccagcactttgggaggctgagatgagaggatcacttgagcttaggaattcaggaccagcctggccaacatagtgagatcccatctgtattaaaaataataataataataataataagccaggtgtggtttccagctactcaggaggctgagaagagagtattagtcacttgagcccaggaggtagaggctgcagtgagccctgatcgtaccaccacactccagcttgagcaacagagcaagaccctatctcaaaaaaaaaaaaaaaagataaatacaagtgatatactgggagacctgatattttgtatctttcatgacttttacactggatctgtcccactgactggatccaggaccccctattaactttgctgacccctcaggtcccctccatcaggttttccctgtgcagttgtctctgagaggcccaaggccggatggccacacaggccaggctggggtcgtccatgccaagcagtcccatgggcctctcgcctcaccacaccttgcctgtttgctctgcaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttcctagcgtgagtgtgatgtgttgtcagggcccagggagctcctgccaggtgcacttgcacgatgtgtgtcctcgggccctgccccatcctggtcccaggactgctggcagcctggcagagtgggcacactcctgctggggacagaggatcagggcgactgggcgccctgcccccctgtcaggatcgccatctggtgggaagttgctccgttctgcgccgagccaccttcctgtcctggagagcttggtggccacctggacactgctgtgggtgacgtggcagtggccatggttgcgctggcactgcttcctgctgctcctgggcctccactgcagcctggggcaggtggaggtctagggggttggctgtcagccatctatgatctctgacttctttctcttttctcaaatggtggtatctcttctttgaatgtaccccggcgtctgcttcctctggggagcttgtaaggatgagctgtgctctcagctccttggcaatgggttccaggcagcgtgccgagggagggcagtcaggcctggggggctggcaggggtctcagtgccggcgcctcccctgccctgcaggatctcccctcctcactgccctccccgagtctccaggatcagccgccttttggggctccctccaaggccctctccccataaaaccaggtttggttatgcctgtcctctgctccccaagtcctcccctgcactgccactcctgggaccacagactgtgatcatctttctccagctggactctgagctctcggagagcaggagcctgatgtggtcattcttacatcctcggggcagcccagcagagagccctgcacacagatgccaggcagtactgactggaggagcgagtgtggtgtgagtcgtgctctgtggccctgagatgtaggggctgtggcgggggctcagccttaaccagtggaactgtggagcctaaatgagccggacttgatttctcctccacacctaagctcagtggccaagggggcacagtccccactcccagctcaggtcactctagtggctgctcctggcagtgcctgggaagatgtgcagtggaggagggagcttggctctggctgtgggtttccagctctctgttaggcagctgcaggccaaggtggctctgtggagtggggagcatgttcctgtggaatccttggggtctcagagcctcaccactctggcctcataatgtggctcaatgagcttgagtgtggacagcccgaggccctggacacaggttcactgggcctcccagaagcctccggctgcccttttctgaacagatcccagtgaggtggctcagggcaagcgagacctgctcctccccggagggatcacacagatgacagggaaatgctcctggggaatcagaatgaaatttactgattgaggataggagagtgatgagatcatatgagtttactgaatctgtttagcagaatgaaagggcagtgccgtgtactacagctcctggggggtggggaataacgccatgccagctgtccaggtgcccctgagaggcagctgagaacgctgccctccgccgaccaacttcagctaataggaaccaggggctggggctggccgcctctacaggtcatggtagaatgatgtaggcacgggggagatactgaagggaggactggccgtaagacgcacggagcccgccatgctgctgttagtatcgattcctcgaaagccccacagcctgctgatatggactggagagacccattgcataagttctggatctggcccagctgtgtcaccgcggtgtcccctcaggccagatgaggttaagtgacatgggcagggagagcgctggcacagtgtgggcctcagtgactggtgtggtcacttcatcttcattgccctccttctgctcagaggggggcggtgtggcagtgggaccagcaattcctcagcacccacggtgtgctcacccctgggggaggaggtcatctccccgtagatgcccagtggcatctacaccagctgtcttctttttcttgttacttgtgtcactcttcttatttcagaggtagagtttagcctggttcacctctgggctttagatccagagagctgggtttacagtgagcaagttcccagggctaggacagggttcttggggaaaataagggaaactgtcccttcctcccactccctgtgcagaaatggattcgttcacagagaaagatgccctctgtgctgctgagagacagactctgcccaagtgaatgagctcagcgccccaaagcagagtttttgcccagggcaagaggctgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggcccggagtctctcaccactcccagagaacatccccctacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggagaccctcacatagctgggaactctgcagtggggagagcccgggtcaccctgtcctcagcctccccagagagccatggctggtgtccagtccagtctctgcctctggccccgacatgacgggttctccggaagcagggaatgagatgtgctgtgaggtgtaactgactcaggttccatctggcagcctctcggaggagctgccgagtagcccagtccctctctgtcaagcctaattctctccttctctttccctgtctctgtgtctccctcccgctgtctgtcctctctcctcccttcctgcggccgcagaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggtgggtgccaggcagtcctgtgcagggggaagcctgcccctgacagggacccatggctcagagaacaggctgctcggccagcactgctggggctagctggcgagcgggacccattgcaggagactggtggggcgcaaaagaaaaacagtgctgtgccaccaggtttgggcttcccaggacacagccctcagcgtggtggaaatggcccctcctaagatatatgtgttaggaccaagtgactcaggagtggtggggagcagggggcaggacaggatcacaggcttcccccttcctcctggtcaccctctagaagaggtctcaggacagcctcctgtaatctcagcagtggcctcccctcacccctgcccagagccccacagcacctttgcatgaaaccgaaaagtggacacgtggcctgtgaacagggcctggactgcctcttggccccacctgctttccctgctccctgctttggtgcccggaacatgcttcatctctgtgcagccgcccagccagaccactccacccatcccacatcgtgcctgccctccctccccaaccccagccccattgcgcctcctctctccccttcttccttcgtccctggtctttgccccaaatccaaccactccagctatctgcaagcctcctgtatcactgcctccctttcttctgccttctctggggctttcttcttgctctcaggggaatgtgtcacagaccttcccccccacccggctcaatgacgctctttccaaatggatggatgagggatggtggcttccgtggaatgggccaactctgggctactgctaatgcctaaaagcagcactgatgggatgccagagcccagccctggtccctctaggggctgggaagcttctaggggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtcagcttgttctgagcacaaaccgtgtcctcactgatggtccgtgctaatgtgaatttgcaaggttcttgcccttcccaaggtgcagagcaggaggtggggccaggaactgtgccctgcactcgaggctctccagcaaagtcccaatagggcagagagcccaggtagcctctggagccagaccacctgcagctcagcaagttgctcagtcatctgtgcctcattctaatctggtcaacacaatgggtaatcatgcccaccccaagggtgactggaaggacagctgcttggtgccaggtctactgaagtgctggctgtggctgccattggtattattcagaggatggaaactaggggagggggaactggccacggagaaggtgccctctgcaggatggagtgagggcaggagggcacaggacaagccctgaaaggccagccccaggtggcccttgggcagagccaggctgtagcccactctggcagccactcctgacctctcccagccacaacgatggagtccagtaggccccctcaggccagggctaccctcagagacaggcccaaccctacggctctttcttgcccagtgtcccactggggcctgacttgggagtggccagtctcactgctgtggagtgcaagcactagatgccccagcgaagggcagttggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcatggctgggtggcagcagggctgtgtgaggacgctgggctcggcagacacagcgaaggcacgaggcgctcctcccacctggacggcttcctgtggccaccttccaccctgggctgtgcccagttcggctctctccagacaggaagctcctgggcagggtccacacgggctgctttgtccaatccttaacagctgtgctgtgggcttggcatctctgcaccagtggatcaaggatgaggctttgcactgtgggtccaggcactcctgctgggctgcccagagctggtctcagccatgacaacccacccaaggctgtcccaaccccctgccccttgccccttgtacacccaaggaattggtggggacagagggcccccagttggcatcatacatgctgatgtccccttaaacttcccaccttggggacatcaatgccccaatgtcctggccactcgcttaagaaccacgcctactaatgatatgctgccagccctgccaagtggcctcttcttaaaggaaaccaatgaggaaggagtgcaggtccctctgagtgcccaccaccctcttgggcaggcccctctccagactttgttttcatggtttactggaatcagcaggattggtttagaccatggggcggtgcctcaatttgctcatctaggaagcaaaagcgttcatctgtggccactgctgtcccaggcggggcttccgggtggatctggtgtgaaaacagtaagagatcttgcaaagtccaaagccaggcaaatgctcagcctgtgtatggttggtgcaaaagtaattgcagtaattgcagttttgctatcaaaagtaatggcaaggccaggcgtggtggctcacgtctgtaatcccagcactttgggaggccgaggcaggtggatcacctgaggtcaggagttcgagaccaacctggccaacatggtgaaaccccgtctctactaaaaatacaaaaattagctgggcgtggtggcacgcgcctgtattaccagctactcaggaggctgaggcaggagaatcgcttgaacctgggaggcagaggttgcagtgagctgagatcgtgccattgcactccagcctgggcaataagagcaaaactctgtctcaaaaaaatagttctttaatttaaaatgcaactatggcttggaactgcccagcagttcctactgctcccttcctgtctcatcccacttcctgggacacgccacaacccacttcttgtcttcatgtccccagccctgtccacccacagcgctcatcagggcctctccccgttcttctgtgtcttgttacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaagaggaggcaaaaagacaaaacacacaaaaaattaaaaaaaaaaacttaaaaaaaaaaggaaaaaagaaaaaaaagcccacgggtctttgtaagcctttctattcccaatcggtgaggtttctgtgatatcttacacactgccagtctacttctctgactaatggaaaattcctgtgtagctcaataaaagagaatgtttgtctgtactcctgagtctcaccctgtgccttccaacgatggttatttggggtgggcttcattctggcaggagagggaaggagggactcggccacacacgctggtaggccggtggttaggagtcccccacaggaccttcccatcccctcagtgccgtcactggagccccagctcagagcacagttgacgcgaccactgcccagtgctgcctgggaatgagggcaggggagccgccactttctcctgcgatgccctctcctcccggctcccggtgcctcctcaccctcagtaggttttgtttgcttttgagaaatgaggtggaagtggggattaggaaggaagaaatgcaagaagggcaggcaagccccctctcctatcatgcaggatcctctttcttctgtagccggcggttcccccacagtgggaggatgggtggtcccaagaatgaggccaattgcctgagcccatctgcacccaagagttcccagccactcacatgcccaggacgagcttgggcccagcctgaccaggaaggctgccttcgatttgctccctgactgcacctggatgccaggaagccccctgcaggccgaacacgcaggaggtaacccagcagtgcagtggggcacacggagtctgatccctgttcctcccctagactgtaggtctcacccgtcccctacattggcccgcttttgctgtaataattagcaaatgggttgcaacggggacctggaggcaacggcagcccactgaacttgcatcatgtccacacgccacttcctgtacaagcggccaagagcatcatgtatcatgctgtcttcagtgagatgggggagctgccaagaggtcagttacctggaatcctctccacatctcaacaaatgggaattagaggctcagaagggcctctctcgggcaagttccagcagtcttttgaatcaagggggtggaggcaggggatattgtttcagagactatggaagaacaagaggcactgtgataaatacccaaccaatacaggcaccccttaaacctcttctgctttccccctggttccccaaaccccaacttatctgcagagaggggcacatgacctaccctctccattgaggggaaggtttgcaatccaggccacagtttgactttgtaacaaaccaagatccacatggaaggctgaaggaaaccatgacattttctatatatggcacatttgaatttttctgaaaaccaagccatattctaatagggttcttcccaactttcaaatgagttttgcaataaaaccaacagaagtttatttgcctcatttttcttagaagggaggtcatagcattttttggaaaggatgcagcaaaaaggccaattaaatcggaacaaggagagtgggggcagaacctatctgatatatatatttttaaagatcctttttcccccctagtttatctgtgcacacaattgtaaaaagctagttctaattagaaccaaatcaaataggagatttacttccaatggcacctaaatagcttctaaaagaaattctgagaaaattgcctctattcaggaggtaaacaaaaggtatccatcatcaccacctgtggaatccctccaggtctttgatctctgccctgaaactctactgagaaagtctcagagtcgctgtgaacctcttctggctctgggggctgccagattcctgaaccattctttgcccagttagaccacccaatgaagaggggctccaaaatgcacttttgttgcctagctggcagttgcttaaggcaataagacaggtaattaaaagagtaattctctaaaggggggaaatgcacacaaaactactgagattataaaaatgcagatccaaccctttttttttttctaaaccaggactaataaccgacactgatgttggaatgctaacatccagagaatgatccgagcaatattccggctgagatcagatcagatctgaaaccagttaaaatcctttaaacgctcaatccgcctgcttcggatcccaggcaagatttaaaaaaaaaaaaaaaaaaaagtggtcctttcactgctacagccaattccattcccagagaattagttcctttggtttgatattcatgtgacttttgatgtttggggataaggctttgccacttaggagagtatctttggttaaaaagactcaaaagccagaaatatcagctgtttgtcccagctaaaattgggtaatatgagatttcaaaggattttaagagctctacggttagaagtcagcttaattaaaaactgatattcaggatatatgtttatcttggtaaggccttcctgctttttctcttttgggatcctgtttttggtaattttttttctagttgactggaaccccctctctaaaaaaaaatgatgtgcttgtttcctctgtgcacttcagttcctaaaaatcatcctcccgcttacttcctctcttccctctttcttctctgccatcttggctaccacatgaaaagacctagaggggacctctaatgactcagagctcttaaggaaaatagaaaaggcaccacagactcctctcttggggagaaatctgtgtttcccccacagaactggaaccccaagagttgcaagtggacagatacctctcaagtcaactctgccctcttttgtatttcatgactggatctccttggtcccagagactgctctgtcctgcgctgtgagagcctgaccttgcgtgtgtgatggctgccagaggcggctcactgcagttgtttacagtaaatgactctatctaaaagctccacaagtgattctaacatgcagccaaggttggaaccatgtctaacctaacagatgagcagcagccctgcaagatggaggctccaaatgacggagggccttcgagggcaggcaggcggccgctgctccttgccagggcttgtcggcaaggccatggcttccttttccatgtgtgtccagctccagcaggactgaaagtccccacagacaggatcaagttggctggctacagataaaaggacacattgtctacttagcccaagtggaaaatcaggcccaagaggccgcctgggcacctggattcacatcaatacaagtgaaacagccacatggcccaccatcctctatggtacagaagagcctcaaaattcaaaacaaaacaaaaactgaggagaacctaggaagtcaaaacagggccactaagaaaatggagagggcaacacagcctcattccaaaagagcccacagaggccaggggcagcccaaccaccattcaccagagcacccggatgctccttctgctgcgcttacaaacctggacccacagccctgagtgctgcttctccaggggctgggcgtgaggaccatctgcctgaccctgcagctggcagggcagcaaaagtggtcctgggaggggaagcccccagcataactgccactgccctcagcacctgtcccggacgcccccaggaagtggtgaaatcctcaagtatccaggtgtaaaatggaagggcggactgagaacttcacttcttgcatcattttaagctacttaataagctcctgctctaaacactgtgatatggctgttttgtaatgtgtcaagaccctctaaaattgatccaagtaattttctcttttcacacatcagaaacctgtgaacatgtggaattagtggcacctacaatgggtgcaacgtgtgaagtataatgtaattcgaggacagtaaaataatctttcgctacacacttacctgaaaaaaaaaaagatataaatacaaggggaagaaaaatgtagttctgccttccccaaatacactactaggaaaaacaaaagttcccaattcaaaaacatgggaaaaaaccctccaaccaaaatagtatacacaaaatccaaatcaaaatggggtttaacgttggcacctctggaaaaagatgccttagcttccagccacacaaaaacatgccttagcttccagccacacacaacacaccaatagagtttgctttttattattattattgttttacaataaaaacaaatagctatgctctcagcaaaacaaattaaaaaaaaaaatcacagaaatttactaacagcatttcaaggtaaggcttttgaaagatttattgaaataaattatctttgcctaaaaatttacctatcacctttttcaattacttttcaacattctaaaaactttccgttatgtaaaatacatttaaactttgccaataattgtggataatactggattcttcccaaaaggactaccacaaaacaaagctttcaaagagtaaaaaaaaaaaaaaaaaaaaaaaaaaaaaaagtaatccaatggggcataaaactgaggtctgtaacctatgacttcatggttcaaatccttaaagttaaacatgtgaagaatttgaagagatttgggacctgggccctctccaaggcaggtaggttcacaccttaccttctctgctgaattaaaccaggaataacacagctaggaaaacgcagtgctcccaggataaaagatacaaaagttcttttttatttctttaataaagcccttcaaggtttactctcccatcttgcaaggcccacatcttgttcaaggaccaaacccacaggctttagcactgcctaatttacttcaccaatgaatgaaaaccataaaccaaagcttgctgcctaaccactccccaggtccagacgggacaaggaaatgctgagaggggaggggacccatggggcacactcatgagatgcaggagcaccagagttcacggaaatcaagccggctttggactggaggctcggaaagtcagtcccagatgtagtgggacagaaaggggtgacttcatcacaccctatagccctggactttcccctcctctgctccaggtatcgaaccaagagttccttttccaagatgccctgctggctcaggggtgcatgagcccgtgggtctggcctctggcacagtctacatgcttccacaacaacgacagcagtttgataacagatgttaccccacgacgtgggggcgggctcacactgtgcgcctcccccacactcttcccactgggtgtggtgctcaggacacctgcatttgtgggacgtacgcatgaggcaggagtagaagctgcctgctgcaggcaggcgactgctcacttcctcctgatcgtcccccaccccaagcagtccagtcaacaccagaagagatcatacctacagttaaaatttgcagtgtttctaaggggaagagaaatgtcacatagaaagtattacaaagaaggattaaatttatcagctgtccaaacactataagaccacatgctttatacagcggcaatgcagtcaagcccgcttttccatggagcgggcagaattgggacaggcctcctccagtcagtcgggcacagggcgcaggaggcagctgaggaaggcaagggagcgctaggaggtctgctgcttctgaagcctccgttccgcggcggcagccagcatccttcgacgcagggtcacggggtcagaggacgcaccttccgaggggaggaagctctctgaggccgcatcatcttcagaacttttgttcaagaaacgtctagaaaaaacagaagactttttctctctcataggagagatggggagctgtggaacacagccagaaggttgatttcacatctccccatgtccaggcaccttcatgaagctgtcactcagcaccacccaatgaccaagacatccagcccccaacagatgggcgcaaattctctctgcaccagggaggaacccttcagtgctgttccctgctgtctcttcctgcccatcccctccacccacagacacagcacagaactcccacaatcacagggtctgccagggcccaaacccacttgaggaacacagtgctggccctgtccttaagagctggaacaaaaccccctctatccacaggacacacctgctgtagctgccaccaaccatgggtgtgtgacgcacagatgcgctgagtgtgtgtacaatgctcagctgaaaggcagagtggtcaacagggaggacctgggagacagacgccagggccaggccagtgctaacctctccagcctccatttcttcagctgtatgtcagctgaatgggttaacagtgctccctcttagagctgttaaagtaattcatataaagggcttagatcaggttagcacacaagtgctctctcggcaagcgtggccaaaggggtccatgggagatgactgacagtaccagcatcagaggtagaccagtggggcccagtgttaccagatgctctggttttttcaagagaggcttgaaatctgagttttggggtggcatgtaatgccgtttcactgttggcatctgtttaaaaagagaagacggcctgacaacggccttcagccactagtttttgatctggattatgccaggtggtctggagaagcgactcacttgcgagcttgctggaggagttcgtccttacgctgcaccagcatgcgctgtctctcatcagcagacttggagaagcggctcccacgagcctcgaagtcttccacctcactgggctccacttccacctcgccgaagtccagcgtctcctccaggcgaggactgaggtccagtggcacacgctcggtctggacacggggcaggaagcaaggaggcagctgtgagcacaggcctccctcctaagcaggttcctcacctacagggcaccccagacacggctgttctggacgcaaagagaaggctgctgccaagcagggaggcagaaactaggaaccacaagctacggataatggagcagcagcttccctgagggcaggcctgctgcctatggcttgagtagtactaagaacaggacctgactcacacagaatgttcggcatcagagggtaagtaaatgattaccagcatgaaaaacgtaagcaccttcaagctgcactcttagaatacgctaccaacacgacaaccgtgagtttacatcctgggaattttctgttcacttctactaattgctcaaacatttaaaccagtcttatccaatcttctgcacaaattttatatcctcaattgactctgaaaacagaggtaaaaaggaaaactgctaggcatctatttatttatttatttacagacagggtctcactctgtcacccaggctggagtgcagtggcacaatctctgctcaccacagcctcaacctccccaggctcaggggatcctcccaacttagcctcccaagtagctgtgaccacaggctcgtgccaccacatctggctaatttttgtattttttgtagagacagggttttgctttgttgcccaggctggtctcaaactactggactcaagcaatctacccacctcagcctcccaaagtgctgggactacaggcatgagccactgtgcccagccctaaggatcttttgaaaagacacaggatggattatatggttccttggctttggttgaagctccaaagtccacgacaatgcccaggcacccccaggtcctagcaggtgcctgaccatctgcgctgctcatgctcccagatgcagacctgcgctggccagggtcagcccattgcccgcttctaggctgtgacagaatggaggtgggtgcagctgagaggcaggctgttttacttcagagttcctgctggacctaccctcactttttcctgccttcagctaagctcgagagggaacttcaagagaaccattcgtatccccgagagtcaaaggacgggggaactggtggctgcatacacttgagaaatctacagaaagaaactggcaggagccaataaaatacagggccaggggagctgtgacgggagcacgttcaccttccactgactccagacaacactgtgtgtgtcctggagcttggatagggctcctgcaggagggaaccaacctaaggttgttgaaaacaactgtgcccaaaaggaccacttggagaggtaacaggacccccatgaaggtgggagtggtcatcaatagccagcccagggtcaaaggaggagtttctggggccagatggggacagggagatagttggcataacatgtacacacacacacacagacacacgtagttggcacaacatgtaggtacatacacacacacgcacacacacgctggagtctcactgtcctattctatccctctcctctaagcctgaccctagagcaggttagaaaaaatggtgagtgaagaggcgagatgttagaaagaaaacagccgcccaccgcaacccctgctctgtgcagctgcatgcctgactaataccagcctgagcggggcagggcagagattagaacagagggagagtggagctgacaagcttactgggctacactgaggtttctgttaactaattgttattcaaggactttgtatttcttcacaaatgaccaaaaatgttgcacagcaaggttccctgtgaaatacatactttcctccattatatatacatatatatatataaaatccagaactcttcatgctaactctagaagcagcagtggaaaatcaagacagggactgaatatgctgtacccacagatgcccccaagcccacagcatccatatctcagctgcgccagctattcaaaaactggaggccgggcgcggtggctcacgcctgtaatcccagcactttgggaggcagaggcgggcggatcatgaggtcaggagatcgagaccatcctggctaacacagcgaaaccccgcctctactaaaaatacaaaaaattagccaggcgtggtggtgggcgcctgtagtcccagctactcgggaggctgaggcaggagaatggcgtgaacccgggaggcggagcttgcagtgagccgagatcgcaccactgcactccagcctgggtgacagagcgagactccgtctcaaaaaaaaaaaaaaaaaaaaaaaactggaaatgtagacatggaccccttagaagccatgcaccatttcacaaatgatgcataatccaattacataggtggatatgaaaatcttaacccagcaacagatttgaagaaggcctagtagtgtttactgtttcctctttgtagagaaaaacacaagaggtgaaagcttgtgtcatttaccagtgcttctagaggagaccttgtgcaccccagtaagggaaggcagcaccaccctagacccaagcctgtgtgcaggaaagccccacatggcacaaacacagaaaggccaaggtggggttgtccagtttttatttgtggtcgcataagaaagtgctctgacaatatggtaactgaggaagcgaatgggaaccacagaagaggagtgggatccagggccacaggtgtagggcagagggcacgggcagggggtggggggaggtggcacctcggccctgctgcttggagttagggtggccacctcaaggcacccaaagtgggtcaacaaacagatctggttctcaagaaagccatgttttccccccagccccactcagctcaggcggtctcagttttgcaaaatgcatggatgtatctggaaatcctgagtttgacaagtgaggtgtgggggagggcatctcaatggcctcggctccctggagagcttgccctaggccatccccatctgagtttagatgggtccaggcaccctcacggtcccgagcccagcttccttctgtccttccacgggctctcactcaggctcaaggtggcagggctggccccggggaacacaacccctttctcttccagcacatgagggcaatccccagggaatg

SEQ ID NO: 284 - DNA, 475577 bp, Homo sapiens
tccatcctgggtggcagagcgagactccgtctccaaaaaaaaaacaaacaaacaaacaaacaaaaaaaaacaaacaattatgtacattaaaacattgtatttttaggataatgcctcgtaactttgatgatcgttgtgtgttacctttgccaatgggttgaagcagtggcaaagaaaaggtgtaattacatctgttgatgttattgacatgcctcctaggatgttgaaatgtggtcattttacaagactgctgctcacttcatcactgctgcctggggcccagcctacctgggacttttccttggaagtgctttctgagttgggagcacattgttttgaatatgttccacttaggaaggttttttctctctcagaatgatttgatttttaaatttttatttatgttaaatggtaaaagaaaaagtcaagatgaaaaatatatctgttaacccatttatgcctagtggtccattattgggacactaaacatgtgagagttatttatatcccactgctcaaagtcctcaccaacgtctgattgcaaaaattcagaaagttgcaacctcaggcataaatggttaatagctttattgagatataattcacatacatttcacccattttaagtatataattcagtggcttttagtatattcatcaaattggacaactaccattattatcaattttagaacttttttttttttttaatgatagagacaaggtctcactatgtttcccaggttggtctcgaactcctgagctcaagtgatcctcccaccttggcctcccaaagtgttaggattacaagtgtgagccagtgtgcccaacctggaacattttcataccctacaaagaaacctcacactctggccgggcgtggtggctcatgcctgtaatcccagcactttgggaggctgaggtgagcagatcacctgaggtcgggagttcgagaccagcctgaccaacatggagaaaccccgtctctactaaaaatacaaaattagctgggaatggtggcgcatgcctgtaatcccagctacttgggaggctgaggcatgagaatcgcttgaacccaggaggtggaggttgcggtgagctgagtcacgccattgcactccagcccggacaataagagcaaaactccgtctcaaaaaaaagagaaacctcacactccttagcagtaatcccctgacttcccccatccctaggtaacctgatttacctagtcccaatagacttgcctattgcagacatgtggttctttgttccggacttatttgactagcataatgttttcagactccatccgtgttgtaccagtgatgtgtcagtgcttcgtctcttttattgccaaataatatcccagtatatggataaaggatattgaatttgtccattcatcagttgatggacatttatttgggttatttcctaatttttggctattatgaaatgctgctatgaacatctgtgtataagtttttatgtggacatatgctttcacttcttttgggtatataactaggagtagaattgatgggtcatatggtaactctatgtttaacattttgaggcactgccagactttttccaaactagctgcaccaatttatattctcaccagcagtgtatgagagttccagtttctccctattctctccaacgtttattattatctgacttcttgattatagccatcctagtgggtatgaagtagtatttcattgtggttttgatttgcatttttcttatggctagtgatgttaaatagctttcgtgtgactattggccatttgtatgtcccctagagaaatgtatattcagatcttttgcacagttttaaattggatattttttctttctgtcactgaaatctgtattagtgagggttctccagagggatggaaccaataggatatatgtggatataaaagggactttattagtgtattagttagggtaccctagagggatacaactaataggatatatatatgtggggggggggcggggagtttattaagtattaacttacatgatcacaaggtcccacaataggttgtctgcaagcctgaggagcaaggatagccagttggagtctcagaactgaagaacttggagtctgatgtttaagggcagaaagcatccagcacaggagaaggatgtaggctgggagcctaggccagtctcgccttttcatgtttttctgcctgctttatatttgctggcagctggttagattgtgcccaccagattaagggtggttctgccctccccagcccactgactcaaatgttaatctcctttggcaacaccctcacagacacacccaggatcaacactttgcatccttcaatccaatcaagttgacactcagtattaaccatcacaataagagagaattggctcacacgattataaagcaaagtcccacgataggccatctgcaagctggggaaggagagaagctgatagcatggctcagtccaagtctgaaagcctcaaaaccagggacgctgacagtgcagccctcagtctgaggccaaaggcccaggagcctctgggaagcaattggtgcaagtcccagagtccaaaggtggaaaaacctggagtctggtgtccaagggcagaaggagaggaagtcaagcattctgcacagcacaggaagaaagagagggagcagactcagcaagcacgctgcttatctccattcgtccacctgctgtgttctagcctcactggcagccaactcgatggtgcccacccacactgagggtgggtcttcctctcccactccactgactccaatgtcagtctctgtcagcaacaccctcacagacacacaggggaacaatgcttcatcagccatccaggtatctctcaatctagttgacacctaatattaaccatcacaaaatgtaagaattctttacattttcaacatttaagtccattatcagaaacataatttgcaaaattttcctcccattctgtgaattttattttaattaacctgatagtatctgatatggtttggctctctgtccccacccaaatctcatctcacattgtaatacctatgtgttgaggaaggatcctggtgggaggtgattggatcatgggggtggtttcccccacgctgttctggtgatggtgagttctcatgatagctggtggttttaaagtatggcactcctgccccaacccccttctgccaccttgtaaagaaggtgcttgcttctcctttaccttttgccatgattgtggttttctgaggcctccccagccatgtggaactgtgagtcaattaaacctcttttctttataaattactcagtctcaggtgtgaaaatggactactaagtgtcctttgaggcccaagttttaaattctgatgatgaccagtgtatctgtttttgttgttgctgctgcttgtgcttttggtgttatatccaagaaactattgcctatccaaagtcatgatgatttactacaattttttcttctaataatttacaagttttggctcttatacttagatctttgattcacttttagttaatttttgtatatggtgtgaggtagggatcccacattattcctttgcatgtgacaattcaattgttcagctccatttattgaagagattattctttccccattgaattatcttggtacccttctcaaaaattagttgactgtaaatgtgagggtgtatttatggattttaaattctattcaattgattcatgcatcttttttttttttttttttcttcttcgagacggagtcttgccctgttgcctaggctggagtgtggtggctcgatctcagctcactgcaagttccgcctctcaggttcatgccattctcctgcctcagcctcccaagtagctgggactacaggcgcccaccaccatgcctggctaatttttttttgtatttttagtagagacggggtttcgccgtgttagccagaatggtctcgatctcctgaccttgtgatctgcccaccttggcctcccaaagtgctgggattacaggcatgagccactgtgcccagcccgattcatgcctcttttttctttttcttttttttttgagatggagtcttactctgtcacccaggctggagtgcaatggtgccatctcagctcactgcaaccaccacctccttgtttcaagcaattctcatgcctcaccctcccgagtagcaggcattacaggtgcttgccaccacgcctggctgattttttgtatttttagtagagacggggtttcaccatgttggccaggctggtctcaaactcctgacctcagatgatccgcttaccttggcctcccaaagtgctggcattatagtcatgagccactgcgcccggcccatatgtctattctaatgccagcaccatattgtctttattattgtagctttgtagaaagttttgaaattaagaagtgtgagtccttcaactttgttcttctttttcaagtttgttttggctattatgggtccctacatttccatatgaattttaggatctacttgtcagtttctgcaaagaagcaaactggaattttgttcaggagtgtgttaaacctacagatttgggaactattgccattttaacagtattaaatcttctgactcatgaacacagatgtctttccatttgcttaggaaagacaggctggagtgcagtggtgcaatcacagctcactgcagcctctacctctcaggctcaagcagtccaacctctttaaccaccccacctcaaccactcttgtagctgtgactacaggcctgcaccacctcacctggctaacttttgtattttttgcagagataggggttcaccatggtgcccaggctggtctcgaactcctggactcaggcagtctgcccacctcgacctcccaaagtgctgggattacaggtgtgagccatcatgcttggttcttctttaattctttgtagttttcagagtataagttttgtatttcttttattaaatttacaatgctctttgttaaatttatttcaaaatatttaattttttatcctgttgtaaatggattttcttaatttattttggttcattactgctactgtatagaaatgcagtcgatttttatatattgatcttgtatcttccaaccttgctgcacttgtttattagttacagtgggtttttagtggattccttaggattttctatataagtgatcatatcatctgcaaatagagatgcttttagtgcttcctttttcatctgtaggcctttaatttcattttcttgctaattgccctggttagagcccctagtatattgttgaatagaagtggcaagagtgaatatccttgtcttgttcatcatattagggagaaagcattaaatctgccaccattaactgtgtttgctgtggatctttcttttaagtcctttattgagatgaagaaattctcttttgttcctaggttgttgtgtatgaagggacattgaatttcgtcaaatcctttctctatgtattgagatcattgtgtagttttgtcctttattgatgcagtgtggtaatttttggatgttaaatcaatcttgtgtccctggagtaaatctcacttggtcatagtatacaatcctttgtatgtgctgctggatttggcttgctggttttttgttggggacttttgcatctaaattcatgaaagatattggtctgtagtttctttttcttgtgatgcctttgtttggttttggtatcagagtaatagtgaccacatagaatgagttgtgaagtgtccccttgtcttctattttggaagagtttgtgaagaattggtattaactcttctttaaattaatctggccctgggcttttctttgtggggagtttttgttttgttttgtttttgttttttgagatggagtttcgctcttgttgtccaggctggagtgcaatggcacgatctcggctcaccccaacctccacctcccaggttcaagcgattctcctgcctcagcctcccaagtagctgggattatatgcatgtgctaccatgcccagctaattttgtatttttaatagagacagggtttctccacgttggtcaggctggtctcaaactcccaaactcaagtgatccacctgcctcagcctcccaaagtgctgggattacaagcatgagccactgcacccggcatgggaagttttaaagctactgattaaatttctttacttgttataggtgtatttagcttttctatttcttcttgagtcagttttgacagtttttctctagaaatttgctcatttaatctatattttttaattttctgacatacagttgatcatagtattcctttatggttttttaaatttctgtaaggctggtagtaaagcctctgtttcattcctgattttagtaatttgagtctctttttttcttggtttagctaaaagtttatgaattttaatctttttaaaggaccaacttttggtttcattgattttctttactgtcttcctattctctatttcattaattttaactcttgtcctattacttttaggagggcctcttaaggaggggtcgtatgctgacttaaattgagggttggtcaaagttcaaaagcctgggggaaggaagcttaatattttctctagatcagtaagtacaagcaattcagctaagaatttgcttcatttatgaagcaaagaatggtaattttcaggacagtctgtgtctgattttgttataagtaaatgggggaagggagataaacatctgtgagtcttatctaagtcacccggggaaggatggttctttataataagccatttcctggaacacgcaggcgatgggcaggggggttactacaaccttatagaaataaaatttctttaactctgcctatatttcagggtatagtcctcaggtaaagcttcacattgtcaagaagaacttgaaaataccttttttccataaaaacacaatgaaactaatactatgtaacggaatattccaaagcactagttcttataaataactattggccaaaatacaaataactgacccaattcaaaattctctaagatttcattaagatccttttgtagttcataagcctgatgcatgggtgttcacacgcatgtgtgagatgtgcctccctcaaaccttgttatggcgccagcccattaccggtctgtcatgaaaaaaaaaatatttcagtaaaagaggatacttctagtatcctttttaaaatttgaattggaagcaaatagtatttcatcccagcatgttaaaattgcaagggtcacctaccccagcttaccatttgctaaacacgcatcagtcaccagtggaacacacatttccaatgctaaaggtcttgactgcttggtgaaaaccactttgcaacactggtgttggaaattactttcttatattaagctgaaatctacctcattggaacctctgctcataagtcctgagtctcatgtagttcagaccttgtctcttctgccccatctggctacttatctccagtttctcctgccagtcttccggtggcatagccccaaaccctttcatttcatagtttgtcactgccctttttaagaggactggggtgctcagaacttattggctgaccctagctcttcctttggcctggtcactatatttgaaaagtgctacctgaaatcataagagcttttttgttttgtttttaacagccattttctattgttgattcattttagttttggttacaactgaaatatctgtctttcacatgaaatatagcttctcatttgcctttcttcacaaagtctgttctaactacacatttccttggcttcagcctcatgcttgatgcagaagtgaggagagtgcaataaaaatttgaacagttgcttggatttttgcaataatagattgtcagttggggtcatatgactctcaggtgctagaaaatactctgcctttcagaacgtaaccgtgggcacactgaatgcaactgtataaaaatgaatgtgaatttttaaaggtagcataattaaagtttgtacattttaacagtttatgtaaatctgtctcatagaatacatgtaattttctctgaggtggatgttgtgatacttgatcaatatttgtcacctacagtaaatgtaccattggtcttggaggtatttctgtgtgtgtttttagcccattctcatatatttcactcctcatcttccgaatgatcctgtggtacagacatgaccttcagtttcaggtagagaagctgactcgtggtgactaaatgtcatactaccaataagtactggagcctgaaatcaaacctggactcaatttcaatacacaggttcctactcttcagtggtgcttctcaggttgataggaaaacctctcacctttagaaaattatacaaaaataaacattgtggccggatgcggtggctcacgcctgtaatcccagcactttgggaggccaaggcgggtggatcacttgaggtcacgaggagtttgagaccagcctggccaacatggtgaaaccccatgtctactaaaaaaatacaaaaactagccaggtgtggtggcgggtgcctgtaatcccagatacttgggaaactgaggtaggagaatcacttgagccccggaggcaggggttgcagtgagctgagattgtgccactgcactccagcctgggcaacagagtgaaactccatcatcatctcaaaacaaaacaaaacaaaaaaaaattgtgtaggactcaggctagaacattgaaatatattcaaaacaacaccaataatgcatatcctctttatttggctttttaaaatcactgtttattccatttggtagagggttttatttttttccatacaaatatttgaacaattttgaattccccaaaaccatacatagacgataaataccatgctattaaagtattaaatttgtacaaaaatactttacagtttaatacttgtttgttacaaataaaaatacatatttaagtgactcatgatctttttttcttttttcttaacatgatcctgctttatactttcttgccctggcggttctgaaatgtgattgaaataatattttttttgcacaaaaagaaaggtgattttttttttatatttccttaaacaaaggacacagtgttcgaatactttgcctaagtggtagtttgaattattgaccaaaatgaaaatgtttggaaaataatcatttcaatatggagagtctaccatcaatatacagatctatttatttttttatgttcaccaaataataacagttattagtgtagctattcaaaatatctgaacaaatgaaaacagttgctgacaaacatttaaagcaactgtcacaatttattgctttgagggatggtaataattggcaatgcatttgtgaaaaatgtatttacaatttcggtaagtggcatggctcagagcaaaagatagtccagtgtcatttttaagtacatgtgctgtacaccctcaatattaccagttttcaaaacatgtcaagcagtatgagtttggtttgcctatcattaagatgaacctcattttaatagactcttcattctctgaagttcttagtcttgaattttaaaaataagataatataactaattctcatgtttactacacactctaattcattatcagagattttcagctattaaaaatgtgtccttaaaaaaaaaacaggtcacaagacatatcctgtttgataatttgttgcatagggaatagcatacatcttagttaaaatcattcctatacgtgggcaaaacatttaccaccacctattatggtctcctacgtgcatcattgctgaaacattttaagataacttaattttatacctgtacccctcccattgtggtagtcccagcagtttaccaaacactagttcccctagtagagccagcctatgagaagaaaagctttgttggccaagttcttacattaatgacttcatagtaagaaactgatttcaaagtgaattaaggaaatcatcacagagaatattttcaaacagatgtttctctttttaaaaagtgatagtaagatgaacttgtaaaaaatttcctctgatgttaattgtagagttgtgggggacggcctatttttctctaccgttgggactggcagggcattgcccaccatataccatagtggtcaccaaaaaagaaacctcttcaacttgaaaagggaagtgaacatgagccatgagagagatttaaaagacccctgtgcttgcagttaatgccacgttgattgattatctgtgcttcaaaggtcacagaaatcttaaaggatttttagcaccatgtagatattgtcttttgtcctgctttataaaaagcgttgctataatgtattagtgggttctcgtgtctccaaattaccaccgtggctaggctgctggaaaaaagcactgttctgttcactccaatctcctggtagactctgttggtctatagacttctgtgaagccagtgggtttctactaataaccaggtccagcttattcccggattctgctatgaggggcacaacaaggcagcagtcaaagtctctggttcggacatgattcacctgaaaggtcaagaacagccattttgaattatcgttgtaaccataattcccaaaacccggagtaacatttcaggtgcaacaagttgtttgaagtcatgaaggtgctaaaatgagcgccatgaggtctatccttgtgactatgctgtgacatggctactggctcaattgccattgtctgctagtaaattgtaagactctcgagggcaaggaagacatacacatcctacctatcctcatgccaaggaggtggctccacccacagtgggggtgctgcaagtgctgaatattatccctaatttacagatgagaaaagcaagccacaaagaggttaagagctttgccttagatcagtagttggtaagggtcataggatgtaatcccaggccaactggctgatctcaaagcctgtgctctgaatcacgatgctgaactacctctcccacaagcgagctccaccaggtgcagtggctcacacctgtcattgtggcacttgaggagaacaagatgggaggatcgcttgatgccaggagtttgagaccagcctgggcaacatagtgagaccctgtctctactaagaaaatttttttaaaaaaatgagcttatcccctcttcagcttatacatgcacccatcttcttccatttctccttcttcaccaacacaagtttttaaaatcacccacatgccggttctactccttgatcttccattctctcctcagttttttcaggtcctccctgacacattgcactgctggaaaatgaccctacttgtcaaatccaggaatgttctggagtttgcatcctccttggcgtttagcatttgccgctcgtgacacctcctcacccttaaaactctccttccttagttctacaaccccacttcgttttgatccttttaccattttaactgctcgctttcagtcctttcctgcctttatttcttcctgtcctttacatttggttattgtggccaggtgcagtggctcacacctgttatcgcagtactttgggaggctgaggtgggtggatcccctgaggtcaggagttcgagaccagcctgcccaaaatggtgaaactccatctctactagaaatacaaaattagccgggcatggtggtgggcgcctgtaatcccagctacttgggagctggctgaggcaggagaatcgcttgaacctgggaggcataggttgcagtgagccaagatcacgccactgcactccagcctggatgacaagagagaaactctgtctgaaataaataaatacatagatacattttgttactgttagaatccatccttggttctgttctcttctttgttataaggccaccaagggcaacttgtcctaaaccccacccttcagtatcctaaatctttaactctggctctaatatctctcctcaccaacagatccaaaccaccaaatgcttcccagactgctctatcacaatgtgctgaaaatattaaagactcattagttctgaaagagctgtcttatcttacctacccctacctggactccttgcctgtgatcttctcctccccaacccaccttcgataaacccataataatattgtattgcctttctatgttaccaattatatcattatcctgcttaagaaactaatatgcctccagcataaagttcaagagctttaccatcacattcaaggccctttataatctgaatgtagtctacttttacagcctcaactgcgatgagagtagagctagctctatttatggattaggaagacactcatagaaggtaagtaacttgtccatagttattcattcagcaaatattagcatgtctgcggaaaactaagtgtccccaaactcctaggataagactaattgttctattgccatagtaaaaatcatcaccagaattgattccaaaactatcaaattgatcagtgacaacttgcttcagcgaacacatccctgaaagccaaccaatgagtggcagcctcctgctttgaaagtcagctgtttggtgacaaactgtttccaggtgagtacactgctaagactgacttcaacccactccattttcctgcaaaatgctcttcccaaaaactgtacataagatcagaaatctgctttcctaaataaaactatacctgacctcaatgttactatatttaaagtaagcaaggttcagctttttggtttcagatattgtgagagatactgagatatcaaataccacataatgggaaatgagagaataaggtactatccctgctctcaaaaagtttacaatctgctggggagtatatgcagggaaacaggaaggtggtttttttttttttttttttggaaactcactctgcacccaggctggagtacagtggcatgatctcggctcactgcaacctctgaacaggcagttttaataatgtaaattctaccaaaagcaaaagctgctgttcgatataggaggggcccctagtccagacttgaggtaaaggaggttgggtggtgtctggtgaagttaggctttgaaggggagtcctctaaactagtggttttcaatttggctgctcactggaatcactgggggaggtgtaaaaacacaccgatgccgtatctgtctcctagagtcgctggtttaattggtctggcatttgattgaacattgggatacattctctaggtgattccattttttcaatcaaggttgagaatcgctgatctatgtgagaccaaaaagttgagtcggaatgaggcaggtaaggcctagggattagaagagcattcagagaaaggaaagagtatataaggctcagagccaatgcgcttctattctgctgtgcagtactgagcacttttatgtgacagcattgttcttggaactgagaatagagtggagaataaaatcgctgccctcatggagttacattctagtgggcaacacagaataagcaaataactagcatcatctgtggttgtactgcgaaccaagaaagaagggtgaagaatggagaggcaggaaaggcccttttagacggagtggtttaagtcgcagcatgtgagcagggacctgaagtagaggaaggagcagggaaagagcctgtgcatgtttagcagagaagcgccacaagctcagggcacagcaggtgcaaaggccaggaggtggcagcatacaccattcctgaaacaaatccagctgaagctagagagtatacgaagaggttgcgcacagtggctcacacctataatcccagcactttgggaggccgaggtgggtggatcacttgaggtcaggagtatgagaccagcctggccaacctggtgaaacacggtctctactaaaaatacaaaaattagccacgcatggtggtgtgcacctgtaatcccagctactcgggaggctgaggcaggagaatcacttgaatgcaggaggcagaggttgcagtgagttaagatcgtgccactgcactccagcctgagactctgtctcaaaaaaaaaaaaaaaaggaaaaaagattctaactaactttccatcaacttcaaaaggtccgtcatcaaccctccaattagttagcaaattgcattctggctgggtgtggtggaaggcacctgtaatcccagctacttgggaggccgaggcaggagaatctcttgaacctgcaaggtggcggttgcagtgaaccaagatcacgccactccactccagtgacagagcgagactctgtctcaaaaatgaatgaatgaatgaatgaagaggcaagacaagatgctggcaaggtaaggagaggccaaatccctggggccttgtaggtcatgtagaagacaagtggtaggaaggactagactggtggtgcctggagtcggataactacgtcatatttatgggactactgtgcgatggtgggagatgaccgtggttgggtgaaatctgtgagattgggaaagatggctctgagctcagtgccgaaaaaaactggtaagaaaccacagaactttggggtctgggttagaatttactagagctgaaaattctttattcagctgtttgcttctactgattccataatcttgatgacaaaggctgaaagggaaaagagcaaagggccccaaatatgcaggaggatgtggaggaagctcccagtgagaaattacttgcaaggaattaaaattccacctgaggtcttacctgtaagagcctgtcatagggctttaagccaccaagatctcctggcccagctgggcgaatatttttgacatacactcctttctccagtaagccatctgctacactgaacccaaagtcctccatgtcagagtccttgtacaaggtcacctgaagagagaaaatgggatgtgaatatttagctggggtggagacttttccttctgcaacttcttgatgaacaatcttttcacacgaatttagtcacatcatgatttgtaatatcagcatcagtcagctccctgcaccaatcctgcagcctttttttcccactccaagaatatctttggactttatgaattcccaaccaaagctgaaaaaggaggagaactggaacgtctgggtcctccctccctccttttcagtcgtcatcagggggatataggagagaacttcctcaaggcaagttgacttctactattttcctggggcaacctctggtcagaggagctgcccgcagcagccctttacaactgctgagatgttggggaataagccaaaggcctttccttcctccccactcctgcctggtgctctgctaagcacagtgctcggcgtatcctctctttgggcaagtaccatgaagttcatccttttatttgctctggaacccccaatgagcaccatcacagaacactatgtaaaagacctgaatgtgtctctatgacaacaccttgctctgcacctcggcttaactcgctccctcagcatttgtctagggtttgatttggtaactgaaggcatctaccctgagtgctgcggcctgccccccaccccgggtctctctgcatctaaggccaaccacagctggctaaagcctcactcctccaccagccctcactccttcacctgaccacctgcgagtgttcatctgaggctaaaataatcatttgtatattcatcaaatatttattgagttcctaccatattgtaagcacagcatggggtgctagaaacagcagtgaacaagaggaagaaaagcctgccttccagaggcacacacatgaatatgtagcagtccccaagctctcaccgcactgggcactgcgcccagcagcacactcagcgcttgatgctcagttaacgtttgagggggccacgggttttaccaagttgtgccagatgccctccacaaagacttcaagcaatggtcaggcttaattttctactgtaattatatatatatatttgtttttacacaactaatgcatgaatacattcttgtaaaatagtcaaaacaaaaacaaaaacaaaatcagagctatgcagggcaaaatgtgaaggttaaaactcttatagcaagtatctttgtttatatccagtgattttacttcagagggctatggcattctgaaggcaatatgaaagtggtcagtgtgtgggtttttattttactggacagacagctaaaatatcaagctgactgggtcaacactattcaccaaccagtcccagtggttattgccatattagaggtgaggaaattcaatttcactggggttatgtacccgctcaaggccacaaaggtaagaatggtggggacgtgtctgtgagactccagacaccaagtgcctaatggttctattctcctgccactaaacatgcacctctcggcctcaccactttcagtgtcctcctggacaggagccaccctcaggagccggtgaaaatgcagtctcagacccaccccagaccgactgagaatctgcagaactaatgttccctgagacgaccctcttcacacgctcattccatcattgtgtgtgcatgtgtgtgtgtgtgtgcacacacactggacactactatgcgtcagggactgttttagggactgaggatatttttcacaggatagagtgataaaaaaagtagagcagtgagcaaaacacaacctttatgaggacagcccagtgaagaaatctgatttaatccttataacgattccgtaagatgggtaagagtcttcattttaagaggtgacagatataaagttttctcagtctgccctcacttatacagggatagagtagtaagccccactttactacataaagggtgtgtggggttatgtgtgtgtgtagcctagtgacaccagcacccccacaccggccccaccacccaccgcccatctaacatgctcactggtgatgcttagggagaagtggttaggttcacactgtgtggttgagagcacccctaccttccaaagcaatactcaccagggggagaggggaagactttgctggtggcctgggcttaggtttgtggcagatccccactccccagctccttgaggggagtaggggtcctttttgctcatggatatatctcaagcccctaaggcagcacctgtcacatagtggggttagtattttgacggacagaaagggcttgtcctgcaccttatgaggctgaggatcaaccatgatgtcctgtgcctttatgaatcattgcagagaaagagagtgtgaactaagagagatttaattctggagttccagccatccccctcacccctcacccaaggccatgctgggaatcaggaaggctgtcccatgacaaagtggccaggcaagacaaagctccaaggtcgacactgtgtggacacgagagggagggcacttctggtaccagggccaggccggcctatctgtgggctgaggagacccagattcccggacagtgaggaaggtagggggagggtcctccaatgggggatgctagacttcttgctagtaaggcctgtggatgttgagtgagcagtttagaaagcaaagagatattactgtctctaccagcttgtggagcagatcatatacagacagggaaatgaaagctcaaagagaaatagcaacttgcccaggatcaaactgatggcaacagagaatcggctcaaatcaaggcttctgactgcaaagcttagatcttgccatagcacactctctccttgcctagcacacagttgtttaataaatactcattgcagagaggaatatttaggctgttccacaattatgtttttgccttaggccagataggagatttctgctcctctttcctaaggaaaggaagagtaagtcactggaagaaaatattcttggtgaaaatttcatacatattctagagtagagaggttggaacacccatctattcaccactcagatccaacaaccaccaagagcttgccatgtttccttcagctatccttctcttcttcgggggagtgttttcaagcaaacaccagtccgcatgtcatttcactcctacatacttcagtatacacctccaaaaaatatgatcactttctttcataaactccacatcattaattcactggcaacagcaactcttcttatgtgatagccaccacttcctagtccataatttccccaattgtctcaaaaatgattttttatttttattttatttttaattttttgagacaaggtcttgctctgtcacccaggcaggagtgcagtggcatgacctcggctcactgcaacttggctcactgcctcctgggttcaagcaattctcctatctcagccacctgagtatctgggattacaggcatgagccaccacatctagctaatttttctatttttaatagagacagggtttcgccatgttgaccaggctggtcttgaactcctgagctcaagtgatccgccagccttggcctcccaaagtgctgggattacaggtgtgagccactgtgcccggcctcaaaaacatttttttaagttggcttgcttaagtcagaatcccaacaaagtccacacactacctctgtgttaagtctgttaaatctcctcttacctgtggtgggttctcgtccttccccctgtgctgctgatctattgctgaaactgtgtcatttgctctgtagtatattcctctgtctcccacatttctctaaatggaagttaaatctagatgcttgatttcagtcgaggttagctttgaggtggggactgggggcaggaacagttcataggtggcacagtgcttcctatcacatcatgtctagctgtcctactttgggtgggttcaggtgatgacagcctcattcctctattgtaagggttctcatcaatctttaatctaaaggttttatttattgatcactgtctgaatcaaaatttcattaggggttgcaaagcgataatctttttctaatcctattaacatcttctgtatttattagcctaaatgattttgtaaaggagaattctcttttatcaattagtgctgctttgttactctgaaatacagcttttacaagaagggcagaatgaatgaatgctaattctttcctttcaatttcaaaacagggaatttgttcactaaatacttcgaatggtggcccaatgagaatttgtgtgtggggaaggtgggggatgggatcaatatgaacctataaattttgatatattcaatgcattttttgtttgtgttttgagattgagtctcactctgtgggccaggctggagtgcagtggcacaatctcggctcattgaaacctccacctcctgggttcaagcaattctcgtgcctcggcctcctgagttgctgagattacaggcacctgcccctacgcccggctaatgtttatatttttagtagagatagggttttgccacattggccaggctggtcttgaactcctgatctcaagtgatctgcacaccttggccttccaaaagtgctgggattacaggcgtaagccaccacgcccagcctattcaacgcatttcaatcagttgcattattattcttttggatgctcaaatgttctcatctttggccacaggaagtctttcctgtggactcctgtgtccttttgataggatccattggttttggtcgcttctttactttccggcacaaaatatgactcaccatgaatagttcttatccccgatctggaatcagctattcctccaaggagccttcactggagaaaatattgttgatttatattctattctagtcctttttctttcttttttgagacagggtctcactctgtcaccccgactggaatgcagtggcgcgatctcggctcactgcaacctccacctcccaggctcaggcgatttctcctgcctcagcctcccaaatagctgggattacaggcgcatgccactcctgcatggctaatttttgtagttttagcagagacagggtttcgccatgttggccaggatggtcttgaactcctaacctaaaatgagctcctgacctcctgccatggcctcctaaattgctgagattacaggcatgagccaccacacctggcctattctagtccttttccttctatctccatgctgctttctcaaagggatgaagaggagaaatagtgagagaagggaaaaaatgagaaggaggctagtagttattagaattggtaatagattgacattcttcagaccctgtttactagtgggtgaaatctctctgcccgaggttcctgcttatgtcccactctggctttatctgtgggatctcttgcctttttgccccttttctgtctttgttcttagccacgttttctccacatggcaagcaacacacctggggcagggaccgtcgccaccattcctagagggtggggcatcctccttgctatctccattccacttgcaactaggtacagaggtgcagtcctgcagactctgtgcctacggctagttgggaaagtgcatcagcttctgctctgcaggcctagccatatccttgaggtgcacccacatgtgagggtgctaaatcttaagctttcaatgggagctaggaaactcactttggtcttagatctgaggcatgttttccaacatagtaaaccagaatccttgcatttgaggaaacatttggtgtgggcctggaataatagtgaagttcttcatgactctattggcctgtgattcttgggtgtctgcaccacaggccagaacccaggaggggcacaaggaagagtggcacctaaaactaacaacaccacccaatggtagtacaccaaccaaagcattagagatgagtgccaaccacagtgggttagcagagtagctcattaacttcaaggtcacagttattggcaaagagccttggtttttctgagcctcagagttgaagagttgatggaaaactcttcaggatgagaggctaataaatagtttaaatctaaaagtaatctatttctccagagatatctcccaaggttaaaggatactgaatttcaatagccagctatatggttctcctggaagtagcctagtaatggcaaattaacaaaaataaaattattttaaaactacataaaagataagagtctagaaatcaataattaacaaaaatggggagcacagggggctgttctcaaaccagtagcaatgaattgtgccatatacccctgtttacctggatattggtagtggttaccttggatttacttcctgtgcaaaaataattctaaggattctgaggtttaagttcatacttccccctacccctggaaatgaatcttttatccagttactttcttacatatgattgcttttgatcttacaacacctctgggcagcaaaatcattgcctttccaagaatgaggatactgaaccttgaaaaagttgatggactgacttgtccagttagaatgcagaagcaccaggattcaagactagaatatctgacctcgtttgctgtgttctttccaccaaatcatgatttttttttttttcgacatgtaatctcctagctggtcaggcagcctttattcatttccaactgcccaaccaactaaagatgaataattaatcatgcccactgggtttcttctcatcagagccctttgtggctttccaagaacatctgcataaagtcctgctccatgctcctatggctcaccaacctgtcagttggctttgcattctaccctagcctgtgtaaagcaaaatttttcttgtagggtctgtcttttgtgctgactagaggatgcccccggagaacctggaccatgaacacagttgcaaggtttttctgttctaaaagagccagtgagcttctcggaacataacactcagggctaggatacagttctacaaagctcagttcaattttaactatttgtcagcatgtgctacaattgcttctaaccctcctgagaacagaagctttcacaggaggcagggtgggttcaccatgattcacattcaaccttgttttatatttctaagcaagtctaccgacatgtttgaagaacatcctcaaggccaagatcagaaacccgatgcttatgttttcagttttgacacatgtgaaaggctttaactgcagagccaactctccccacttggattttaagggcaattgcatctgctgtcttgagcaagtcatggcaattgacagccatcccagaagcagtcctcaagctctgacagctccctatggctcactcccttgtcccaatggccttgagaaccaaactgacacctacttctcagaaacagttttcccataaatcaccaggcattttggtttactcatgacagataccactggggtagccccattcctttaactctgacaatttaagtaatgccagttttgaggacaatcctatactacctatggtgctggaagaaaacgaaatagaatacagtcttctaaactggaagcctacagcccaagaagaagcaatctcagtttatactactagaaactcaggggttttgagaggaattgggtcagaaggcagctgctgccttcctgtctggggagtcttcttggctgaggagagaaaggaagagctgctccaaatgccacctcctgcttcattctggcaacagtgtggcaccaagagctggaaaaaatgagggctcaacaatgagagaatcagtagctgggattttggctgtaagtataagcaagccaggggctaccctggcccttggggagctgagtcccaaccaaaaaagttacacagtttttaagatctgtggcagacttaggtgctgcctttctcattcatcccagagcaccttcacacatctactggttcacatagtaacaaaaacgaaagagctagatcattctccaaattctccaagagatcaaaccaagctgcaagcaagcagctagtcccctagttattgccagctccattgctggtcttttgcacttgccccagccaccaccaagctggctggctgtggcggagtccctgttgcgggtgtctttgctcaggcctgcctgctgcctgctcacagcacccctcctgactcagcctctgctttctagctcccagcttggctctggcctggcccttctccagcttttacccttttcccaattccctctgcaacagattgacctccgttcctctcaggaccatgtgggcctccttgactcaggaacatcctgcagctctgggtgggtggcacaccctccacccaccctcggggcctgtgggactgaaggccaggcacactgtcattcagaaaggatgacaagttgcaactaaccaaactcccactgcactcagggctaactgtcttgattttatttccccactgtagaaattgccgatgcctgatattacgaagaggctgggacaaggaaagagctctctgtaccccatctgagagagaggaagagacatgccctgggctagagtgttaccaatttaatctttttttttttttttttttttttttaatgagacagagtttcactcttgttgcccaaactggagtgcagtggtgtgatctcggctcaccacaatgtccgcctcctgggttcaagtgattctcctgcctctgcttcctgagtagctgggattacgggcctgcaccaccatgcctggctaattttgtatttttagtagagatggggtttctccatgttggtcaggctggtctccaactcctaacctcaaatgatccacccgccttggcctcccaaaatgctgggattacaggcgcaagtcaccgcgcccagccttcaatttaatctttactatagccttgcctgacaagtcatatggcagaacaacagtggaggaggaggacgataggactgttctccaagaatctggacatgagggaaatggagtgaccttcagaaagtacaccatttgtaagtgaacattctacagataatacacaaacttacatgctagaaatacgtacatttgatcacaacagagatgcataaggatatcagggagggatgaatggtcccagaccagaatcaaacttaagggaagctattaacatttctgaagagaggtggtggtgggtccaggacagaagcgataagatgtatgatcaagccctgagaaataaggcacactagacactagcgagcctgccgcagaggcgtctgagtctaggggatggcaattctcactgcttctctcgctcagagctcagactctgcaaacgtggatggcaacttgtagaaaagtgataagatacaaattgaattctgtctggtagagatgcaaatcatttctcccctcagaaaagataacctcaaaggctttgattttatttcccgacaagttattgggcagctttgattccaacttagaaaacttattccaacatttcttttccccactggctgatatatcacatatcatatatatatcctactaactttatatatatatacacacacacatatacacacacatatatacatatatatacacacacatatatgtatatatgtgtgtgtgtgtccatatatatatatatatatatatatatataaagtttctgtatctcttttttttttcctttttgagacagggtcttgctctgtcacccaggctggggtacagtggtgaggttgtggctcactgcaggcttgacctctcaggctcaagtgatcttcccacctcagcctccttagctgggaccacaggtgcgtgccaccacatctggctttttttttttttttaaattattttttgtagacactgggtctcactatgttgcccatgctggtgtttaacttgtgggctcaagtgatcctcctgccttggcctcctaaagtattgagattacaggtgtgagccactgcacctggccctccttatgcctctttaaacaagttttgccatcctgttatcattccttgctaatgagttaaataaacattttttgacatgagccagtcatttacataagaattgtgtttttcaggaaattctgtcatttgtgacgatgtggatgaacctagaggacattatgttaaatgaaataagccaggcacagaaagagaaatactgtatgatcttgcttatgtgtggaatctgaaaaagttgaactcgtagaagcaaaaagtagaatggtggttactagaggctggggtaaagaggagacattggtcaatgggtacaaagttggttagctggcaggaataagttccggtgatccactaaactgaaagttgactacagttaataataatgtatatttcaaaatcgctaaaagagaaaattttaaatgtggtgggcatggtggctcatgcctataatcccagcactttgggaggccaaggaaggtggatcatgaggtcaggaattcaagaccagccagtctgagaccagcttggccaacatgatgaaacctcatctccaataaaaatacaaaaattagccaggcatggtggcatgcatctgtaatcccagctgcttgggaggctgaggcaggagaatcgcttgaacccaggaggtggaggttgctgtgagccaagattgcaccactgcactccagcctgggtgacacagcaagactccatctcaaaaaaaaaaaaaaaaaaaaaaaaagaaagaaagaaagaaagaaagaaatgataagtggttgaggtgtgaaaggaaaataaaattaaaatctcaggacctcaaactcagtaagccaaaggaaacagtgaagatgggcactgggtcctgcaaacctccttcccatttcgttcctacataggtagctgtatacctttctcatattttgcccacaaggaaattcctggcgggccctgagatctttaaagcagttcagttgaatttcaccccaacaaagtaaattaacagtttatcttcacaaatatgggacaaaggacagaactcaaagtcatccttctgctcacctgagaaaaatgcatatctgactcctccctacctatactctataattattttatcttatgtaaaaatgcagattcactgagctccagataaatatataatggatcactcctttcacatgaaaaatgaaatgaggatggtcagggctggatgccattatttattcagtgaagctaatcaaaaggctcaaaagaacgcaacagcttccgtcttttatccaccctctccctctctttttttctttactctttttcctttaaatattgaagcccacagaccctctctggaaaaagcacagatcacagatttttcctgtggtatgtgtccctttttccccagggcgtgtccataaccttggcaaagtaaaaatgactgagacttgtctcagtcattttctctgacttacagaggtcatgaatatgctaattactcatgtatagattctacaatgtatacatgtatcaagatatccctttgtactccatagatgtatataattattatgtgactatttaaaataaaataaaactttaatgattatggttttggggtgggcatggtggctcatgcctgtaatcccagcactttgggaggccaaggaaggcagatcatctgaggttgggagttcgaggccagcctggccaacatggtgaaaccctgtccctactaaaaatacaaaaaattacccgggcatggtggtgtgtacctgtaatcccagctactcaggaggctgaggcaggagaattgcttgaacctgggaggcggaggttgcagtgagccaagatcgtgccactgcactccagcctgggcaacaaagccagacttcatccctcacctccctcccaaaaaatattatgtttttacatttaaaatttgtgtcttaacagaatcatagagaagggaagctaatggaaatgatacattttgaggatggtcagggctggatgccattatttatttaaagcatacaagccaaactccaatccttgttccacagttctatgttcccctgataatgttctgtttgctgtccctggttctacagggagagaatttgctggtcaaactgataagtgactggtcactagacacacatccacttctctttgtgaatggattctcattctggtatacaaccttatgtctagggtggctttatggcagccatctggatcttgttgaagtctgggatgctgaagaagtctcactgtgtgagtttctgaccctgtaaggttgaggcaagatggaatgatggtgactttaccagaaaaaaatgctatcttgtgaagtctccctcttctgataacaagtgaccctgctccctctttggtaagtgaggaaactgtggctcatggaagtggcatggctaatgcatggcaagcgaggtctgcctgactaggaagcctatgttctctctagtttatcactccttgcctgaagaaagagaagcagatctagcaaagggtggtagacaaaaacaaaaagttcatatattcaatgtgttgtttttagcttccagtgatttccacagtacacaattctacactaggtatttggagaaagttgaagcctggcatgaggattcatttgatcttgagagctgactccaaatatttgtgaagaaagaagcatgtgcaagaataagatacatatttccatttcatacttcctccgagggctgagcctgttcctgactcagagagatattgcaaaagaagctggtattatacacattgaaaatgacactccttctaaggagcaaaacaactttatcatatcaagcagagcaaagctcccctcttggaaaactcaaaaatgttcaaaatgcaaactgaacttggcagggggaaaaggcgatggtagcaaaagcagctgtgaaaaataaagaggttacttgtgagtgactgaaatgtccaagtgtcatgccaccagcagccacaaataaaagcagatgctgcaacattttttaaaagcatttctgtaagaagataaaaatggctgcatacaattaagaagtataattttattgaaaagcatgaatgacaaagcaaaaggaaatgtcaatatgatttttgtttttgtttttgttttttaaagagagggagtcttgctctgtcacccaggcttgagtgcactggctcaatcacagttcactgaagccttgaccttccaggcttaagtgatcctctcgcctcagcctcttcagtagtttagactacaggtgcaagccaccacgcccggctaattttttcattttttgtagagatagggtcttgctacattgcccaggctggcctctaacttgtgggctcaagcgatcctcttgcactggcctcccaaagtactgggattataggtgtgagccactgtgcccagcctcaatatgaattttataaaagtccaaatgctctgcatgtggagaactttccatctacaaaaaatcgttctgccttaaggtgtgcaaagaagtgaggccagaactcatttcagaaacagattaagtggacaccaaaggatatttaagcttcagaagggaaagaagggttatcaatgaacggtagctgagatcacaggccccttatctgcaaagagagagaatctgtgataagctgtagtacaaaccagaattcatttgaaagataagatgcataagatgcagaagctccagggccttacttagatgcagcctcatttcctttgtaccctgccacccagctgttgcctatgatttcactgaaacagttatcacctccacttagcaaaacctaagggagtgattctcaatttctattctgcaaaagaatccactgaaaaggttgctaaaatgtagattctcggcccatgctccctgaaagtgctgacacagtaagtctgggctgggcttaggaacccttattttaacaagcactccatggaaaaggtcatcaggggttcacactccaaactactgtctaaggctttaatcctcagactattggttgagacctactagtaagtcttgaagtcagcttagtgagattagcatttgaaaagaaacagaagaaaaatcagaaaaatgtcagtgtatactgtgcagtcaatttttagtttcattcacatatatgagtgggggtatacacgtgtagtgaattgtgaggtacaatatatttcagactgtgcatcccagctgagaaagttggagaaacagtggcctaaagggacatgaagatcacttccctgtgacccatttatcattttctccatccccacactgagttccaaatcactccagctccacttccctcccatgtctacaaagaggatataagactgtgtttctttgttctccagtgtcaggcatgacaactggcttttcagcttcaggaatgaatatggacaacttgaaggaaggcttgccaagatcccagtggagcctcagatgcagcagatgatgagaagtgagtgaaaaccctttagattctgacctggggaccttccaaaggtctggaggaagagaagtggtaggaaggaatgggcagaaaatgaggggcaaactctggagagtaggttgagacctcagaagatggaaggtgagccaatgcattattctttttgtatggagatgatgttagtaacccacctgcaggagctggagtgtttttagctatttttcctcccagcaatggcacagatccttgtccattcgttcatattatcttgatccaacttatagtgaaaataataaggtttaacaggtgctggtctagatatgaacaggcgcaccacttgttctcctgcatacagcctaaccatgtgagaaagagccaccagaaagatagcaccaggaaaataacgccaagcatgtttagcccggtgtgctattcatctctcccagcttccccactctggtcttttcagccccttgggaattcctccactaggtccatttggaaaagagtaccaaggaggctcaggggactgaaaaccagctgtgcactgtggcttgggttatcttcaacttaaggaaggtgtttttctcattccctagctcccttatccatgccaccaccgcaaaacagtacctttccctaatgttcacaaaggtttaatacaggctagtagtaccccaggggaagagagctccattcctttaacaagtcacttgtcttttcatgacattaggtagtctttcagtgttcaaaagacacccacattcaacacacacacaattaccactctttgctctaagcagcttttgtaatgaccatatctcctccccagcacttcaaaattggagggtgtgcctactaacaaacatcctggatggtctatcagagtaagtgaattccttaaaaaagaacagacacccaagatgcgagcataaatcactccaataattccatagtatctggccacaggcatctcagctatatcttcacttaactaggtcattttagggggcttacaatgtctaggacaccacttattttttagagccttattttgttggggatcaattcagaaaaaaaagtgaagcttcatgggacatgtatgtattgtcaccatttagagaaaatgacagaagtgaaggaaaaaagaagcatcctacttataaggtcaatttggctcatgcgtgtctgtgatctcaggatcttacagttcacacactgccacacagatgttccaaccagtccatccacagccattcattatgccagtaagtggatgatactttttttttctttttaacaagatctttttttttttttttttttttttttagcagagccattttaaacctcagctataacaacacttgcacgtccaattcattgtcattatctttgctaaatgctttcagtgaaggagggatgagaaaacaggtcttttgtattcctgggctatcaataatcttcttccttggaggtaactgtttcactccagagggaaaaaatgactctgttttatacttgctatttgtctatcctgtataagtgagggctgagaatgtaaagtacatagcacttgctaggcactcattatgtgttgatatggattctctttggggtgaaggaaggtgggttatcaagcaggctcctgtttctctggggaacagaactgcacagaagaggggaaggcagtgttcacaggtacccgagggaacccgcaggtgccagccgtcttcttggtacagcagacttaggactgaatatgtggtttccgcaatttaatcaccattggacttcttacagcctaatggtgtatgtcaattagtatattaggatatgtgacttacccatcagacacatctatttagggtaactggataaacaagctaacctgtggctggggcctaaacctgggtcatcatcctaacatgtcagaaatgtctttgctttttctcttagtctgtaattcctcctagcacacaagcttccaattctagactctggtcatgttagaatatttgcatcccctccctcagtgcaccacaatctttgacatccctttgcacctgcttttctctgtgcttggaatgcccacccatcctctaccttcctctgcatagtcaacatctacttctaggaagtcttttctgtcccctgatagtgggttagggcccaccctcaaggctgcccaggcttgcctctgtcattggactgatgccattatcttcccactgtttcccaggcagtctcctcattagactccgtactccctggggagttgtaatacgttctttgagtgaattaatgcacagtatgggtattaaatgaatggaggagtgagtggtgaaagaatgaacccaggattggaacacaaagttcagaacccaacttcccatactatcctttctctcacagtatccttgtcagttgcaaaacaaatagctaggtttaataaggtggctagggaaattgaggtctttagaggaaaaaagcgagtagctagcctattgcctcctctgaatctgacatttatttgctcttctgggtaaggtaacgaatgtctagctaatagattattaaccacaaaaaatgtcttggttctcaagaaagatggcatgagattgttaccattttatacatccttttatattaacaaaaaataaagcactcaccctagaaaaggaaactagacctccattgctctccttggcccagggttccacaaacactgttacttacatatgccttggctaaccctgccagcaaatcttgaattcagctttgtgtgcaagagtgggttttgttccatgtagcaaagtgaggcaactatgacaattagagacagaacatagccagggcttgccttatcctggcccaagacatctaacacatcttggagagaactccatgtctcctgaacaacataatcatctactgcaagtctgtaatgaaagattaagcctccctgcattgaacctgaacccctttttctgtgaagctatgagtgtatgacatttagaaaatcctttccccttccaatgagattggaataataaactaattatgcaagctccgtgtgacattggagcctcaaatttttgtaagaagattatggccataaataattttttttttttttttttgggacagagtgttgctctgtcaccgaggctgcagtgcagtggcacaatcttggctcactgcaacctctgtctcctgggttcaagtgattctcctgcctcaacctcccaagtagctgggattacaggtgtctgccatcaagcctggctaatttttgtatttttagtagagacagggtttcaccatgttggccaggctggtgttgaactcctgacctcaagtgatccacccgcctcggcctcccaaagtgctgggattataggcatgtgccaccacacccagccaccataaatacatttttgataaatacattgcttgaaagctagttttccctgcttttcaggataacctcccagagattgtattttgagaacaaagtctctgaagatctgtttttaagcttctttgcttggctgagcccataggaggataccattgccatgcttacatctcggcgtacatgctatgcagaatggctgccaaatttgaccctagggaaagaagagaaagcttactgaccttgtgcagctccacaggagttggagacatgatctcctttatttcttgtttcatttttctcagggttactgacttcctacccacatctgaaggcagggtgttgctccgagttgtttggctgtagtgcggccgcgagctgctgcgctcctggaagctggcctgtcgccccagctgactgcgaggtgttggagcctcatgattcaaactcatcgtgctccccgacatgattgttgcctgtggcattgacaatttttagaaacaattaagccatggactaaggaaaggatttggtgctcaacagtaagcacatttctccttctgcgaggtaaaaatacagtctcttcagggcaaaaccaaaggctggaaaatggatgtactaattgaactatgaaagtctggaaaatgctttgcaagtgacatttataatgcacatctcaaatccaatttaagtacttaagccattgagtttatttaatcaaataccacccctggcagttttgaggcaaattgaaatgctctaacatttgcttactgtaaactacattttaagcattcactttccactcagtgggctctaacagatgggattcatgaggccaccttgaatatatcttacagaaacgaattaagaacttctcaatggacaccaggctgcctgtacttgcaatgctgcctctatctccaactgcagttaacaatgggctggaaagggatgactgatataaaggcaaggggttcttcccaagcttcgtctagactgtatattgtctttcctttggccaagtggcctgtccccagagtttgtagaccagctaagtctccatattatttgatacagattaagtgtttcttagaaatactctttgtataagatcctcagagaaagtaaaaataatcatttattatgttattatattcaactttttgctcacaagcagtaggacttgaattggatgttaccagtgaattgggaagtttgttcggtttcaaatatgttcttccctgaatacttcacaagcaatgacaagattagataccaaagatgaataaggctcagaactggaaaaaaaaaaaaaggatttgaaaccaatatcaagtagtggatattcatttctcatggttggagaatgctaaaattctgaaaatatgcctgtagccagttctgtactcctgggtataatagtataaaggtaaactagcattggtaaatcttcctgataccatggggacagaaaacaagttccatttgccatgtgatttagttgtttatattaatactgatgctaaaagtaaccgcagcttaacttgttgagtcttttgaatgtagtcactcatttaagcctcacaacaactctatggggtaggcactgttacttctctcaatttatttatttatttatttattttcttttttgagatagactctcactctgtcacccaggctggggtgcagtggtgtgatcctggatcactgcaacctctgccttctttgttcaagcaattctcgtgccacagcctcccaagtagctgggactacaggcatgcgccaccatgcttggctaatttttgtatttttagtagagatggatttcaccatgttggccaggctggtctggaactcctgacctcaagtgacccaccccacttagcctcccaaagtgctgggattacaggtgtaagtcaccacgcctggccattcctcccaacttataggtgaggaactgaggcacgaagaggctgactcacccaaggtcacattggtagtaaatgagccgagggcactttataaaactattgatcatgagggaatactgcaaagtgagtagagttttcatctgtcacgtctctaagatttcatagttcccaaattcacctggtgttcagctatacacacactactaacaagatctttgaacaacagccaagtgttggcacacatgtgcatatatctaacaactttgttgaaaaagaaatgaaacaagtagactatatcttgactagatcagttatctcactgataattttgaaaaagaaaattataactgtaaaaagacttgctgatcactgaacattaacatgtgctaagtcccatacagattgcatgtagaatatcatttaatacataagtaaccctatacaatagatattaaaattaccatacatcctcatttcagtaaaggaaagagatgcgtggacaagttaagcaacttgcccaagagcctgggcatggagctctagtactctgactccagaactctttttcttgactgcttggtgcttctcagtcaaatgttaggttgaatcatataaaacttcctttttagtaggtagaaagatgcctagcatttaaaaacaagtgtgggctatttatacaacagtttatttcagataaataccctttttaagttgattgaaacctttctttactggcttcattggtgtcatgggatattctttattttatggcacttactcatgtatataatttctatgttttttattttattttttttgaaatggagtttcactctgttgccaggctgaagtgtagtgatgtgatcttggctcactgcaacctccacctcccgggttcaagcgattctcttgcctcagcctcccaagtagctgggatgacaggtacccgtcaccacgcctggctaatttttgtatttttagtagatatgaggtttctccacattggccaggctggtctcaaactcctgacctcaggtgatccacctgcctcagcctcccaaagtgctgggattacaggcctgaggcaccgcacctgccccatttctatgtttaatctagtgtatctgacagcactcattggttgttttcttgccatgctgaccatccatttattatttttacctacttagactagttgtttgctttgttaacatccattttttaatattcatttttcatgagaatgacaggacacatgttggaagtaaaacaatcactacaactgagagaccacagttttgctttgatgagtcttagctgccatagaagaaattacagattgatttagaaaaggttctgatggaagaaataagatactatcactaattctttggttcgcattttcaggtaagtatgtgaatctgtacagtaatcaaagtttgattgctttgtttaaaatgaactttaggtagcatctaagaaggaacataaaaggtaaaacaaatataaaaactaaaataaaaagctaaaaaataattatttttaattacctaggatttgctttggtctcaagagtatgtattacctgttttcatttgccataattcatgattgtatattattcctaaggcagcctagagttctctatctgacatttagttaaaccttcttcttatattatgctaaacaaaaaatagttaaagcagtgatcattaatcaagaaagggcaaaaatactaatagttaatttttattgaatacttaagtgccacataattattagctcattataattcccatttttatagaagaaatatctgataagagaggttaaaaacttgtccaaagactcattcaaatttctctcctttgttaaaactatacatttttcggtgctaaagttgaacctaaattattgctagcaataggggaaatgattagtaaattaattttcatttccatttcaattgtaatcatctttcatcttagctaaccttctacatttattagtattatagtgtgctttaacttttaatgctggatgtaaatttaatatgcaagaatctagctctaatattttttgtataatagcatttccaatcaagggaatggggttcatttaaaccaataaataaatattctttgtgataaaagtgtaaatataactaatttatgaatttgccaatcattcatcctagttgaggatttaatttctctttggcttataaattcaactcatttgctttctgcattaataatgtcaagggccacatctgtctggagctatgttacagcaaattcataggctgtggcaacataacatctactcttactgatggatgttgttttcatcagataactcaatttctgggtgaaaacagaacctgattgtatcactttttacatcattttctttttgcctaatgtaaaataagctgttagaaaaacaactttttttcttcaaaagggaaatatcaaaatgcacaatgaaaaagcaggatgagccaaaacatgctttcaaaagcagggctatgttcaagaattgtgaattgtgctcgttactcagtttgggctacttttcttcatcattctacatgcagaaggtggtacaggtttaaataagccagctgatacttcagcattctgctctttttgaaagttgtataaaaatgaatcattgctaacatcttacttcatttagattttataggattatccatgtccaggacctttaactgtgctctgaagctgcaattcatgccagataatactatgatgtttacaagttcaaactaatagttttctttataattctctttgcagattcacaaacattagaatcacataaaataaccacacatgcaattgagaagcaaaataatataaagatgagtaatcattttagaattgcaagagtttcaccccattatgccattcacattccttatggtgacttggggacctcataagacatcaaaataaaaatgagacttttgccactttattttttacagctcagaaaatttaaaagaacataaaaggaaacagtccaggacttcctagactaaagtgtgaataccatcagcaaattcatggctttgattaaagaactcaccaggagttcagctattacattccatctcgttcttccttgaattcacactaagttaatacagatggaatcaggatttacaattaacagcaatgtactgtgtaatatttttgctgcttatcaaatagactggcctttttcaccagctgcattgtcatctactttaaggacaaaacaaagtaaaataaaatttcctcttatgttcctcttaacgatcacattaatttctattccaggtacaaatgaaaacatgccaaagaaacctttctaaagcaactaagagaatgggatgcgccgctgctgggagacttagctcgctttttagcgatttggtaggaaacagatacaatcagggttagcagggagcaatggcagaagccacaagtcagtaagcttgaggggtggagatggggatatacttttgactgcattgtataaaatcaaattgctgtccagaaggcaagggggtagggaaggcagcttcacaagcaaaaatataaacataaagggtagctaccaagagagtcatgtttctcaaagacacacgcctgtcagctttctcctgtggaaagggttaaagcttttaaatgaactggtgtgagaaatgcaaacttaaaaggaccaaaaaaaatgaatgtagaaacaataaaagtaagtagcaggaccaaggctacctccagttctctcagaattcctgactgtccgcaggtttccaaatcctccagcgcttgagaccagaagttctcctcttgttctgtctctgcactatcggcagcccctgcaaaactgttgtcaagaaacacaggctgggttaggaacttgccagacatttttttttttttttttgagacggagtctctctctgtcgcccaggctggagtgcagtggcgcaatctcggctcactgcaagctccgcctcccgggttcacaccattctcctgcctcagcctcccgagtagctgggactacaggcgcctgccaccacgcctggctaattttttttttttttttttgtatttttagtcgagacagggtttcaccgttttagccaggatggtctcgatctcctgacttcgtgatccgcccgcctcggcctcccaaagtgctaggattgtaggcgtgagccaccgcacccggccttttttttttttttttttggattcagaatatctctccttcatctcacacgaaatatagaaagagagtcattttggatctggctttcttccacctgtgccctccaagagtatgagcttcagcagagggacgctttaggaaatgcagtgttgtgaagatggaaaggatggtccatggtcttactaccggatttcagactatttgtggctgctgctaaatgggctgcagccacatggccctgttggaatgggatggaacgtcggaaatgtatttcagctgctatatctacaaggaacgagaaatcaaatttttctctaagagagaaacatgtgtttttctcacttatttaaagatcattataagtaaaccaaatgctatcagtttttataaatttccttaaaatgttttggtaaggaacaaaatggtaaaatatactttgctgaaaagatggatccatgaggtatcttttaaaaaaaaaaaaaagtaacttaatgtgaaactaacttttaaaagaaaggagaggggcccagtgcagtggctcacgcctgtaatcccagcactttgggaggcctaggtgggcagatcacttgaggtcaggagtttgagaccagcgtggccaacatggtgaaaccctgtctctactaaaaataactaaaaacacaaaaattagctgggcgtgttggcaggtgcctgcagtcccagctaatcgggggtctaaggcaggagaattgcttgaacctgggaggtggaggttgcagtgagctgagatcataccactgcactccagcctgggtgacagagtgagaccttgtctcaaaaataaaaaataggctgggcacggtggctcacacctgtaatcccagcactttgggaagctgaggcaggcggatcatgagggtcaggagttcgagaccggcctggtcaacatgacaaaaccccatctctagtaaaaatacaaaaattagccaggcgtggtggtgcatgcctgtaatcccagctactcgggaggctgagacgagaatcactcaaacccaggaggcagaggttgcagtgagctgagatggcaccactgcactccagcctaggcaatagagcgatactccatctcaaaaaataaaataaaaaataaaagtaatacaatataaaattaaaaaacaaaaattaggcacatgtggtggcacaggcctataatcccagctactcaggaggctgacgcatgtgaatcgctagaacctgggagatggaggttgcagtgagccgagatcttgccattgcattccagcttgggcagcagagtgagactctgtctcaaaaaataaaaaaataaataaataaaataaaataaaggagggggacctacttgtcataaggaagggagtgcaaagtttatagaagcagcttctccccaggtgctactactgttttcgttaggggaaacccagctcttgccctgttgtgtggtgcccaggttgccactggtcaggcagcttttagaatcctgccatgtggccagcatggatgattatggtggctttaagaagcccatactaacaatatgtgctactggaagtacagaagttcaaatcttgcccacatgaccatgcagtcatcttggatgaggcagcattggttgaaaaccttacccactggctgtggaccggtcccagtcttcataactcagccccacatctgggtaagtctggcttcgaggcttagtgactggggacaagctgcctctctgttttggactcctccagtcataggtgttgaaattgtatcctgaggcctgaaaactagtgcctaaaatataaacaaggtgttagcattgggcccaaggattacttaatccattgagaaatgacattgttaaccagtagaggagtcaaattataacggcaatgacaataacaatagtgaacacatagtgtgtgcttattgtgcaccaaagacttcaccaagtacttcattttgagccatctttcttctttagagccatctttggaggtagatactcctattatttgcattttacagatgaggacacggacggcttagaacagtggtttcaagtacctaaggctatttgcaaactttcttgggagttcaagtcataatttttggagaatcggttttcagatcctcaagttctagatgcacttcttccccaaactggcttagctgagatctgccagttagtgctcccttctcatttcctctttcacaactgtactcctgccactttacaaacaaaagacatatttctcatccatttcaaatcttttttcttgagatggagtcttgctctgtcatccaggatggagtacagtggtacgatctcgccccaccacaacctcctcctcccgggttcaaacaattctcctgcctcaacctcccaagtagctaggattacaggagtgcaccaccacacccagctaatttttttttttatttttagtagagacagggttttaccatgttggccaggatggtcttgaacttctgacctcaggtgatccacccacctcggcctcccagagtgctgtgattacaggtgtgagccatcgtgccggccccatttcaagtatttgaaagtgcttgggccctgggatataaactcctagttgccaattcaagggataatttgggaaagacttgttcctgtgatgaggtctgttgggagcaaggccttatttcaaccaggcacaaactcacagcaaggctttcacccctctctcttgtccatctctcatgctgcctcagagaactcagaagggcaacggatgtcagggataagaagcctgctgcgtttattgtttatttgaattgcaaaatgctgacttttttccaccagggagttacatctgattagcctgatgggtgagacagtgaggaatggctttggcaattatgttacataatggacactttccacaaaagtatttccaagctgtagttccaagattttgatagaaatgtttttaaagcatttttacaacaaactggaaattatagtctttgcaagtatttacattttgtgagaaaaacatttagacaacaacttttagtaggtgatggggtatgtggttctttaaaattattatgggggttcaagtggggctcgattgtaggtctgattccatagcttgtgctgtaatcatcacatacgccttcatccactacctcaggttgtgacttgtgtgtgtgcatgtgtatttacatggatgcgctggcttggaatatggtatgtgtttcttactgtacttaaatcatttaatacagcaaacagacctgtacccgcattttcaggtacagttaaatggcctgattgcgtaagatgattctgtctccatgatatccctgcttcctcttccccattcactttctctccacctgttgtcgaagcctctaatgccatttttgctactagtttaaagcccaagcagagcaggatatctgaaggataatactctctgatcaaaaggatttgatcttaagaacccagggcaatgcctaccaccacatgatggaaatactctaagaaccttctattttaggacaccaaggattagaagaccttggagcagaggaaatatttacagttcaatgtctcattctctttttcctagataactgcaaaagtgtggttagccatctgggaagaagtcttatgaatgcagttttctgtcaaaagtgttgacttaaggaaacacagatgtgtcttctcttgaaggggaactaagtagctgtgaatttcatcctggctccctctgatggactaaccattttccccttctgaaccaatcaaaccaaccccaaatacatgaagtctcagcttttataatacaaagagtttggggaagcctgtacctcacttaaactggtttcaaccctcaacctttcaaagagccaatgctaattggtggtgtcttcctggagtatccttttctgataaacattaaccccgatgaccactgaattccctggtgaaatttcaacattttagactgattttctttccaactgttgtatgtataataagtagttcttggagacttaggcaagagtgcaagaatgggcttgagcagatgtgcaccaccatcagtaggaaactgctaaccttgaaaggcatgtgtatctctaataaggatgccttgtcttaataagcactattaaatgattattgcattacaacaaagcagagaaagaaaaggggataagattcaaatctctgggtgaaatgtaaagtcagaaaacctgatcccagctcttctctagtccgtgctacgctgacccagagattaaagtaagaaaagttgaccaggtgcggtggctcacgcctagcactttgggaagccaagacaggcagatcgcttgagcttaggagtttgagaccagcctgggcaataatccgtctctacaaagaaaaaaaagacaaatcccaaacccctcaaaattagctgggcatggtggcgcatgccagctacttggggggctgaggcaagaagattgcttaagtctggttgttgaggctgcagtgagccaagtttgcaccactgcactccagtctgggtgacaaagtgagatcctatctccaaaaaataaaagtaactgggcatggttatgcatatctgtaataccagctacttgagaggctaagaggatcccttgagcccaggagttcgagaccagtctgagcaacataaaaagaccctgtctcaaaaataaataaataaacaaataaataaaacttaataaaagtaagaaaagaccaaggttcaaatcctagcttagccacttcctcacttcacagcctggccaattaacctcagtgtaaaatggggataacaataggtagtttaccaggttgataagaaaatgaagaagaatgaatgcacaccttatgaaagtgcctagaacacaaggaggttttaatgaacacagatgcccattgttactatatactaagcccttcaacctctcaagatctcagtttccttatctttaaagtagggagacaaggaaaagaggtaagtctcagcatcattaatgcagtaaacacttgggtgtctcttaagtatcagatactatatatcaggaactaaaatgcaaagggaaataaaactgattcctgtcctcaaaaactgcattgtttggtatatgtataggagaaggagaagaaagaggcatagaaagtgagttctagtagcatgtgaaagtgtcatccttttagtcttaatgcactaatatggaaggacagagacaggtttggggattagaaggtgggtcatgaagggtgccaaaggaaaaatgacatataagcttgcagttagatagcaggtcagcatttactagttggaactgttgggtaagacagtacatggtgggcacagtggctcatgcctgtaatcccagcactttgggagcctgaggcaggtggaccacctgaggccaggagttcgagaccagcctggccaacatagcgaaagcccatcactactaaaaatacaaaaattagctgggtattgtgatgcatgcctgttgtttcagctactctggaggctgaggcaggagaatctcttgaacccgagaggtggaggttgcagcgagctgaaggcatgccactgcactccagcctgggcgacagagcgacactctgtctcaaaaacaacaacaacaacaacaacaacaacaacaacaacaacaacaacagacagtgttggccaagtagaagagagcctggtaaaggtgcagtcagggtaaacaggtcctcgattctatcagtgggtctctgttctactcctaagaagggaaaagtattccaggaatattctgggccctcttaccatgtgtacttattcctccccataggaggaatgtgatttacccaactggtgagttttggaaaagaacattgggcatgtcactcagcccattcctggctttctctggacgctttctctcccactgctgctgtgctgtgcggtaagcaagcctgggtcacaatcttggggctctctgagcttgatggaggcaagaaaaggcatgactaggcagttggataaccatggcagactacctgttgctcatcagaacattcattctcttcttcgtccttagtaccagaataccagtttcggggtgagcaaattattgctcagactaaaactatacttcttagcttctctcaaagctaagtgcaacttagtgaaatgttctggtcaatgacgtagctaaggggacttctgagaaggctccttacatctttgctactgctgtctggaatgcaaatgaaattgctggagccccagtaactgtcttggactatgaggtgaccccaaggatgaaagtcaagtgctaagcaaaacagagccgaaatatttagaagcatgggcctctgatgacactgtggagttacataccagctcgaagtgcctgtttctttataatgtaagtcaatgtattattagagttttcagttctcttcagctgaacctaatctcattgattggtaaccagttcagttatggtttgctgtgtagatctgacttgcgtcttatttaaatttaaatgtctagacttgggttgagggtaggaaaataattatcctgattctggctgcaggaccaatccagctttttctagcaaaaaaataaaatgaaatgctgatattttaatccatagctgactctcatttctatttctcaatggatttgaaaccgattaagaggttaattaacatatcaaaatacctagtgttatcaagataccaaaatgcaaagcttgcttagagaattgtgagatattccgggtatgtgtactaaaaggtactgcaaggaagtgtcagcagatggactgacaaagtatttggggactagattacaaagaaccctgtgttttaaactgaagacctttgactttatcctataacaatagataaccatcaaaagagggtttttttggtttaagggagtggcatgactagatttggttttgctaaagattatagatagaaatgtgggaaaagatgctcaaagtaagaagataagtgaggaaggagttaccatatttcatcaggcctgaaacaaaggcagtggcaatggagggacatcagagatgctaagtgagtagagggagtgagatacctgggtcctgatgacaccatgggaaaaataaatcctgatgttgcttaaatgccatcacttaaattttgtttcgtatgtagaagaaaatcttcaaatcagctaaacttgacctttaactgatacagctggctggtgataccatgatttaaaagagggaatatctgaggaaaattatgtttaggtaaaaggcaaacctgttgccattactgataaaaagttaacaggctctgaggaatattcctttacaccaggagtcaagcttaaaagccagggaataaatgaggcagcccaggcgtaagaaaaaatcaactgccagatagataatgaaattttttttgttgttgaatgatggtgtaagcacatgaaatacacatataatattggaaactacattttaaattaaaaattgataaaataaataagttgaaaaaagaaataatgttttttaaatgtactggccaggcacggtggctcaggcagggcacggtagctcatgcctgcaatcccagcactttgggaggctgaggcgggcagatcacctgaggttaggagttcaagaccagcctggacaacatggcgaaacaccatctctactaaaaacataaaaattagctgggcgtggtggtgggcacctgtagtcccagctacttgggaggctgagataggagagtcacttgaacctgggaggcagaggttgcagtgagccaagatcgcaacattgtactccagcctgggtgataaaagcaaaactcggtctcaaaaaataaaataataaaaaataaataaaatgtatggtcctaagtcatttctcctttggattatttatttatttatttatttatttatttagacacagaatctcactctatcgcccaggctggagtgcagcagcatgaccttggctcactgtaacctccacttcccaggttcaagcaattctcctgcctcagcttcctgagtagctgggattacagacacacaccaccacacccagctaatttttgaatttttagtagagacagggtttcaccatgttggccaggctgatttcgaactcctgacttcaagtgattgcctgccttggcctcccaaagtgctgggattacagatgtgggcctgcatgcctggcctcctttggtttagaattggcaactttttcttctttccttctttattttacatctgggtttccatatctgatcttatactttgtatcctaataggaggtataaaatttagtccagattcctttcactgatattaatgtttagttttatttatttgcataatggaaaacaggtcttcataaaaaataggtctttatttgcacaagtggaaaacagcaaagtaggtatttctgaaagtagatggaatcttgataggatgatttttatttttagggtaactatgccttagatatttgtaaaattctaacattccaaccttgtaatatttggttttctgtactaatacagattaatatttgtagcttttaattcatacccagcattaatttagaaaagtgaactaatcagtgtgggttcatattcataaagtttagaattcaattttcggccgggcgctgtggctcacgcctgtaatcccagcactttgggaggccgaggcaggtggatcgcgaggtcaggaagatcaacaccatcctggctaacacagtgaaaccccatctctactaaaaatacaaaaaattagctggtcgtggtggtgggcgcctgtagtcccagctactcgggaggctgaggcaggagaatggcatgaacccgggaggcggagcttacagtgagctgagatcgcaccactgcactccagcctgggtgacagagcgagcctccgtctcaaaaaacaaaaaaagaaaaaaaaatagaattcaattttcatctcaacaattttgggactgtagctcttgccattactttcattcttggaaaccaattttagtacaggaaagagagccagttaattcgctgccaaatttgttttctaaagacccagttttgtgaaggatgagaaaatcaaatcatatgtttgtgtaactatttgtaattgatcttgccaagaaatattcaaagtattcagatgaggctgtgatctaaatgtcaatgcaaagacagttctctcttctctcagaaatcacctcaagacaaaaagtaatgataaataacagaatgcaacctccatcttaatcacaactagagtgttcatgtaatctcagaccataatacataagaaaatacataatacataaatccagtggaagtcaaatgggaagggggtggtggtggtaagaagtggagagaagacacctatggccaggactaccaaactactctttggtagacaactcagtctaccaaagcaggggcggtggcatgaggcaaaactccaatgctttgtttggaacaccagtatgcactgcatggctggtggcagaaagtacatgtgatcccatctggcatcaaggtaaagtcagggaaagagaacacatgtcacagactgaagggagcaattgctcaatgaggcaggatagcagagaggaattctgttttgtgagcagcctgctgttgctgctctctggtagctggggaagaatttactcacacataccatgctggaactggggtgtgtttggtaccttggaaacagagcctctagcagcttccagttcaggaagaactcatctcattcagtggtgagcagtaattgaaaaggaattggcataacatgtataccaagtaaatatcagacaaatgagagcaaaggcatagaaaaacaaagcgatagcagatgaagaatactcatgagaaaaagcctggttcagagcaaatgataaacatgaccaatcagaaataatcacaaaatttaaaaaatacacagcaaagccatcacctctataaaacaagagatcaaagcagaaatataagaactctagagaaattgggcaaggcaagatgatgatgaaacatgagcttgtagagatcagaagagaaacgaaagagaaaaataaaatcctgctaatgagtagaggaggataccattgggtttctactctgtgctatcctctgtatgatttgtattctttaatgacattaaataaagttggactctgactgcacatgttggtgtcctttcagttatcatccttatgaaaacacaaagaaggaatatatccttataaagcaatgaaaataaataaatcatgcatccaacttaagtcataaaaggaataaaatttaaaaggaactgaatgaaagagtaaaattaaaagtaaaattgtacgtaaaaaaaaaaactagagtaaaactaataaataaatgcaagagtcagttctctgggaaaaaataaaaaccaaacaaagaaatcaaataaactgttactaatcgaatcatggggaaaataataaaaccacaaatataccaattaaggaacaatattatggatataattatagaaactgagaaaataaaaaattaaaaaagagattaattatataaaatacatttgacatctggatgaaataatttcattttctgagagaaaacaaatgatcaaaatgacctcaaaagggagaaaaataagatagaaatatagctatctgagttgagagtccaaagttacagagagcacaagagctattcagcccgcgagcatggcagtctatgtaccaccaccaatttgccagtctcctcttgtattgacctttgctaaatccaagtaaagcagtcatagggttttctcagagttagaaggaagaattaataagatgcaaggaggccaaatgcctaagattttgataaggcagaagggcatgaggcatctaatgggcaagacaatggggagtgaaagaagctgacctggaggccaactggaagaagtcagccacacagtggaactgagaatcagccccttgtgggacttccttaaacatatcccttctttccccacaaggtttcgtcattccattctatttcccttttcactaacgaagtgatagggccactgtttgtttatttgttaactgactgtcccttcagctgggtaacctcttccatgggagcagagaccatgtctcctttgtccaagagtgtatccacatggtctatgggcctgatattgagccagtcattacatactggttgaaggaatgaatggagcaagcttgatattttagagaagaaggagagaacagtaaggaatgttgctgcaaagacatcgatttccagccccaggaggaagatgtgcattatggagtctcctgggaacaaggcaactattacagccttaaagggaacagagagaatgtgcaggggcttcctggaacaaggcagagagcctgctgagaggctggagggacaggttggagagataagctgtatctcacaacataatattgaataggaaaaataaaagtgtggttctatgccttgcttttatttttgttttaattttttttgagacgtagtcttgttctattgcccaggctggagtgcagtggcatgatcttggctcactgcaatctccgcctcctggttcaagcgattctcctgcctcagcctcccgagtagctgggattacaggtgtgtgccaccacgcctggctagtttttgtatttttagtagagatggggtttcgccacgttgctcaggctggtcttgaactcctgacctcaggtgatttgcccacctcagcctcccaaagtgctgggaatataggcctgagccactgcacccagctgtgccttgcttttaaaaagtcaacctcacaagcacaatctggagagatgcagtttaactgaatatcacgggtaaagaaaaaaaaacacattcacaagactttgagatctcggtaaactgtaagcgcaaaatgagtgacagatgtgccatgaccactaaaattcttatgttgaggtaggtgtcattgatcagttctcctgtcttcaatgatgccagtgaccagcttgctttgctccgggctgtcgggctgttgtgtgattttcctttctgaatgttacactttaacgggtacacaggtaaactgaagcacattcgtaagggaggtccacaggacgatacagatactcgtcagtaaattatagaagacacagttaaaggaactggggctattttgcttggagaaggaaagcctcaacagagacccaatagctgtcttcgagtatctaaggggctgtcaggagaagaggctttagtctagtgcagaatgaccttgagggtatagccgggactattaggcatactgcagctcaatacaagtgagagctttagagtcatcagagctacgtggagatggggggctgcctcagcacaaggaacaacctgtcaccttgggcattcaagtccatgcagcgtgtcttggcgtgcagtgaggcaggacctggcaccaagggctgcactggacatcagactagctgactcctaaaccctttccaaacctgaaatcctgccttcagctcccatgttcgtcacaagaattaatggggattagttatgtgaaagtgctttgtaaactctagagtgttctatatatataaagggttattactattttttcattaccttggagtacttcgattctatcctgattgccattgtctctacttatccctcagttcccttcaacctcataaaaatgtctaaattataaatgcaaaatgtaatattatgactatgattcaaaatttcaaaatgcttcacaaatagtaaatggtttttcatcttttactagtgaggggcaggtcctatattcagtttgcttctcatggtcctgtgtctgtggtttcaagggatggagtagctaaggtcttacagatcaccttacagggaagaactaattaatatcaatagcaccctcacaaaaatctctggtaacaaaaatatctctacattaataagcaatacacaaaaaatacacaaataaataaccaatacacaataaattgataaataaacctgagtctactctgatagaatgtgacttctgtcctttactcagtgtcttctggtggcccatcaattctcaggcaatcagaaggtctgttatttggtggcataggtgaacttgtcacaaggtattatgacttggaaaaattaattgccagataaagccccaattctacttaggtgttcaaagtattttccccacctaactccagtatcatctctaatgaaagtaacaacttgacaactttgaaatatcatctcctttcatttttttttccagttttttctcccttccatttttgttttttgttcaccagaggacttaacagagagtgacacaacataggcaggctgagagaaggaaactaggaaaaccaggagagagcaaactggatacagacactcctaaaaagtacagttaactcagtgacaaagcagccctcacaccaatgtgttctctaaactgtttatgtgttttattatttgactgactgaaacccagagcaaacaagggattcagaggctggaatttacatagaacatgagagaaggtaaggctcagatgaggagaaataccaagaagttttgacatacttctcttgttgatgctacggatcactgggaagaaaatattttttaaaagaagctattagtttatgctctgtattcagtctgacaccttttatgtgtttatattccatgagtgaggctttttaatgtagatagtatttcttcacatgacgatgacacctatgaagaaaaatctactctatactttcctatattgtgattatagtgctctaattataaacattcagggaaagggcatggtggctcatgcctattatcctagcactttgggaggccaagatgggaggattgctggaggccagaagtttgataccagcctggagaacatgacaagaccccgtatctacaaaaatttaaaaatcagctgggtgtggtggtgtgtgcacatagtctcagctactgaggagactgaggcagcaagatcccttgagtccaggagtttgagactataatgaactatgatggtgccagggtattctagctggggtgacagagtgagacccagtctctaaaagaaaaaaaaaagtcaggagtgtgcaggaataaatagagtcacaaatcattggctaatctcttatgcacctcttccaaactccccaatccatctttgtggaaagcttgctgaaaaataaggcaatggggcctgtattgaacgagccactttattgtatggtttgcctcacattaatctaagcttgaaggacaagccctggatgggatacttggccatcagtagacctaatggaggcctgttagtgtttggtaaaggttcatgccttataagcactagaagaaaatgcatggccagcagagtgtaagtattcaatgtgttcaatatgattatggctgcaccaaagcagacacaagttaaagaaagatattctcctcatggagcagaggatgaatcttggagaagcatgggcttcaacaatgacaagtcctctgggggacaaagtaaagacataccttgagttccatagctggtgtctattgcagacccatcccatgaatccacagcactgtccacactgggcaccgtggaggggtacatgtcggagagcttgcctggcttctgtgctggtgaggagtcctcctccacatcccccaggtcactcaaatggctagaaatagggaacttcttggggctcgatgctgactgggctttatagacaggaaaggagtttaagtatcagagtaaatttaaataaaaatataccaagatactccgtggctagagatttgtttccctagaattacacacagacactagcacattctttcaaggaagaaaatgcactggaaatccttaattgtggctttcaattcactactcaccatctgtctgtttcttaattttcaaggtgacagtctctcctgccatctgtaacaaatggatggcttcactcagaggcttccctttcaagctgctgctattgatggctaggattcggtctcctatgtggattgcgccagttctgaaaagccaaatagtaataggagaggtagaaataatccctgtatggtactgaatataaattccctgacataccttatacattcatcataataaagacttggtaaggatctccagaagtcccttcttgctttctcctgggcaatgttataagataactgcatctgttgtggattactttttagtttccaataaaattttaaaaattgttttaattagttattaaaatgaactgtgttttttaattccaagaaagctgagtcattggttaagcaccctaaaaatcccaagaaaatgaacaatgttgaatgacaaatgtagtggatagcatggagcatcctttctttctacagatttttttttttttttttttttttttttgagacagagcctcactgtgtcacccaggctggagtccagtggcacgatcttggctcactgcaacctccgcatcccgggttcaagcaattctccagcctcagcctcccaagtagctgggattacaggcaagcaccaccatccccagctaatttttctatttttagtagagatgaggtttccccattggccaggctggtcttgaactgacctcgtgatccatctacctcggcctcccaaagttctgggattacaggtgtgagccaccgcacctggcctgtatgagctaatttctaaggtacactgcagctccaacattttgcaatgctgtgtctctattttgctagccactgttttcaactgttagcaggaacaatgcatttgtgtattcctgagctaggttactggagggcagatttgcttatagggtttgttatatgtccaacaacacatctcagaaagaaatgcagtttagcggagggtggggagtgggtgtgtgtgtacatcattgccaaaggaaaaaatggacattccagcttttaagacattattaaaatgggttatacactttgtttcccataatccttgaagatgatgtctgtatcatccttttctgaaaacacagcagctaagtgtggcacctgtcaggtaacagaggctcagcaagtgtttgctgaatgaaattggacaagctgttcaacctccctgaactttagtttcctcctctcaaaatggacacaatacaaatccgccttcagtcaattgtggtcagcttatacatttcagagagtagtatcaatgctaagcccaagacgtcttttactgcctgtaagatgcccctcagagtcaagtcggaactctgcctgagagttctcaggctctaagatcaatcctttgtgcagatttttaaaagccaacagataaccacagagagaggagcatgtttttatgtggttgtgaggaaggaagcccgtctcagacacaggtaattataacagttacttcaaattttacctttcagctaatccccctttagtgaggcttgaaatgattataggatcaaacggctcttcagttcctgaaattgtgatgccaaggggccccccgtagcgtttaagctccacggtgtaaataattgctccggaactttcttgctcatctgtaataaatgccaaggaatcataattgatttctttggaaaaagcaaaagagtaagatgcatagattcatacataaaagaattcaaaacatcctcgtcaaagtatcatgtcacagaaaataattattttgggaagtagcatttccttagtaggatcttacattcaaatacagggatataatcattgtcagtgccaggggagaggaacactgcctaatgacttatgttttaaatgtgtgagatccgcccagctggggctgcaggacctttcaactgtgtccatgtctaggacagtgcttacctagcatttagtaagtatgcagtaaatatctgtgaaataaacatatggctgaggaggcattataatatgagaggagagagtcactcagtaacaaagaagacagacattgggtcacgctgtttccgttttaagctttacatgcatgctaacttttgatatagaaaagtggattttgcgaagggttggaacaaataacatatatatggttaagtggaacttagataagtaaacttgaagacaacagcaagaaatctagaatctcttagatatcattccactgactgtcttctaatgtgagtcctatcagtgaattacggatattaaagtggaggtttgaatgatcatctctcctctttcaatggagtaacagctgttgtaagctatgtttcaacagcatagaccagcctgccacactgtcataaactaattttggctattcaacattattatagttgaagacacttgtgaatgtgctctgcctaaagcactggccagaaagatatcatgggccgccttcaacgtgatgggtattgtgatggtgtcagagttgcaaataagaagtctcagaattcaaaggttttatttgcttctgacatgcttaaagttcttgggcacttcttgttttattccttgggcctgggagctgtgaatggttaaggaactgtttcatttctgcaactaaggataaaatgaaatggttcagtggctactttagcaaaatagtcagcttttacagtcagactacatcctagtgaagcattaacatggccacatttttgcagtgagcagctgttcgtttacgatatgaaatcctaaaataaggaggaaaaccaaagcttgagttaacaattcaattatttgtgtttgcagtgaagaattatgatgaatataaaatgaaaggtctatcaagtcatttgggaagcaatgtgtcctctctcgccagcacttacttcacttctggccatagattgggagttttgaatgcagccattacctccactttctgagtgctctactcaacgtatttactccacacattcagaactaaagaccatccaccacacactgcaatgcttaagtcaacattttagggcacaaaatcttcaacattgggctcaaatttacattagcagctgagaagctcccatatcaagcctaaaacagctctgtttgctggttcacaagtttcttctgggctgatgctgaagttgtggccaataggctggtgatgatctgctaagggctccagagagaaacatcaagatagagggtaaccaaataatcagcagaggtcaaaagtctaaattttcctacagtacgatattttgtcacctttcagagctggctttgacctaaatgaacagagtactattggatagattacatgtactttgcagccctcatcatcaacaatatcctggatgaaattctgaatgagtcatttgattagtagtccctggcacagttgaacattagttactgctggacactctgtgtgggccattcagtggaggtgtgtatgccataggaaagaccttgaccccttattgctctctgcataaggcaagcatgagcacaaacttgtcaatgggtgccaagcattttgggttggagcatctgctctttatgggttttggggagaaggacagttgcccaggacctggagacccaagaaccagtgggaagtgtccattgaaactgcagtcaagatgaaaacaaacactggactatggaaggggagttgggggtagtcccattcattgggagaaggggggcacctggttctactcagctcattctgcagagtgagtattccatgttattttttgacaatgtaacttgagacgcaaagatgacaaaataataccagagatgaagtgaatggctttaggatagtctgtttcaggctgccttatttggagacatttttttattggcatctgagtcctcactgactagaaggcaattgttaggtcacccaatgagtttagatagtgatggagatgcaaatctgggaaatggtacctcttaactaagaaggacacattcctgtgattacattggggtggaaacaggatgacatgatattctatttaaattatgacagaaatggaagctgatttctgttttctttaacaaataaattgccagaaacacaaaagagaaaggagatttggccaggtgcagtggctcacacctgtaatcccagcgctttgggaggccaaggtgggtggaccacctgaggtcaggagttcaagaccagcctggccaacgtgatgaatccccgtcttaactaaaaatacaaaaattagccaggcatggtgcctcgtgcctgtagtcccagctatttagaaggctgaagcaggagaatcacttgaacccaggaagtggaagttgcagtgagctgagatcatgtcactgctctccagcctgggcgatggagcgagactctgtctcaaaaaaaaaaaaaaaaaaaaaaaagagaaaagggagatttaagagacattacaatcaaaagcaatgagtagatcatttgggattctaataaaaccaactgttataaaaaggtatctattggccaggcgcagtggctcacggctgtaatcccagcactttgggaggccaaagtaggcggatcaccttaggtcaggagtttgagatcacactggccaacatgtccaaaaccccgtctctactaaaaatacaaaaattagccaagtgtggtggcacgtgcctgtagtcccacctactcaggaggctgaggcaggagaatcgcttaaacctgggaggtggaggttgcagtgagccaagactgtgccactgcactccagggtgagtgacacagcaagacaccctctaaaaaaaaaaaaaaagctatgtgtttttctatcagatagattgctttaaaaaaacagttggttttaattaggattttatatatatcagggaaatgtgaacattgagtgaatattttataagattaaaaatattgctaatgatgatatttagttatgtgttttgaaagagtattttttaggcatacgttagtaaaaagatgggatgatgcctggaatttcttcataactccaccggtgaggtggagaaaccagactgagagtggagatgaagcaaggttggttgtaagcaaatcactgttaacactggatgatgcatggtgattcattatgctatttttatttttgtatatattttgaatttaataacaagcctttgaaaaagaaaataatatcaattcccttagaaagccctatgtggatgccttgtgtaaacagatatttaattagtctggctttcctttcatagacggtggtgatggctgcccgcacacagtcttttccagaccatatggcccgtctgcccacaagacaagctctccagggcatcccactgccacttgctcttgagaagggccccactgtggctctgcccagtttttcatagcaatggcttcctcctaaacagttttcctgcttgggatccagcctttgcccctcctccccacttctattttcaccaatgctgccaacatataatttcttctctttccttcccagaatatctttaaaacataaatctgaatatgttactctcttacttaaagcttttcattggttcctcagttctttaagaataaaatacaacccctgtgcaagagctgagctggcccccagagggtcacgccattctcccccatcccaatccaatctgctaaattctctcttcatagaaccactgcaattccttaaatagcacttttctaacatctttagcccttgcacctgttactccctatgcacaaacacctttctcccatttgttatcctgtagaatttctacttttactttaaagcttggctcagagtctcatccttcagaaaggcttcctggtggcttagctggaggggctagaggccttcctatgagacccacagcttctgtgcattcttctgatgtttctaaacttttattttcattcttgctctcaaacaaggagaagagtgaaattatttttaaattctccttaatgagagaagttaaatattaaggactagaattccatcaggtatgattgagatttggagggccacaaactattataatataatatccaagctatcacaagaaccaacttttaagaaccaatttttgccccccttgagaatgcatgttctagcatatgcctttcactctatgttttaaggatctcgctacttggttcttcattagaataagaataccttgaaaacagagatttttaactcatatccccataacctagaactatgtctggtaccaaagcaaactcagtaaatgcttgaacaagtgagcagaaggatgaatgaatattagcatgtagtcattggttcccaggctgagatctccagaagagtattgcgagtcagcttccctgctatgccaaggtctagtttccttttctaagacatgtgatgcaaacccaatctcattcaaagtttgagaatacaacctcagctgccattgtggggacaagcaaacctagaacttcctccctccaccgtgccaggagcgttgagtcagctttagggtcaactgccaattccacctgccttctcgggctttaactcaactggtgaggccctgcagcttaggaggagggtaataattgccatttaagaaggaatactcagactattttggagattgaagcactcctagatacactctccttgaggctgctccagtgtagaagtcttagaaaggagcaactagggtgtttaactagaagagaaacttctgagaaagaaaaacgtagaatcactagtaagtttcaaagtgagcctaagcagatgttaatgatattataaacaacttttatatcccaacagaaggtttacaacgattagtgaaagacaggaaagggggcaagcctacttgtttgttctgctcagctctagttaacaaaattaatggaagcacggaacagatgcaaaattgctgcattacttatctgcaatgttattttcaggcttcttgagtgctgcctgtttaacaaaatgaatgctatctggcttgaatccataatggtagctgcttctgtggccaaataggaggcttggatttgggagagagcctttggaaggcgtacatgtgcaggtcagtcaaagttcacttcaactaaaagtgatggaattaattttagagtacggctaaatttcttggagtcggacaggcctgagaaagtaaaccatttgaacaacactctctacagctcccttactgctgcacggtcattttacatagatatgtcacaatgatataccaagagatgtccaagcaagtgttgagtgtttcagagtagaattcaaatttctttgtgtaagtgataattttaagtctcaaaactaggtttgtttgtgacagcatttctcaaagtgtagttctaggactagcagttttggcatcatctgcaaacttgttaaaaatgcaaattctcaagtttgcatttgactgagaatccctaccccacagaccaacaggaatgggaactctgggagaggggcctagtcatctgtgttttaatgtcttctgggtgattccgatgtacactcaagcttgagagccgtccctttatgagatcaagcatgcaaaaaagagaaaagtactttttatcataggtccttcttgcagccagcttcttgccaacacacctctttccactgctcctaggacagccaagatcattcttgggagcttggaatggggcatctctgctacaccaatactccaatctgggtttaggggaaaaagctactgcaaattacttagcttggcttaacactggtaaactataaatatttgaagcccaaaatatgaatctgtcttcaaaggactaatttaatcagtaataaggctgtataaaggttatttgttttgaataggacaagctgcagcctgaaaatggttttttttaaacacagattacagcccatgaaggtaaagtattgatttatggtctccaaaaatatgctatatattagagtaatattccccaaaccaagcgagaaatcattaatagctgtatatttgattgacaaaaaggtggtaatacaaagccgacttttgaaaactatatgtgatagatttgcaaacctctatctcttcctacaaatccccaaaagtctctactgctttgcttcagggtttcctctcaggccctagccaggtcttccaactctcttcatttactttggactcagaaaccatcaaggcaaaacaatagatttttttcaagaggattatttgcattgctgattgggtattggggattgggtagcagcctcaggaatcccagagccttggacccacacaagaaccactggacactacctgagttacattccttcagtaatggaagacgacaaatgcagaagctcctgaaggcaggagggtggctgaattcagagtgagggaggaaaacgcctacaaccccaagtgttccaaaagatttggccattgttaaataaagctgaaattcacttttaaaatatccaaatacagtaatgaccactgatagtcaacattcattgggcctcactaggtgcaaacttattggtgagttattaaatatattacctcctttaggccaggtgcgatggctcacacctgtaaatcccagcactttgggaggccaaggcaggcagctcacctgaggtcaggagttcgagactagcctgcccaacatggcaaaactccatctctactaaaaatacaaaaaattagctgggcatggtggtggacacctgtaatcccagctacttgggaggctgaggcaggagaatcagttgaacctggaaggcggaggttgcagtgagccgagattgtgccattgcactccagcctgggcgacaagagcaaaattccgtctcaaaaaaaaaaatatgtgtgtatatatatatacacacacacacacacacacacacacacacacacacacacacacacatatatctcctcctttaatccttaaaacagccatgtaaagtaagcattaaatggacatttacagatgaggaaactgatgctcagagaagttaatttgcctaaatttcccagattgtcagttgtgaagccagtctggcattcttagtctttcattctactgtttcccccagcttgggctagaaacagagttaattcagactctcttgaatggctcattcagcgctttcatcaagtgattaaaattaatggtcactaaccaagtccagtgggcctcattcctgttttaagtcctctaatggccccccattggtttctgggataaaattcaaatttcttaacatgatttacaaggcccataatgacttggctccagtatacctttctagcttacctactaccaagtccttgcacacgttatgcttgagccatatctgcctactagagtgtgccatgctctccctaactttctgcaccacttcacaaatcccttcgagaccaaggttgttagaatcttttccttgaggtcctcaggctgaaatggatgccttcacattctcttaccattgtggaatattttgtgcatatccttatgacattcatcatattgttaattattgattttcttgtttctcctatttggtggtaactgatttaagggcaggattgtgtcccttttatctaagaactggtagtccatggcacattgcctgatacttcatagacaataaacgaatgctgatggcatgactgaaaatcgagggctttagcagcatttgggaatagttctaccatctccttgggtaaggtacacagcagggtagcgagacttgggaagctggaagaaatgcttacattttgaagtagtatctgttaaaccccaattgcagtacaagctagcttaggaaaccaagttccatcaagtatagttataaacttcctgtgaccagagagagaatcatcactgaaggatggagagcagccagcagttaaaggactggaaaactcctgcagtgcagagggcccacattagtatgagcaatatttctgggggtggagaatatacgctgaatattaccattcaaaaatattgagacgaagcatgacaactatttaatgtgatagttctaatcaccagcataatttcagattaagcattatatcaaactttcaaaatcagtgactgtccaaagggtaaatgcttattttccactcagtcatatcttgatcaaggatcagaacgaatgcagagaaagggatttcaggaggtaattagaatacagatagtccccacttattgagtggagcatggactgtgccagtatttccttcagtaagctacaagagctccctgagatgggtactattatgtagacattactgaaaatgggaccaaatctcagacaagtttaccaagttgcccaaactctcacagctcaaatgtggtagagctgaactttaaactgaggtctgatttttttttttaatttatttcaatagctttaagggtacaagtgatttttcattacctggatgaattgtgtagtggtgaagcctgagatttttgtgcacccatcacccaagtggtgtacacggtacccaatatgtagttgttgttgtccctcatcccccgtctaccctctcttcttctgagttcttatatcatgtctggttttaaaacatttgctctttgtgaagatttagtttgcctttaaataatctgtggtcaggctttacattttgaataatgtttttttttcctcccttactttgctctgaataaaaatgaattcagatactcaaattatatttatgatgttatgagggaagaggatactaggatcatataaattcttccaaatcaataactgaataattttcaaagagtgatcttttataaaaccatgtctgaatgagtatatatttctgtatatcaatatgagaaaatctggtttgggtaagcatatctctcatgccaatatttatagtcttattttgggtggttgtatgtttttcaatggaaggtttaggattttaaaaacagagcctcttaaaattaaaacatatttaataagcacaataaccatcataatagtatacatagagattgtaggggaagggtataaagggggaaaatgaggcaaaggaaatcagtaactgaaaataagatctagctctccaagtgctcagttgtttcagaaactcctgccaactggtagacacagcctggctttgaaactgggtgcattgccagctgtgcacactatacatattcatctctggcttggctttttcactttgcaaggaaggtagctgacatctgctgagcagggcaaatcatgcaaaacaggtttctccacagggctttgcctcttcactaggacagaacccaggctgatgctaaaggcttcctctctattttgaaatcaatccccaaaagaaagtgcaactgaagcaggcttgtaaggagagaaatgcaaatgttggcacagaaaatcagttgcttaagaaataatgagtgcaaacctgtgcatatttttaaacattggttataaaatatatttggatataatcattattatcaattgtactgatggatgcaactatagatttttttttacttggaaaaggaatcataaacacatagcctgacataaccgtgaactctagatctagatgacctgattaacaaaatcccagaacattgccacaacttcattattggttgcaatgaaattatatacagtagacgttctcttaaccaatctccacttaaccaatttactgaattaattgtggctgttcgtcttccaccataaaatgtacagaccaatgccatggcatgctccagagcaataggtttctttatgttgcccctctgggcttctgctcctgctcctgcttgagttgtaaacttcaaaatctagaggcaattatatttattcctaaacccgtttatgccagctgtacttgttattttaactatgtaatttaattaatcttatataacctatgaaatatgaatgtagttgttctatgaaaacaaaatccaatggtttggaaagattcaataagggttcgttaggcaaaaatctatggccaggcgcagtggctcacacctgtaatcccagcactttgggaggccgaggtgggcagatcacttgaggtcaggagtttgagaccagcctggccaacatggcaaaactccatctctactaaaaatacaacaattagccaggaaaggtgacacacaccagtagttccagctactcaggaggctgaggcacaagaattgcttgaacctgggaggtggaggttgcagtgagcagagttggcgccactgcactccatggcacactccagcctgggtgtgccacacaaaacaagaaacaaacaaacaaaacatctactgttaattacctaatggaaaaactctacaacattggggaaaaccaaaatctaggtggaggaagaattcagattgctataaattctttaaagtctcactgcattaaaaaccaaaccaaaccaaaataaaactggaaatcataaaatatatattgtggatacggtttaggcaaacaaacaaaaagacttgtaagtataatcagcagaaccatattaataggaaaggccttgactttacccacgagattggcaaaattgtaaattaaacgtttactttatggatccatatcacattctgtaattccccacattagctgactcttttggtgaatggacacttttcaattggctctatattcttatcataatcagataagatgtctcttatttcagggctacccaaagtgtgctccttgcaccacagctgtggcagcatctgggtgtttattaggaatccagaatctcaggtcccacctggggtggtgccaggatctgtgttttaacaagctcttcagatatgattctatgccctcctaagtttgattggagggcctaaaaaatgtgtatagcccttttgaaaagcaacatggggcatgactgactcatcaggaatcatagacatttcctttgtattcttactcagccatcctgcttctaggaatattttcttatttcaaaagaaaaaaaaagctggataaagatatctatgcataaagatgtctataagagtactatttacaataatgaaacaattggaagcaatatagtgatttaagaagagaagaaaggtaaatcacaggcagtcaataaaaatgatagatattaagagtttataaaacgatcaaatgtttacaatgtaaaattaggtaaaaaaatgcaacattcacttggttatagttatgccatatgaataccaataaaaactagaaaactaccagtttcactgtattagatgatgatttagatttcatctttaaaaattattttcatgcaattataatatgttttctataatgaaaatatcttaatgatatcatttacaagcaccattatttaaaatttgtactacactctcagcacaaaatttaaagactcttttagctgtgaaacactgctgccacatcactagccagctgttgtatgtaaaacatcaagatctaatatctttggtgacagatgggcagttcgaaaaatcagttttaactaaggatgctctcaatacctgaattatcttcatctttgcggattttgagcttcaccaggtcttcacattgctggaggatctgaactgcatcttccatggaacagttgtccagccggatattatctattgcgagcaatttatccccaagttccagggtcccagttctgttagtgaatgcaaagtaacacatgactaatgatgagcacttaactaggccatttaaagaggcattaagcataatgcagcattatggtagtctttagaggaaaagaggttcaactgtttttaaattgtacttcattgacaactccctcccttcttctagtcttatttgggttgcctgccatgatattaaattgcagagtattaaaaacattttttcttatacttttttcaattaaacaagaacatatgtgtcactcaggaagcatacaattcctaggaagggaggtaatgggcgagggtctgcatagacccaggtatccttgtctttctccatattgttgtattacttttgatccttggtagtccagatactaggagagcattaagagaatgacagaaggcaaggtgtaatagagttagtggaagcctaaggcttgcacctctgctacttccacttgcatctggaaactcactatggccagagtagcatgaaaatttatagatgaatccatagcttcttatttggaaagtggccactgagactctaaaactggctgtggaccagggtaggtctgttgaaaaaaattttaaggtccataatgaaacaacaaaaaaaataatgtgaatgtagtatgtatatgtttctatgtgtgtatatgtatatatacacagatttgtaagaacagccttttatgcattatatctgtgccagagactgctaattgtctcccagcatccattctcccttcccttcttttaagttaccctctaaaaatgcatgccccagactctctggggaccctccccacctcctgcctgtagctagaaaatggtaacaggagggaggcggagcaaggtggctgaataaaagcctccactgatcatcctccttgcaggaacaccaaatttaacaactatccatacagaaaagcacctttataagaaccaaaaatcagatgagcaatcacagtacctggttttaacttcatatcattgaaagaggcactgaagagggtaggaaagaaagtcttgaactgatgatgccggcccctcccccattccttctgcagcagccacatggcatggagagaaaaactgtgcacttgtgggagggagaacacagtgagggagagactgcattgaaactcagtgctaccctgtcacagcggaaagcaacactgggcagaagtcagctgatatccacggagggaacatttagatcagccctaggcagaggggaatcacccattccggtggtcagaacttgagttccaacacgcctcactgctgcacgctaaagtgttcttgggtactaaataaactcaagacagtttaaagccacaaagacagcaattcctggacaagccctgatgctgtgctgagctcagagccagtagacttggggggcatgtgacctagtgagaaaccagctggggtggctaagtgagtgcttgcaacacccctcccctagccctacacagcacagctcacaactcccagagagagtccttcactctaactgagtagagaagaggggagagtaaagaagactttgtcttgcaacttggatatcagctcagccatagtacgacagggcaccgggcagagtcctaaggccccttttctaggtctttgccccgggataacatttctagacacacccagggctgcaagggaacctgctgccttgaagggaaggacccagtcctggcagcatttttcacctgctgactaaatatccctcgggccctgaataatcagcagcatggctgggcgcggtggctcatgcctgtaatcccagcactttgggaggccgaggtgggtggatcacttgagaccaggagttcaagaccatcctggccagcatggtgaaactcggtctgtactaaaaatacaaaagttagccaggcgtggtggtgcacgcctgtaatcccagctattcgggaggctgaggcaggagaatcacttgaacctgggaggtgcaggttgcagtgagccgattgcaccactgcactccagcctgggcaacagaatgagactctgtctcaaaaaataaataaaattaaatataataaaaaaataaaatcagcagcagtagtcaggtagtacttgctgtgggccttaggtgagactctgagttgtgctggcttcaggtgtgacccagcacattcccagctgtggtggctatggggagaggctgtttctgcttgagaaaagcagaggaatagtaaaaaggactttatcttgaagcttaggtaccagctctgcaacagtagggtagagtaccaagtgggctcttgggttccctgattctaggccttagctcttggacgtttgtggacctgctctgggacagaggggagcccatcgccttgaaagaagagtcccggccctggcagcattcgccacaagctgactgaagagcctttgggtcttgagtgaacatcagcaatagccaggcagtacttgccatgggcctggagcagtggtggccagggggagagacttctctccttgaggaaaggatgggaaggactttgtcttgtgtcttgggtgccagctcagctatagtagaatagagcaccaggtagattcctaaggtttttgactctaggaccaggctcctagatggcatctttagacctgcaaggggccagggggagctcactgccctgaaaagaaggatactaccctggctggctttgccacctgctgattgtagagcctttggtccttgagtgaacatggcctagtggtagccagtaagggtttactggcagccatagttgagacctagtaccacgttggcttcaggtctgaaccagcatagtctcagtggtggtgaccaaggggtgcttgtgtcaccccaccacccctcagcttcaggcagctcagcactgagagagagactatatctgtttggaagaaaaggaagagaacaagagtctctgcctagtaatccagatgattcttctggatcttacccaagaccaccaaggcagtatttttgagtctgcaagagccatagtgttactggacttggggtgccccctaatggagatacaggtgaagtgaccaaaaacttagatcacaacacccaagccccttcgaatacttagaaagccttcccaagaaggacaggtacaaacaagcccagactgcaaagactataataaatacttaacaattcaattctcagacaccaatgaacatccatgagcatcaagaccatctgagaaaacacgacctcaccaagtgaactaaataaggcacgaaagaccaatcacagagaaatagagatgtatggcctttcatacagagaattctaaattactgttttgagtaaacaataaagttttgagtgtgtgataatacagatcataaattcagaatcctatcagataaattcaacaaagagattaaaataattttaaaaaatccagcagaaattctggagttgaaaaatgcaattgacacactaaaaaaatgcatcagagtctcttaacaacagaattgatgaagcagaagagataattagtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactcccgcctgggcgacagagcgagactccgtctcaaaaaaaaaaaaaaaaaaaaaagaagagataattagtaagcttggagacaggacatttgaaaatacacagccagagaagatgaaagaaaaaaaaaagctgggccaggcatggtggctcacgcctataatcccagcactttgggaggccgaggtgggcagatcacctgaggtcaggagttcgagacaagcctggccaacatggtgaaagcccgtctctactaaaaatacaaaaaaaaaaaaaaaaatagctgggcatggtggtgtgcagctgtaatcccagccacttgggaggctgaggcaggagaatcgcttgaacccaggaggcagaggttacagtgggccgagattgcaccacatcactcagcctgggcatcagagtgagactctgtctcaaaacaaacaaacaaacaaacaaacaaacagacaaacaatgaagcacacctacaagatctaaaaaatagcctcaaaaggccaaatctaagagttatcggccttaaagacgaggtagagagagggatggggtagaaattttattcaaagggataataacagagaacttcccaaacatagagaaagatatcaatattcaagtacaagaaccttatagaccacctgcaggaatttcagcaactacaaatgcaaaataactgaaatcataacagtctctcaagaccacagcacaatcaaattaaacccaagattaagaaattcactctaagccagggttttatgaatagaactctgatcttcttgggatggagccccttgcaggaggggaagccatggtctctcttgttcagttgacttagcctttcctgcctgctggctctggagggtctgggtggtctggatgagggtggttccccaaatcacagtgcacctgctctgtcaagcggcagccagactgcttttttaagcgggtccctgataccgttcctcctgactgggtgtgacctcccaacaggggtctccaggtctccagatcggcatcaggtcagtgcccctctgggacagagctcccagaggaaggagaaggctcccatctttgctgttttgtagcctttgctgtcacaggagggatccaggcttggggtctggagtagacccccagcaaaccacaacggcactacagaagggggcctgactgttaaaagaaaaacaaataagcagaaagcaacaacggtaacatcattaacgaaaagaccccacaaaaactccattcacagatcagcaacctcaaagattgagggtagataagttcacaaagatgagaaagaatcaacttaaaactgctgaaaactcaaaaagccagagtgcttcttctcttccaaataactgcgacacttcttcagcaagggcacagaactgggctgaagctgagatgactgaattggcagaagtaggcttcaaaaggtgggtaataatgaacttcactgaactaaaggagcatgttctaacccaattcaaataagctaagaatcataataaaacattacaggagctgatgaccagaatagccagtttagtgacaaacataaatgaccttatggagctgaaaaacacaacatgataacttcacaacgcaatcacaagtgtccatagccaaatagactaagtggaacaaagaatctcagagttgaagactatctttctaaaataagacaggcagacaagaatagagaaaagagaataaaaaggaataaacaaaacctccaaaaatatgggattatgtaaaaagaccaaatctatgactgattggggtacctgaaggagaaggggagaacagaactaagttggaaaatgtacttcaggatataatccaggagaacttccctagcctagcaagacaggccaacattcaaatttaggaaatccagagaacctcaataagatactacaggagaagatcaaccccaagacacataatcgttggattctccaaggtcgaaatgaaagaaaaaaatgttaagcatagccagaaagaaaagccaggacgcctacaaagggaagtccatcagaccaacagcagacctctcagcagaaactctacaagccagaagagtttgggggccaatattcaacattcttaaagaaaataatttccaacccagaatttcatatctggccaaactaaacttcataagcaaaggagaaataagatccttttcggacatataaatgctgagggaattcatcactatcaggcctaccttgcaagagctcttaaaagaagagctaaatatggaaaggaaaaaccattaccagctgctacaaaaacacactgaaatgcacagaccagtgacactatgaagcaaccacataaacaagtttgcaaaataaccaactagcatcatgatgacatgatcaaattaacacatatcaacactaaacttaaatgtaaacaggataaatgccccagttaaaagacacagaatggcaaactggataaagagagagccaagacctattggtatgctgtcttcaagagacctatctcacatgcagtgacacacataggctcaaaataaagtgatggagtaaaatttaccaagcaatgaaaaactgacaaaagcagagcctgcactcctaatttctgacaaaagatactttaaaccaacaaagatagaaaaaaaatgttaaattcaacaagaagagctaagtatcctaaatatatatgcccctaatacaggagcacccagattcataaagcaagttcttagagacctatgaagaaacttatactcccacacagtgacagtgggatattgtaacaccccgctgacaatattagacagatcatcgagacagaaaataaacaaagatattcaggactcgaactcagctctggatcaagtggacctgacagatatctacagaactctccaccccaaaacgacagaatatacattcttctcattgccacatgacacttactctaaaattgatcacataattggaagtaaaacattcctcagcaaatgcaaaataactgaaatcataacagtctctcagaccacagcacaatcaaattaaactcaagattaagaaattcactctaaaccacactactacttggaaattgaacagcctgcccctgagtgaaccttgggtgaataataaaattaaggcagaaatcaagaagttctttgaaactaatgagaacaaagagaccaacaaccagttctgaaattgagacagtaataaataggctaccaaccaaaaaaatcccaggaccacatggatttacagctgaattctaacagaggtacaaagatgagctggtactatttcttctgaaactattccaaacaattgaaaaggtgggacttctccctaactcattttatgaggctagtatcatcctgataccaaaacctgggagagatatacaacagcaagtaaaaacttcaggctcatattcttgataaacatggatgcaaaaatcctcaataaaatactggcaaactgaatccagcagcactttaaaaagtttatccaccacgatcaagttggcttcatccctgggatgcaaggttggttcaacatacacaaaacaataaatgtgattcattatataaacagaactaaagacaaaaaccacataattacctcaatagatgcagaaatggccttcaataatattcaccatcccttcatttaaaaactctcaataatctcggtattgaaggaacataactcaaaatagtgaaagccacataggacaaacccatagccaatatcataccgaatgggcaaaagctggaagcattcaccttgaaaactagcacaagacaaggatgccctctcatcactcctatttaacatagtatattggaagttctgaccagggcaatcaggcaagagaaaaaaataaagggtattcaaatcagaagagaagaagtcaaattgtctttgcagatgacatgatcctatatctagaaaaccgcatcatctcagcccaaaagcttcttaagctaataagcaacttcagcaaagtctccacatacaaaatcactgtgcagaaatcactaacattcttatacaccaacaataggcaagcagagagccaaataatcaaagaactcccattcacaattgctacaaagagaataaaatacctaggaatatagctaataaaggaagtgaaggacctcttcatggagaactacaaaccactgctcaaacaaatcagagaggacacaaacaaatggaaacacattccatgctcatggatagaaaaaatcaatatcatgaaaatgaccatactgcccaaagtaatttatagattcaataccatgcccattaaactaccattgacattctttgcagaattagaaaaaaactactttaaaattcatatggaataaaaaaagagcctgtatagccaaaccaatcctaagctaaaagaacaaagctggaggtatcatgctacccaacttcaaactatactacaaggctacagtaaccaaaacagcacggtactggtacaaaagcagacatatagaccaaaggaacagattagagaactcagaaataagaccacacacccataaccatctgatcatcaagaaacctgacaaaaacaagcaatgggaaaaggattcccaatttaatacatggcactgggagaactggctaatcgtatgcagaaaattaaaactggaccccttccttacaccttatataaaataaaataaaataaaataaaataaaataaaataaaataaaataaaataaaatggattaaagacttaaatgtaaatcccaaaattataaaaaccctagaagaaaatctagacaataccattcaggacataggcacaggcaaagatttcatgacgaaaatgccaaaggaaaatggcaacaaaagaaactttgataaatgggatataattaaactaaagagcttatgcacagcaaaagaaactatcatcagagtgaacagacaacatacagaatggcaggaaattttcacaatctatccatctgataaaggtctgatatccaaagtctacaaagaacttcacttctcaaaaaaagatattcatgcagccagcaaacatgagaaaaagctcgtcatcactgatcattagagaaatacaaattgaaatcataatgagatatcatctgatgccagtcaggatggcaattacgaaaaagtcaagcaacaacagatgccggtgaggttgcagagaaaaaggaatgcttttacatggttggtgggaatgtaaattagttcaaccattatgaaagacagtgtggcgattcctcaaagatatagaagcagaaataccatttgacccagcaatcccattactggatatatacccaaaggaatgtaaattattctattataaagatatatgcacgcttatgtccactgcagcactattcacaatagcaaatacatgggatcaacccaaatgcccattaatgatagactggataaagaaaatgtgatatatatacacacagaatactatgcagccataaaaaggaatgagatcatgtcctttgcaggtacatggatagacctggaaggctttatcctcagcaaactaacacagaaacagaaaaccaaacactgcatgttgtcacttataagtgggagctgaacgatgaggacacatggacacattggaaacaacaacatacactggggcctgtcatgggtgaggtgatgggagggagaccatcaggaagaatagctaatggagactgggcttaatacctagatgataggttgatctgtgcagcaaaccatggcacacatttacctatgtaacaaacctgcacatcctgcacatgtaccctggaacttaaaataaaatttgaagaaaaaaaaaacacgacgaattttgtaaactatgcagacacatggaaatgaaacaacctgcttctgagtgacctgtgggccaatgaagaaattaataagaaaattaaaaaatttcgtgaaacaaatgataatggaaacacaacacactaaagccaatgagatacagcaaaagcagcactaagcaggaaatttttagctataagtgcctacatcaaaaaagaacaaagacttcaaataaataacctaacaatgcatcttaaagaatcagaaaagcaagagcaaactgaacccaagattagtggtagaaaataaataataaagatcagagcaaaaacaaatgaatttgaaatgaagaaaacaatgcaaagatcaatgaaacaaaatgtttttaaaaaggtgagcaaaatggacaaagctttagcaagactaataacaaaaataaaaaaaggagaagacccaactaaataaagtcagagatgaaaaaggagacattataactgatatcacagaaattcaaaggatcattagtggctcctatgagcaactatatgccaataaattagaaaagctagaggaaatgggtaaattcctagactcatacaatgtactaacattgaactatgatgaaattcaaaacctgaacagaccaataataagtaacatgattgaagtcataataaaaagtctccaagtaaggcaaaacctgggacccaaaggcttcactgctgaattctaccaaacatttaaagaactaatataaatcctgctaaaactattctgaaaaatagaggaggagggaatgattccaaactcattctatgaggccagtattaccatgataacaaaaccagacaaagacacacacacacacacaaagaaaagaaaagaaaaagaaaaagaaaaagaaaactatgggccaaaaacctctaacgaacattgatgcaaaaatccttaataaaatactagcaaagtgaagtcaaaaatatattaaaaagatgattcatcacaaccaagttggatcacaacccagggattaaaagatggtgcaagctatgcaaatctgtgagtgaaacacatcatgtcagtagaataaaggacaaaaaccatatgatcatttctattgatgctgaaaaagcatttgaaaaaatttaacatcccttcatgataaaaatcctcaaaaaactagggtatagaagaaatatacctcaacataataaaagccatatacaacagagctgctgctagtatcatactgaatgaggaaaaactaaaagccattcctctaagatctggtacacaacaaggatgctcactgtcaccactgttatgcaacacagtactggaagtcctagctagagcaatcccacaagggaaagataaaagcgtatccaaattggaaaggaagaagtcaaattatccttgcttgcagaagacatgatcttatatttggaaaaacctgaagactccacaaaaaacaattagagctgattaaaaaaattcagtaaagttgcaggcttcaaaataaataatacaaaatcagtagcatttctatatgccaacagtgaacaatctgaaagagaaattaaagaagtaatcccttttacaagagccacaaataaaatcaaatacttagaaattaatgaaagaagtaaaagatctctacaatgaaaactgtaaaacactgatgaaagaaattgaagaggacacaaacaaatagaaaataaactacatgtttataaactagaaggatcaatattgttaaaatatccatactacccagagcaatctacatattcaatgctatctgtatcaaaataccaatgacagtcttcacagaaatagagaaaagtatcctaaaatttatactgaaccacaaaagacctagaatacccaattctatcctgagcaaaaagaacaaaactggaagaatcccattatctgacttcaaattatactacagagctaaagtaacccaaacaccatggcactgacaaaaaaacacacatatagaccaatggaacagaatagagaacccagaaacaaatccacatgcctacagtgaactcatttttgacaaaggtgcctagaaacatacattggggaaaagacagtctcttcaacaaatggtgctgggaaaactgaatatcaacatgcagaagaaaaaaactagacagctatttcttgccatatacaaaagtcaaatcaaaatggattaacaacttaaatctaagacttcaaactatgacactaccacaagaaaacattggggaaactctccaggacattgctctgggcaaatatgtctcgagtaatatcccacaagcacaggcaacctaagcaaaatggacaaatgggatcacaacaagtgaaaaatctttttcatagcaaagaaaaaaaatcaacaaagtgaagagacaactcacataataggataaaatatttgcaaactatccatctgacaagggattaatcaccagaatatacatggagctcaaacaagtctataggaaaaaacaatctagtaatcctattaaaaaatggccaaaatatttgaatagtcatttctcaaaagaagacatacaaatgtctaacaggcataagaaaagatgctcaacatcagtggtcatcagagaaatgcaaatcaaaactacaatgagatatcatctgacccgagttaaaatggtttttatccaaaagacaggcaataacaaatgctggagagaatgtggaggaaagggaaccctggtacactgttgatgggaatgtaaattagtacaagcaccataaaaacagctggaggtttctcaaaaaactaaaaatagagctactatatgatccagcaatcccactgcttgggtatatacccaaaagaaaggaaatctgtatattgaagagatatctgcactcctatgtttgctgcagcactgttcacaatagccaagatttgcaagcaacataagtgtccactgagagataaatggataaaaggaatgtggtacatatatacaatggagttccattcagccataaaaaagaacgagatcctgtcatttgcaatgcattagatggaactggaggtcattatgttcaatgaaataaaccaggcacagaaatacaaacatcacatgttctcacttatttgtggtatttaaaaatcaaaataactgaactcatggagagagagagagtagaaggatggttaccagaggctaggaagggtagtgggggggtcagcgtggggaaagtagggatggttaatgggtacaaaaaaatagaatgactaagacctagtatttgatggcacaacagggtgactatggtcagtagtaatttaattgtacacttaaaaataactaaaaaagtataattggattgtttgtaacacaaaggataaaagcttgaggggatgggtaccctattttccatgatgtaattactgtgcattgcatgccttatcaaaatatctcttgtatcccataagtatatataccaactatatacccacaaaaattaaaaataaaaaaatggtaataactgacaagctgctgggatggctcccatagccctggattgcctgcctatctcccaactgttatgagagagaaacttctgtcttgcttgatccactgtctttggatgtctctttgtcatagcagtggagcctgcacatatatcacctaaactcacacaatgtccttcctactttttgaatgttaaagtatttcttgggctgggtgtggcggttcacacctataatcccagcactctgggaggctgaggtgggtggatcacctgaggtcaggagtttgagaccagcctagccaacatggcaaaaccccgcctctagtaaaaaatacaaaacttagccgggcatggcggtgtgcacctgtaatcccagctacttgggaggctggggcaggagaatcgcttgaacccaggagacagaggtttcagtgagccgagattgtgccactgcactccagcgtgggtgatacaggtgacactcggtctcaaaaataaaacaaagtatttatttaataaaataattgtgataataggttgaaatttttttaagtcctgaattggaaaataaaaagaaagttaatggtcttatatcagtatcctcaatcatttaaaaatatttttatttatgaaatgaaaaatttgagacctcctgattttgatggtatatgggccaaataggtgacatgaacattttaaaactcaagaatcttgcttgcccagaggggatattctggtaacagcaaaattcttgcacaacttatcacctctgtttgggtacctctaataagtgctgctactttcagggttttttttttttttttttggtcagaaaatgaatggaagctgaccagtgaaggagagcctatgctagattcatgaaagaccctaagaaatgttttcagctgtgcagaaataaattgataagcaggaagagatctatggagccactggaactagggatgtcaaatatgatcaattaatagtggctgcttggaagtttttgaaaatacagtgacccattagaaaggtttgctttgggtgtggaaggtgtcatgtttacttaaattaagagaggccttaaaatgaatcagaaaatccattttccttacctgtgtgccacactccctttcttgatatctgaaatgacgagggggtctcctggttttctactggatggtgctgtaataatggagatagaataatcacatctttatatccattattcaccccttactgtacatttcccctgttttataataacttaatgcaagtaatgtttgtatgcaaaacaaagatggtcagcaaatgaattaggaagtatgcacattatgtctttacaaatgtttgtgctaaaatatttacaaacataaaaactaaagcaatgccactttaaatttgtaattagagaaagcaattggataagtacccatttaatttaaatctattttaataagcaattctcaagagaggacctgaagggtgggtatctcagttggagagtattaaaatcaattgggggctccccttagttaccccttcttttattcctttccagtgaggagacaccactgttgatgggaatatgccatatatcacttcagtgtagagtgggaaagtggataagaattactgatttaaagttcttttttttggccaggcacagtggctcatgcctgtaatcctagcactttgagaggctgaggtgggaggatcacctggggtcagaagttcgacatcagcttgaccaacatggtgaaaccccacctctacgaaaaacacaaaaattagaaaggcatggtggcacatgcctgtagttccagctacttgggagactgaggcaggagaattgcttttacccaggaggcagaggttgcagtgatccaaggatcacaccactgcactctagcctgggcaacagagcaaaactccgtcttgatcaatcaatcaataaagttcttttttttttcctcacaaggaaatcttttgctagatggactctaaatctttaaattctgctcacaaattcatacttagaaagctcttggaatgtgacttttttttttttttagtaaatattttgttgctagttaactaaatttttatatatgctcatattctaaacatgtacatgtaattttattgagtttttagataaaactattatactgcacagtggtcagttttgggtttttatcaattttctcaggaatatttccatttatgagagtaaaaaacaattataaatgagcctacttagaattaaccctagaaactaattatagtccatataaatacaaaaaaaaatcttggattagaggtttgcacttaatttaggaattggatccttaaaattagccataccaacatttgtgaaaaacaatttgcctccaagaggagatattttgccaacctgaaggctggagtggtttccttttagagatcattaacaggcccctaaagtaagattttattataaacagtctgatcaccccataataatcatagagccatatcatatcccataatcccatctgaatcccaggaaaatgtttatgcacaagaacagatggcttaatatcttaacacaacatttaaagaaaaagaaaacgcatataccgataccttacccactgtctaaattagtccatagtaaatgctaatgggacttcatttaatcattattcttagcttccagcaaagaatgcaaaacattctcttcactacaattaattcataatttaaaacttcattcaatgatttgatagaatgcctctagaggcatataagcatccaggatttctagttacatcatatttcaaaactgcaaattgttctgggcatagggcacaaaaacaaaaactttgttattaccagcaagtacagcttttctagcatctgccaatgaattgacacaatatttttgccaagctgtagtaaccatcacatagcactcaatgtttcctttggcttttttaaaaaaaatccatgttccactgaaatggtctgtaaaaccaaacaatagtagaggcaacaaaatatatcagacctatctctgtcatccttgaaagagagaaatatagcactataaggtcttggtcaaacctacacagctttgcagaggagtttgaaactactcatggtctacagacatgtatggtggccattttcacatttactagattcttctctttctcctttaatggactcgatagggtggatgcccattgggatgatggggtcgaacccagaagtgtgtcatccagatctgtatgagatcctgcccatcaccaccatgcatgttaaatgtggctatgcatggtccgggggcccagtcatggtttgtgtatcctagccccatgttttaattttctactacctaagaataaatcacaaaccaagcatgctttgcttggctggtagtgctttaaaaatatttagttgccaacacttacaaattagtagattttatatagatacatggcttcttttaaaaaaatagatgggcaatatggtgtcatgattgagagacaggacttggcagccagaatggttgggtccaaaatcctggctctaccacttattagctatatgtgcttgagcacaaagtactcaggtgccttagtttcctcatctgcaaaatggtgttcatgaataacagtgcttaccatacagtttttgttgggaggattatgtgagctattacatgtaaagagattggatgagtgcacacataaggaattacataaatgtttattgttgctattattgtttaacaacagtggactgtttcccactacctcctttagatggagcctttgatttcccatttgcctctatcctcattgggctgatctcactcactgagttgcctcacccatgaaagcttctgagtttgtgaccctttgaatgagaatacactagcattcactgagtgcttggaatttgattggagttctccacagaaccattcgtttatttagtacatagtttttgaacaccaactatgagacaagcgcctctgctctgggcactggctatgaacctccagggaagttgaataaaaaggagagacagggctggttaaatctcctgaagttattaggcatgaaatagttttctctcttctgtcaagtgattccaagtgggaaatccatacaaacacatcatatggggatggggaaggatactgaatacttccaagagtgtggttaagaagaaaagggcaataaaagcttattaagttctgaaacagaaagaaaaaacaatacaactctttgaaatttcaaactccttgaaatttcagctgaactggtcgaacacacaactgaaagcctgacaaaaaagagcaatgatgctaaatcctgtgttatatgatatatattagtactgcctctttcccattcatattttatgaaatgattttaattcaaactcgtcacttgtatctccaatgcaagtgtttttgttgttactagatttgcattatttgagtcatttacaagcttgttcagaattcatcgtcgtcatgtgtgtctacagctcttctgcaatccagcaaggcgatgtcattggaaattttatcccggatcacaagaatccattttaataacactgcaatattaagatttttcatgctgcctatagatatacattcttggtactcacaaggaaacaacttactatattactttttaaaatgtattttctttgtaccaaaaatatacatgcatacaatttaaagagtcaagaattctgaaagagccgtcctcaatttcttgcttccccagatgctttcaattcttttggctgtttccatattgctaaataatatatgactattactaccaaattattttctggtgttagtcattttctatttactttctattatgaaagatgaagagttagtttctcccacctctagaccactaacatactcatatacccttcttgtccccccattttcccaataccattttgtcataatttttggtatttattgatcaacatttggaatttattttagcatgactatgtcaacagcatccagaggtaagtcatatagcattccatgatttctttccttttctgcagaatatgtatttcctttagttatctgatgtcttgatgtttttgtttgctttgttttcttgtgtttattattaattcaactcctcatatttcccaggatatataaatcttctctcaatgtgtcaaatcttatcaggaattctatcagagtttgctaatctgtctggactggttgctttctaggtttgctacacagatcttggggacttccttcccacaaaccctgggaaacccagaggttctcttctcttctctcttgcatccttagatcccttgtatcctgaacccaactctccctgtttctggctttactttctctcactcttggtggtgcacattctccagtagcttctgaggaagagtgcaagggagaagagtttattgagaccttgtagagctgaaaatgtcattttctaccttcatatttgattgactactttgctgagtaaagaattctaggctggcaatccttcttttagaaatttgaaggcacttttccattgctttctagcttccagagttgttgttgaaaagcctgatgctgagaaatgcaaatcaaaaccacaatgagataccatctcacaccagttagaatggcgatcattaaaaagtcaggaaacaacaggtgctggagaggatgtggagaaataggaacacttttacactgttggtgggactgtaaagtagttcaaccattgtagaagatagtgtggcaattcctcagggatctagaactagaaataccatttgacccagccatcccattactgggtatatacccaaaggattataaatcatgctgctataaagacacatgcacacgtatgtttattgggcactattcaggatagcaaagacttagaaccaacccaaatgtccaacaaagatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccgcatattctcactcataggtgggaaccgaacaatgagaacacatggacacaggaaggggaacatcacacaccggggacagttgtggggtgggggaaggggggagggatagcattaggagatatacctaatgctaaatgacgagtgaatgggtgcagcacaccaacatggcacatgtatacatatgtaacaaacctgcacattgtgcacgtgtaccctaaaacttaaagtataataataataaaataaaaaaagaaaagcctgatgctattctgattatttgattattgtttgtattattctaacacattgtatgacaccccatcatgccctgctgctccagcaccacaaccctgtaagattactgcttcgtccagtgttctcagatctcttgatgacaagcttttctgtgggtatttccatccacaggtatggacccaccattttggaaataaatcccttaattctaagacatttatacaattatttctttaatgtgtttctttcctctttctttctgtaacacctattacttggatgttgtgtcatttgtactcaacctgtataattttctcatctattctagattcttcacttatttgttgttctaatttctgaacattttccttaactttattttccaatatttgtatagaagtttagttttttcatttctcttaattttcaaggcccacttttttccccctctgaatgtcattttgtaatagcgtccactccctgctcacctcatgaatgcaatgtatttgttgctaatgatgtcaatgataggtttctctttgtttggtttgttttcttcttcctgaatgtgctaattctctgatttccccctttgtttctggtgacagcctcgcatattagattcttcctcaagtgtccatttttctcttagctgtctgtttatattaaagagtgtggtcctaaagagctgttcaaaagcttggtgtacccaagtagggcttgtggactgtgggtcttaagtgtaagttgaggccaggctgtttatttgggtcagatggtcctgaattttcctaccacttgaaggctattaaacttggctatctggcttctttaagcttcctgggggaagaaggctctcagtctcaacattcagtatgcaaaccttcacctaatttccatttttaaagcagtactgctgcattcagctgtgtgctctcagtccaaagaactctctattgcatgctttccagagaataaaactccaggcttctgccagggtaggggaagggtacttcggagtcggagaaggcatctaaagactaaggtcattcttagcagtctttaaaccaatcctcctgccttaggattttccatcaaatgtacttcccgaagtttctggtccctgaacctgtactccaaagggagtacaggatagaaattaggctcactatcagcttcccctctgcttctttacttaaattcatctttctttatcttctttgccaaatttggttgctgttgtctattttccttttctttttgtccttatgagtttttgccctttgaaaaatcttatattgtcatttaaagtggagtgtagggtgggagaagaagtaaaggcttgtgttcaagctactgtcttttagaaacagagcagggacccctcttaggagcctgctgagcaccaccccccaaacatagaagtataaaaaaaatagtattttcaagggaaattccaggcacctaggtaggcttgaaaagtcaattaacaaccctataagcaagaagatacaatactgagaacttaaacaatagtttcccaagcaagtcagcatcacaaagcattttggttccccatagaaactaaaagataatatattaacatatgttcttatgttgtttttcagaaacctggacccacaccagatggaaaatgctgaccaccattacatagacctcagagatctcatggagataaggaagaagtgagaactgaactctaccattttttgttctaaatttcttcctgagagacctggagagagtcacgcctaaaggccacaccttaacattccttttttgcggatcctaagtttttagacaaagccctgcttctttaaccaactgcaaatcaaaaaaaattctctgaatccacctatgacctgtaagcccccactttaagatacctgccttttggggccaaaccaatgtaaagtctccatgtattgatttatgactttgcctataacctctgccttctacctttaaaaaccatctaggccatcagggagttcaagtcttaagcattagttgcccaattctccttgcttggcaccctgcaacaaatgcttcactttctctcgctgaaaatcctagtgtcactgtttggcattttctgtatgctgggcaagtggacccaagtttggtttggtaacattttgacctcagaaatttaaaaaccactcatcatcacacacacacatacaaactcttaatcattcagctttactttaattgcaaccatatacatcatacatggtaagtaaaacaagttaattgatttgaaatggagcagtgagtagagctttttactgcaaagttggcaaaataacaggaaccaatctcttctaaatatactttaaaacttaggggaaaaatgacagatttgttgtgcttgtcatcacaaaggctgcttcatgattttataagaaaataaagcaagcctttgttcctgcaaacaattcagtcagaactaaaaaggaaagacagtgaattcactgtactcacaaaatactgtcttttgcttttctgatataggatatagggagtttcatcaatcagatggtgacagggatgagtggtgtggtgaaaataaagccagtgctaagtcagagacaatgggtttggatccctgcttcactttttattagcccctggtctttgggcaggttacccagctgagttgttctttcctctttgtaaaatggagatagatgtcacagagctactttcaggattaagtaagaaaacatataaaactgcatagtgccatgcctggtacaaagtagacacaaacccctgtaataaaacctcaagggaaaacacccatgtaaaaaggactttactgataatgggatgtgacagagacaatcaggattcgctgactcgaaagagaggtgggctgtgaggaaggtgtgagctctgggatttctgactggttaaggtgtggaggcatcaggatgtgacttccagtcctgaactgcatccttctgctaggctgttccactttatttgctacaataaatcactctatattacagcaataacatcaataaaagcaatgcctggtgctaatatgctgcaaatgtgtcatcggaacttaagaaaattagtctgaaactgctcactgtgtctaaaatcagacagactcatttctcagtcaattaggtatgaagagtgagccgtaaaggctctgctggtatgcttccagagatgaggggctgtttcttaatacttagagcttgcacaaggtgaagacgacagaaagaggacttggtatagagataatgagaagaatcaagtccttgcagcacctcggtttcactaacagtatccgtgtgtgtctgagaagagggttcccagatttccttcttatgttggcactagattttgtgggctggagctgtgcttaaaatattttagcaggcatggtggctcacacctgtaatcccaacactttaagaggctgaggcaggaaaatcgcttgagtttagaagttcaagaccagcctgggcaacacagtgagactttatctctacaaaaatttaaaaattagccaggcatggtggctcatgcctgtagtcccagacacttgggaggttaaagtgggaggatcgcttgagcctaggaggttgaggccgcagtgagccctaatagtgccgctgcactccagcctgggtgacagagtgagatcctgtctcaaaaaataaaacataaataaataatataatatttcaaaaggctctgtgtgtaaagtaaataatgacgaagatcatcatcattaatgtttgttagggttcacaatgtgtttaaggcattttacatatagtaattcatttaatcttgtcaacaatactatgaagaaggtaatatgtacaccattttctagatgaagaaacggcacagagaggttgagggaatcagggcatgagacagtctaggctctgagtccttgctcttaatcattttctaagtcagtctttcttctgtctatgcatcagcctttgcacaaacatttatattcatttatcatctcccttggaagctcatttcttggagtacatagtgcttagtaaaacatttgcaggtaaagcttcttattcattcactcagcaaatggaggcattatataagcacattgtatgtcaggaactgtgctaggcctcaggattttactaactcataacaatgaaaatggattctggcctttttgtttttctttttttaaagagcaaagtctgctttgtcatctggcaaaatatgagtatttcccatgaggagacacaaaagtcagcgtggtggtgacgactagttgtgcaaatggagctgtagctctagaagaactgacaagcatgtttgacaagctcatgtatcatttctctgtccgggaatagcataacactttcagcttccatgaatgcgtttgcttgtggctggctaaaatgcaagccatctttatgggggtttttagattgttgccattattgctactaaaacccattttagaagtaaaacactcatgcaaaacaaaacaccatcataaagcataatattaaatgattcttcatgtggataaaacaaatattttgtagtttgtgtacaagactacatctcaaacaaattagcatataaatgtctactttttaataagaaatacaccatagggtatttttagatggatactttctgactaaattatattttttatttatatcaatctgtaactaagaatacatctattgtataaaacaaaattaaagacaatattcctacttaaaatttgagagtaaaataactgtgtggcagtggtgataaagcttctgaggaatagatgacttcacaataccaaccagcaggaagcatctagaaggacagggtgtatattcttaaaatttagcctagggcttagagcatggtggacactcagaatgcatttgttgagggaaggcagaagaatgaaagaatggaagtgggggcagggtttctgtgtacagaggcaggttatatagtgcacaactccaagacgcaccactcccacagctagttctgacagaataaatgaatggattggaataaacaaaagagaataaccttaaagttgcatgagtgtttgcatgcagaagccatcttgagccctaaatatgtttggaacagtaaattctgatacgctttcttaattttagtagccctagttgttgacactatagtgacataccatctttgctgcatagtgaaaaaactgagaggctaagtgacccaattaaaggaataaatgactttaggagcacttaggatagtgctggagtctctaaaatcccattccatctttctacttttctcccactaggtcacattagggtttggggggatctaggctctctcccatacatgtggcttcttgctcttaatatttattttgaattgcagtaccgttctttttagtgttgcagtagatatgtgtgggttattggttataaataaaatttcatttttcagtattaaatttgtatcgtccatgttgaatcagacagcaccatttcatactgcccaattgagaacttttatttattttttgcctgaaccactgacagaaatgctatccaacagagtgcagtgaggcacttttatgtggcctcatcactctttcttgaagaaaccagctcttggtcacagtcattacctctacgtctcctttggtctttaggcatttaacatttgcttcattttcttgggacatttatggatgcatttagtctatggatattaaaagccccccaaaaccctcaatttccattctatgaaagtccactggagctaacactttcaaagttgtttttaccaaagcagttataaaactaaagcccgaggaaaggagggaattgagtacatttatatgctccacttttctttctggttcagttttccagacactgtgcactatggaggaattcaaggatttacttaaagtaagagacattgttttagtcttgtgaaaaggattatagatgcttagtggacagatgggaagatagtcttaaaagtaaataaaggtaatttttgttaaatagattataaaaacttaattcacaatacactgtgaattaatatacaatatgctaataatatatattatacgatatactaataattcacaatataaaatgtagagaatctatatgcatctatctctcatctaattatttatctagttgtgtgagatacatgtttatctcaccaggactcatcacttgccaagcactgtactaggtatataaatatggattttattcaataattaaaacaatcctatattttctagctatccttattttcattttacagatgaagaaatataagattggagagagtttgagtaacttgtctcattcatacagccagtaagtgctggaggtgtgactgactccacatttttgtatcatgatataaaaacttcgcaaagacatataaaacatttgttacacctgcaaaccatttgacaacacagttttctaatgcctttaaaaattatttaaaagaaataacttctacttacaacttatggttattccaagttccacattgtgcttcttaggcagctttacatgaaatgttccactacttgggatgacagactctaatatcaaaacaaaaaagaatgtgttaatagaacactgaggactggagcacccatcaataaaaatgcattaggaatacttgtatcataatcatatgtagctaaaactgtaggaactgaagtaagatgaaggcctttaaaatcctagtaaattaagctcctggtgatgaatacacttcctatccacaggcaactgtgcataattcacaccaacagttgagttcagtatttctcaagtgtgatgcatgcaccatctacatcaaatttacctggaatgggagttacaaataatgattcctgaataattccaatctatgaatcagaatctctaaagatgaggcctagagatctctaggtgaatctcaggcatagtaaagtttaagaaccttaggtcctattatattctttccacccccaaccatattttccaagagtgtgctattcagtaattcttccccccacctccactcctatttattgtttgaaggtacctgggaaaacagatttcaggagagatgtcagtttggtgtgatggttgctgattgggcagtgagagtgggtggagaggtgccttaatttgtaatgtgaaaagtacaattaaagaggtagaatcaggagtgacattcaaaatatttcacaaccaaaacagtactggttatcaatcaaaaagactaaaacaaccaatcaaactagatgctgaccacagagttggaacacagggacccagcagattccaactacattaaatgatcctttagtttctgtataatgaggagcttttagagattccagagaggatcacagggcactggaagggagtgaaagtgggctcagatactggccagtcagtatagaagtaagctaatatcaaggcaacagagagagaaccagtgtacactggctgaatctcaacgcaggacagagctaagctgattttatccagacctaattaatgtctgagaaaggaagaaattgctacagattcttaaatatactcttcttaaaattccttaacagtcagaaagacctttaattaatgataaggttaaaatggaaatatccattgaagagatagcatctattcatgctaagttgctaatgactataatcctttctgatggttttggaaagaagtggggagaggcttcaggaacagtggaaactttagcataagcagaggattgtgggatgggtgagctatccacttggccggcttggtcagcttgactcaaggcaggtgcctatccagcacacagacaattaaccacagcagaaccattaggcactcaggcccttagcttaatttactaaccacatagttaacacatttgagtctgtgcaaagtggaggtgatggttaggactggattcatggaaagagagagaggactcccttctttgtttggccttgaattgctcttcttgacctctcatcctttctgaggaaaaattcaggtattaaatgtctcacaagaccagaatctgatttttcaactcagaagttttgccatacagtgttaaactggagagcacaatagaaatttgatttccctgggcccgcctagcttttagaaagccacctataaaaaaggatccccagactggccctctcagcatcagtggtgctatggggtcttccttctctgggctccctccttcgctctggtttttatttacttcagaggggagtgaggcaatcagctgcctttcccatttcctccctcgaccaagtgagtgtcacggactgagttaacacctttgacttcggggttgtcttcagctaacactctcatgggccaggaagtgaatccacatatatttatttgtttatttattcactaagaatttgtatcctttcaatttctcagtaggacttgagatagagcaaattatttcccacaggagatttgaaaaagactggctaatctgaaaaagagaaatgaagtaggtaaaaaaccacttaggtgtgctttacttcctgacttcaggagctgcaaatgtcataaatatttccttacaaaatattttccaatctatgcctttcctgagtcctccccatactgcgctttaacaacaaaaggctaattgccaccttccttctaccttcaaagtgacagtttaagaatttggaattagcatgcacactgggggcagagagggcctttggaagtggccaggttttgcccatatgcaccagcagccagtcagcagagagaaggaagaaagaagcaagtgtgtatgaggagagagcctgtgcctggccttgacagccattgaagtcaggttctagcccttcctggctgtgaaacacagattgcgcttccagtgaatgcctcttctctgattaaaccaggtggagtgcatgtttcttgctggcaactgaaagatccctgatgaacacattgattcggtagaggaaatgggatgagggcatgcagaaagcctccacacaagtgtttacgggcatagcagaaaaaaatgatttgattacttggataaagcacacaaatggcccataagtaaatgtgcatgaagcatcactatttgtagaactcatttcacaaacgtgtgaccattttttttttttttttggagactggttctcactctgtcacccaggctggagtacagtggcacaatcacagttcactgcagccttgacctctgcaggctcaggtgatcctcttgcctcagtctcccaagtagctagaactacaagcacctgccatcacgcccagctaatttttgtattttctgtagagatggggtttccgccatgttgcctaggctggtctcaaactcccaggctcaagtgatccgtccacctcagcctcctaaaaggctgtgattacaggcggagccactgcacctgtcctacccatttaatattttctgttttaagaaacagttctctgtgaaaggggaggggagcatacacatatttgtacatatgtatctgtatatctgtatacgtatatagcatcttgcccatgatgctaagcttgtgtaagtgaggtctttgaaacacaagggccagaaaatgctgttctagaatagttactacagcaacattttgcttttataaatttttaatccagggaaacttgaccaagattaacattgttaatgacactgcaggagatattatcacttcctggaaaacagtaatgaatcacttctgactacatgagatttgaaatattcataatgatgaacaaatatcaactaataaatctctttgatcaagctgtggcttcattttaatctttaaatgccaacatgatttattttatatttgttattttttctttatataattatttggctgctaaagcaaaggcatatttaatttggggtttcttaaagaaacactagtaaagaggaaaaggtccaatatttggaaaaacagcaggtttagaggaagtacatagaatctaagaacaaatgatgtttattttgttagactcgcatgtaattattttgtacttccctgattttgctttatctttgttaatgctataattaaaaacacatttgggtaaacaaaggtctccttctttccaagtggtctgcttttctgcctgaagcattcattgttagcacagtaagataacaaccacaccgtaattcatcaatgcagacaccctttgtgaggaacgtgaacgtttaactcccaccaatgcagagaaaggcactgggggctccataatgatggcaaacattatttgataggattctcaccgagacttctttccagaacaaagatatatatttttttccaacaaaataacttcagacttaaagtagaaacttcaggtattattcatgatattagttggagatgggtgtttaaaaggcagtaacaaacaaggcaaaatataaattgtgcatatattatggttacagctttataaaattatatgtatggtaaggattttggtaagaaatataaaaaatttaaacatatttattagcatgatggggttataagcaccttttacttaaaacaatttcattaaagttactatgctgtttgtggagtatagtacctatatttaaagagacagatttggggccaggcgcagtggctcacacctgtaaccctagcactttgggaggctgaggcaggcggattgcctgagctcaggagtttgagaccagcctggccaacatggtgaaaccttgtctctactaaagatacaaaaatacttagccaggcttggtggcacatgcctataatcccagctacttgggaggctgaggcacaagaattggttgaacccaggagacggaggttgatagcaccactgcactctagcctgggtaacagagcaagactctgtctccaaaaaaaaaaaaaaaaaaaaaaggagaaaagggagagagatttgggcaaaaatgagtcaagcttttttaaccactccatgtcagcttaaaatatttataaaatagaggaatttgtctctgaggtccaaaggtttgggaattaatatctggttgtaaaacatttctgaggcagaattttggaaacggatggcttacatccagaaaattaggagtgaattcagaagtactgaacagtcttgaaacaactcacatccagtgattccccaccaatgtcccaagttcttgactggctagaaaggatttttctgaatccagtagtttccagttgatactagtaggttggtaatgactaactagagtgttttattgaggactatgatgctgtatctgggctcagcgggagaatatcggtgtcaactagtgatgtctgtcatgaggaaggaacaacaagatgggaacatagcttttcttgccctattctgtattattgccatctatttgaagtgggttactttctggaacaatcaagggcagtgggagatgaacttaacatttccttttcctgtcccttatcaagtaagctgggtactgaacaaagtgggtttaacagacacagttcctattttttaggagctcaaatttaagatattagagtatccaatcaacaaatattaaaatacacacatatatattcacaagtaaatacttagatactgcttatgaagaagactaaattgtgctggtaatttgacaactggaatgtagtgagtgggtgctgctgaatgttctacagtgcacacaatgttcaacaaatcacctccctgcaacaaagaatgtcagtagggcagaggtttagaactcctgctctaattgcttcatcctggtaacatctctttgaagagtcagtgcagtgtgatatggtgaagagagactccaagtcaaccgacctaggtctacgattcaccctgctgtatgaccttgggtttccccaattgagcctcagtttccccatttataatgaataaaggtattggattacaagagacatttcaccactaatgttctgttattgtagttaacaataattaaccattaatgttgtgttattgtagttattgtacattctggggttgctggacagccttctttgaaaaccatatcttcaccaccatctgatccatccttgaaaagtcctacttgattcttccgtggtcacagctgactagaagggtaggataccaaacctaagctgggccattagattctttctcctgggaatgagaaattagaactggctgggtactttagcaaagatgggacaattacatacaataaaaagtcagaggaaacttgtctatagggacaaatggagcagatatacagaaacaagcagcactgacagaccaggaaccccagagaaacagtagggatgatctcggctcctgatgcagtctgaagttcctgatcccagttcctcagtagagccaactgctctctacccattcgttcaccgagtattttttttttttttgagacggagttttttttttttgctctgttgcccaggccagagtgcagtggcatgttcttggctcactgcaacctccacctcccgggttcaagtgattctcctgcctcagcctccctggtagctaggatcacaggcacacaccaccatgctaggctaatttttatatttttagtagagacagggtttcaccatgttgggcaggctggtctggaattcctgacctcaagtaatccacccgccttggcctcccaaagtgctgggattacaggcatgagtcaccatgcctggcctcattcactgagtactgaccaaatgacagcttcttgtattccaagcaatacattgggtgctaggtgtacattcataaacaaaacccacaaagtccctgatttcataggtttttccactggaggagagtgaaaataaacaaataaacatacaatataaggtcagagtgtgagaatggctaagcagaaccataaatctgagcaagagaatagagagtgatagatggccagggaaggcttctctgagcatgtgacatttgagcaaagacctgaatgaagtgagccaaaccacccaaacatgacagaaagcatctactgcaaagcttcttctgtggaattgtgcttggcatgtgcaattcagctagttcttactcccctcctaattctaagtcctgccatccttctgtgagatttcactgcatggctggtccctccattacactgtgttcccaattctcagatctctcctggttgaggatctttacctccactccacttttacaaatcaccaccctaagtcttgctggaccttctctgaaatcctaaactctaatacagcacttgggcctcaatctcctagacatcagctccctcattcctttctctcactatccctttttcttcctgaagatctctagttccttaagtcttcccttttctctcagtctatcaggctgatctattattgattctcatctctcccactcagattctttcaaacacagtagtgtagtgtagtgtagtgctgcaggtgtggcctttgaagccagactgcctgggttaaaattccagcctaccatcaactatgtgtgcctcaattttctgaggacataatcatagtaatctcttccattgctgttataagaattaaacaatttgatgcacacaccacgtttagaaagtgacaggccacagagcaagcatttgataaatattaccataataattatgatgttactatcataatttttcatctgctctcccagaagcattttgaacctccctgactagttcttctgttgaaccttctctggaaacctcaatctctggctcaatctaatccttcattttctctgctctttttacttggcagctgaggtctcctgaaaataaaaaacaacaacaacttactccactgtgtaggctgatgctgctctaaacttgaagcttccagacactgcttgaatatccttttacagcttctggttggtttcctcatgcattcctctgatttgctattctaaatcttcattcttttcaaccctcgaagctgctgatcttttcacccttgcttgacagttcttacatgaaccatctaaaagccagctaaaaatgtatttatattctcacatccttttcttttcttttttaaaattattttaatttttgtgggtacacagtaggcatgtatatttatgggttacatgggatactttgatacaagtatgcaatgcacaataaccacatcagggcaaatggggtgtccatcctctccagtacccacactttgggtttcaaacaatccaattatactcttctggctatttttaaatgtatgattaaattattttttacttcagtcaccctgttgtgctagcaaacaccaggtcttattcattctttccaaattttttttggacccattaaccatccccactccccactatcatcactactcttccaagcctctggtaaccatctttctactctctgtctccaggagttcaattgttttaatttttagctcccacagttaagtgagaacatgtgatgtttgtctttctgtgtctcacaaccttttctacaaattcataagaggtcttctaccttctgtcctggacttctctttctcattcctttgtggatctgattccattattatctcttctctccctcattcatgtcaggccccaaacatgctcaatctctccaatcttaacaaaacaaagccgcaaaacaaaataacacccctctgaactttgagtctctcactatctgttgtctcttcttctttctctacagctaaatttcttgacctcaccaaatgtcccctggggcaaaattgaccccagttgagaactactgaataaaggatataatacaatataaaatagagcaacaagcacataagtaaatgcagaagttctcaaaagaggagcccacaatggtgtccagtctctttcatccattcagtgcatttttccggccaaactctcttccaaaatccagttcctaaagcagacagcaagcagagcatctctgtatttgtcactctccactcattcctcagctcactgcaatctgacttccgcccctacttttcagatcaattcatactatggcaatgtctttcttcttaatggccaaatccaagggacatttcctaccttatgttacttgaattctccatagtatatttaagctatcaatagtgacttttgtcttgaaattctttctttggcttccaaaatgccaccttcttttggttctccttccgtttctcaaggtacaccttcatcgcctttgctcacacttttttccctttaagtctcagtattcctcaggcagagtcccctccttggtccctttcttactgccactctttccttaggggtctccttttttcctgtgactttaaccatcactgccatgttggttattcctcggtcttgctatccagcccagaccctgaatcctaggctccagggtaatgcctgcactactctctcctgggcccttctttctgcattccagtggcaacacaaatttggcaagtctattcttaccattcagcagctctttctctcctatttagctttgagctctttgaggatatggatcctttctattttctctttcaatgatctgaaaatagtacagtgcttagcacctagtaacaggtgctcaataactgtcatttgaattaaggaagagacatgcttatcttttttctctagtattagcagtggatttgccaactcatctctaaaatagaattatttttcctatctccaaatttcccctcttccagtcttctcagctaaagacatcactgtctacctgactgctcaccctcacacctcaggagccattcatgctcttccttctccctcatcttccatatccaacccataaacaagtgctattagctctgcttcgagccatgtcctaaattccactatctgtctccaattccagcactaccactgtgtcaagccactatcatgccttacgtgtccaactgccacaatctcctaactggtttttctgcttctgctattttcccctcccatgtcagaaggctctttctaaaacattcctcagattagctcctctgcataaaatgctccatggcttcattacacttggaatgtgatctaaattccttaccagacactgcattagtcggtctctctaacccctctaactccatcaccaaatccaaaccaaatccaaacccaactcccttatattgttccaggaacagccctttttgttgtttctccagcaagctaattgttctggcttagggtctttacattgcctactccctttccctagcacgcctcttccgagagccttacaaggcttacccgtctcagctttcatatccctgcccaaatgtcactccttagagcatcagcctacaaaactagctcccctaaagtcattctctaaccctctatgctgctgtattttcctcagagcacttattctctaaatttatatttgttaattttaatgaattaatttttttgagacagggtctcactctgtcacccaggctggggttcagtggtacaatcactgctcactgcagccttgacttccagggctcaagtgatcctttcagcttagcctcttgagtagctgggactacaggcatgcaccaccatgccaggctaatttaaaaaaaattttttttttaagagatgaggtctccctgtttcccaggctggttttgaacttctgggctcaagtgatcctcccgccttggcctccaaagtgctggggttataggtgtaagccaccacactgggcaatatttgttaatttttaaattaactttctatatgctgctacaatacaagcttcatacaatataagctttttaaaaaatataagctttttttactttcttgtctactattacatctacattgtgtaggggcataactggcccatggtaaatagtaaatatttgttggaataatgtgatccctgagtccacaagcatatctttactaattggtaagggttattgggtctgtgaggtagtctttcattgtgtgaagacaattttcttaaatgggaactagcaccaatctctaaaatccacacacctgttagctactgatcaggactctgcctgtaaccaaactttagtttggctccctggagccctcttcttgattatgccttgtttttgggctgggagcccaattttagcaagaatcctgctgagtcagtttagggagaatcccctttgccccccacctttgatatttaatcgagttccttttagtaattttccattcaatgactccctcctcttcactttgtcctctggctataaattcccaactgctctggctatatttggagttgtgttcaatctccctcccctaccgcaatattttttttttcttttctctttcttttttttttttgaggtggagttttgctcttgttgcccagattgcccaggctggagtgcagtggtgtgatctcagctcactgcaacctccgcctcccgggttcaggcgattctctggcctcaacctcccaagtagctgggactataggtgcccgccaccatgcctggctaattttttgtatttttagtagagacaggatttcatcaagttggccaggctagtctcgaactcctgatctcaggtgatccacctacctcagcctcccaaaatgctgggattaaaggcatgaggtaccatgcctggcctactgcaatattcttgaccccctactgcagtagtttccaacaaaagtcttccttgtcatttttaacaagtatctgctgtcatttctctttaatattaaaaactaaatatttgccaactgggcttgtttaaatacacttagggaattttcattgctctcaaaagaagtttcatgtgttctttgcagtgtgaagggtcaaagagaggctttacttgtctctgtgactgaagaatatggtttctctagtatacagaagaaagaaagaatgaaggccacatgatttatttttatcgcctctatagttgtggctattatacaatttgtcacatttattttcagttgttcttgtggtgacattttaaggaataatccaaaacaatgttcaattcaaaacgacaccccaaacctcctaaacaaaagcaggttcagcatataaaatagtttcctcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtccgcagtccagcctgggcgacagagcgagactccgtctcaaaaaaaaaaaaaaaaaaaaaatagtttcctctctgccacataaccaatataactcacatgcagtccactcctgagatgatatgattatacctgcaacatcaaactcgatttccagtgtgaccttgctcgtgattgaagagtctcggaggagctgactggcttcttcgaaggtgctgtcttctgttggaattccattgatggccatcactctgtctccaatctgtagcaccccacatctaatttagaaccacatgtgagaggttgtagatggagtaaataattaccaagctgagcttgccaaatctaccttgcttgatccttgcaaaatagcatcataatttggtcttgcttattcaatgctgtgggcatcatataggtcaaattcaacgtcgtgtgttgttgcagttcatggttataattgtgagcaggggaatcctgaagtatcccagagaagtaattaataattcataaccatggtattgttagaatctgatccaaaccaatatttagtaatgatgaatgtatattcccccatggcagaaactattgaagttgaacttcaggatatgtttattttatggatttttctcctttttaattaatatagcttctagtcccttgatggacaaaatctgctagttaaaggcatccatgctcattactcttttcaaacctgatcaagaacataaaattttattgtcagaagacagttcatcatatcttgcatttcctgcattgagcaatgtttcataatttactagccattcaaagatagcaggtaccagaaacgcagagcagaaaatgatgctgtgaaagaaagtgtctcacctctctgctgggctgtcagcttcgatataggaaatcagaggtggagaagagagagtttctgtggcaaacacactgccctgcagttggatcccaaatcctgtgacaggatctgccgtcagcacaacctctgtggtttctgtgtgaacaacctgcccagccaatcctactgtgctggaggctaaggacactagaggaacaaacagaaaatactgactttaggttggagcaagcaccaggaataccagcatttccaaaatagatcatgtctctgcataaaaactgaatggcaatggtgggaggttaaattatggcctctggtttagcaagagttgaaaaagataaatgaatctctcaatattcatcacaattctataataacatcagtgtatccctgcaccctggctccctactcctcaaaccagggatcattgtgggggctttaagaggatggccttagggtcaggttacatgggttttagtcctggctctatcactgagcaccagctggggaaccttggggtaggccattttgtctctttgtgtgtctatatcctatctaagaaaaagggagttgagctagctggtttcatgttttttccactttagccatttgcatctgggctttgtgacttttaaacaatcctatcttcagctttgaagaaataattaaactaaatctggcccctggcgtggtgaggctgtgctggtcctcaaccttaatctagtgttgggttggcatgatgacattgtttaaactctgtacattcctcctgccgccccccaccaccaccccagagtttggtctcttcagtccttgctctttcccactgggtttctagtctaagttgttgtatttcatttatttcctattatttctcctctttcatttatctctctgatattcatctacaccttccagcagacatctccatcttatttccattctgaactcatgaaagggctgctccactcctccatgtctttctctcagccctgcccattggagtgtggccacccgtgctctctgtgagcacagcctctgcctgcaggtcctatgctgcactgagtcttcctccagaaagagtctggccccctttaactaaaacctgataacaccatatacctcataaccctcttcaaaagccattttcttttactccctctacaggtggcaggaagacaggttcataatactccttgctctccacatacggtacattgattcaactactcctatttaaaattccatattctgtacttatttctgctctgtctcattttcaagcccataatctactttttcaaaattctcccccttttcttcatgacttcaggacttgcctcttagtctgcctcctctaacctatagcttttccttgtcctctgcctctttgccattatgatgataaccttctagcaagctggctttatgcttcttcaactctcttcatgtcagttcctagcaataccaccctacttccactctctgccagcagagccctatggtggtctccatcttccttcaaaatgaatagatcttcaagatctcaatatctgaatcccccttgttgatcacataccctttattagccatctctcccacttcctgcaatctgtctcctctttatgactttcagtcccattccctctcacttgtctcctgagtctattgattttagcaacagatttttcccccttaaaatgaaaacatataagggatgcctttgtattccagataaaaacagctactgtagttgatgtgggaatgggagacccctgaggttttccctggcctcatgtggggatctggtaagtgcaggtggaaagccattgtcttcgcccactggctttgctggcatcattttccccacactctgcctggacccctggtgagcattttaataatgcatctcctaggctcaaagattcctaaacctcatgggattttcctataccctaatactttatcctctatggtaatgcccggtcaactccactgttgttactaagttgctgaagggtgctaggaaaagtcactatgaattcacaatcctattaggtccttaaattatttgttgtgtgatattttgacaccttatttcattccacaaaggatttgtctcaaatgtttctaccctaaatcatggtcaaatgttactcctcatttcctataagactgaaaagatgcaaccctttgacgagagttccttaaacaacattctgtttagcctcaatttctctttatcattatttgttccctcttccttttttcccccactacaggaggttgtatccttccttccatttcaaggctaattcccccttttagtgtttttaatactatccctttccaccccccatgattttgtgccatgaaaaaatttgcctcttgctgcttttccaaacttttctgctcactcccccagctttctgacttctgtctatagacgtgtactgattctgaagtggctaaaaacttggcttctgccttcaccatttactgaaactgctctcaccaatgacttcctgacttctaaaatcagtggcctcatctgctctagctggcgactggctttaggaccatcccttgctttctaaaattgtttgcttggttttgatgaaggtttgtttcgagtgtcttactttttcagccccagccagttgctttgcctccctctgcatttcagcgcacagttccatcctccaagtcttttctactctcattctttccctcattcatgcctacatgtcttctgcatgtatcttctcaactctttctcttgtttttgtcaagctccagtaatggatctccctccttgatgggtatgccatccacacactctctcattggctcctcaaactcaatgttttcaaaattgagcgaatcctcttccctctctcattgccactactatttctgtgaacaggaccatcatttttattgccctctgggcttaaaatctcaaagtagccttaactcacaactccccattgtctcaaattctatccattgctaaatcctttctggatgactagtgaaatatatcttacaaaaatcctcttttcccttattaatttcagtacctcaatttgggctttcattattttttatttgaattattctaatgtacttatttctgggtccttacatgcaaaatattccccacatattatttccagatgaacctcctgtcaaactttccggatatgatgaggccccaacttatttactctgcatgtatcttctcaactctttctctttagtttctgtcaaactccagtgatggatttccctactcaatggatatcccatccacaaactgtctcattggctcctcaaactcaatgttttcaaaactgagtgaattttcttccctttcttattgccactactacagagcaaggcctcatcatcaccagtgtacaatactggatagacttctaactagtgaccctgcctcttgttttatgctaacagcctccaattgctgctagggtagcctttctaacatgcaagggtaacccctgccctgttttgaattttcaatagcttcctgtttcctatagaacaaacttttcaattctagcagagcacataggacccttcatcagttcctttctcctgcccatccactctcctgtttctctgtgatcccttcatgtgccatgtgccccaaccctcttgacacacttttgtgtcttcatatatactgtgccctctgccactcagctcttgctctgggtccttttctctgttttatccaggcagaattaggtacttgcttttctgcatttccacatttctaatacatggtcccgtttcagcatttatcaggtctctatatgcctgtttctctccacctgaccctgagtttttgaaaggttggaaccagctctttcaatctctgaaatcttagtgcctggaagattcaacaaatgctgaataaatgaggaatgaatcaaattttgggatgtcatctacatattccttttaggaaacaacacttctcatagatgctgctgagttaccataaggaactacaagtcattcttcagggcccaggtaattgcagctgatggggcaagggagggtgaagtagatcatttgtctaggaggagtaagaaaaaaaatcgacttttccttaagaagcaccattctcattccatctcagctggattaaggttaacatagcctgcagtggggggtgaagatagcctccaaccctacgcttcttacaggtggaagcttgcaattgccaggtctgacacatagactgtcatgtattaatttagatcacatgttctagtgtggtttcgctgatgtagagtgtaccgtgattactctccagataataatttttgctatcagtggcaccaaaccactgggagacaccatttcctgtcaataaggatctggagagtatgttgcattccagttattactcacagaagatgagagtatcatgttacagcatcacctatttggcaggtaacttccacttatcttctaggtgaagctttttggacttaatcagtaatcctttactttctttgactcttttataggttcatattaatttttttttccatttgagatcacaatttgatacagattatcggactacttaattggagttaaaagctgtttcagaaactttaaggcagctgtttaccatcttcactaagaaagagccaagagccgggcgcggtggctcacgcctgtaatcccagcactttgggaggccgagtcgggcggatcacgaggtcaggaaattgagaccatcctgactaacagcgtgaaaccccatctctactaaaaatacaaaaacaaaattagccgggcgtggtggcaggcgcctgtagtcccagctactcgggaggctgaggcagcagaatggcgtgaacccgggaggcggagcttgcagtgagcggagatctcgccactgcactccagcctgggtgacagagtgagactccatctcaaaaaaaaaaaaaaaaaaaaaaaaaaaaaagaaagagccaagaaaaaagaagtcagtttaatagtaacaggtgagattatactagatatagtgaagccttctcaaaggaaagacttgctatgtttttttaaacagagaagatagttgaataattttattctctagaaggttttgaaaataagtactaatttaatgtgaatattattaaatttataagctctatttggaggcaagttgagatgataaaaattattagaaaattgaatttaggatttaaaataaatttatgtattatgtattggttttataattagttataatttatattatacatatagcattgtagtaaataatttatgattttataattaactctgaaagtcttctgacatattggaatcttttatttgacaaagagcaaaatttcatttgaaattatatgtattgattagttacacatataaaagttttgaaaactattaccagatatgaaaaagatatattgtgatttaaagataaggaatcaaaagaaaaaaacaatcaatattaacttggaggagaaaaaaatgagcttgattatcctgcttcattaatgtggtcaaccagcaaagtaaatgaaggtgaatattcccccgtcatttgaaaatgtggatggtgaattgtctctctagtagcagatgcttccgcaaggtattcagtcgtcattgctgcaagctaccggctttggctgaggcttgcctactcctcaaggtgaagatggaaatgactaaattgctgacatcctaactggtgtatgccgaggttgtgttcaggattcgttcctgctctgtcctgttcccattctcacatggagggttctgttcacaactcttcagatttgtagggaatgactacatttttgtcaattcttgttcttcctagtgtaagaaagggcagggggagccaaaaacacctccaaaagtttaaaaatttaccaaatgcttatttaatttagaaggctgaaagatttcctatcagctatgagaagcatttaaaaaatatagagaactaaggaccccaaagatttattattataatctgttttttttttttttttttttttttttttttttttttttcagataggctctcactctgttgcccaggctggagcatagtggcagaatcttggctcactgcaacctccatcttctgggctcaagcgatccttccacctcagccccccaggtagctgggactataggtgtgtgccaccacacctggttgattttttcttttctcttttttgtagagacagggtttcaccatgttgcccaaactggtctcaaactcctgggctcaagtgatccacccgcctcagcctcccaaggaataatgtgtttttattattgatcctgtaatctaagacttctgtctcactaaagtgtcccacactatagtcaacctgccatagacctaacacatgtgtatcatgtgatctggttcaggaacgcagtagaggtggccaacagctcctttgtccaaatgagggtgtgaggacagttcttagggtgtcttcttcagggctccctgaatggtcacttataaaagcttaccagtagctgcctttatcttccattctttgttcccaggtcaatagaagggaccagaaaagttgttaggttttttcattttctttccttcagctcttttcaatggcactctctctaatagtagttactactgatgacaaaagcagcaaagaccattctggaaatgtgttctaacttctactctttgccgcaattcaggcagactgggaagagacggagtctctacactggcccagggtacagtggtggggaacagaaagcagggcaaactagctagatctgttgctcagccatgctgttgttacagggagatgatgaggttctggaaggagacttggcctctttggcagaaaaagaggcagcacaggcagccagggaaagggcagtaagattccagcagaggagatgagagggctccctctatgacatggcttggcaatgcctccagggctttgtgacacttgtcaaagcctaatgtgtgctgtattaattattttctctatgaaacaaacatgacaccttcctgttttaatacttgtaacacatcactatatacagacttcttgtatttcctctttgatcagtgatacagaatgttttaattttcatgtgagaagatttcattttttttctgggcatctccttccttggcattggaaatacatatgagcattttctgttttgcaaactctggcctcaagtcatcaccaatacagcaaagagactttttgccatgattcaccatctacacaaatggcctggttgctatagaaacatatgtattacaaagggggcagcaaatggtggcacaggataaagacataaataaagcagtggaaataaaccatggtatactaagagtggcaataaaacttttattatcagttatttgggaagacctttacatctaatgtgaccataccaaacctatgcaataaaagaaaagaaaaaaatcctcacttaaaaaaaacaaaaaaacctttgcaatgctatcattttttcaggtctttttgaagtgtgaataaaagttcatagcattttggaatttatggtttgaataaaatacaaaatgtgtgatctcctgagacacatttataaacattctggtatgtttattgtgagtggtgctctagtggccaatgtctacagcaaacacaaacaactagaaatgtattgaaataggtatttctaccatgttgaagaataatgtcctgattcaagagagaatttatgcgttggttatgcatatcagtgacagcgctgcctcagctttgtttcctactacaaaatttaagatatgaaaatatcaacctgagatagccaaacatcatttgtttgtattcactaatgtccctaatcaacacagcaagtcttacctaacacaaacaaatactagcctttgaagcagaagtatgaacactaatgaattcattttaattgctcttccctgctgagtgctgttagcctgtttttgtcactgaggagtactacacacaaagccattatctgttaaaaaaattcatacacaaatacccaccacaaaccctgaaggcattacatagaagactaaagatctacgtattatgccaaaatgtacccctcgttaaaaagattgaactttgagagcactgtcaagagattttctcatgtgacaattcatatttaggccgatgacagttaacacaaactattcaaaatagctaacaattaaattgtgcttactatttaccaggtgttgttctaaacacatatacacatgcaatctcatgtaatctcaattacccaatgaagtaattcttcctattttcagtcaaggcatacctcatgcagtcttcacaattacccaatgaagtgattttccctattttcagttgaggcatagagagtttacagaagttgctcagggtcctacagctagaaggtaatgatgctgggatggaacccaggtagcctggttccagagtctaggcttataaccagttcactgtattgcattcaactagtttcttccaagagtaaataatttactctagtgtcagctaaaaaacacatgggactccaggagtactttgttctcattttgactaaactcaatcttccactttcctaatttcatttttactatcattttcatataccaaagatgacaaatctccttatatgtaaaagtatgtgcaagtctaaatcatgtacaaaccacagtggtgaccctgtcttatgcaatggagttcactgtagggaaagcttcagtttcctgtatcatgaagaaactagctcccagtgtgggtgatagctggtcttgggcacttagggtggccctggtgagactggagagagatcctcctggggagatgaatctcttgcaaacaagctgaaaagccagtaagtccataacagctgtgaagtatctggctttggttttatttaagtaacttaaggatgttccttatttttattcccatggtgagcacaggaagagatcccatcttctttaaatttctctgtttaaatcataatcatggccatcaaaagggatacatgacaagaaacagactctctagactatgattaggtctagttagaaaggtcagtgttctcttcttccacaagttatatgatcatgataagagagaatgatcttccccaatagaaacgataaatgtaggagtgatttatatttctttctttttaaggcattcaatcaccttttttacccctctattcagacaaccagctatcccaaagcaagtagccaactatatcttcctagttttgcttagtctatatcgtgtttggctgtccagatcatttttacaagaatcatggttgaaattcctagactttaggatgcttattgtaaagctgagcatccttccaatcttccttaggctggagtggacagtaagaagtgtatgttagatcactgattaccagtggggtaggcttctggaaaaagtattggagtcttggggaatgagatatagtttaaaagggaatgttcatatttatcattgttttggggaggagggtaacaaaatataatttagtataaaatttatgacaacattaaatgaatgcatgagaatcttatatttatcaaaaggggagcatcgttttcacaaaatttctttagaatgagtaagaaactaagaacaaaggtttcatgtccaaagccacccagaatataataaaaggagtcttaaaggaaaaatcatatctttgggtatgttatgacatcaaaagagcaagaaaaatctcaaatctcaaataaaaagttgtaggcaaaggtagtatgaatgaattcagtctgaagttaaattggggtgcagtcattgccaaacagatactgggtatcgtgtcaacggtctttggcacagagctgttagctgctcagcatctacctgatcacttaagcaactgtgaaacactcttcccacaatttcggtattttcaaggctccattgcccacaggttttttccaggccaaatgccattggctgtcatttcacttacatgagcttttgaagtctttctttttcagtctcctcctcatcatggttccacgtgggctggtggagtagaggcttcgaggtagagtccccatgttcagggaactcaggctgtatgcactcatggaggtaggagagaaggatgaagacaccaaagctgctgcaagagagtgaagacgttgcacagagcactctcaggtgaggtgtgagcccgccacacttgtcaaccagtaacaatccagaaagacacacatgatgcatagcaatggctaggaaggaccccagccagctagaggccagctctcaggagcatgagacaatgctttacaagagcctacaaatgctgaggggcagcaggatctttataagctcataggaacacaaagagactctgtgagaattgctttaaacaaacaaaagaacaactttgtccatgaacaactcaatgcatcagatacataatctcattttcatattttctgacatgaatttcataagtgattccacatatacaaagaagacctgagaacattgtctctgtataatattctgaattgttacttcctgagccacatataaagcattctgaacatttacatcctttcctaacaacaaatgctttctgatggaaaagaaaaaaacctaggagatgtcagaaatgataaattgctactataagaaacagaaaaaacaacatccatgaagccaaagatgagaaaaggagagtgtgagaaaaatataattgaaataaaagaccaggaggagaaagcatggaacattacgagggctgtttggaggaggtgctttcgggaatgtcagggctggtactctgcaatggtcagggtggtacgtgttatagtgatggttggtgtgaaggctgctgtggttgctggcccaggaatcccaggtaagttgcctgtcgctcctctgaattttcactgcccatatgaagtgatgatgaaaaataagaaaaacaaacgaacaaacaaagaaccaaaaaagaggaaaaataactgaattgcccaaattaaaagtataacaaaaaagaaagctgcttgcaaataaaaacaaatctacttggctttgcccttttctcagtggtcagcaaaatagatgattaacataaaggatgtaaacttttcatcttcccaagaataatgcatatctttcctcagctcgttttttcttcttttaagatgactattgaatcaatttctaatctccctcagtgctttgcagctgagattaagaacattttttttaacttaaaagtcagcccctcaaagatctatggcacacaattagtaattaaagatttgcaaatcttggccagttagtagcacttgttttgagaaaaagaaaagaaagagcaataaatcacgttggtgcatgattcaagtggtttactagtcacacatcagaatttactgctctgacattttaattgcactacaatccatcacttggacttgattttcctcaacaataaaccactctaatcatctatcagtatcagaatcttatctgtatctcgactaataaggagaagataaaagtctctatattttatgattttttgaaaaagcatatttacattagaaataattattaaaatatttcacgtttttatatttccttgatgccataaaattttaataaagtttatttcaaactttattaaaatttcaaattgccgtcccttttatgttttagaaaatctttatcatgtttccattctagcttcaatattaagatttgatattccacccagtgttctgaaatatgagcaatataatgtttgttattatgtctgatatgaagtttttcatttaataatcttaaagaactcaaaataacatatgaacttattttatttttctagagatggggtcttgctgtgtcacccaggctggagtgcagtggtgtgatcatagctcactgtaatcttgaattcctgggttcaggcaatcctcccgcctcagcctcctgagtagctggcactacaggcccacgccaccacacccagctaattttttattattttatttgtgtagaaatgagggtctgcctatgttgcccaagctggtctcaagtgatccttctacctcagccctgagttgttgggattaaggcatgagccaccatgcctgacttaacatatgaatttatatctccttctactttcatgattttggtgttaggtgtcttacaagtgaatatgtagagaggtgaaatactctatgcattgaaaggacagtcgtttagataagaacttaagttacatcaactgtgatgccagctgaattggtcaattcgcatcctttctagaatgaaacaggacatgaaaaaaaaagcactagcacggacagatcactgcggggtgaagcagacctgggtttcagctctgcctccagcccttcctctttgtatgaccttggccagctactcagccactctaaacctgaatttcctcatacgtcaaatggagatcatgaaatcatctacctcacagggatattgagaattaggcaaatacggtgcttagcatggtgctggcacacagaataaaaacaaatgagtttagagtatattgatttgtctacttttccatttacgtgccaacaataaagtatcttttaaaggaaataaatttatttttcactcaacaaatttcactcgttggacatttaagtttagagaatttctcagaaatctgcagcagaaactttcatagccactataattttgttaccctaaaccatctggtctgctccttctactcaactgccctgtttgtggtttggattccccctctctctccactttcctacttcaagctgccacctccttcatctaggccactgtaacaccttcagacatggcttcccaactcatctcctgcatacctaccttccacaacatagctagggtggccttctaaatatataagttagatcatgccactcctgtttgaataggttactttttttttcttttgagacagagtttcactcttgtcactcaggatggagtgcaatggtgcaatctcagctcactgcaaactctgcctctcaggttcaagtgattctctcacctcaccctacccagtagctgggattataggtgcccaccaccacgcccagctaatttttgtatttttggtagagatggggttttgccatgttagccaggctggtctcaaactcccgacctcaggtgatccgcctgcctcggcctcccaaagtgctgggattacaggcatgagccactgcgccgggcctgaatagctaactattacaaagagaatcaaaggcagcccctgcctatctctctagtttcatccatatcactctacccatcatttgtatattttagccacactgatcttatgtctactcttagaacaagtcaggttccttcctgcctcaaggcctttgcacttgctgttctttccccagttgtttgtatgactgcctccttctcatcattcaggtctcacccgaggtgccacctcctcagagaagttgttgctgatctccctggctgaaggagctgccctccccatgctatctcattactgttttacattcttcatggtacttattgctgtctgaaacagctttatttatttaatatatttttaatgtttgtctgtctgtactagaatgtgaattctataagagtagggatatactttgcctgtcttgctcactaaatatatcctagcaactagaacagtgcctggtatataatgactaatacatgaatgaatgaataaacaaatgcatgaatgaacgggaatatcagccagagtgtccatgtgaacactgcagcagcattttccttgagacaaaagagtatttattgcaggagatgtccctaatggattctctctcaccatcctcattctactttgggtgtacaagaagacatttcagcaagacgcagttattactgtgtttggccaatttacaaccaccgacactttagcgtacttttcacaaagtaccatctgtgtttcaaatgaagccagggtacggtgaatgcacttcgggattctacacccaccttttgacccgcttcttcattgagagctttgaaaattactgggcatttgttaggactgtacagcacaattaataagtcaataaggaagatattatttaccagctattgctttctcagactgtgccaattgctacaggcaggttaaaggtcataccatttaccttgactttgaattactactggggattaaatcttcatacatataaaataattaagagacaaaaatgatataagataatgcacaaaactgtatgccatggatgatgaatgcaaaaggtgttgaacaaataatgtaggccagagaagagagctgctgcctattttgaatgtacactccaaatgttttctgttttacagtggtgtacttgataggcaagtatttccaaagtttaataataagatgttacatttttggcatgtcctgtcattttgcaaagagcacttatagacattctctcatttaataaagccaataattgtagcctactttcactgattacttattatatactaggcactgtgctaggtgctttttcatggattagctcagacaatgttcacaatattcctttgaggcaagtattattatgacccccattttacagatgaagcaactgaggtatagaaaagttgggtaacttgcttaagaccccacgtggtggagtcagaggtgaagctctggacacgtgatcctaaagtccccgcttcaaccaccagacataccgcctcttcctatgggtatgtctaagtcccttgttatggataagaaaacaacacatttaaaatattatggttcttgtatcattccatggtgacgtcactactgcagtctcaagagatatatggccacagaagttacttttctttcttctttctctaattgcagcctcttactctgttcaggatgttcgagagagcagaccacagtggttccaggttgccctggagctctcaaatggaaggtcctcctggtactgaatgtgtcgagtctagtgactctggtcacattttcctttccaaaacgtcagtttccttcaatccaattatgtctcctgaaaaccctcagtgggaaaaatttctaacctcactgaaaactcatttctgtcagcttctttaatgctgctatttatcagtgaaaggcatagctaatctcttatcccaagttgagatattcatttccacactggcctgaaaactctgtggtatatgctttactgctaacacaatctggaaatttgggaagtgtgttgagagacacactgttcaggcatcagagatcttgaaaaaacaatcagaactttcttgtggagaaagggtaaaactatgtaaaactccactagtcaaaaatttgagaattgtaaacacaataataattttttgtttgtttttcttctttactatgatttaattatgtttaggagccaaaatttatttcctcttggaaatccaagtctgattttaatgtgcaatataacggaaacacctgcttgataagaaagacagtgaacaactttcagtaaacgtagacgatggagtcagaagtggaagctagaattacttaaacttcctatcagtttcctatccctgcaacacaaacgacatcaggttttccacaataaaggcaaaaaatttgtgcttagtccatatattttagtgtataaattaaactcaaattgccttggcaggttaaaaaatttaatattccatgagttgaaaacacttgaattatttatgaattgtatatagggccaattaaagaaaaataaaagagattactaaagatgctaacattttaaaagggtctggtatgcatttccgattcgctgataccagaatttagcaagcaaaaccccatgctgagagagcactacacagtgtacattcttatggctactgtgctccaaatccaatgatgactgccgattaatttaaagaaacttaaacagcttcagaaatctctcctctctgccagagtgcaggaagggcccacggggcctcctgataggaatggtgtgcatccttgtgaacggcaccttcctacagctgtttgcattgctattccaatactgtgatgctgattttcttttcataacctgcctatgctgcatcatttctctactccaatgtgtaaaattaaaatctgataagggtaatgttgtactagagattttcattagcttcagggctgtctaagctccatttaattaaaaaggttgcatccagctgactgatttagtatgaaaattatctggtccctctttccccccgccccagactgtggagaagtgtagtgcattttaaaaggtgggagacacaatacaaatgaccccctcataagcaaaatttcaatttcagagaaaactgcactgtgtctaaatatacagaaatgcattatcctccttcaggccaccctgacaatactagtgaggcctctaatttcaaggagtacaaaggaatggtgtttgctttaaggaatagggcaggagagggagtcggaacaaatatcctactggaaaacttgacttcatttgatttggggctcaaagacccctttctcataccaggttttgcctaaaggtgcctaggtagatggtataaacacccagcaaatgtatctgtgaatttcaagggagtcaaaatacagataccttcagctgacactttctattgaataaatggagttaaatattctgattctcccagacaagatgtttgctcagacaggttgttctctatcctaagaaaaaaactccactggcaaaagacataatatattgtaaaccaaggcttcatataactggttccctctgattcctgccaaatatttgaaggttctgctattaaaatccactttacttatttatttttaagtgagagctttactatttgccttcattggccttcatctaggctggaaattcaaaatgtataccaggaagtcaaattattttccttgtctgcacattcaatttgcaccaaagacttttttaagaaaaaaatatcaaatagcactagcctgaaaattttttcctcgatgttagggtttcaagcaaattatgtgtggcttagaaaaaagactttggaagatgaattagagtaaacaaacataaccttgttttgaaaagaaatgatgagtctgaccaacatggtgaaaccctgtctctattaaaaatacaaaaattagctgggcatggtggcggtcacctgtaatcccagctactcgggaggctgaggtaggagaatggcttgaacccaggaggcagaggttggagtcaaccgagatcatgctactgcattccagtctgggggacagagtgagactccatctcaaaaaaaaaaaaaaaaaaaaaaggcagaatgagacccagtgtctttctgctgtctaactctgctagagggagcaacactgtgagggccagagaaagagcttgatccaggtggaccatctcaccatggtcgggcccctttagggccagccgggtctgatgatggggaaggatctcaagcttgacctggtcagtggtgttggccaggaactgggttgcttctgcaagtgtacagtactccatgctggttccatcgatggagaggatgtgatctcccacatgcaatgcgccacatctacggaaaggagaaatactcggtaagaggcagtgccttcctctttggaatctgactttcatgtccttcatagttaaaatttcacagtttttcatttacttaaaataaaagaaaagaaaagtttgagtgttataggaaacaccatctgccaaattttaagtaccttgaatatgaacaaggaagtaaaaccttgtggaaaatagagaaaaattcaacgaaatgttttctcttgtctttctttaaaaaaaaaatcttattttggagtgcttgtgtggaaagttgagggaaagcgagcaagaggaaagggaaaaacaggaaaatgtttcccctggacttttgtctgtgtttttttgttctaggcttttctatctataaacatgagtgggtaaatcttcagaatctcaaacatgactctcagaattggaatagggtctattttatgtgtaaagaagaataacttggggagatttcagtaatacttccttggaatcctcacacaaactccaagatcaccagttctttattattatgttattctggagttgaacatgtattagtataaaagctcttgataatggtagaaattatgcaggagtcaagtgagtaataaaaccaggcctgcatggtgagtcaaggggaaagatgggggcagggaaggggctagctgctacatcttgctgaactcaagagctggctactggatgagttaagaaaagctagcgcagtcgtcagcatccccacataccagtcaagtgaacagctccttaaactggttaccccctgtggaatgggaaaaaacagagggagaaaattaaagcatcctgtgccattgaactgcacaacacccctggatcaatggctgtcactgataaggactgaatgttgggtaagaccacaatggagatgtagactgaccactacggggggttgctgcagttcactgcaccatggctggaggtggaaaggcaggttgaggggcacgtggagaagagggctggaaacatacaggggagactggtcattcaggtgcagtatatctataaattcccagtgtgaatagtctacgtctcaagacaaaagcatttcaagtcatatcttccaactaaaaacataattccacattttttgcacttggagtgctttagctatgggagatgaggtttttcttaccaggagctgtaaaataattaattagatggaaaggtagtctttttttatcttccccttttaccttacgagtataaaatattaattagaaacatgaaatttcatttttattgtggcattgaagcgaatgatgttttaagacaccctcgaaggttgtaaaatcctaagattaacatgctatgagagtataggactttttaaaagtattgtaaaaaatattttaaaaagtattgttttatttatttaagaaacaaagaaatcagattttatggtagcaggatttaattgtcaacaattcaggaaaacccatcactgctctgcatggggtttaagaaagatctactcagctaccctacattaagaacaggctagtgccctaggacacagtaagaaaacttgcttagttgcttgatttttttttctattgctaaaggccacaccaaacatctggatgacgtgaagtgacatcatggggtggctgacacataggtgaatttttaagccctgtaacagtaacttgcttctgtgtgtgaaacctgtataaactggcaagagaactgtgtgtgtgtgtgtgtgtatgtgtatatgcatgtgtatatgtgtattacaagtgtgtgtacatatgtatgtatatatatttaaaattgcacacatgcaattttgtaaaggggcactttctttctttctttctttctttttttttttttgagatggagtttcactcttgttgcccaggctggagtgcaatggttcagctcactgcaacctctgcctcgcgagtttaagtgattctcatgcctcagcctcccgagtagctgggattacaggcacctgccaccatgactggctaatttcttgtatttttagtagagatggggtttcaccatgttggccaagctggtctcgaactcctgacctcaggtgattcacccgcctcggcctcccaaagtgttgggattacaggcgtgagccactgcgcctggcggaaaagtaggcactttctacaatacttacctgtctgcaatacttgcagatttgattttgtctatgacaatgacttgtttgttacagcacatcgaggtagttagggcaaccccaaggctggcaccaggagttttggcaacttcgactagtagtggcccggatgctgttgccacagagtctgtcaaagaacaaattttagaaaacaaaacaaataaaacaaataagcaaagagacaaaagaaagagatgaagaatattcagtttggtgttagcctgttaattttatcactgaaacttagatttccctccatataatatccccacagccaataataaattcatagggcacctcttaacacacctgttccattcagcttgtattgtgttaatgtatgtgtaatgttcatctcttcaatgagattttaagcttcatgtcacttgggataatatcttatgtatctttatcccctccacagtgcttggcacaatgccgagcatatactaggtctctcagtaaaggttttttaaattaattacttaattcaataaatatcttagcacctaccaggaataaatagacggatggatgaatgaatggatgaaaggatggatataaaaaagaaaggaaggaaagaagaaagaaaggaagggaggaagggaggaagaaagaaaagaaggatggatgggtggataaataaaagaatgacaagagggatgggaggatgaatggatgggtagatagataatcagaagaatggatggatggatgatgtctctagccaagtagtaggaatgttacactaagttgaatttgtaaagcttaacttcatatatgctttatttttggcttggaacactctttgttccttcaactccttctaacatttgcatactcaatgccaacatcaattcctcgggaagcctaaattgtaatttggtaagatgcttttcacatgtgcttctacagcctgctctattcctgctgttgtagcatacatctcactggttcatagtggccagtacggacgacatgcctgtgttccttgccagattgtaaacatgcttgaaggtagagactatgtcttgtcaatcacagcattctcagtgcctagaataatgattagcacatcagaggtatgccactaatagttgtggaatgaatgcatgaacaaatgagaaagctcatgatgttgcttaaagctcattagagccacagacacaagggaaagagtctgggacacagaattaaaacatctggattcaattctcattttcacaatatttgtgtcatggtatctaagacaagactagttactaaaactttcctttttttgtattttgataaaattgacaattaacaatactaaaactttctaagcctgcttgcttacctatacaatggtatcttttccacagtgtttattaaaaccaaaccaatgaacaaagcactttgttatacatataggatattttcattattgctatattatgacctcaagcctttgagtcatgtcatttttcaagactgcatattggtctgtaatctttttctaattttcaactgttctgatgtttgacactccattaatacaattttgcctttctgcaagaacatctttgtcatcaaggccccactcagatatagtgaaataggaaatctgtattcccattgctgaagctcaggtaatatgcactgactcatgaagctgaaaggtccatgggagagagccatcttcagtttgagataagatacttattaaagtaaagatgacaatatccaggccaacaacatgcatatccagtgctaaggattcttgtatgtattaacaccatgtttcctaactgactggtaagattgaaatgttagtccttaaaaaggttaagagaccatcagggcctatatctcttcctgtcaattccagagcagagtttcattaataatatctgcaaggagccaaaggtcttaattattaaggagagtttttggctctggggtattacaactactccagatcctatggttgatttgcccataagcctaactatggtggatgctactctctgctctcgctcaccttgatgtattaattcccctgatctcctgacatcagactagggccaatgacaatgtcctggcttctctctctccttctccctcatttgctgctttgtttctctgcagagtctcacctggtcattgtgcgtcctgccttactctcatcttggagttttcagtgagtgggccccatggctatgtgcaatggtagtttgcacatcatgagccttagtcaggagaccctagtaaagaatccttgttagtccccgcagcctctgttttagttgtccttctatcactaaggtggttagttttgcccacctctcaattttaacaaagatctgtggctgagcccagtgcacacaatatgatgcctctggctccacccccagcagtcagccatcatccttctgttccttaagcacgctgcatagcaacctttttctgctcagccaaacctcacatgagctctggcctaccagggccttttctcacattatctttctagaactttagaatgactaattttgatttctcaaacccactttccatggtcttgttggattttaataggtatgtttgtggggtgacaatcacttatgtttttcctcatggttttgtcatgtctaaagataaatttattttacttaacaggtgaaagtgataaagtttctatattacttattaatctcttttaggaatgacagaaactgctaggtgttccctgatatctcatcttctcttcttttgtcagtaatagggtttctaagttttagctgagcaaatggctgcccagttaagaaccacatttcccagcctcccttgcagcaaggtgtagccataggaccaggttccagccaatgggaagtgagatgtgactgtgttccaggatgtgctcttaaaaagaatggctgtgcccacctctccctcatttcccccttgctggtggaatgtgggctcagaactggtaagccatcttcaaccatgcagaccagggcatcaagccatgagatagatgaagcctaggttcctaaaatcttcagggatttctcaagagattgagaaagaaacttctatcgtatttatgtgagcattgtgagtttgggcctttgatacaatgactgaattggtattccaataggccttttcatttgagaggactgcgccaatgtatctgtcttgaactgtttttataagaagtggctatttaaagtaggtatgtgcagatgtaaattttataaaactacaaccaaccattacccaatactcaaacaaagtattcatttttctaaaaagtactaaatcatgattaaacatgagagtttttaaaaaggtcatcaggatattcaaaaggtgtctaaatataaacccttaagttagtttttttttttcatggcctgtatatttgccaaagtattaaaacttatatttttgtggttttaatgttccaatgatcatgaagaattaacatgaaattgttctggtagaaagaaatgataggagtaggagtattaagaagcttaggaaaaggatgccagatcctctgccatcattaatttagagggtgtgagagagagcatccacagcttctacagtatgcttctgtgactggaaactagaataagtctctctttaagtacaacttgccccattaaggcttgaaaaaacaacaggtgtaatatttccatttgggggatgcaaatatgcaattaatgaatcttttttaaaacttaaagtagaaagctttacagttctgaggtaagattaatttaaagtcatggttaagggaagaggcagtgtggtgctacacaaggctcaaggctggagctgaggaccagctagagggtggttcttgctatatcatcaactcagcatgtggcccgagccatcatctcccttagacctcattttcttcacttgtaaaatgaagagatttgaataaaatttccctagtcattacaatctgtgaatctacagagaaataatgatgccagttaagtagctagccagagaaagttaaggcaggttaaccaactttatgaaaatatacagtagctagaatctaaatcccagtatcctacaatcaatagaagagatgagtagctagatagaaaagtgattcttgataactatgtttatgaaggtgggataaaaatcctcagaccttcaaatatttgtatgacaataacaatatcctttaaagactgagtttggagggatggcttccaccttcaaagagacatcacataatatgaagcttccacattaagaagtttccagggcacaactacaactttctagcaagattctatcatagtaaggtcctaatctaactaaccagaaaaaaaatgatgaagaaaagaggatgtttatctcatgaaagacaatcagggcttattgacaacagtctacagaacatgagctcagtcttgtattctctcacctcagtagcccacagtttcacttacctcagtcactcttaaatccagcacacatcattcccccaagctcctatctgtcacttagaacaatttttggatatctcctaggaacactgacacatgtcccaaactgaagagtgagaccaccctactccactgcttctgcaggtttccttctccagtgatgggttcacgctgccctccatcacacagaccagaaacccaggagccatccctggctccatcttctcccagatccttataaattcctcttgattttaccccctaaatagctctcaatttcatcctttctttccatctccatgatcaccaccttagcccaacttaccatcatctgatttccccacatcctctcatgcccttcaccttccccaatccagagtgatcctttaaattgaatatctcatcacgttaatcccaagcttaaaagctttccacagctgttctggtaatggagtacaggttcttaacatggtctacaaggacctgcatgatctggcttctgcttccttcaccagttttgtcttccaccattctgccctgcttctctctgttccagtcctgaactcctattttagtcattcaaaatgctgtcagccgctgctacagtgccttcatttatgttgttctctctacacagaatgccccacctcttcctgtcccttccttcacctacttttttttttttttaacaactgctctgctcaaatgtcacatcctcagggattactgccctgacctgcaaactatgtcaacctacccattatacactttaatagaaccctatgtgaatgcagtggacacgatgaagaggacattgtttggctctaggagaatctaccagacctgctcatctgcaggggactctgggcaaattatgttgactgacagctgaacaagaaccatggggtagagtatgctgtttaagtcagggtcccagcaagcaacacatggtacactcaaattaggataacttgagaagagtttaataaaggaacaatttagaaaggtgtgagaagcttatagggaaactacaagggatgataccgtactctgggggcagaaataatagggaccataccctactaagcctgaaaaggcaaagaatagaattgctagtagaaccaggattcagaaaagcctaaagtgatgagggctccttgacatgagctgggaccttcagtcaagggaccagtttcagtgaacccacaaggacgaagtcgggagagtaatacttttcatcattgtcctcccttcctctgatcgactgccatgattccctactagccaaactcaactggaagccagaaggcttgagagcccatagtgtagaccatataggtcatggcagagcagcaagaagggtggcaagtggctctggaggtaaaaaggagggtattcttatttgtatttatctctactcatctttacacaaaaatcttgaggctgtttgcttgaaacaaaataagtaatacaaagaaacaaccaggaagagtctacaaatgccctaccacaagggttaacagaggtgcagtttgactccactgcaagcatgacactggactataagtaaatccataggtacagaaagtagaagtacaattagtagttaccagggttgctggggagggaaaaatgactgcttaatggatacaaggtttccttttgggatgataaaaatgtgctggagttagacagagggaatatttgcacaactctgtgaatgtactaagtgccactgaattgtatctttaaaatgattaattgtatgttatgtgaattttgctccaataaaaagaatgactcaatttcccagcaacctgaataataaaggaaacataatcaattatgcagttctcactattggaaaggagaaagtctactagtctctatggtggaaataaagatgattctagcagagagctctaaaagatatccctctcatgggcttttatatacagatggtggtaaatgatataatggataatgccctcaacacattttatgataggatgcagaggtagtttccaacatctgttccctgatcaaggttgagatataagattaaaaagcaaatcaatgatggtgtctctagaatgggacgagataatgtattggtcaacatgatctaaaggtggatcccagggtcaacagactgaatatctcttgggatctttgttagatgtcaatcttttctctcacttaggttttgaaaagaagctggatattagacaattcaaggaagtcccctgtgataaggcactcttatgctggcattttacataagtgactaggaccagatccatatgctttgggcatcagatgaatcagcagcagcattaatgtactatcaggaggctggggaagcctaattatattcttgctaggatagaagtctgtccacctcatagtcccatggaagtggactttctaagttgtcatccattcaacaacatgaacttaaaaactatatttactaactgccaactatatgccatgcacattgaaaggtagtggggattcaaagatggacatttactattccttctttccttctagtaaccccttgggatcccatgccaagaaggtggggagtagtgctgaactccttgattccactaaagaaatatattctattgaatctcatgaagtttctagttacttttttctttttaacatactgtttgcaactcctctcttcctgcccaatgaaatctttaatatagtatggtcaaaatgcttacaaaaatattgagttatctggtggctggcaagatggtcaaataggaacagctccagtctgcagctcgcagcaagatcaacacagaaggcgggtgatttctgcatttccatctgaggtacatggcttatctcactgggactggttagacagtgggtgcagcccatgaagggcaagccgaagcagggtggggcgttgcctcacccaggaagcacaaggggttggggaactccctccccttgccaagggaagccatgagggactgtgctgtgaggaatggtgcacactagcccagatactacgcttttcccatggtcttcataacctgcagacaaggagatgctctctggtgcctaggccaccatggccctgggtttcaagcacaaaactgggcggccacttggacagacactgagctagctacagaagtttttttttcataccccagtggtgcctggaatgccagtgagagagaaccattcactcccctggaaaggaggcaggaaccagggagccaagtggtctagctcagcagaccccagccccatggagcccagcaagctaagatccactggcttgaaattctcactgccagcatagcagtctagagtcgacttgggatgctgaagtttggtggggggaggggcgtccctcaatactggggcttgagtaggcagttttcccctcacagtgtaaacaaagccactgggaggtttgaactgggcagaggccactgcagctcggcaaagctgctgtggccagactgcctctctagattcctcctctctgggcagggcatctctgaaagaaaggcaccagccccagtcaggagcttagagataaaactcccatctccctaggacagagcacctgggggaaggggcagctatgggtgcagtttcagcagacttaaatgttcctgcctgctggctctgaagagagcagcagatctcccagcacagtgcttcagctctgctaagggacagactgcctcctcaaatgggtcccttgaggggacagtgcttcctgactgggagacaactcccagcaggggtcgacagacacctcttacaggagagctccagctggcatcgggtgggtgcccctctgggacgaagcttccaaaggaaggaacaggcagcaatctttgctgtcccacagcttccactggtgatatccaggcaaagagggtctgcagtggacatccagcaaactctagcagacctgcagcagaggggcctggctgttagaaggaaaactaacaaacagaaaggaatagcatcaacatcaatgaaaggacgtccacaaagaaactccaaccgaaggtcaccaacatcaaagaccaaaggtagataaatccatgaagatgaagaaaaaccagtgcaaaaagcctaaaaattcaaaaaccggaatgtctcttctcctccagaggatcacagctcctcgccagcaagggaacaaaactgtacagagaatgagtttgatgaactgacagaagtaggcttcagaagatgggtaataacaaactcctctgagctaaaggagcatgttctaacccaatgcaaggaagctaagaaccttgaaaaaaggttagatgaattactaactagaataaccagtttagagaagaacataaatgacctgttgcagctgaaaaacagcttgagaactttgtgaagcatacggaagtatcaatagccaaactgatcaagcagaagaaaggatatcagagattgaagatcagcttaatgaaataaagtgtgaagacaagattagaggaaaaataataaggaacaaacaaagcctccaagaaatatgggactatgtgaaaagaccaaacctacatttgattggtgtacctgaaagtgacagagagaatggaactgagctggaaaacactcttcaggatattatccagtagaacttacccaacctagcaaggcaggccaacattcaaattcaggaaacacagagaatgccccaaagataccccttgagaagagcaactccaagacacataattgtcagattcaccagagttgaaatgaaggaaaaaatgttaagggcagccagagagaaaggtcgggttacccacaaagggaagcccatcagattaacagctgatctcttggcagaagctctacaagccagaagagagtgggggccaatattcaacattcttaaagaaaagaattttcaacccagaatttcatatccagtcaaactaagcttcataagtgaaggagaaataaaatactttacagacaagcaaatgctgagagactttgtcaccaccaggcctgccctacaagagctcctgaaggaatcactaaacatggaaaggaacaaccggtcccagccactgcaaaaacatgccaaattgtaaagactatcgatgctaggaagaaattgcatcaactaacaagcaaaatgaccagctaacatcataatgacaggaccaaattcacacataacaatattaaccttaaatgtaaatgggctaaatgctccaattaaaagacacagactggcaaattggataaagagtcaagacccatcagtgtgctgtattcaggaaacccatctcatgtgcagagacacacataggatcaaaataaagggatggaggaagatctaccaagcaaatggaaaacaaaaaaaggcaggggttgcaatcctagtctctgataaaacagactttaaactaacaaagatcaaaggagacaaagaaggccattacataatggtaaagggataaattcaacaagaagagctaactatcctaaatatatatgcacccaatacaggagcacctagattcatacagcaagtccttagagacctacaaagagacttagactcccacacaataatagtgggagactttaacaccgcactgtcaacattagacagatcaatgagacagaaagttaacaaggatatccaggaattgaattcagctctgcaccaagcagacctaacagacatctacagaactccccacccaaatcaacagaatatacattcttctcagcaccacactgcacctattccaaaattcaccacatagttggaagtaaagcactcctcagcaaatgtaaaaggacagaaattataacaaactgtctctcagaccacagtgcaatcaaaatagaactcaggattaagaaactcactcaaaaccactcaactacatggaaactgaacaacttgctcctgaatgactactgggtacataatgaaatgaaggcaaaaataaagatgttctttgaaaccaatgagaacaaagacacaacataccagaatctctgggatgcatttaaagcagtgtgtagagggaaatttataacactaaatgcccacaagagaaagcaggaaagatctaaaattgataccctaaatgtgatctaaaatgacacgctaaaatgtgatctaaaaaagatcacaattaaaagaactagagaagcaagagcaaacacattcaaaagctagcagaaggcaagaaataactaagatcagaggagaactgaaggggatagagacacaaaaaacccttcaaaaaatcaatgaatccaggatctggttttttgaaaagatcaacaaaactgatagactgctagcaagactaataaagaaaagagggaagaatcaaatagatgcaataaaaaatgataaaggggatatcaccaccgatcccacagaaatacaaagtaccatcagagaatactataaacacctctatgcaaataaactagaaaatctagaagaaatccataaattcctggacacatacaccctcccaagactaaaccaggaagaagttgaatctcttaacagaccaataacaggctctgaaattgaagcaataattaatagcttaccaaccaaaaagagtccaggatcagatggattcacagccgaattctaccagaggtacaaggaggagctggtaccattccttctgaaactattctaatcaatagaaaaagagggaatcctccctaactcattttatgctcactttatgaggttagcatcatcctgataccaaagcctgacagagacacaacaaaaaaagagaattttagaccaatatccctgatgaacatcgatgccaaaatcctcaataaaatactggcaaactgaagccagcagcacatcaaaaggcttatccaccatgatcaagtgggcttcatccctgggatgcaagcctggttcaacatacgcaaatcaataaacgtaatccagcatataaacagaaccaaagacaaaaactacatgattatctcaatagctgcagaaaaggcctttgacaatattcaacagcccttcatgctaaaaactctcaacaaattaggtattgatgggacgtatctaaaaataataagaactatttatgataaacccacagccaatatcatactgaatgggcaaaaactggaagcattccctttgaaaaccggcacaagacagggatgccctctctcaccactcctattcaacatagtgttggaagttctagccagggcaatcagacaggagaaataaataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcaaaaatcacaagcattcctctacaccaataacagacaaacagagagccaaatcatgagtgaactcccattcacaattgcttcaaagagaataaaatacctaggaatccaacttacaagggatatgaaggacctcttcaaggagaactacaaaccactgctcaatgaaataaaagaggatacaaacaaatggaagaacattccatgctcatagataggaagaatcaataccgtgaaaatggccatactgccccaggtaatttatagattcaatgccatccccatcaagctaccaatgactttcttcacagaattggaaaaaactagtttaaagttcatatggaaccaaaaaagagcctgcattgccaagtcaatcctaagccaaaagaacaaagctggaggcatcacgctatctgacttcaaactatactacaaggttacagtaaccaaaacagcatggtactggtaccaaaacagagatataggctaatggaacagaatagagccctcagaaataataccacacatctacaaccatctgatctttgacaaacctgactaaaacaagaaatggggaaaggattccctatttaacaaatggtgctgggaaactggctagccataggtagaaagctgaaactggatcccttccttacaccttatacaaaaattaattcaagatggattaaagacttaaatgttagacctaaaaccataaaaaccctagaagaaaacctaggcaataccattcaagacatagggatgggcaaggacttcatgtctaaaacaccaaaagcaatggcaacaaaagccaaaattgacaaatgggatctaatttaactaaagagcttctgtgcagcaaaagaaactaccgtcagagtgaaaaggcaacctacagaataggagaaaatttttgcaatctacccatctgacaaagggctaatatcctaatctacaaagaactcaaacaaatttacaagaaaaagacaaacaaccccatcaaaaagtgggctaaggatatgaacagacacttctcaaaagaagacatttatgcagccaacagacacatgaaaaaatgctcatcatcactggccatcagagaaatgcaattcaaaaccacaatgagatatcatctcacacaagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctcgaactagaaataccatttgacccagccatcccattactggatatatacccaaaggattataaatcatgctgctgtaaagacacatgcacacgtatgtttattgcggcagtactcacaatagcaaagacttggaaccaacccaaatgtccaacaatgatagactggattaagaaaatgtggcacatatacaccatggaatactatgcagccataaaaaaaagatgagttcatgtcctttgtagggacatggatgaagctggaaaccatcattctcagcaaactatcacaaggacaaaaaaccaaacactgcatgttctcactcataggtgggaactgaacaatgagaacacttggacacaggaaggggaacatcacaccctggtgcctgttatggggtgcagcaatgggggagggatagcattaggaaatatacctagtgtaaatgacgagttaatgggtgcagcacaccaacatggcacaaatatacatatgtaacaaacctgcacgttgtgcacatgtaccctagaacctaaagtataataaaaaatatatattaaaaaaagaaaaagaaaaaaaagagaaagaaactgtagccctaaaatgtgagagataaaacagaaaaaaaaatcaatgaatccaggagctggttttttgtaaagattaacaaaatagatagaccactagccagactaataaggaagaaaagagaaaagaatcaaatagacacaataaaaaatgataaaggggatatcaccactgatcccacagaaatacaaaataccatcagagaatactataaatacctctatacaaataaactagaaaatctagaagaaatggataaattcctggacatatataccctcccaagactaaaccaggaagaagttgagtccctgaataggccaataacaagttctgaaattgaggcagtaattaatagtctaccaaccaaaaaaaagcccaggactggacagattcacagccgaattctattacaggtacaaagaggagctggtaccattccttctgaaactattccaaacagtaggaaaagagggactcctccctaactcattttatgaggccagcatcatcctgataccaaagcctggcagagacacaacaaaaaaagaaaatttcagtccagtatccctgatgaacatcaatatgaaaatcctcaataaaactctgacaaacttaatacagcagcacatcaaaagcttatccacaatgatcaagtaggcttcatccctggaatgcaaggctggttcagcatatgcaaatcaataaatgtaatccatcacataaacagaaccaatgacaaaaaccacatgattatctcaatagatgtagaaaaggccttcaataaaattcaacaccccttcatgctaaaaactctcaataaactaggtattgatggaacgtatctcaaaataataagagctatttatgacaaacccacagccaatattatactgaatgggcaaaaattggaagcattctctttgaaaaccagcacaagacaaggatgccctctctcaccactcctattcaacatagtattggaagttctggccagggcaatcaggaagagaaagaaataacgggtattcaagtaggaagagaggaagtcaaattgtgtctgtttgcagatgacatcattgtatatttagaaaacctcatcatgtcagccccaaatctttttaaggtgataagcaacttcagcaaagtcttaggatacaaaatcaatgtgcaaaaataacaagcattcctatacaccaataatagaaagccaaatcatgagtgaactctcattcacaactgctacaaagtgaataaaatacataggaatacaacttacaagggatgagaaggacctcttcaaggagaactacaaaccactgctcaagaaaataagagagtacaaaaacaaatggaaaaacattccattctcatggataggaagaatcaatattgtgaaaatggccatactacctaaagttatttataggttcagtgctatcctcatcaagctaccactgactttcttcacagaattaaaaaaaactagtttaaatttcatatggaaacaaaaaagagcccatatagccaagacaatcctaagcaaaaagaacaaagctggaggcatcatgctatctgacttcaaactatactacaaggctacagtaaccaaaacagcatggtactggtatcaaaacagagatatagaccaatggaacagaacagaggcctcagaaataataccacacatctacaaccatctgatctttgaaaaacctgacaaaaacaagcaatggggaaagtattccctatttaataaacagtattgggaaaactggctagccatacacagaaaactgaaactggacccctttcttacacctatacaaaaattaactcaagatggattgaagacttaaatgtaagacctaaaattatcaaaactctagaagaaaacctaggcaatattattcaggacagaggcataggcaaagacttcatgactaaaataccaaaagcaatggcaacaaaagccaaaattaacaaatgggatgcaatggcaacaaaagccaaaactaacaaatgggatctaattaaactaaagagcttctgtgcagcaaaagaaactatcatcagagtgaagaggcaacctacagaatgggagaaaatttttgcaatcaatccatctgacaaagggctaatatctagaatctacaaaaaaaaaaaaacaaattcacaagaaaaaaaaagcaaccccatcaaaaagtgggcaaaggatatgaacagacacttctcaaaagaagacatttatgtggccaacaaacatctgaaaaaaagctcatcatcactggtcattagagaaatgcaaatcaaatccacaatgagataccatctcatgccagttagaatggtgatcattaaaaagttaggaaacaacagatgctggagaggatgtggagaaacagagatgcttttacactgttggtggaagtgtaaattagttcaaccattgtggaagtcagtgtggcaattcctcaaggatcttgaaccaaaaatatcatttgacccagcaatcccattactgggtatatacccaaaggattataaatcattctactatagagacatatgtacacgtatgtttcttgcagcactgttcacaatagcaaagacttggaaccaacccaaatgcccatcaatgatagactggataaagaaaatgtggcgcatatataccatggaatactatgcagtcataaaaaaggatgagttcatgtcctttgcagggacatggatgaagctggaaatcttcattctcatcaaactaacacaggaacaggaaaccaaacaccgcacgttctcactcataagtgggaattgaacaatgagaacacatggacacagggaggggaacatcacacatctgggcctgtcggggggtgggaggctaggggagggatagcattaggagaagtacctaatgtagaagacaggttgatgggtgcagcagaccaccatggcatgtgtatacctatgtaacaaacctgtatgttctgcacatgtatcccagaacttaaagtataataagaataataaatattgagttatctaatatgatatgatttccaggtttccagaaaaattactcaagcatgtcaaaagatccacagaaggtgcctgatgctccctgtccataagggctatagaaagcaattattgttaccaaataactacaacaataactgtcaagggaatggcagtgtcagtgagacttctaggcatctgaggatgctgagcctgatgagctgacatggctgggatgagcttattagatgagatagaatttgattggaatgtttctcatttgactttattttaatgagctctaggagaacaacaaaactattttagcaactactgttttccagcattatccatgtggcagtcactttctgcatcacagaagggaatctacgaatgttaatgtttaattgatcattagccttttctggcaattgttttccataataaatgtttccccacaacaacatcaaagcagctcatactgccttgtggtattaagcctgtttccctagctgccacccaattccattcacagagggatttatgaaaagtaggattccaaaagccctggctttattccaagatgtctaataagatgcataggaaaataaaggcagggagacaggctggataaatggggcactcttatttaagaaagtgcaagagaaaaattggagtgtgtcaaaatgagaaaaatagaggaaaaatcaggaagaaataatcaagagcccatccctagacagaagattagtttatcctgctgaaatgaagcatggttgagaaaaatggatgatacagatataaattattcatggttaaagacatctcagtcattaagatatttacaccatgagtgaagcccatgcatgctgggttgatttatgggctacataattacagaagatacgctgatgactgtttgcatgggaaacactctggatttttattttgttaatcagttttcccacttctgagtcctgcattgcaatcacagtgcaaggcttgattagaacctcccgggggtagtggaaaggctgtgcatggtaatatcaactttgcctgccttacattcctttagataagaaagtaccttttgggagcctttcaacttgctcgttagttaacagtatttttattaatagtacctattcatataatgctattaataatttcaacccttttcagataaaccaaaccccaatacatttttttaaatattttttaaattgctgatttattttttttctattgaaataaagtgcttgggaaagactcacctaaaagtgcaccttccaatgttcaaataagcttcgtcttaaatcctaacttttccccagggagttaaaggagacacagcatgaatatttattgtattgcaagaagagtacaaagcaagtgaaactcgataatacttcccatgctaacttgagtttggataaagcatgtttaattattgactcccactctctgcagcaggctcaccctggtaattgcattaattttggaataacttgaccccttattttacatgacagatttttttggtaccctgcttattaggtaatagtattttaaaaactttttatggaagtatatcaacatgcagagaatgcataaatcacaagtttacaatttgatacattttcataaactgaatatatctgtgtaaccacaccaagacccagaaatagaacattaccagcatcaaataatccccctactcctttacattgctcaccatccaaaaagtaaccattatcctaacttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctaggattacaggcgtgagccactgcgcccggcccattatcctaacttctaacaggataagttagctttgcttactgttttcctttttagaaatactatttatactcttctttggcttcttttgcacaatattaggattgtaagagtcatgcatattgttaggggtaatttattataattgctatattgtatttcatgaggtgacccatgctataattcatccattctacctaagtttttctgggttttggctattacaaatatttctgctatgctctgcacaatggccaagatgtgaaatcaacctaagtgtctattgatgataggtgaatggataaagaaaatgtacacaatggaatattattcaaccatgaaaaagaatgaaatcctgtcatttgtagcaacatggatgggtctggatgacactatgttaagtgaagtatgccacgcacagaaagacaaatactggatgttctcatttatatgtgggagctaaaaaagttgatctcgtggaggtagagagtagaatggtggttaccagaggttggaaaggagaaggggcgggggtgtgaaaagaggttgcttagtgggtataaaacacatttagatggagggaataagttctagtgtttgatagcacaatagggtgactatagttaccaacactttattgtctatttcaaaagagccagaagagaagatttggaatgttctcaactcaaagaaattataaatgtttgaggtgatggatagatatccctattactctgagttgatcattatacactctatgtaggtatcaaaatatcacgtgtaccctataactatgtactattattatcagtaaaaaatattgctgctatgaacattctagttgtctttggtgagaatgggtatgcatttctgtaggaaccataactaggtttggaattgttgggtcacagggtatgcgtatgctcagcttcagcagatactgtcaaagaggttttctaaagagttttatgaatttgctgtcccaccagaagggaatgagaattccagttgctctatatgtttaccacctcttgttgtggtcagtcttttccactgtagccattcagttgagtgtgtagtggtatcacactgtgttttcaatttgcatttccctgatgactaacgtagtagagcaatttttcatacagttattggccatttgaatattctcttttgtgacgtgtctgatcaggtattttccctgattttttattagttgtctggcttattgctttgtgaaaattaaatatatatatataatttaaaaaataattaaaatagttttaaaaactaaaaaataatttcaaaatatatattctagtatgagtcattgttggatatgtgatttgcaaatatactttcctccctctatgacttaccatttcaatgcttaaaggtgttttttgataaagagaagttctacattatttatattatggttatactttatatgttatgtttaagaaatctttgcttactataaagtcatcgtgatgctctcatatgcttttttttacaggtttcattgtttaattttatatttatatcagtaatcctctgaaattgattcctatgtgttgtgcccggtagagtcaagatatattttctccacatggatataattgatccattatcattttttgaaagggctactttttttctcattgcattacaatgtcacctgtgtcacaaatcaggtgaatatatgtacacagacagattaatatatatattcatatgtaccactcatgtatttatgaatatatacatatgtatatatgtgtgtgtgttttctggacactctgttctgtttgtcttttcttcgtgtgtcagtaccatattgtcttaattacttcagctttttaatagatcttaatatctagcagtatgggttctctccagttctttattgttctttaagactgccctgactttcttgaccccttttagtgtggttttactgtgtatttaattcagcaaaaagtaaagctcagtaactaaataagtgagagagtttaggcccttgccaagggaataataatatatgaaataatcatgttagaatttatgtgacagatttcagtattaaatttgatagactgacatggtttatatatatatatatatttaaaaatactctgtagaatactaataaaagtcttccaacttaaatttctagggtctcaatggtgtcccatgtagccaaagaatttttaaatttttaaggcaggtgatatggtttggctctgtgtccccacccaaatctcatcttgaattgtacttccataattcccacatgttgtgggaggaacctggtgggagataattgaatcatgggggcagtttcccccgtactattctcatggtaatgaataagtctcatgagatctgagggttttatcaggggtttccgcttttgtgtcttcctcattctctctttgcctgttgccatccacttaagatgggacttgctccttcttgccttccaccatgattgtaaggcttccccagctacatggaactgtaagtccagttaaacctctttcttttgtaaattgcccagtcttgggtgtgtcttcatcagcagtgtgaaaacaaactaattcagcagacaataagaaaaagcaggtctcaattttttttttttttttgagtgagggtctcactctgtcacccaggctatagtgcagtggtatgatcatagctcactgcagcctcgaactcctgggctcaagtgatcttcccacctcagcctaccgagtagctggtaccacaggtgtgtgccactgcacccaacgaatttttaattttttaatagaaacagggttttaccatgttgcccaggctggtctcaaactccagacctcaagtgatcctcccaactcagcctcccaaagtgctgggattacagatgtgagtcactatgcctggcacaaaatttcttaaaggtctttctgagctcagacatagtaactgggggcacactttgtacataccatcatggccctcattgcacaagctctggaagcctttacttccattgtcagtactaatgtgaagattttttaaaaaggggcatacaggtcatctacaaagaaacgcccatcagactaactgaaactctcagtggaaaccctacaagccagaagagattgggggccaatatttaacattcttaaagaaaataatttccaacccagaatttcatatctggccaaactaggcttcataagcaaaggagaaataaggtctttttcagacaagcaaatgctgagggaattcatcaccacctcaagcctgctttgcaagagctcctaaatatggaagcactaaatatggaaaggagaaactattaccagccactacaaaaacacactgaaatacacagaccagtgatactatgaagcaaccacataaacaagtctgcaaaataaccagctagcatcatgatgacaggatcaaattaacacataagaatacaaactttaaatgtaaacaggataatgccccaattaaaagacacagaatggcaagctgaataaagagccaaaacccattggtatgctctgttcaagagacccatctcatgtgcaaagacacacgtagactgaaaataaagggatggaggaaaagttaccaagcaaatagaaaacagaaaaaagcagggtttgcaatcctagcttttgacaaaacagactttaaaccaacaaagataaaaaagacaatgggattacataatggtaaagggttcaatccaacaagaagagctaactatcttaaatatatacgcacctaatacaagagcacccagattcataaagcaagttcttagaaatctacagagagacttagactcccacacagtaatagtgggagattttaacacccgacaggcaatattggacagatcattgagatagaaaattagtgaagatattcaggacttgaactcagctctggatcaagtggacctgatagatatctacagaactcttcacacaaaaacaacagaatatacattcttctcattgccacacaatacttactctaaaattgattacataattggaagtaaaacacttctcagcaaatggaaaataactgaaatcataacagtctctcagaccacagcacaatcaaattagaactcatattaagatattaactcaaaatcacacaactacttgaaaatttaacaacctgctcctgagtgacccttgggtatataatgaaattgaggcagaaataaaagagttctttgaaactggtgagaacaaagagacaatataccagaatttttgggatgcagctaaagtaatgttaagaagaaagtttatagtactaaatacccacatctaaaacctagcaagatctcaagttaacaacctaacatcacaactaaagaactagagaaccaagaacaaacaaactcaaaagctagcagaggacaagaaataaccaagatcagagctgaactgaaggagatagagatgtgaaaatcccttcaaaaaatcaacgaatctaggagctgcttttttgaaaaaattaataaaatagaccactagctagattaataaagaagaaaagagagaagaatcaagtaaacacaatcagaaatgataagggtgatatcaccactgacccccacagaaatacaaataactatcagagaatactataaacacctctatgcacacaaactagaaaatctagaagaaatgtataaattcctggatgcatacaccctactaagactgaaccaggaagaaattaattccctgaatagaccaataacaagttctgaaatttagtccgtaataaatagcctaccaaccaaaaaatatccaggaccagacagattcacagctgaattccaccagaggtacaaagaagagctggtaccatttttactgaaagtattcaaacaaattgaaaaggaggggctccttcctaactcattctatgagaccagcatcattctggtgccaaaacccggcagggatacaacaagaaaagaaaatttcaggccaatatccttgatgaacatcaatgcaaaaatcctcaataaaataagtaatggcaaaccaaatccagcagcacaccaaaaggcttatccaccatgatcaagttggcttcatccctgagatgcaaggttggtttaacatatgaaaatcaataaatgtgattcatcgcataagcagcactaaagacaaaaaccacataattatctcaacagatacagaaaaggccttcaacatctcttcatgctaaaaattctcaataaactaggtattgaaagaatatacatcaaaataataagagccatatatgacaaacccatggccaatatcatactgaatgggcaaaagctggaagcattcaccttaaaaactggcacaagacaaggatgccctctcttaccactcctattcaacatagtattggaagttctggccagggcaatcaggcaatagaaagaaataaagggtattcaaataggaagggagaagtcaaattatctttgtttgcagatgatatgatgctgcattgagaatactccatcatctcagcccaaaagcttcttaagcctgacaagcaacttcagcaaagtctcaggatacaaaaccaatgtgcaaaaattactaacattcctaacaccaacaacaaatctctctgatttggcaagtagagagccaaatcataaatgaactcccattcacaattgctacaaagaaaataaaatacctaggaatacagctaataagggaagtgaaggatctctttaaggagcattacaaaccaccatacaaggaaatcagagaggacataaacaaatgaaaaaacattccatgtccatggataggaagaatcaatattgtgaaaatggccatactgcccacagtacagtatagattcaatgttattcccattaaactaccatcgacatccttcacagaattagaaaagaaattttttaatctgtatggaaccaaaaaagagcctgtattgccaaaacaatcctaagctaaaagaacaaagctggaggcatcataccacccaagttcaaactatactacaaggttacagtaaccaaaacaacatggtactggtacaaaaacagacacatagaccaatgaaacatagtagagaacttagaaataagaccacacacctacaaccaactgattttcaacaaaccttacaaaaacaagcaatggggaaaggattccttatttaataagtggtgcttggagaactggctagccataggcagaaaattgaaactggactccttccttacaccttatacaaaaattaacttaagatgggttaaagacttaaatgttaaacccaaaactataaaaaccctaggagaacatctaggcaataccattcaggacataggcatgggcaaagatttcatgatgaaaatactaaaagcaaaaattgacaaatgagatctaattaaactaaagagcttctgcatagcaaaagaagctatcatcagagtgaaaagacaacctacaaaatgggagagaatttttgcaatttatacatctgacaaaggtctaatatccaaaatctacaaggaactaaaacaaatttataagaaaaaaacaatcccattaaaaagtgggcaaaggacatgaacagacatttctaaaagaagacattcatgcacacaacaaacatatgaaaaaaagctccacatcactgatcattagagaaatgcaaatcaaaacaacaatgagataccatctcacaccagtcagaatggcgattattaaaaagtcaagaaacaacagatgttggcaaggttgcgaagaaaaaggaatgcttttacactgttggtgggggtgtaaattagttcaaccattgtggaagacagtgtggcaattcctcaaagacctagaggcagaattaccatttgacccagcaatcccattactgtgtacatgtatacccaaaggaatatgaattattctattttaaaatacatgtatgtgtatgttcattgcagcactattcacaatagcagagatacggaatcaacccaaatgctcatcaatgatagactggataaagaaaatgtggtacacatataccacagaatactatgcagccatataaaataccagatcatgttctttgcagggacatggttggagttggaagccattatcctcagcacaacaacacaggaacagaataccaaatactgcatgtcctcatttataagtgggaactgaatgatgattacacatggacacatgaggaggaacaacacacactggggcctgtcagagtggtggggcttgggggaaagggagagcatcagaaagaatagcttatagatgctgggcttaatacctaggtgatgggttgatctgtgtagcaaaccaccatggcacacatttacctatgtaacaaatctgcacatcctacacatgcacccctgaacttaagagttgaagaaaaaaataagagcaaaaacaaagaaaaaagggggcataattctttgaggaccaatctttcaggaaactcaaagtttatcttcctcatttactttaaaaagtgtaaatagcaaaaccgatccagcatttaaagtgacaattaccaatggaaagatgaaaatacttgccaccaaggcaaaaaattatttgccctacctgttaaaatgatttagtatattacacatggtggctgcacaatcatcacattccctatcatcattctacagaaagtcggattcctcctcaatctaaaaatagtcggggctggataagtgattcacaggaaaaatggaatgaatctccatcaggctctgctgaggcagagaaactgtttaagtagcagccagtgtgtgccagcctgagaaagaattcctactactcatattcttaactttccaagactgggaaggaacagtcagtcaggaagagttaatggctcaacagcaacatgcaaatgctctggcatcttgtgctacagttggcttcatgtttcagttaaaaaaaaaaaaaagtatcctagttctttcagaaccagatgtgaaacgagacaaatgaataccaaccactcagatttcctaaaagccaatttacttggaagttgccaaaaatatactttgaaatatttaaagcatctacatttctgaccgacctccttggtttttataggaggtaaacataaaattaaaaaccaaatactactaaagtaccagtctaaagatgggactagattttttttaataaaaagaacaacaatttgatgattatgtatgaaaataaccaatgtcctgtcaaccgggaagcctgaccagggaatcaagagagccaaggcactgagaggcaccagctgagaccagcatgaccgctgtgtagaagtaataagcacacagtccaggatcttgaattcagtgagtccccaataaatgtgcatttattaatcataaaataaataaaatttccaatttccaattagaagaatttgatatagctagaatttgacctagctagaagggacagcaaataagttggatgtcagaatcaaggaatttagactggctaggccaggcatggtggcttacacctgtaatcccagcactttgggaggccaacgcgagtggatcacttgaggtcaggagttcaagaccagcctggccaacatggtgaaatcccatctctactaaaaatacaaaaattagccaggtatggtggcaggcatctgtaatcctagctactcaggagggtgaggcaggagaatcgcttgaactcggaaggcggaggttgcagtgaaccaagaccatgccactgcactccagcctgggtgacagagactctgtctcaaaacaaacaaacaaacaaaaaattaggtgggctagaatggtgggtgaatactttcaaattactgtttaatatgccttacatttttatagtgagtttacaaagtgcttacacatacatcatgccattttcttgctcacaaaacccctctgggatgggcctgggcattttaaatgctctgtaggtgattctgatgtttggtaagagttgggaactattgctttagactgtagcattgctcagcagtgagttttcttttattagggggttcaaattgagtttggtaaggagatcctgaaggcctcctagcattgtagagtggtccaagtaaatgatgctaatattcaattattgtgtgttaacaactttgcagatcaccatgtccatggaactgtatatgccttcaggagcatgttttgaaactcgtattttcaactgtgcagtgagataggtcttctatagacatctgtttttttgactaggttttagacagcaagggtatttgaaagtgataaatagcactttatgccactggaacatatactaccactaacagaaattgagggaactcctgaaatactgtaaaagaccaaggtagaaaactttcctaaagaaagagccaaatagttctgtggataacttgatctatggaatccaattacatgcagagcacattctgcccatgtccatagaattaaggaaggtgagagacttagctaaagggcaagagttaacagattgtttcattttcaaactttcattatggaaacttgattttaatgatggcactgcaggatcactcatgatacctttattatgttaagaagtgaacacagactctaaattgggagtaaacctgtgttccttttcctgggctgcttattcctctcctctctcctgaggaaagctggattctaacacttcattatgaaaaatctgggctgcaggtgtagtgcccaggaatctgtaaagatgcctctgggtatatgtaaaaaaagaggcaggaggattccaggaaaagtatgcctcactcccttaggctgagtagctttaccataacttgaatcaataaaaatacctgaatgattaaacaagagtagataattaattcattgtctcactttcttccttcttactcagaactctcttaggtgcttaacattaaatatttgatgttctgggattttcctttgggtaaggctcaataatgtacttaaatgtacttaaacctaaaactattatattttaaataataagattctacttttatttttaaacactctgttaagacttttatttttgtaagaatattaactgagtcttaaactttgaattcaaaaatcttacatttagaatatataaagtcacattccaatatttgttctgccttcaaaacttttacctatacttaaaacattgtttcatacatctgctatagtttctttcaatcttctgtgagtataatgtcagatttgtgaggttcatctgggtttaatcctaggtttaacactacatggtctgtgtgaatttgaataaattaatttcttcaagacacagttacttcatctgttaaaaataaggatattaggccaggcacagtggctcatgcctataatcccagcactttgggaggctgaggtgggagggttgcttgaagccaggagtttgagaccagcctgggtaacaaagtgagagtctgtctctaaaaaaacaaattaaaaaaaaaaggtagtgaggtatggtggcacatgcctgtgttcccagctacttgggaggctgaagtaggaggatcgcttgagcccaagagtttgaggctgcaatgagctatgattgcaccactgcactccagccagggtgacagagcaggaaggaaagaagcatctcagaaacaaagaaagcaaaaaagagagaagctcttttaagacagagcatctcaaaaaagaagaaataaaaagaattataatgtatgtgtcctagggttgctataactattagagttaatacaatgtgtaaggtaccttgtacgatgcttgtcgatacaaactgcataaattaatgttagttttcttctctacttcttcctgggttaatcccagggaataaataaggatgccatctatgatgcttaattagttttccagttgatgtgaaaaattactttctttacttggccagagaaagctagagaaaaggctcttaagccaaaaaattaaattacctattcatatgtccccagaacttttaagttaatgttgcttctattacgatgcagtgaagttgttcctaaaagaaagttatgagagaaagagaagggcgagcaggagggagccagacagctttctagtgtatcatcagttagatttgcatgtgccgttccacttaattagctttgagtgttgtgaattatttcaatattaccctatctgcaattttagattatctacactgttatggattgagttttataatctataactaatgaattcatatcttgggcaagatattaaaaaaatctacatgtggagcatgtagactgtacaaattacaaaaatgaaacttttttttcccacaggtggcatagttaatattcctgccaaatagtaccttcagcgtgactgaccaaactaaaatttacgtgagccccccacccccgtgccctcccaagtgtgagaattctgcgggaaaggctgccaagctcctgctctaattttgtttggagagttaaatgtaagggaagcagattccacaaggcgaatgtaccactcagcacgaaatcgacttttaaggaactcaacagatgcactggagttaaggaaatcccttctgagaagtcagaggtcccagagttacacaaagccgttcccggcagcgcgaaacatttcagatgtggtgcagtgaaagcaaaggagtcctcggcggcaggtgagcaatggtgatgaaccgaagcgcgccaggagaaggccggcgggatttcatatgagtgcagctgaaatatgacttcagtacttgaaccaattcttgtgagttaatgataaccactcctttccactctctgaaagagtgtgtgtggctcagtacctttctttttctaacctcttgagggccacaagcttaaatgtgccagaaggaaagtctccagtgagctggaaatgtagtctcgatacttagcttgttcaaatatatgatgtttatctgaagccacacctgaacgtgtctaagagcatctccttttaccagtacctgcaaggttcaggctctgtggaagataggggatatggcaggagctggaccacgaatatggataccaagatttacattccttaaaagacccacagaacacccagctttcgatgagccaagttaccacagcggggcacctttcaaaagctatataactagggacttctaccatgtagactcatatttgctattttgctccaacaagcgttatctaaaataggagggctgaacacaaggtcatacaggccactttgtagactgaccccagtgcttcccaatattcaaagaactggagagaaatgatttgtcactgtgtactactgtaccttctctgggggatgtctcttacagcccttcaaagtctgaatctccagactaatatttactgttagactctggagctatagtgctcctgaatcactagaaattgctaatgaaaatttgggtaggaagtcatctcttggtatgggccaatgaatggcctgaaacccttccacgtggtgctctgagattcaggcatcctgatgcttttatctgcagctggaggaaatgcttctgtaaggaaagggaagaaaagggaaagaagggcaataaggggagggaagagaagggaaaagaaaagaaagagagaggataggagaggaagagaggaaaggagaaggaacaaaagaaaaaaggaaggaaagagaggatgaataagaatacaaattgcttacttaagctgttactgcatcttttactactacctttggagttcttcagggaagagtaaatgtgcactctcaatttagatgaaacactgcttttaagctgtctgcatttcattcagataacaagtatttaacacttttttggtgtgtcaggtacacactatgcatgtagtggcaaaaatgcatacataatgtccctgtttccccgtccctgcccttctggtacttattgtctaatgaaagagaccaacagcttagcttaccaacaaattaccattataattgtgataattactatgaaggaaaagtaagggctccctgggggagtaaaacagggagacctaatctagataggatgttatggaagtttgttttgtctgagtaacagacatttaggctgagtctttaaagaacattgcaaaatagctggtaaagaatgtgtggagggattggagaatcacttcttaggcagagggaacagaacttggaaagtccctgaggacatgaacccggcattggggaggagcttaaaacaagagcattgggaatcaaagggaagagagcaactgggaaagttgaacactgagataggggtggcaattctgggtaaagggcatgtaggatttggaggcaaggcacagatttagtggaatggcattgaatggaagtgatgtgaagagcagaggtagacacgagctgggaggtgactacagttccttgggagagagatggcagcatctgtgagtgagaggcacggacaagtgtgtggacagcaaaaatggagaggagcaggctgactggagagagtcagggaactgtgtacgtcaggcctctgagcccaagccaagccatcgcatcccctgtgacttgcacgtatacgcccagatggcctgaagtaactgaagaatcacaaaagaagtgaatatgccctgccctaccttaactgatgacattccaccacaaaagaagtgtaaatggccggtccttgccttaactgatgacattaccttgtgaaagtccttttcctggctcatcctggctcaaaaagcacccccactgggcaccttgcgacccccactcctgcccgccagagaacaaaccctctttgactgtaattttcatttacctacccaaatcctataaaactgccccacccttatctcccttcgctgactcccttttcggactcagcccgcctgcacccaggtgaaataaacagccatgttgctcacacaaagcctgtttggtggtctcttcacacagacgcgcatgaaagtgtaaggcttgggtgtcagtggagtgggacaaataaaagatggtccaggcttttggcttgagaattgctcaagtggaggcactcatgcctgagatggggaagatgggagaggaacaggctaaggggagaagtactaaacagttaattttaagaattatcatataaacgttgtgttaaagctgctctggttaaattgctgttaagcaagggttctgaaatcaggcataacagtttgaattctggctctcttattttctacctgggcaagttattttatttcctctgatttctcaaatagggattcttaagtctatctcttaaggtaaaaatgcaatgtaataatgtttataaaataccttgaacatcataggaacttagtaaataaaaattactattactataatggcaatgtattatgttagagaaaagactcagttttgactttgacacttataaactgtcatacaggcaaaaaaaaaatgtatttgagatttcttatctttaaaaccagccaaattaccctcttttcctacgtcatgaagaatataaaaatgataattacaactctaacattttttatttagtcttgaacctataccattgataagtgataagaggccttggagtgaaatagtctttgtactacaaggaggagaagattataaatatttatagcctgtgaccacaggagctctgtgaaaaacagtactgtaaagagaatagtgcattgggggaaaggtattatttaaggtcagtctcatgatcactgagaaggagcaaaaagatccctaggacatccaaatgtcaactacaaagttcttacataatattttggaaatgtagccttcaacattaagtgtatggtgaccatgaagcctattatgctctgtatcttttgtttagaaaatgggatttattgtcctcttaagttgcaaatgaattcactagccttgtgtgaactgacctatcactgtggaagtcatgtggattcttccattcatcaaaaagtgacagactcccatgtcatcacagccctttcagtctttttctcaaaaaacaagaggtagcctgcttaccttaaataggttatcatgaggataaaatatgatgaagattataaaagtgcatattaaaccaaaagtactctaaatataagaaattattttggatattattacatttgggagaaaggctcaaaatcaaatactcttcatttatttgttcatttatttgcttcatcaaccaataaacaaataatatcttttatgtacagggcacaacagaggatacaatatgggtagaaatagcttctgttgtcaaggagtttataatgcttaggaggagagacagtcacacacacagataactatagtactacactgaatggggcagagactataggaagcatctaaaaaaagataagatggtatgggagttattagaatagaggtatttcctttagctgggtttaccaggataactctaagaacaggctgggtacaatggctcatgcctgtaataccagcacttttgggaggtcaaggcgagaagatcacttgagcccaggagttcaagatcagcctgggcaacacagggagaccctgtctctacaaaaaaataaaaatacaaaattatccaggcatggttgtgcacgcctgtagtcccagctactcaggaggctgaggtgggaggatagcttgagcccagggggtcagggctgctgtgaacctaccacctcacaacagcctgggcgacagagccaagatcttatctcaaaaaacaaacaaaaaaccccaagaaacaggaacaattttgaaaggctgtaatagcagagtaagaaaattaatctcataacaacaacaataataaaacaacaataaaagcagatttcaaaattttctatatgtgccaaaaatgtgtcaagtgctttaaaggtattaacaactttgatcatcacaataaccataggaaggagctgctatgaccaatccccattgtacagacttagaacggtcacacatccagtaagttgcagagccaggaaacaaatctgagtccttttaatcacaatactctattgtctccagataggacgaaagtcatgaagaaacagaaaaacatagtaaaacctcggtgacaaatcattaggtgttcagtgtggctgaagcacaacaaaaaacaaatctagcagaggtaggtctgggaaaggctgggtagagtcttagtgttagactaaaaattgtggtctttattttataactaacagggagatgtctaaatagggacgatgggaattgtgagaacagatgtcaatgttatgagagagagtctttagagacagaaaaggtaaagaggttcagggaaaaatttcacagtgagtctcttgcattttacttgttcttaagtaaaataattcagtaggagaggtgatctgtgtaatagtcaatcattcaatgttccatgtgaatgactccattagatgctacagtgattttcagtgaggacaagtccaacctgtgatgcccccatagagatcaggtgaaagcttgctggcttttccatttcctattttactgctaccaatagaatgtcttcaggtagtaagaactaggtgttacagaaagaagacattgtatattggtgtgctctcaaaagaaattcacattaaaagtatgatctcaacctgcttctgagaatttgcagtagagaaactcttctttaatcttaaaagtaaaccagagggtccttaccaaaatgctctgacctcctgacctcaagacagtttcagggcagtttctatcacggttgtgaaacctgtgtcacacagaagagccaggagacaggggactcagtgggtgttactgtattgagcaactgtaccctcctgggtgatctcacaggtgtatctaggagtcattttcagtgtcaaagtcatagaaacaagtagtaaaatagtttatctccttgacagcatgactgttggagttaacctggtattttaacacccactggtataccagaaataattcttaaaaaaataattttattacataccaagtactgaagttaatactgttggacaaagatagcttaaacatggagaaaattacgtcacgcctggtggggaatattgtagtcttgtttcttttgaagctatatactattatataatggctaatggaaggtaaaaaagaagaatatttttttccccagtgaatgactggagctcattttattaagaggaatgtaaaattagtatacaatcacagagaaaagtaatcttaattagtacttaatagcactctataaaagatggcctcagactgaccttgtgatcaatagaagtgcttgcctgctactcttctcaaaaggaaaagccattcttgtctaactaatacatatacatgacctcaaagaaactcatcacacaaagagagatcgcctcccctgacagaattcagtcagtttttcctatttttaaaatatgctaaaattaaagggataattttctccctaaaagacatgtttcattttagaagtcccatatataatctgaaaaggagggaattttaaccaacttcccattaatttagtaaatatctcagaatgctaagatcaaaatcttcacagataatggcttcacagcagcatgttggctttacacctactgtgagaatgctgggaagtaatctttgaaaaatttgtaattgtcaatgggactactgggtttgatgtgattaacaagagaaatgatcaactttccttcttagatagtgattttagctataatcactttaaattggttaaactatttttatttatagcatttttgttttgtatttatggttacatcaatgaaaaaagcagtgatgataaattctgaaatattttaagagaatttatcaggtccagagacagaatagtggagctggaaggacctctgagatgatatagtctggtctccttatgttacgagttaggagtagtggcccaaagatttttaaaaaacccttctgattctatcacaatggatattacctaaaatataatcaatttggcccttagagaaaaatttataagttatttgtccatgttactcctactctgaatcaactactcatcaccatggtacctaatacaatgctaagcttctagaaggagctcctaaattatattctacagtattttgtattcttacatttgtgttactcaggaatttgaaagtggttatgaatacctctaatatcatttggatgtcatttccaaatctcatgttgaaatgtaattcccagtgctggaggtggggcctggtgggaggtgtttgggtcatgggggcagattcctcatggcttggtgctgtcctcactatagtgtgttctcataagatttggctgtttaaaattgtgtggtaccctctccttctctcactcttgcttatgctcttgtcctgtgatgtgcctgcttccacttcaccttctgccatgagtaaaagctcactgaggccttccaagatgccaagtatatgctgacaccatgcttgtacagcctgcagaactgtgggccaattaaaccactcttctttataaattacccagtctcaggtatttctttatagcaatgcaagaatggcctaacataatctacactaaaatcagactatccaaattacttcaaagacccagaaatgaacaattagcatattagaaattgttacatgaagttaggcatgagcagggcaggagagggctctgctccccacctacgaggaatgtcaggtgattatcaggtgatggtttggcagttatcacattgctgctctaaaaatgataattcagcagccagtgcaccagggagagataatctcctgacggtccacagctgtcacaatgaagtgttaactgaatgcagacaccagggagaggcaacttcccaaacagataaaaacacttaaaattggtaattggctttcaacagggtctcagaaattgggcgagtgaaccgggcacgtgcattaagagacaaaatggtggactatgacttttgggggcatcccaccagaaaagggaagaaaccttcagatgggcatgcatacaacttcctaaacacactgcacatgctcacttcccaagcataaggagggcacatgcaggcagcccaccctaagggagaaatcgtgggaaagaggtgcaagatgctgaaggtgggccagcatataaagccccagggtcaaggttaaatgcctgcttgggtctcttccaagtgtactttcctttctttcccgttctaaagctttctaaaataaacttccactcctgctccgaaagcttgccttgttctctttttctgccttatgcccctcagttgaattctttcttctgaggaggcaagaatcgaggttgctgcagacccatacggattcgccactggtaacctgaataccttctacccctaacagaatgagttgtcaggatacacatgtgccccctgagctgaaagaaacaatcagagtgtggtgaacaggaggctgcaggcctaagggagaaaagcttgggggagcctacagtggctatgaagagagagactgggactctgccagaaacttcccattcctcccaaatatctgttctgggaaatgtgaggttagaaagagaagactgttgaccacttgggacaggaacttttcatagggatctttttgagagtgtatacaagttaggctgtcttggagctaggctggctaaaacaaaaaggtcattgtgtagagcgggaatcacaaacccaagtgcctgagggacaggcatgatggtgacttgctataaggctgtactgtcagggaaatgatttggacaaactggtgagaacatccccatcaagaggggcagtctgagagtcaactcaagctaagggttacatgcaggaatgttggcccagtgatgtcgaattactaagagtaacccaatatttagatttattctaaatacaaagtctctctttttaggtgttgaaagcaaattccaacttctcaaaaacattgtgaaggctgaaaaatacatgttccacagccatgccctccagtttgttgcctcttgtagagggtgtaaaaaatggggattagttacagtgaaaagatgacaacaaactattctattattcagatttatcatatagaaagcctctgaaactgaattagatatggactggttctttggtctagtggcttgaatctcacttgggtctctaagtgggtgtgggatggtaataagatgcatttgtaatcatatgtacctgtagtgctcaggtagatggtgtaggtaatcacagtgctcttttcctttaaatttcaaaatccttcaagcctcaacaatcttcaaactgcaaaatccttctcaatgcagtatttcagatggccaccaccagttaatcagagatgacataaaaaatagaaaatcattgactccccctggcctagatgagcctcatatataatgtacatagttttgtgatactttatcatttatttgtccaagaatatccagagaaagataataaaacatgctgtagtcaaatatggagattagaaaaaatctcaaaagctacttattcatttgtttgaaaaatattattgagagtatcctttatgccaggcacattgctaggcattggagttgctctagctgataacctctaaacaattggttagacttccaactactggcatttcttttctagtcggttcctgtctctttgtcttgattttggtggacagtcccatgacaggcagaatttctgaatttatcccccaaagattccatgccctaagccacagattctgttaatatgatgatacaatatataactccaatgactatgttatgtcatttggcatcagggaccttaaaaggggagattatgtgggtggtcccaaggtcatcaaatgagtccttaaaagtagaggactttctccaactagtagtatgagaagaaggcagaggagaaagtcagagatatatgaaatacgaggactcaatgaaccgttgctgtcttgaagatggagggccatgtcagaagaaatgtgggtggtttctaggaacagcgaatgattccagagagcagacagcaaggaaatgaggaccttggactgactccaaggaattgattctgccaacaacctgcgttagcttggaagggattatttcccagaccttacagataagagcttagcctgctgtcatcctgacctaggccttgtgagatcctaagcaaaaaactcatccacgcctgcctggatttctaacttataaaactgtaaatcactaccctttgtggcattttgctacaatgtaatagaaaaataatacagtaatggtgggaggggttggtgtggggaacccaagagcaacatctatctaaatattagagaataattttatatattcttccaagcttctgtgtttaattctttaaaaaaattccaaaaagtaacccaaaagtttgttggaatgtatagcttatatgtaccaattttggcatttattttgcattcagtagccaggatgagtttgtaacacataactgaaaaaaggcttgtatacacaatatataaggaaatcatataaaccaataagaagaatagaattatccaatagaaagaaaatggatcagaacacttgagcagaccatttcacaaaaatatctatatggccaatattaaaaggtactcaacattcttattcatctgggaaatagacattaaaaccacaatgagatattattatattcttttcagaatggttaaaatgaaaaagactgacaataccaagtgctggtgaggatgtgaaggatgtgaaactgttagtgggagtgtaaattggtgcaaccacttaggaaacactcgttggcagtatctactaaagcatgtaactgacatgtaacctaaggcctagcaattccactcttaggtataatcttatggaaatgcatacatatgttccccaaaagacaaatattagaatgttcacaatagtattatttataggagtggcaagctgaaaaatacccaaatagtaatcaaataaggaagtattcaaattgtgatctattcacacaatggaatactataaaacaatgaaaaagaatgaactattgctatagacaacaatatgatacaatctcacaaacataatttgggcaaaagaacccagctaccaaagaaatacactgtatgatttcatttatataaagtttaaagtccagcaaaatgaatctctggtttaggaaatcaagacaggggttacacatggggaagggatgggagaaaacacaatggggcttttggtgataataattatgtttcatttcttgacctcgatggagaacacataaatgaaaatttaataagttgtacaactaagatttcagtgcttttctctttgcgtgttgtactataatacaaaagtaaattttaaagcatactctattctaatttagtaatataaaagtaactaaaaattcataacctttcctaaactagggtaactcttttctcacccgctagttttatctccagaaacatagtaagtggctctgagtttgaatatgtaaaagggaatgaggaaggtgggagccagagtattctgcaaaaataaacctttttttttcctctaaaaaacagagaacgtataagaaaatccaatttttatcttagaaaaataacattctaagtaaaataccattgtcatttaaaacttatagacttcttttatatagggaaaccctctgaacttccctttaatgacattttccttgaaaggaaagttaagtcggtaacccacaaggaagcttgtgtgtcgtgttataaatactttagcagcccttggaaaactgtttccagctcattgagatcacctgtaagaaactgataaagtatgggccatgcgtggtggctcacgcctgtaatcccagcactttgggaggccgaggcgggtggatcacgaggtcaggagatggagaccatcctggctaacatggtgaaaccctgtctctactaaaaatacaaaaaattagccgggcatggtagcaggcacctgtagtcccagctacttgggaggctgagtcaggagaatggcgtgaacccaggaggtggagcttgcagtgagccgagatcgtgccactgcactccagcctgggtgaaagagcgagactccatttcaaaaaaagaaaaaaaaaaagaaatcaataaagtatgaatagtggctaatttactcttgcgactggtagaagttttatatcttgatatccccccaaaataaaatacaaactatagccaagatgcagttgtgataatgccaataaacctatagtttttgactgcaagggagttaataatctcttctgaagactcatagcagtcttgataaaaaggaattatttaaaaattgctattttatgtttgctcaagattaaaggcgtataagtaaggactacccatgtagctgctgggcaaagatataataccatagggcattcctttctttctttctttctttctttctttttttttacagagggatcttgctcttccacccattctggagtgcagtggtgtgatcataattcatggcagcctcaaactcctgacctgaaacaatcctccagcctccgcatcctcagtatctaagactacagatgggtgctaccatgcctagctaacactgtagggcatttctaaggaaatgataaaacttttctcagtatccttggttttgcatgctagcataatctaggtgatcaaaaagaaaggtttgaagctgagcaaggaaagtaacagctaaagggaaagacagagatttacaggaattcagaaaaatgtcataggtagattaagaggtgttgtgattgaaagatccacgatgtcattgtgcaatgtaagataaaatcatgtagtaacttcattttaaacctacagcataaacattgatgttctgctacattctacacataccgcttaatgatgatgattcataagaacagctaatctatgggtgaacacattgttcaattcacagttgtctttaagtgccttctaggtatgtgtgagggctccacattaggtgttatggaaatactcagataaagatgattggttagtgtccccacagagtttgtagaactagtggcacaacagaaaaacacacagattattaaggtaaagtaaaatgtaaatactttcaagagtcaccaggaaagtattacagagagtgctccttcctctctcaaaaggaaaaatgagagattgaataatccaaataagaacaggatgaatgagggagatggatttgacctgggccggtactatagttttgcaaagtttgtgcataggaatactagatattgggcacaacagtgggaaagctcagggcatttgggaaaaatattttagttattgttccatctttattatcaactacaatagtttgttggttatatttgaaagctactaagatcactgtaaacattaactgtctctcgttacaattactctacagtgagccttgttttattcagccagcaagaatttcatggttactgactgccgtctgtggttctccccagggaaggaagttataaaatagacaactattagagaatcatgtaattttaaaaatccagagcaagttacaagtcagtacagatttggcacaatcttctacatctcttgtctctgtaacacctgcccaaggattggtgttcagaatgatgttcttgagataattgtgtgctcctccaccaaagactcaagtacctaacttaatatatattctcagggacatattttataaatattttagcaaaggtctaagcaaaataagtattccgatgaacttatagaaaataaaatgatccagaacatgtcatttccaaatatgcttcctagcaacaattcaatgttgtcacagagtgaaccatcagctacatcttaattcagcataataggagacttgaggttcattttagagaagtggagcattaagagccaattaaatttcttggtattcactaacagtttggttaaggcgagcactttacatgtattcactcacttcatcttttcatcagtcctatgaagaagtactaccatcatccctattttagagatggaaaagttgaagcttggagaggttaaatattgtccaaggtcaacagagagccaaaatccaaaaccaaatttgtctgactttaaaaggcactgtattttactacagtcattgctttcagaacttttttccttagatgttcatgctttccaaagacatggacccaaatgcccattaatcacagactggataaagaaaatgtgatacatatacactatagaatattatgcagccataaaaaggaatgagttcatgtcctttgcaggaacatggatggagctggaagccattatcctcagcaaactaatgcaggaacagaaaatcaaacactgcatgttctcacttataagtgagagatgaatgatgagaacacatggacacatggaggggaacaacacacactggggcctgtcacgggggcaggggaagggagagcatcaggaagaatagctactggatgctgggcttaatacttaggtgatgggttgatccgtgcagcaaaccatgatggcacaagtttacctatgtaacaaacctgcacatcctgcacatgtacccctgaacttaaaagttgaagaagaaaaaaaaaagatgctcatgctttccttatacttttatgttacttttccaaccacagggctctcagacccaatcatttggtaatatagttcaaccatattgaagtggaagtttttcccatatgcattttaaataatttgttcacaatttattgagcacatatgatgtgccaagcaccacatatgcattaacccttctgctcctcatagcaacttctgagggtggtagtgtaattactaccattttacacaggaaaaatctggcctccatgactccacgcttggccttcgttcactgtctccatcagtgcattggcctcctcaatttattctatagggccctctacgcattcctggttaactactggatggtctcagagctcagtccttgggcctctctcttctctgtctaagctttctcccctacgtatctcatctagccttgcaatataagtgatgatgacttaaaaatttatatcttctgctctgacctgtgtactgaactccccccaaaatactcaactttcaactcatacctccacttacatgattgacaggcatctcagacttagcatatccaaaattgaactcttaatttttcttcaaacttatttttctcagtcttccttatttcaaaaaaattgtccttaaaatgtcaacacagactaaattaaactttatttaataaaactgatagtttcaatagctttcctaaacagaccactgaatttgctaaagtttatcatttgagatttactgaataaatatatctgactccagggttgaggtattgatatctatattgtacacacatacaccacacacacacactttctaagaaataatttgtgtacttgtaatagtatgtaaataaatcaaagtattattaatgaaagtaaaaccaaagccataagcatgtctcactggcaatgaaaaggtgctccacattgttattcatccaggaaatgtatatcaaacttaaaatgagatactaccacatgctgatcagaatggttagaatgaaacaggcagagaatactgatatggtttggctgtgtccccatccaaatctcatcttgaattgtagctctcacaattcccacgtgttgtgggaagggcatggtgggaggtaattgaatcatggtggtgggtctttcccatgctattctcgtgatagtgaataagtctcatgagatctgatggttttataaaggagagtttccctgcacaagttctcttctcctgtctgctgccatgggaaatgttcctttcaccttctgccatgattgtgaagcctccccagccatgtggaactgtgagtccgttaaacctctttcttttgtaaattgcctagtcttgagtatgtctttatcagcagcatgaaaatggactaatacaaataccaagcactagtgaggatgtgaagcaaaggaaactctcatatactattagtgggaatataatatttaacacttaattgtgtcttaaaatggcacctattattttctttgtcaatcccacatcatctactttgggaaattgctatttctctggcttattctgtttgggccattcaacatatgttcttgccttccataccacagttgtagagtgcactatatccctggacacagtgctcagtatagtgatcagcatttgccccaagctaaatcattaagagtcttttagaggagatcagtcttgtttctttttctggcatcacaaactctcaaaataatgtagacttttgggtggtaggaccatcttgccatgacataggagagcctttctcaggcaaggagaactgagagacaaaactcctatgacattattaaacttgtttctaaagccaggatatatcttgggcttttaaggctaataaattccctccttaggctagttgatatagtttggctttgtgttcctacccaaatctcctcttgaattgtaatcccacatgttgctggagggacctggtgggaggtgattggatcatgggagcagttttctcccatgctgttctcatgatagtgagtgagttctcacaagatctgatggtttaaaagtgcgtggtgcttcctctttctctctcttgtcacaatgtaagatgtgccttgcttctccatgattgttaagtttcctgaggcctccccagccatgcagacttgtgggtcaattaaacctcttttctttataaattacccagtcttaggtagttctttagagcagtgtgaaaacggactaacacagaaaattggtattgagagaaatggggcactgctataaagatactcgaaaatgtggaagtgactttggaactcgataacaggcagaggttggaacagtttggagggctcagaagaagatagaagatgtgggaaagtttggaaattcctagagacttgttgaatggttttgaccaaaatgctgatagtgacatgtacatataccactgaactattgttccttatctaatttaagatcttaagtttttaactgaaattgttgtatctatttagctttatctaagagtgatagaaagctattacaatggaagtccataaataactttgaagggaaataaacaactgagaaaagtttttatgaaaaacagatgactaatgcctttaatatataaatagttaatacaagccaataaacaaaaaactaaaagcacctccaactgaaaaatgaataaaggacataaatgacaacagaaaatgaaaatgaccatatgaaaaaatacttacctgcactataaattttttgagttaaattaaaatataatgcaatgtttacctaacaaatcagatatattaaaaatgataatattcaatattgacaaaccctgatgagatgtacacttaaagcattgctggtagtaatataaaatagtgcaacttttctggaagacaattggaattatgtatgaaatatatttaacacattgtctaaatgaaatgagaaatacagacaaacatttaggtagaaagatattctttttagttatttataatagcaatctactgggaaatggttaagtaaatatagaatttatttttgggtgtaatatgaagtaggaatttaattttccccaagtggctaattgtcccagcatcatttacttattagttgaacatttcttcactgatgtttgactatacctctggttccatatggacagtggtctgtttcaggcattttatcctcttctactggtctctttattatcccatgttaatatcagatagacttaaggccacaattttagaatgagtcttgatattgggtagaacaatattctctgtcttcagattgtttcaaaaatattttgactatttttccctgcttccttttctaacttcatgtacattttagaaacagcttattcgggtaacctcaaagatgctttttttgcgattttaaatagaattaaatttgttgatacatttgggagaaatgacatattttagctattaaagcttcccctccaagatcataatataggtctttatgtatttaagtattcttttatgcatctgtatatgcatatgcatatctatatctataatgggttcatgtaacttctataaggtttattccttttggaaccttataattttattgctattataaaggataccttaaaattttaactttctgttttggctgatatacagaaaggaaactgattttttgtataatgatcttatattcagcaaccttgaggaactcttaaaatgagtttccttcctgatggcccactttctcctataaggagctgactaggaactctagggtgtgaaaactgtcaggtttcattcagaatgtgagagtgagttgcaaagaaggcaaacaggtagggacaccccattccctcctgaccctggcaatagtgaaacttggagggctcttccctaaaatggtatctatcccagtggatgagaccttgtctctctgatgtggaatgctgcagccttacagagactattgtcttcagtctgggagctggttccttctaagcctttgggttttaacctgttacctcttcactgactgctctatttaaatcacctgccaaccctcacctgtgcctgcccttattccctattacagaatactgttcttgtcctttatggcaacgatcacactttatgagtttatttgtttggtaatattcttgtttactgtctgtttttcctatccattgcaagcttcataagagcagggaccaggtctattttgttcaccttcttcctggtccctgccatttagttcaataaatgtttgtagactgaatacatgagttagatgtcaaatacctgcttcaatttttaatgttaacaatccacttgtctcatcatttaaaatataccctacttatgtaatctgattttatcttcataattgtctttaaaatagggatgctagtccccatttgacaaataaggcacagggaaatcaaatcatgtgctccaaattaatatctagaaattagtagagttgaaaacagaacccaaatcatctaactcaacatctaattaaaataaaacatataacaaaaagaagagagaaagaaaggaaggaaggaaggatggagagaagaaaggagagaggaaaaaagcaaggtggaaagtaagggaggcgatattcatttgtgaactttccatgtcaagggcataccacatcatttatccttctaaaaactccttaagtttcatactttcccattaggaaacctcatagtctccagacatttcaggccagcagacagattaagaatagtcttgtatgacattgttatatatgagtcatacagtgtgagaaataaaggagtatgcagttatagagtaagcctctttttctcagctacatttcacaacataaaactagctggtaaagtcaggtcacctaatcgagtctgataattgtaaggtttactcacagcatgatttaagtttcaatttcaagttccaattcattctcttataatttttctgccttagtcaacattacacaagacgttggctctcttaacatttaagatccacatgagaatatcttgtcggttttactataggtatgagtgtagaaatagtttctttctagtagaatcataatttaaaaaaagaaaactgcactcaagtttttattttaatcaatgatactacatctcctttatttttcttatccctaaatctgattgtgaaataaatggtcgtttctattattttgattagctggctttgtactgtgaagttacaagaaggaaaggaatcacctactgctgtcagtctctatgtaataataaaaaaaaaaagtaccagtccttaagttaataatactatttttgtgatttggaggggaaaaaacactttgctgccaaagggtaatccacatagaagagctgattgctaggtgaaacactgacagaatgagactctattatggaacctattgacatgagaactctacatcactgtaaagtacagccactcacatattcctgaactcaaacagagtaaaatgatatagtatttatgaattctgtctgctccaggagggcatgacaatacatacttaatccaacatggtttatcagggacagacagtgacgttctggtgcttagagatcacaccctcaggaccccaacatacccattactgagacatcatattctatcagcagtgctgcttcttgtccacattgtttaagaatactcatggcttcagcatgcgtagttccaagaagccgaattccatccacactgagcaacctgtcaccgggtttgatcgtgccctctctgaagggagaataaaggaatagtcttgattaatttagcataatggggcttagtattaatagtcactttagccaaattcgttttgtcacacatattctgccatccatctcatttgcattctttttaagcatcaaatgtgacagtaagagtataaagaagtaaccctgaacagaaaattgctgtaatatgaaaatcagtaatgagaaaataactacacattagcaaaaaaacctaattacccacaggtaattcttggagtacaaaagtaagaagggcacattttccctttttctaggtttttgcctgaatgtctaaaatggatttattggaggccagaaaatactattcacctattttcccaaagtcaggtaagcagaaaagcctgcgaatttcattcaaatcattactagtgaatccaagcaggataggaactgctggtaagaaatctcccttgtctataaatttccctactgatttataaggccatttggcaataattcaattgattcgatctcacattccctggaagaggaaggcaaatgctatcctccctgctgtgaccacagacactcaaggcattgagagatgactcaggacttcagtgacaccacaaaagtacagccagggtggcccccagataacactccctgcctcagggaggggcacaaaaataagaaaatcaaatggtgggattatatgtttaggatttggaaagaataataatgacctttgaaataaaaatgtttcacctagttcactctctaagtcttttggctccaatttttttcttaaattctcagatttctttgagttctaaattaatttggtaatacaagtatgccactcacaagctcgtagcctatgttttgacatttctgtcaactccaactctaaatgttaataagaaatgaaaacattctaatttgcttcaggaagagtgattcactagacacatgagaagggaaaaggggaaactcttggacattttgttacccgctgcaaaagcaaatatacgtcagcaaaagtaagaaaccagtgttttcctattttctaattttatatgaaatatcactttcttaaaagtgagctaatcatatgagtttcaaaggaaaagaagcctgaattcctcccgcagttctttgacttactcactgccatactggcagttctgtcatctgtaaatgtggatacaaagacctcatgtagagggtggttgtaaggataaaataagataatgtccaccaagccctcagaacagtccctagcacgtagtaaatgcttaataaataatggttattattattattatctctatctcttaacaaaggtttttaagtttatcctggtctgaaacagagagacaggaggaatcagtgcattttcctcctccccttcaacaatctctaatggcagcagttgtgttcccccatcattatagagtcaacttttgctgtgggaaactaatacagagatgagtatctccagagacacctaagttgtgagtttactcggggccctaattataacaggaaagttgaaggcatttgcccttcacatattcaaattaacaaggaagagaaatgcaaagaaaactctacagactaatgaaatgtcttccattttacggaaagtcacttccattctgacctacacagtcactatcaaagaataacactaataataagaatgttgagaatggtaagaatctcaccaccaccacctatctgtccaggctgggagattagcaacaggcgaagatgcatttccagcatctgcctaaatgctgagttctgtaagtacctcccctgtgccatgccccctgcaaggcattatatatctccaatctttgataaaactgatcagctctgaaaggtggtattattacctacatttccaatggtggtggaaattgacctcagtattaagtcacttgacaaagatatagtaagtatagaatctagaggcaaaccttttttttttctgattccatagttcagactctcaattttcacattgtaacatgtttgcttaatagctacattttactgtaaaatttctaatttatcaacttctatgttaaagtccccagctttatttattctattttggatagtgacacagaaagataaagtttacctgtcagcaggccctccaggacgaacacatgttatcacaactggacgagatttatttctatcatcatgtgctccccctagcaaagaaaaggaacagagcttaaaactgctttcattgttggcatttaaaaaaaatcacctacaagatatcagctgagaaatgtcctacttgatgtacggaggaaaatatgtaaaattttccttgaggcatacaaaagccttaaaggtcttgctcattttatatagaatatatttttgaagtcaccatttctccatctttcaataaatatatggctgtaaccaggtaatatataaagtatttaacaactggaatggcaagagaatcaaccgattatatcaagtactggcccgatttgaacagctgtcagttatacagtacagatgtgtatatctgtgccaatcaaactgatctaaaatactggtcagtaggtctacaacctaacataaaggaaacaaaaaccaaagtaaaagaaaaatcctagtactaaaaaagaaagccaaaaaaaaaaattcaagtgaccaagtggctttcattaaaagtgagatgttcaaaaatttggggcaaaattttcagactgtgtcaagccagctgcaatccttgaatgggaattttaactttctgttagaaaacttctccacaagaattcatagaaacatagatgtttcaagatggaaggtaatttattgtaaattttctttttaatccatgacccttttgtacaatttccttaatctgtgctcccccagcgtctgcatgaaatgcacgcgtgctggcctacttactagatgtgaggctgctcactccacatttggacaccaaggagtgttagaaagttcttcctaatatttaactgatatctcttttcctttaactttcatccactcgtctttgttctatgatccagagcagtaaaataaaaatgtatgctctcttttacaaaaatgcttttccgaaagttgaaaacagagattatacgctggctaaatctcaccttcttaatgttgaacaatgccagtttccttatctattctttatgtgacctgatttctttgcacatcaccatcctgactgtccatctgggagttttctagtttgccaatatctgataaatataaacctattgtcaattattgctcccttaatgtttgcctgctagaacagatggacatttcccaaacctggcataggccgaaaggtcaacttatagaaaatagcctaagagaaaaattaaaaggcattcacagttcctcaggaaggcaaatgcttcttttgtgctcacttctacgacaagtgatttgtttagtgtgattgattggtaaaagctctcattcagtattttattcttgcattgtgtttagcttctttagaaattcctctttaaaataagaaattcaccactttctcagaaaaaaattttaaaataaaaattttaaatgttaccacaaatgcttgcccatatttatgtaaatactgttacataatttctcttttgcaaggtgatcataaaggataggtttgcttttccctaaaggaaaactgattgagaaaaggatgggggtcaaagatagcaagaaatcgttccataattttggtttgtatttacaaatttcaatatgtaatatcgaatgcttgttaaagtgtgaggtagttttatatttcttgatatgtggcattttactgttatttgtaatgaaccaagttccctgtgtgacttacttaggttctggaagtttgcagcagcaaggccaaacaggaaccactcagagaccagtgatattctcaatcctggtgtacattagtatcaactgggatgctttttgaaaatatcaatgccagggccacagtgcagaccaaatctgaacatcaagcagcatatgttaaatgactaggcccacctacaattttacatttgagaattactagagaaggtttccttgtctaaagtgtaaagcaacttcatggcagagtgcctttcctatcagtccaactcatctcttctggcttgcttgcattaactgaaatttaaccctccaaggtttaggccagaacatcatttttattctatggatgcaagcttctattgtttagggaataaaggttttagaacctgtgacttatagcattagaaatataattccattcatcagctaaaagcttaatgttgcaagttccattctattaggttagaacttctcccatactaaacagatatgctccatctgcaatatcttctctttcctgactgtcctagtattttctattgatctaagtttagctcaactcccatctatgccaaaatatcttatctgccatactaatatttactcacagcactttctcattctgattaaccagtgattcttaagtgatgggtagtgaccaccttttgaacagggaaaatcctccagatggacctctaactaatctaaaaacagaaatcctatatttgattctcattgagaaattattcaaaactccaaaaacttttatgttcaaccaacatattaagggagttattaaggcctataaaaatgcggtcctcataaactaatactggcttattgtaacttaagttttttaaaatcagtataatactatgaagtctgatgtccacacaaatctaggcaacattcaatcattcacttattaagtgcctccacataccaggcagtattctaagctcacattataaaactcctggatatacacacagatagtggaaattcctgcaaactgtgggaagggtgttttactaacattacatcatcagttgtcttgaggtggttgtgcatttcagttgcttctattctgtttatttcttgataataaattactcttggtttagctctttcattagtaatttgattcgctattgactaaccatacagtcactatcaatgaatatctgcaacagcagtatattttggtacagtgtttcaataattaggctatgtatgcatgtgattcaagaaccttctcgttcagatctgtattgcaaaacagatttgtatatatcacccttcagccaaaaattacttgtacagtgacttttcactatattcatctagttattttaaacagaaatttaggaatggttagggtaaatgatcttgggctctgttgctccacctaaaaataggccttggtcagaaaaatgtaataactacaagtctaaacctctcaatgagttcctagttccacatcctctctactactcacttgagcactctatcaacttttgtcttaaattcactggactgtaattccttgtagatcaaggtattgtcttatgactccatagtacttctttccatgctgacatgttgacatgtgcttaataaacatttgattgattgatttgttaagtgactggcacaaaatgaaagctactatttaaaactcaatcacttaagacaaatccaaatctgtacaagtttatccacatctcttttattctttgatgcatacatatttattaagatgtttaattttaattaatgttttaataattttgatagaatttttactctggtgaagtataaaatcttataggtgaagacaaaaacaatcaagaaatgtgaactgttaaaacattcctggtggagccaagtggccaaataggaacagctccagtctacagctcccagcgtgagtgacgcagaagacgggtgatttctgcatttccatctgaggtaccaggttcatctcactagggagtgccagacagtgggtgcaggacagtgggtgcagcgcaccgggcgcgagccaaagcagggtgaggcaatgcctcactcgggaagtgcaaggggtcagggagttccctttcctagtcaaagaaaggggtgacagacggcacctggaaaatcgggtcactcccaccctaatactgagcttttccaacgggcttaaaaaacagcacaccaggagattatatcccgtacctggcttggagggtcctacgcccatggagtctcgctgattgctagcacagcagtctgagatcaaactgcaaggcggcagtgaggctgggggagggtgcctgccattgcccaggattgattaggtaaacaaagcagctgggaagctcaaactgggcggagcccaccacagctcaaggaggcctgcctgcctctgtaggatccacctctcggggcagggcacagacaaacaaaaagacagcagtaacctctgcagacttaaatgtccctgtctgacagctttgaagagagtagtggttctcccagcatgcagctgtagatctgagaacaggcaaactgcctcctcaagtgggtccctgacccccgagcagactaactgggaggcacccccaaataggggcagactgacacctcacacggccgggtactcctcttagacaaaacttccagaggaacgatcaggcagcagcatttgcggatcaccaatatccgctgttctacagccactgctgttctacagccaccgctgttctgcggccaccgctgctgatacccaggcaaacagggtttggagcggacctctagcaaactccaacagacctgcagctgagggtcctgtctgttagaaggaaaactaacaaagagaaaggacatccacaccaaaaacacatctgtacgtcaccatcatcaaagaccaaaagtagataaaaccacaaagatggggaaaaaacagagcagaaaaactggaaactctaaaaagcagagtgcctctcctcttccaaaggaacgcagctcctcaccagcaatggaacagagctggatggagaatgacaagttgagagaagaagacttcagacgatcaaactactctgaactacaggaggaaattcaaaccaatggcaaagaagttaaaaactttgaaaaaaaattagacgaatggatacctagaataaccaatgcagagaagtccttaaaggagctgatggagctgaaagccaaggcttgagaactatgtgaagaatgcagaagcctcaggagccgatgcgctcaactggaagaaagagtatcagtgatggaagatgaaatgaatgaaatgaagcaagaagggaaattcagagaaaaaagaataaaaagaaacaaacaaagcctccaagaaatatgggactatgtgaaaagaccaaatctacgtctgactggtgtacctgaaagtgatggggagaatggaatcaagtgggaaaacactctgcaggatattatccaggagaacttccccaatctagcaaggcaggccaacattcagattcaggaaatacagagaacaccacaaagatactcctcgagaagagcaactccaagacacataattgtcagattcaccaaagttgaaatgaaggaaaaaatgttaaaggcagccagagagaaaggtcgggttacccacaaagggaagcccatcagattaacagctgatctcttggcagaagctctacaagccagaagagagtgggggccaatattcaacattcttaaagaaaataattttcaacccagaatttcatatccagccaaactaagcttcataagtgaaggagaaataaaatactttacagacaagcaaatgctgagagattttgtcaccaccaggcctgccctaaaagaactcctgaaggaagcactaaacatggaaaggaacaactggtaccagccgctgcaaaaacatgccaaaatgtaaagaccatcgagactaggaagaaactgcatcaactaacgagcaaaatcaccagctaacatcataatgacaggaccaaattcacacataacaatttaactttaaatgtaaatgggctaaaagctccaattagaagacacagactggcaaattggataaagagtcaagacccatcagtgtgctgtattcaggaaacccatctcacatgcagagacacacataggctcaaaataaagggatggaggaagatctaccaagcaaacagaaaacaaaaaaaggcaggggttgcaatcctagtctctgattaaacagactttaaaccaacaaagatcaaaagagacaaagaaggccattacataatggtaaagggatcaattcaacaagaagagctaactatcctaaatatatatacacccaatacaggagcacccagattcataaagcaagtccttagtgacctacaaagagacttagactcccacacaataataatgggagacttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcaccacactgcacctattccaaaattgaccacatagttggaagtaaagcacccctcagcaaatgtaaaagaacacaaattataacaaactgtccctcagactacagtgcaatcaaactagaactcaggattaagaaactcactcaaaaccactcaactacatggaaactgaacaacctgctcctgaatgactactgggtacataacgaaatgaaggcagaaacaaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgacggaaatagagacacaaaaaactcttcaaaaaaattaatgaatccaggagctggttttttgaaaagatcaacaaaattgatagaccactagcaagactaataaagaagaatagagagaagaatcaaatagatgcaataaaaaatgataaaggggatatcaccactgatcccaaagaaatacaaactaccatcagagaatactacaaatacctctacgcaaataaactagaaaatctagaagaaatggatacattcctcgacacatacaccctcccaagactaaaccaggaagaagttgaatctctgaatagaccaataacaggctctgaaattgtggcaataatcagtagcttaccaaccaaaaaaagtccaggaacagatgaattcacagccgaattctaccaaagctacaaggaggagctggtgccattccttctgaaattattccaatcaatagaaaaagagggaatcctccctaactcaatttatgaggtttgcattatcctgataccaaagcctggcagagacacaaccaaaaaagagaattttagaccaatatgcttgatgaacattgatgcaaaaatcctcaataaaatactggcaaaccaaatccagcagcacatcaaaaagcttatccaccatgatcaagtgggcttcatccctgggatgcaaggctggttgaatctacacaaatcaataaatgtaatccagcatataaacagaaccaaagacaaaaaccacatgattatctcaatagatgcagaaaaggcctttgacaaaattcaacaacacttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctctcaccactcctattaaacgtagtgttggaagttctggccagggcaattaggcaggagaaggaaataaagggtattcaattaggaaaagaggaagtcaaattgtccctgtttgcagatgatgtgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagttaactcccattcacaattgcttcaaagagaataaaatacctaggaatccaacttacaagggttgtgaaggacctcttcaaggagaactacaaaccactgctcaatgaaataaaagaggatacaaacaaatggaagaacattccatactcatcgataggaagaatcaacgtgaaaatggccatactgcccaaggtaatttatagattcaatgccatccccaacaagctaccaatgactttcttcacagaattggaaaaaactactttaaagttcatatggaaccaaaaaagagcctgcattgccaagtcaatcctaagccaaaaaaacaaagctggaggcatcaagctacctgacttcaaactatactacaaggctacagtaaccaaaacagcatggtactggtacaaaaacacagatatagatcaatggaacagaacagagccctcagaaataatgctgcatgtctacaaccatctgatctttgacaaacctgactaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaacaataaaaaccctagaagaaaacctaggcaatatcattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagagaatttttgcaatctactcatctgacaaagagctaatatccagaatctacaatgaactcaaacaaatttacaagaaaaaaacaaccccatcaaaaagtgggtgaaggatatgaacagacacttctcaaaagaagacatttacgcagccaaaaaacacatgaagaaatgctcatcatcactggccatcagagaaatgcaaatcaaaaccagaaggagataccatctcataccagttagaatggcgatcattaaaaagtcaggtaacaacaggtgctggagaggatgtggagaaataggaacatttttacactgttggtgggactgtaaactagttcaaccattgtggaagtcagtgtggcgattcctcagggatctagaactagaaataccatttgacctagccatcccattactgggtatatacccaaaggattataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccataaaaaatgatgagttcatgtcctttatagggacatggatgaaactggaaaccatcattctcagcaaactatcgcaaggacaaaaaaccaaacactgcatgttctcactcataggtgggaattgaacaatgagaacatggacacaggaaggggaacatcacactccggggagtgttgtggggtgtggggatgggggagggatagcattaggagatatacctaatgctaaatgacaagttaatggatgcagcacaccaacatggcacatgtatacatatgtaacaaacctgtacattgtgcacatgtaccctaaaacttaaagtataataataacaaaattaaaaaaaaatttctgactgtggaaaaccaaatactgcatgttctcacttataagtgggtgctaagcattgagtacacatggacacaaagaagggaacaacagacactgaggcctatttgagggtggaggttggagggtgggaggaggaggaggatgaggattgaaaaactgattgagtatgatgatgattacttggatgacaaaattatctgtaccccaagcccccatgacatgcaattcccccatgtaacaaacctgaacatgtaccccttgaacctaagatagaagttggaaagaaaaaaaatccctgatgtttatatagctccctattgaagctcattgtcatcctatgagttgagagttgttaatgtaggcacagtctttaaggaataaaattactaatgagaaaatataatgcaagatagaattatactttagaattagtaggttttttttttttttttttgagatggagtctggctctatcacccaggctggagtgcagtggcacgatctgggctcactgcaagctccacctcccgggttcacaccattctcctgcctcagcctcctgagtagctgggactacaggcgcctgccaccacgcccggctaatgtttttgtattttttcagtagagatggggtttcaccgtgttagccaggatggtctcgatctcctgacctcattatctgcctgcctcggcctcccaaagtgctgggattacaggcgtgagtcactgtgcccggcctagaattagtagttttatgataagttggagtcacctgaaattgttattatcaatgccatactataatatgatgacttgagctgaagcacatagatacccaagagattagaatcttcgatccatttttagaaagctacaataaccaaatgtgtttctggagaaatttatttaaataaagtcccttaatcctagtgtattaaatcaaatcaagcatactaatcaacatttttcagtgatatcgaaaaatataaaaggaaagacaaaagacatgttgaaaagtataggatgactgaattgacaaggtttataaacattggctttttgctctgtattaatgaaccaaaaatagagctacatatggtttccagttttattatcattcaatgttgcgtttatttaaagaagagaagatttttctaacccagagagtgagagaaaatctttacaaccaatacatccaacaaaggactaatatccagaatctgtagggaactcaaagaaattagcaagaaaaaaccaaacaatcccatcaaaaagtgggctaaggacatgaatagacaattctcaaaagaagatataaaaatggccaacaaacatatgaaaaaatgctcaacatcactaatgatcagggaaatgcaaatcaaaaccacaatgtggtaccaccttattcctgcaagagtggccataatcaaaaaataaaaaaaaaaatgttgacgtggatgcagtgaaaagggaacacttctacactgctggagggaatgtaaactagtacaaccactatagaaaacagtgtggggatccttaaagaacaaaaagtagaactatcatttgatccagcaattccacaactggatatctaccagaggaaaagaagtcataatacaaaaaagatacttgcacatgcatatttacagcagcacgatttgcaattgcaaaaatatggaaccagcccaaatacccatcaatcaactagtggataaagaaactggtatacatatacaatagaatactactcagccataaaaaggaatgaattaatggaatttgcagcaatctggatggaattggagaccattattttaagtgaagtaactcaggaaaggaaaatcaaatatcgtatgttctcactcgtaagtaggagctaagctatgagaatgcaaaggcataagaaagatacaagggactttcaggactcggggaaagggggagggggctgaggaataaaaggctacaaattgggttcagtgtatactgctcgggtcgtgggtgcaccaaaatctcacaaatcaccactaaataacttattcatgtaaccaaatacccaaataccacctgttctctgaaaacctatggaaatattttttttaaagtagatttttctaaccaacacctacctcgaattacaaaaccaaaggtattgccttctttatgtaatgtgacctccactgttcggaaaataacacttgatccttgcacagctgaataaaggaaagagagaaggaaatataacttgtaagtcatcataacatttctaaatcattcaatgtggcataaaatattacagatccctgttgcaaataagttttgagtaataagcaacaattccttttcaaagaaaatgtttaaaaaactgtaatgacataaaaataccataaaacagtcatctgtataagtgactcatatagatacaagtggaaacaaaatcatagctagctcatttccttctatatagttcgtttctagataagagggggatatttacattgtttaaactctacctaacaagagagacaatatttatataagtagaattgttttccttttgtaaaatgcaaaaacaatatttttgtaacacttgtacaataacttctgtatttatttttattttgcagctggcacaggaagaaaaattatcattctcagattgctatcaacaattaggctgatgctaatagatgttctgacatataaatagctattaaactaagacacagcaacccagatgaaacttagagggcaaaagaaattctaagtgcatttaaaatactactactatctaagaaactacagattgacttaattttacttgatatattatgcttatgttgtgtttgcatgattatcactttcatttaacaaaatggaattgtattgtcaagctgcaatctctagtcacattacatacatgtatgatggtataaggtatatgaaggtacatttactaaaatattctgtaagattgcttacaagaacctgttgagtcattctagttgtactatatacaccatttctgcataaaaaaacccataaaacttccacaaactggtattttatcattatgcacagagaaatgtttttattcatagagacttgtaatgtgtaggagaattttagatctttattttgaatttgtacctagttaataccatgttcattaccaagtaacacatttttttacattgctactagatcctgaagggtttattagataaaactatcagcaaaaagtatacagtcaggccaggcgcggtggctcacgcctgtaatcccagcactttgggatgccaaggcgggtggatcacaaggtcaggaattcaaggccagcctggctaagatcgtgaaacctcatctctactaaaaatgcaaaaatcagctgggcgtggtggaagatgcctgtaatcccagctactttggaggctgaggcaggagaatcacttgaacccgcgggggcggaggttgcagtgagctgagatcgtgccactgcactccagcctgggtgacagagtgagactctgtctcaaaaaaaaaaaaaaaaaatatatatatatatatatatatatatatatatatatatatatatatatatacacacacacacacatacatatacatatatacatatatatacacacacaggcagaatccaaaggcattgtttaaaaaaacttttcttacagaaatagcaagtagttttaggctttaattacaattatttttaattatcagaaattctgaaccctcaagggaagaaacatgattaagaaaagtacacatttaaattcataaaactgtccactatctggctgggacataaagtacaataaaaatttggatcggctgaaaaacaacataaacctacagttcaaaaatgttttggtatactgctgatttaattaaatgtcatattcttgctatcaggggaatttcagcttagactaatcaactaggaacagtactcacaaacagatgaaagtgttgaggtacagttttaattaaacaaaaaaaattgagttcattccaaatattttcttatttccatggcccaacaagccacttgaagaaattggttaagaaaatgattttttttttgttctcttggtaagtgaggaaaggaaaggatatggaaagaaataattaataagaatttactgtgtgctcagaactctgcaaaaatggtttacacatattatttcatttactcaataaatcagctttcaatgacatataattgaattctaattctgggccacctgtcctttttggctgggtatctgttatgggaatgcaaagtactgcaattttgattttgctgtagctaaatcttgctgactataaaatcttacaatcaaatttaaagtcaatataaaggctctgtattttctacagctttagattatctacgctattgttctccatcatttacaaagataaatttgaatgttgactgcgttttaatacaattaatgaaatagatttggtctttcttgtttttatttgcatggctggctcttcatgattgggttttcacgtgcagtaccagacatcctgcattgccatgtaaattttactaatgactcatacatatgtatgtatacacaaagttccaattaaggtgcttacccaaaagatcaaaaagtaggtagaaaccaaattcacaatgcaaaaattctcctcggtctttcaattgtgctgttgtcccttctttctacatgtggatattcatgtacttctacacagttattttcctatggtagatgaggtttttgaaattacaaactccttccctgcctccctattccctgtctcaataggagttgtgaactttcctacctcattatgctgcacttgcccatgtgacttacttttgccactaggatgttaacagacacaagcagaggctggaattgcacttacatggttgtgcttgccctgttttccctctgccattgccacaagaagagcgtcctccaggtagctgctgctccctcaaactgaatcccagagtaaatcacatggaggagacctgagactctttctccctctctcctcctccacttcaccaccaccaccaccaccaccaccatcatctgtctattttagaactgagaagtcagaaggctgtcaaagggacatgctttaacacatttatttgagttaaaaatgactccttaggatagaaaggtcatgtgagttagctaatggagtaacagtgaagagtgcctttgccaatcagattatagggcagactgtttttcattaaatgaagtaaacctgtagctccaaggtttgcatgaaaacagaatctaaagacagataaaacaaacaatatgctaggaattgcatcctttctaactattcatgcttatgataattttaggtgttaactaaaaatggatgagaattatgtaacatttcaaaattctttaagagttaagtgaccaaaaaatttgaaggcactgctctagaccaaatttttatttttattatttatttatttttaattgagacagggtctttctatgttgcccagggtggtcttaaactcctgggctcaagggatcctcctgcctcagcctcccaaagtgctaggattacaggtgtaagccaccacagctggcctagaccagcttttaatacataaatatcaggccgggcgtggtggctcatgcctgtaatcccagcactttaggaggctgaggcaggtgatcacctgaggtcaggagtttgagaccagcctggtcaatgtggtaaaaccccatctctactacaaatataaaaattagccggacataatggtgggcacctgtaatcccagctactcaggaggctgaggcaggagaattgcttgaatctgagaggtggaggttgcagtgagccgagattgtgccactgcactccggcctgggtgacaagagcgaaactccatctcaaaacaaacaaacaaaaatacataaatatctaagatacaggttggtaatattctctctaaacacagtctcaaagaatcacataattttaaagtcagaaagagctttagagcttatatagaccaatcattttattttcataaagaaactgaatcttagaaagggccaaggtcaaaccagttttcttctatcagattacacacacacacacacacacactcacacacacacacacatacacacactctctctctctctctcttttctgattctttctgaactctgtggttagctgagactcaaactgctgtgatcctgagatagctaccagtcttggccttgggtcgcttgtcttttagcagtcagttctccttatggaccttcaggtgtggatggcctgtttctgctctagctgtctgagctaagtgaaaggggaacttattaattccttcaaccactctcaactcaagtatccgattactttcttcaaatatagtagaaagagacagattattcttggagaatagaccccttttgatttccgtcacaacaattcacacttttgtgtttaaaaatattttgccccttttccatcagctttattgtatgacagggaaaaagatggtactgcataatgaccaagtcacgataggttttaactcctaaacatttctgatactcatctcctttaactctactaatgctatttttatttaggatatcacttctcttttggaaaatcctaacagtctttgggcttgtagcctctggtcttttctctattttgcctcctacaatgataaatctaaatactcagatcttatgatgctgttctcctttaagggctcctcacggcccactggatgccaagctccaacaatatggcttataaggccatattatacactatttaaattctcatttggtcctcgtgtacctcattggcctcatctatctccaagccccctctttctttgtccctccttctccgtctttctccctctttctctcttcccttcctcccttccttccttctgtccattcttccttctctctctctctctttttgagatggagtcttgctctgttgcccaggctggagtgcagtggcataatctcggctcaccacaacctctgcctcccaggttcaagtgattctcctgcctcagcctcccaaatagctgggattactggcgcccaccaccatgcctggctaatttttgtgtttttagtagatacagggtttcaccatgttggccaggctggtctcgagctcctgaactcaagtgatccatctgccttggcctcccaaagtgctgggattacaggcatcagccaccacacctagccccctctctgtctttccctatctgtttgtagtttaactgtgggctgggctgtcatcttcccttcgcgctgcaccctttgtctgaaatattcctcttcccacctggctagcatgacctcctttaagtcttcctggaaacgcctagctctgaatcacccacaacactggacaaatcttcactattagcctttgcctaaaagctatacttagagtttcttttaggaaggggttgtgttttattgatattcatatccccagaggaatacagatgtataatcaaagagcattagctctagataactggtttctcttatgtctttggcaatggtttgagagagtaatttcaaagcaaactgactcatttaaagttaaaaaaaaaaacacagtactttcagtataataatgtaataatggtaataaggctaatgttattagttacttacaaagtgtttgataatggtctcaataatgatcatgtgattataacatttaatcattacaaaaatcctgcaactactatagctattttatagattagaaactgaaggctcagagaatttaaataacatgcccaaggtcacaaagacagaaatgagcaaagctgccatgtaactgctgacacagtctaagcctttacactctattttattgcctagtcttgctgaaaacgaaaaaatgttgtagcaaggtttgtgaacatagtcttaaattgattttgttacaaaatgactactaaatctttggtgttagactttatgtgaagaatacgaacttgtgactgattatgcacatgtttcctgagtactggaatctgatccccaagcttcgaacaccatctatattcccattactctcaaatgtatatttacagtacagatctttctctcaaactccaaatcatatcttcaggtcttgacatttcctcttgcatgtcaaataggcacctcaaatgtagtatttcaagccatgaactgctgatctttccctcacaaatcagctctgcccacattcttatccattcctgttaacggatactctgtccttccagctgctcatgctcaaaaccttggggttaactttgactcctctttttctgcacaactcacaaatccattaggtaatcctgtaggctctcccttcagaacagatctggaatctgactgcttttcactgtctccactgccatctctcacatggatcactgtaactgccctccagctcatctcccagcttctaccctggtctcttacagtctgttgtcaacacagcagccagagagcctctgaaaacaaatcacatcatgtcactcctctgccccaaaccatatagtgacttcctgtatcattcagagaaaaacttaaggtcctcccagtggcctatagtgataccccacccccttacatttctgaccccatttcctaattctcttactgctcattctgctatagccacactgtcctccttaatgtttctataacaaccgtaagtatattcctggcttttggtcttagcaatgactgttcattcttccgggaactcttttcccccagaaatccatacaaccaactccctcacctccttcacaagtcattgactaatctcacattctcaatgatgctgtcctaaccaccctatttgcaattgtattcccaccctgatcccagcactctcaatccctctccttgcactgctttttcgcatagcattcatagtattcatactgtataattatttattatggttttattttattatctgtcttctgctacaatataaactctactcatgttccccaagctcctagtacatagtggtggctggaacatagtaaatgctcaataagtcattgctgaacaaatgaattctaccaactcttcataatcaacctgagttctcattagtatggaagagcaaaaagctatctcagggtagcatccatgttcatagctaataataggagaggtggtgctagaacagcataaacactgggcagcagtcatatatcagtatacctcacaatgaatatgcatatggactttggagtctggcagcctggattcagatattgaatccaggctttgtaaaatgagaaaaaaaaatgcctatcttgtagtgttgattgcctttttattgaaaactttgatagtgccaggcactattctaaatgttttccaaatactaacttaattaatcctcataacaaatctatgagtaggaactaataatattcgcattttacagatgtggaaactaagacatagaaagtgtaagtaactttctcaaaggcatgtagctagtaaaatgtggagctgggatttgaacctgtctatttgatactaaagttcatctctgctatgctgacactccttgtggaaaggattaaataattcaatgcaagtcaagttctttgtaatgccagacatttggtacaatcaaaatctgttggctactgctgttataattactattattactacttgacaatatgtgttctgaagctattttcatgcttcagaaatggatatatcatatatatatatatatgtatacctactatgtacccacagaaattaaaaattaaaaaagaaattaatgtatccataaagaactaatataaaacatactaaatatgcttttcctaaacctagtcactaagtacaaaacctggatggtacttattgcacagaacttacaaacatgttgaattaaaatggcttaggtggcaaacagaacatgggcccttcataatttcattgttagtgatgcctttttaaattcttcctgagtaggttgtaagttttccaattcaaataatttttaaatactaagaaagttggctttgccattcctgtaatgagatattgatggcaaagggaaaaaattcagaagctgattttgctttggaaaaactggtgccgctgttcttcctctgcgttatgattatagcaattcctccttatctgcagttttattttctgtggtttcagttacctccaattaactgcagtctgaaaatattaagtagacaattccagaaataaaccatccctgttttaaattgtgtgctgttaggagtagtgtgatgataatctcacattgtctgctctatccatctggatgtctggcacattcacgctgtttacactacctgccttagtcactttgcagccatctttggtatcagattggctgttgtgttcttgctgtacttttttttttttttttttaaacagggttttgctctgtcacctaggctggagtgcaatgacacaatcatagctcactgcagcctcgaccttctgggctcaaggaatccttctgcctcagcctcccaagtagctgggactacaggcatatgccaccatgcccgactaatctttttttggtagaaacatggtctcattttgttgcccaggctggtcttcaactcctggcttcaagtgatcctcccgcctcagccttccaaagttctgggattacaggcatatgccaccatgcctagcccttgcagtacttgtgttcaaggaacccttattttacttaataatggctgaaagcagaagagtagtgagattggcatattgatataattattccattttattaatgttgtgtgtgtttgtttttttgagacagggccttgctatgtcccccaggctggatggcagtggcgtgatcatgtctcactgcagcctcaacatcttgggctcaagcaatcctcccactttaacctcctgagtaactgggactacaggtgtgcaccaccatgcccgactaatttttctattttttgtagaggtggggctttgccatgttgcccaggctggtctcgaaccactgggctcaagcaatcctcctgcctcagcctcccaaagtgctaggattatagacgtgagccaccgcgcccagccagttattgttgtcaatgtcttactgtgccaaatttatcaattaaactttatcataagtatgtatgtatagaaaaaaacctgatatatatagggtttggtattatgagcagttttaggcatccactgggggtcttggaatgtatcccctatggataaggggggctactgtacttacagaccggtggaagctcgtactctacttcaagaaccactctttctcccacattcttcagcaagctgatgatctcgtcatggcggaatttggccaggttgattccattcactgctttgatgtagtcacccacatccagctggtcacttctgcaaaatagacaatgttgtttcaacagacccaccctctccataggccagtctgactatatttccactttcccttcatggtaagcatgcaagtgtagaagcaagcctagaaggctgacagcagaagtccctgcctcctaggagacggtgggcccttaagggtaagagtacagctgaagtcagatgagagccagggatcccttttactcatgcagcctgtgatactttggaagtcctgctctgattctgccactatctctgatttttttcctttttgcctgttttatttttaaaagcaccataaaacaaaatcaagagaagcttttttttttttttttttttttttcagttctttgccctaaaccagttggttctctgggatgggatccagatcctagacacaacacatgtctttttattctcaatccctcttgtttttgctgcctcccttttgtacatttcacctctttcaataacttcactgggagtttgtccaggactaaggaaagggtcagcttattttgctatttattgcttacagcaggattgataagaagagtattggtgaaggagaaatcacaatgcaaatattgggtttcagtaacattcttatctctctataccaccataacagaatattggctgctcttggactttagtcaaactccgtttctaaaccaagagcaggtagcaagaccaataataagagttaaaattcatgtcactgataaggaccttcaataacattttctcccaaaacagaaatagctaatgcatttattttatatataaatccagctccaatcattcctccttcaaagagcctcctaatctgctccagtctgcagtacatgcatggcccttacctcactttcctgacacttatgtcaacttaaccgcctaatgctctgtaataacttctgtgctgttgctttttgctatcatgcaatgccatttttactcccaaatgtttcatgttttttatgccttatctccactaatagattgtgagcccctttagggcaaggatctcatctttaattattctgatttactaccttcaaaatggtagtgcctttaacagtgactatttggtgatttttaattctcaatataactggcacagtaatacttttaattacagaattaatacaactgaaaatgctaccctttcctccattcacacttgccttaagggagagctataaagaagctctggagacttatgaacccctagcatcatgaactggccatgattgttataaaataaaggaggttgtgggtgtggaaagatgcttcttaaaagcctaaagaaagcagattgaggtgcttgtgtccacaccagcctcccttacaaacaataacttctgatcatggaggcaatccactggattaagtttataaattgtacaaacaggttgatcattaaaattaatcacagaaatcaccacttcagatgacattttatggggcaagaactcagatttaacctggaattatgtggatatgaatattggtggccagaatttaaggtactttggcctcacttttattttttatttttacttatttatttatttatttatttgagatggagtttcgctgctgttgtccaggctggagtgcaatggcacagtcttagttcactgcaacctccgcctcctgggcggattcaagtgattctcctgcctcagcctcccaagtagctgggattacaggcatgtgccatcacacctggctttttttttttaattttttttttaaatttttttagtagagatgggtttcaccatgttggtcaagctggtctcgaactcctgacctcaggtgattcacctgccttggcctcccaatgtgctgggattacaggcatgagtcactgcccggcctggcctcatttttaatgaaacctgatcttctgtcccctttttctgaggcagatttagaatgtatctcaaggaagcccacccctgcccagtatccaggacattctgcctttggcaataactagtggaatttgcagttcatggaaagaaagacaggtgagacctcctcctctaagccttctgtcctttcggaaaccaactctttaaaatctcacaggtagaaaaggagagaggatgtgagataaacaaaattttcactgaaaactcagagttaggtctcccattctttctagggtagccatgtcccctctctggcacttttccccattcacattatatgggtcatctgtttcacatttagatgattggagtgtctccttcccactgcagcttgtctgctgttcagtggcacatttgcagacaagattcacataggctttttgaaattaaaatcttgtgagggcctggcagctcctgagatgacacaagaacctccctgggactgcagcctaggctagaacagccacatgggcagacctggggaacagcttctgaaacgtgccccactgtgcttctgctggcctgtgctgcctggcagatggcagctgtcatttatttattagtgaccacttttgatggagctttaatttttgaattaattacaccctgtgttcctttcagtagatttccccaagaggcagttacctagcagcaattcctccttgccgcagattagatactcttggcttgccatccttatcaattcctcccgataccgtcagacccagggtagtgccttccttcttcatcagctcgacgactgtggagcccttgaattcctctgttaaaagaaaagcatttgccttattaaaatgagagtagaatcaccaatgtcatttctcctccccagaagttctttccactttttcttttatgagaaaagatatttatggcctccttccattgtaatttgaagaatatttcataaagatgtgcatgcaggtaatgctgaggcagatattctattagaggttatgaaaatgggcactggtggggtattcactccaggttgacaatagtccaaattgtcttatgtacaaataatattcaccctttattttctgccattctcaggtgacattctctggtttctctccttgtaactccaatgggaacaattaaaaattgtaaagtacagaattagaacagaattttagatgataatacgaacatatatagcacagtggcacactccaagttcatggtatgtctcaggttaggaagccaactgaaaggagaagagtgctttctacaggttctagaaaaatattattgactttactttctttgtctttcaaaaacaaagtatgatggcttatgtaacaattcatgtcattcttgcagaatatgtcacagtatggcaaggcaggattgatcctcagaatttccaggtaactgacataaatctttcattctctgcttacgaaattttaaaatttcacagatcttgtggggataatatctatatagcaagatagaactcaactcttttgattttagtcagagcagaaggtaagaaaactgtaagaatatccttcccttcaaaaataaaaatgagtagagtcaatatttaccttccagaggctaattaggataaatgctgttttaaaattatctgtgatgttattcccctatctgcaaatatattttcttggtagggatggggaaattgtccaattttccaacttctcctaaattaagttacacatttcaggggtaatgaacttctagaacatcaaagacgcatattaaaatgcaaaaacaaactcgctctttcaaagtgaaatttaaaaaaagattatttgcacaccttaaccctttccctaattacagttatttataatgttgaaaatatttataaatgtgtatcataaaggtttttaaattgctgctgctagtacattatcctactagccaatgaaaaaatgaaattacattaggtaaggaaacagtatctcaactgatctagtgaggagaacagagtacttgggggaagaaggctggggacggcaggctacttatttcctcagcagcctagagaatgtccttcaaggcagggcttttgagtttgccagctcctgtgactttaacatcccagcataccatcactggaatcctgccttttcatggcagtctcatgacactgtatacataagtcattatcgtcttttaaagtagaagccaaggaggagtctgagcgtgtatgatgtcagcttcatctactacattttgtatgacagaccaaataaaaattgaaattcaagaatgaaaattcttgtcaagtgcatgaaagtacaggaccttttacatcatttaccagaaacatctgtaacaaaattctatcactgtgtgcacttcccttgtgctacttaaaacaaaacaaagcaaaccccagaaatctcatgaaaacatacgtagattcaactgatattgaagacatcaccttaataaacaatccctctaaacccttgctggcagaaggctaggtataaatttttttaaaataaagttaataattaaagtaaccaaaatgacatagatgatgaccgttcatattaaagagatataatgtgcccaacaattttgccaacaaaaagattctctgcatcttctttaaatatgcagagtatcctatatatttagacatctgattatagaactttacatgtagagttggaagcatagttttttttaagtgcttatcttaaaggtctatccaattttcatgaagaagcaactctaaaatactaacaccaggcatgtgagaagtaagtttctattcataaaaattttccttctactccaagttttcaaggacatgcttcctgcataaaataggatgcacgggtacagccttatgggaggcagacaatgtcattttctccagaaggaacccaggtgcttcctgggcttccggctgaatcctgaaaatctagaaaagctcaattattttagtttaatttcatcattattaaaatataaattcatcgatctggctactttttcaactgatacttgtcaattaccctatcatttaaaaacatttcaaatgttttcctaagagctaattttaataatgtgaaattgagaaaatattcctgcaccagttaattgagtaatttgtgcattcattgattcaagcacgtattgaatgcctactctgagccagacaataaaactcaaagatggaaaaagcaaaggccattatcctcaagatgggccacagcctagtcaaagaggcaacgtcacagaccactgtaccatacagcatgagttgtagggaagcagccacagagaagatggtccaggcaacaacgtagagcgaaggcctgagattccaaatgcaccatctattttacaattttgtcttctagccaatctgctgtacttatcgaccagggttagctgagcagagcagaccaaagaaggaatataaattaggcaaaactcaggagtaaagatagaacatacttgcaagaaaatttgctgaatcgcaagaatggtaactgccaataagtatctctggtcccagaagaattgactaaatcttttatggatgtttctgtagggggtgggagagaagtggtcaggagagaaaggaacctgcttttggagtttgcttttggctcacctgaagtctccacttggctaattaatcatttaataccctttttggtgtttaatgtttgcatagtgatctaacgaagacagaagaaatgaagacagatgcattcatttgcatgagttcacttatatatcaaggcttactgaacaaacactgtggtaaaacagtggaacttgggcaagtcaatatgtactgatgatttctttcttttgtgatttaaattgcaaatatcactccctcaattaagaggaccttgtagggagcactgtacactctttcaattagcaagcagcacaggcaacagatgatgtctaactagtgaggaaggaaatggttctgaatttgactttttccttaatcaccatatttatttatcttagaaaataaatggtataggtttacagctataccattacttactcaacataactgaacagaatcccactgatgaaatgaaatttagttgtttgctgtttttctttgtgtttgtaattcaatctttttaattactgaactccagaaatttttaagaaaagtaacagtgatggttggcaaacacaagagaattatgaaaagttcttacgaacaaataagaatatttaaaaacacagatggttatacaattaatatgcagaaaactatatcctttatatagacaaacaacagccagtaaaaggttattatagaagagaaggccccatttacaatagccaaaaggtaaaatccctggaaaaaacttaacaaaactgtgcaacatctatatgaagacaactttaaagtgcttctgaaggatataagattagaataaatgaaaaggcatcccattcattcattcaataagaactgagcacttactatgtgccagacagtgtttgaggcattggagatacaacactgaacaaaatggatactattcctgccatctaagaactaatattccagtggatagcataagtcaacagaaaaaagcattgattttctttaatcagttgtatatctatatagtagcaatgaacatatgtaccttaaaattaataatgaaatatcatatataattgttcaaaaaatgaaattcttaggtgtacaagtaacaaaacatacagtacttacattgtgaaaactaaaaaatgctgttgaaagaaattaaagaaggcctaaataattggagagacaaacatgtgcatggactgggagactcagcataacaaagacattaattctttccaaattgatatataggtttaatgcaaaccttatcaaaatcccagcaaaatattttgtaactatagacaagattattctaaaatttatatgaaagggaaaggaacaatttttaaaaagaagaaagtgggagtatttagtctactcaatttcaaaacttacatagttaagagtaataaagactgtgtggtaggccaggtgcagtggctcatgcctataattccagcactttgagaggctgagaggggagaatcatttgagaccaggtgttcaagagcagcaacacagtgagatctcatctctgcataattttttttttttttaaatagctgggcatggtagtgtgcacctgtagtcccagctactcaggaggctgaggcagtaggatcacttgagcctgggaggtcaaggctgcagtaagctatgatcatgccattgcactccagtctgggcgatagagtgataccctgtatcaaaaatcataagtaaaaccactgtggtattgatggagggatagacatatagatcactggaacaaaacagaggacccaggaatagactcgcacaaatatgacatactgttttttgacaagatgcaaatgcaattcaatagaggaaaggtagcctattcaacaaatgatgctggagcaatttgacatccacaggcaaaataaataaataaatcccacaacttgaccagagtttcacaccttgtataaaatttaactcaaaataaatcacagtcaaaaatgtaaaccataatattatagaaactgtatgaaatatttagaaactgtaggaaaacaggataaaaattttaagatctaggtttagcgaagggtttctagacttgacataagcatgatccataaaaggaaaaaaaaatcagcaaattggacttcatcaaaattaaaaatgaatgctctctgcaagacctgcttaagatgaaaagaacatctacagaccaggaaaaaatatctgcaaactacatatccaacaaaagacaaaagactagtatttcaaatatacaagcaactttcaaaactcaacagtaaaaaagcaaacaatctaattagaaaatgggaaaaagacatgaaatattttattaaagaggatatacagatggcaggtaagtacacacgaaaaaatgctcaacattttccattggggaaatggctcaaattacttaaaaattaaaactacaattgatatcattacacacttatcagaaaggctaaaataaaaattagtgacaacaccaaatgctggtgaggatgcagaaaattagatcactctgacgctactgatgggaatgtaaaataggacaactactctggaaaacagtttagcagtttattagaaaactaaatatgcaaccaccctatgagccagaaattatactcctgggcattaatcctagagaaatgaatgctttcattcacaccaaaacctgtaagtgaataattatcacagccttattcacaatagcaggaaacagaaacaaccaagatatcctgcaacaggtaaatggctaaacaagtgtggtttgtctataccacggaatacttctcagcaatcaaaagggtcaaactagtgctacaagtaacgacccagatcaattaccagagaactatgctaagggcaaaaagtcaaccccaaagatttcacattgtgtgattccatttatttaacattcttgaaatgacaaaattatagcactagagtatgggttagaagttgccaggggtaagggcaggagggaagtggatgcaggtataaaagagtaaaggattgatccttgtggtgatggatatgttctgtatcttgactccatccatgtcaatatcctggttgtgatattacatatagttctgtagatatttctattggggaaaacaaggtaaaggatataaggaatttctatattattttctacaactgcatatgaatctacaattatctcaaaattaggagtttaattttttaaaaaatgtcccatcagtgggtatatgattcaattggtctggagtacgcctaggcatcagtatttgaaaagttcctccagtggattctaacatgcagctagaattgaggaactacttgtggttacttaagagtgaaatgaacatgtgttgttcttttagtttatatatatcttttttcaaatggctaataagttgttaggataaaatatgaactgtgttgtttggacctaactacttagtaaattgaactagtggtatttcatttggcctggaggtgctgtaaaaaattctgagacactaaaggctctgtggactgagaaagtttagaaacttctgccctaggactttatcttgttttcattcagctggtggaaggggaaagacagctctcttgaaagccattactggcctgcttatgttcacatcccaagggcaagaacttattccatccatgtacacacataaattcaaaggaggctgagaactagagtctaaatagagacccatgcaatgggggtagggtggatatggagggacaggtactgactatgccacccagaggcaacacatgatggactaaaatacatcagaggctatgtggatgacatggacaccagacatattaatgaggaggaattttccggagttagagaccaattaggatgtgggaagcatggaagtgagtgaggatcaaaaaggccccaaggtttccaacttgtttgattggtggatgttgacatctgtcactgagaaagggaatctagaaaacaggaagtttgtgttgctgcgggtgattggagtggggcaggcacactatataatgtcatataagataaatttaacattgaaataccacagaaaaacttggtcttaaaatacttttcatcacacctcaaaatgctctataagatcttcaccacatggctgtagcgtaaaaagagaaagtacaatttcaaagcaaccactagaggcatattcagcaaaacaggcgaagctctttacttcttgaagtactattaactgcagagatttttaaaaatactattaacagttaaatagaaatactattggtgaaaactctgtaaagtaagtcacaaattttgaaatgctggtgtcaacaagagtgttttttccctgctgtatctccagcatctagaatagtgcctggaacattcacaggtcctccctggtaactgctggatgaacgagcacatcagtcccaaaacagggaattataatggggtggtgagcatcagcttgtggcaaacagaattattgctggacggtgcagaagcaaaatgataaaggagcagaatctgaacaggagcagacagagttatttccctaagcttacttggttgattaattgtaccaatgccttagtaaggggaattagggcacgcaccagaatactatagctatatctgtgtactactattgaaaaaaatattattgctcatactacagttttatctgtatattacttttggtggtgccactaggaagtttattcccctcaggaaataaacagatgctttttccaatactcatttcaagctcttcctaatatcccctggttcagcaaagctgtggggatcaaagctgggtttctgtgatgaactgctgcattttcagtctcagtttttgccacccagactagcagagaaaggtttttgggcattttccacctctgtgtagtgacatgagggatatactagaatttttctcatcccttgggagtctgaacataaatttgatcagtggcagggatgtacagcacataaatattacctggcacaaatattcatgtgaaacaaaattatgattgggatttatctcatgcagtgatgggagggctggattaatatctgtatgtttcctattgcacctccaaagaaaggggatatacaaatatgcagtgtcaaatacaaaaatatgtgacccctgaagatatgtgatatatgggtcaggattcttttaaaaatagattgaacagagatgttgactgtttttctggcataactgattcaggtatcaaatgccttctaaagcattaagttaaaaaaaaatccctgcttttaaaatatggcaatacgagaattgttccaatttctactgctcccaaaatcagttatttaattgtcaaaatttgctattaagctttccaatgtcaaacttattaacaagttatttagttttcacgggtcttagtttcctcacatctaatttagggataataatggtatctacttacagaatgtggtgaaattaagtaatacaattcttataaggaacttatggtaataacccacacagtaagtgttcaatatatgttagccaaggtattattgttgtcttattgtcattattattgttatttggatattggaaatttccagatatgcaaactgccaattttctactatattttgattgttatgaatataagacaaaagaattaacagtggtatttaactgttggtgaagtcacagactactttgagaatttaatgaaagcagtgaacgcttgtcccagaaaaattgtgtgcattatttcaggggaattcatgaattccccctggggtttatccatataccctactttagaaactctgacctagaagatcaggtttgagcaatgtgacaatcaaagaacaatttacgctggagtgacattttataattcgtgtgtatgttgggtagggggatgtagaatagcaaacagcacccacatctatcagtcacgtattcctacacaatcatctgatagtctaaataaaaccatgatgcaagatatcagaaacaggaaatggctcacctcagtgaaaccgcctctcttcctaagcatgatggcctgagtggtggacatttaaatgtaagagttgataagggccaggagaaagcactgggcaggatatctcggaatcacacttgcttcaagagcctcaggcagttttcctttggaaaaactttccatctgtaattttcacttgtaagctattataaaatcacattgttgacatgattgaaaatcggagtttacaagtaaaactgaagcaattggcatggctatctttgaatttaattactctgattttcaatgttcccttagataagttaactacattcttacaactacttatggactgttttgtcctaaaaacgtttttaagcatttataattgccagactctgtggtagaggctagtattttgaagaccaataatcactgcctctacctttctgcaattcacattctaaatgtctaagagacaaacatctaataattgcaatgaaatgtcgtcagtccatagcatggcctgggagcctgaaagggaataacagctcaacgtatgctgctgagaaagtcctctataggctacagatggctatttagaggtttaagttcttctttagatgaaagtagaatatttacttgcagtattactgttgtttccacttaatagagaagtgaagataccaagtattgcttagcaaattaatgagctatttttgggaggaaatcatttatttttgcatgtatttttgggtgtccttttggctagaatccttttttttttttttttttttgagacaaggtctcactctattgcccagactgtactgtagtggtgcaatttttgcttactacagtcttaacttattgggctcaagggatcctcctgcctcagccccctgagtagtgtgtgtcactaggcccagctaattttttaaaacaattttgttgttgttgttgttgttgtacagatggggtctcactatgttgcttcggctggttttgaactcctgggctcaagcgatggtcctgcctcagcctaccaaagtgctgggactacaggcatgagccacagtgccaggcagggcagtatcttatgttgaataactatttaaatatgaaaatccagaactactgtgcggggattagaatgatcagatgttctgatctgggagtccagctgaacaacaagggatgggagcagctgggtggataaaaagaaagaacactctggaagtgaaagaagatcctgagaaagatatcaggtaaggctgcactacagctagtgagagctagtcattgctgagttaggtcgcttagtgtttaacataaggggccaaatgttgcatcttcaaagacaactaagaggacaaggcttgaggttccattgtgcctgaaagggaaatggagaaaggataaacttcaacaagaaatcagacttcttaaataatcagggcaaagtagaacttagagctacactcacttggcctttttcttccatgaatatctaagtacccacgaatctaacatgagctaggaacctgactgaatagagagattaaaatgaagaaatttgtgatacttttaaagactatccattcttttaaagcagtttatacttttccaagtattcttacatccattcactaacttagccttcagaaaaactctgtaaagaagggcatactaccattttatagattagggacactgagacttgaaaattagggtcctttcattaggccgaacttcatgtctattttacgtacatgaaatttccgcctcatgtaactaaatgctacaaagtttcagactcatcatacagtaattgtcaaacaatggaccaaaagaatgtatagatgaaatacttttgagaaaagggaagaaaagtaaagctagcctcaagcagactccaagccacaagggcactagtaaatcagtcctcattttgtcacagatgcctgtgcatcaggggcatttatttgattgtcccttgtttgatgagacttgattcatttcaaatagaggaacagatggaaaactaatagtgtagtcactgcagatcaccaagaagcaaagcatctggggagccctatggactttccatggagaagccatgggcctgctgcagtgagtcagagcttcatgagagccctactcagacccactggaattcagaactggagaaggctgtgctgcctatatcaaggacagctctcacaccctgtatttggctttctctatcctaacagggagggtaccattctctcctggcccctctcctggtccctttcatttcttctgctctacatgggaaaccattttcttgtcacagagaaatgttccccattgcagtaagcagaaagagaatgagcagataaagcagtcactactgtttcctctttgatgccatccatcctttttattagtacctcaatcaccttatgtaacactatcttacccaagtataactatcttctagcctcactctgagtttgaaatgctttagtccctccctctcttcctcatttcctccctccttccctctccctcccttgtttccctccctatcttccattgaatatctattgataatttcctaaattctaggcactttgctatctagcagtaaatgatgtagacttagtccctgacctcaaggaatttatattctattaaaaaatacagaccttgggaggcagagcaagatggctgaatagaagcctccactgatcatcctccctgcaggaacaccaaatttaacaactatctacacaggaaaagcaccttcgtaggaaccaaaaatcaggtgagcgatcacagtacctggttttaacttcatatcactgaaagagccactgacaagagtaggaaaaacagtcttgaattgccgatgccaccccttccccatcccgcatgtctcatggcacgaagaatttatgagcttgggggaggaaaagtgctgtgattttgggactttgcattggaacttggtgctttcctatcacaatggaaagcaataccaagcagaagtcagccaacacccatggaggaagcatttggaccagccctagctggaagggaatcctccatcccagcagttgccatgtgagctccgacaagccccaccacagtggactaaagtggtttggggccctaaatctacttgaaaggcagtctaagccacaaggactgcaactcctaggcaagtcctagtgctgtgctgggctaagagcccattgacttggtgggcatgtgacctagtaagataccagctggggtggctaagggagtgcttgcaccactcctcccccaagcccaggcagcacagtttgcagttccaaaagtgaccccttccatcttcttgaggagagaagagggaagagtaaagaggactttgtcttgcaacttggataccaactcagctacagtcagagagggcaccacacaaagttgggaggtgtagcttctgaacaagatttctagacaaaacctgggccaaaactcactgccttgaagggaagaatccaattctggcaggtttcatcagcttctgacttaagagctcttggccctgaatagtcagcagtggtagccaggtgtagtacatgccatgggccttgggtgagaatctgagacatgctggcttcaagtgtgacctagcatattcccaactgtggtggccatgaggaaagactctgcttgagaaaaacagaggaagagtgaaggggactttgtcttgcaacttaggtaccagtttggccacaggggagtagagcacgaagtgggccattggggttcccattccaggccttggctcatgaatggcatttatggacctgctttgggctagaggggggcccactgccctgaagggagaatcctggggctggaagcattcattacaagctgactgaagagtccatggaccttaagtgaacatcggtggtactttggcagtattccccatggcacactggaggtggtggccatggggagaggctcctctgcctgtggaaagcagaggtagagtgggaaggactttttattgtgctttgggtaccagttcagctgcagtagaatagagcaccaggtagctttctaaggttcctgactccaggacctggctcctgaatgccatctctgaacccatccaggatccagaggaactctctaccctgaagggaactcttcaccctgaaggatggctggttctgctacttgctgattatagagttctagggccttgagaaaacataggtggtagccaagtagtggttacagcaggccttaggtgagacccactgctgtgctggcttcaggtctgacccagtgcagtcccagtgatagtggccacaggggtgcatgtgtcactccttccccatctccaggtggctcagcacagagacagactctgtctgtttgggagaaagtatggcaagacagtaagagtctctacctagtaatccagataatttttctggatcttatccaaaaccaccaagatgatgcctctatgagtctataagagccatagcattactgggcttggggtgccccctaatgcagatatggctgcagtgaccaaaaaattagattccaacacccacgtcccttcaaatacctgcagagctctcccaagaaggatgggtacaaacaagcccagactgcgacgactacaataaatacttaactcatcaatgctcagacactgatgaacatcaataaacatcaagaccatctaaaaacatgacctcatcaactgaataacataaggcaccagggaccaaacccagagaaatagagctatgtaacctttcagagagagaatgcaaaataggtgactggaggaaacttgatgaaatttaagataatacagtgaagaaattcagaatcctatcagataaatttaacaaagagattcaaataattaaaaagaattgagcagaaatgctggagttgaaaacatgcaattgacgtactaaagaatgcaccacagtctgttaataggagaagtgatcaagcagaaggaagaattaatgaacttgaagacagtctatttgaaaatagaggagacaaaagaaaaaagaatgaaaaaggaataaggcatgcctattagacccagaaaatagcctcaaaagggcaaacctaagagttattaaccttaatgaggatgtagagacagatagggatgtagagacagatattattcaaagtgataataacagagaacttcccaaacctagagaaatatatcaatatttaagtacaaaaaggttatagaacaccaaacagattgagcccaaagaagactgcctcaagacatttaataatcaaactctcaaaggcaaaggaaaaagaaagaatcctaaaggcagcaagagaaaataaacaaataacatagaatggagctccagtaaatctagcagcagacttttcaatggaaatcttacaggccaggagagcgtggcattacatatttaaagtactgaaagaaaaaaaacttttatcctcgaatagtatatctggcaaaaattgctttaagcatgaaggagaaataaagaccttcctagacaaacaaaagctgagggattccatgagcaccagacctgtcctacaagaaatgctaaggggaattcttcaatctgaaagaaaaggatgttagtgagcaataagaaatcatctgaagttacaaaattcactggtaataggaagcaccaagaaaaacacagtataacactgtaatggtggtatgcaaacttaagaagaaagactaaatgatgaaccaatcaaaaataataactatgacaacttttcaagaaatagccagtatgataaaacattaaaaaaaaaacaacaacaaaatgttaaaaagcagggggacaagttgaagtgtagagtttttgttagttttccttttgcatatttgtttatgaaatcagtgttaagttgtcatcagtttaaaataatgggttataagacagtatttgcaagccttatggtaacctcaaattgaaaacatacaacagatacataaagtataaaaaggaagagattaaaacataccaccagagaaacattaccactaaaaggaagacaggaaggaatgacagaaaaaaaaataagaccacaaaacaaccacaaaactaataacaaaatggcaggagtaaatccttacttatcaataataacattgaatgtaaatggactaaattctccaatcaagagacacagagtggctgaatggataaaaaaaaagactcaactatctgttgtctataagaaacacacttcacctataatgactcatagactgaaaacaagggatggaaaaagacatcctatgccaatggaaaccacaaaagggcagaagtagctatatttctatcagacaaaatagattttgagacaaaaactgtgagaagagacaaagagggctcattatataatgataaaagggtaaattcagcaagaggatataaccattgtaaatatatgtacacccaacactggagtacgcagatatacaaagcaaatattattagagtttaagagagagatagaactcaatacaataatagctggtgaccctactttcaggattggacaaatcatccagacataaaatcaacaaagaaacaatggacttaatctggactacagaccaaatgaacctaattggtatctacggaacattttattcaacagttgcagcatacacattctcctcagcacgtggatcatcctcgagaatagatcatatgttagcacaaaacaaatctctaaaaattccaaaaaatttgaaatggtgtcaagtatattctctgaccacagtggaataaaactagaaatcagtaacaagaggaattttggaaattcaacaaacacatggaaatgaaacagtatgctcctgaatgaccaatgggtcaatgaggaaattaagaagaaaatttaaaaatctcttgaaacaaataacatcacaaacacaacataccaaaacctatgggatacagcaaaagcagcactaagagggaagttatagctattaatactacatcaaaaaatagaaaaccttcaaataaacaacctaagaatgcatcttaaagaactagaaaagcaagagcaaaccaaacccaaaattagtagcataaaagaaaagagcagaaataaatgaaactgaaatgaagaaaacaataccaatgatcaattaaaagttgtttcttttctttaaagttagttttttgaataaacaaaattgataaacctttagccagactatgaaaacagagagaagacctaaataaataaaatcaaagatgaaaatgaagacattacagctgatactacagaaactcaaaggacctatattagtccgttttcatgctgctgataaagtcataacaagactgggtaatttataaaggaaaagaggtttaatggactcacagttacacatggctggagagactcacaatcatggaggaaggcgaaaggcatctcttacatggtggcaggcaagggcgaatgagagagccaagcaaaaaggaaaacctcttataaaatcatcagatcctgtaagacttactcactaccacaagaacagtatggggaaaacacccccgtgattcaattatctcccactgggtccctcacacaacatgtgtgaattatgggagctataattcaagatgagatttgggtgggaaaacagccaaatcatatgaggaccattagagattactatgggcaagtatatgccaataaattggaaagcctagaagaaatgtataaattcctatataaataaaatgtaccaagattgagccatgctgaaatccaaaatctgaactgaccataactcataacaagtaatgagattaaagctgtaataaaaagcctcccagcaaagaaaagtccaggacctgatggcttcactgctgatttttaccaaacatttgaagaagaactaatgccaatcctgctcaaactattccaaaaaataaaggagagaatacttcagaactcactctacaaggccagtattaccctgataccaaaaccaaacaaagacacatgaaaaaagaaaactacaagctaatattcccaataaaccctgttgcaaaaatcctcaacaaaatagcagcaaaccaaattcaagatcacattgaaaacatcattcatcatgaccaagtgaaatttatcccaggggtgcaaggatggtttaacctacacaaatcaatcagtgtgatatacccacaacagaatgaaggacaaaaaccacatgatcatctcaattgatgctgaaaaagcatttgataaaattcaatatcccttcatgataaaaaaaaaaaaaccctcaaaaaacagggtatagcaggaacatacctcaacataataaaaaccatataaggcagacccacagctaacatcatgctgaatggggaaaaactgaaagtgttttctctaagatctggaacttagaaagatgctcagtgtcactactgttattcaacatagtactggaagccctagctagagcaatcagataagagaaagaagcaaaaggcatccaaatcggaaaggaagaagtcaaattatccttgtttacaaatgacatgatcttatatttggaaaacccttaagactccaccaaaaacctattagatctgacaaattcagtgaaattgcagaatacaaaatcaacataaaaaatcagtggcatatctatatgccaacagtgaacaatctgaaaaagaaatttaaaaagtaattccatttacaacagctacaaataaaattaaatagctaggaattaaaagaagtgaaaggtctttacaatgaaaactttaaaaccttgatgaaagaaattgaagaggacacacaaaaaatggaaagatactccatgttcatggattggaagaatcaatattgttacgatgtcatactacggaaagcaatctactaattcaatgcaatctctattgaaatatcaatgacattcttcacagaaatagaaaaaacaatcctaaaatttatatggacccacaaaagacccagaatagccaaaagtatcctgaggaaaaataaaactggatggatcacattacctgacttcaaaatatactacagttctatagtagccaaaactgcatggtactggcataaaaacagatacacagaccaatggaacagaacagagaacccagaaacaaatccatacacctacagagaactcattttcaacaaaggtgccaagaatatacactggggaaaaggcagtttcttcaataaatcatgctgggaaaactagatatccatatgcagaagaatgaaactagacccccatctcttgccatatacaaaaatcaaatcaaagtggattaaagaattaaatcccagacctcaaattatgaaagtacaataaggaaacatcaagggcactctccaggacattgatttgggcaaaaatttcttgagtaatactccacaagcacaggcaaccaaagtaaaaatggataaatgggatcacatcaagttaaaaagcttctgcacagcaaaggaaacaatcaataaagtgaagagacaacccacagaatgggagaaaatatttgtaaactatacatctgacaagggattagtaaccagaatatataaggagctcaaacaactctatagtaaaagttttaatgtaataatccaattgaaaaatgggcaaaatatttgattagacatttctcaaaaaaaaagagagacaaatggcaaacaggtatatgaaatggtgctcaacatcattgatcagcagagaaatccaaatcaaaactacaattaaatataataacatctcaccccagttaaaagaaagggaataacaaatgctggtgaggacatggagaaaagggaagtcttgtacactgttggtgggaatataaattagtacaatcacaatgcagagcagtttggcggttcctcacaaaactaaaaatagagctaccatatgatccagcaatccctagcagcatatacccatatactgctaggtataagccctaaagaaaggaaattgatatatcaaagaaatatctgcacttccatatttattgcagcactatgtacaacaaccaggatttggaagcaacctgtgttcatcaacagatgaatggataaagaaaatgtggtacatacacacaatggagtactattcagccctaaaaaagaatgagatcctgtcatttgcaacaatatgaatggaaataaaggtcattatgttaagtgaaataagccaggcacagaaagacaaacacatgttgtcacttaattgtgggagctgaaaattaaaacaattgaattcatggagctagagagtagaataaaggttaccagaagctgggaagttagcaggggagtggaaggaaagtgaggatggctaatgggtacaaaaacattagaaagaatgaataagatgcagtatttgataacacagcaggtgactatagtcgataataattgtacatcttaaaataactaaaagagtataattggattgtttgtagcacaaaggataagtgcttgaggtgatggataccccatttaccctgatgtgattattatgcattgcatggctgtatcaaaacatctcatgtaccccataaatatatatacttactatatacccacaaaaattaaaaactaaaaaaaaagaaatactgacttaaagaaatagaaaattataacaatatggttagttatgattatttagaaaaacaaagggttaatctggggctaagttgggacagtcacttgaaaaatatttgcaaatggttcattatgccctaaaaaaccagccctattgcctcgcctctggcaagtcactaaatccttgtgtgccctaatctctgaactgtaaaatgagagaactgaagtatatggcttaaaaaaatatatatattttattgactttaaggtgccagcgatcgtaaggcacactgttattttatttgctgctaagaaagaatatgtctgggtttggtggctcatgcctgtaatcctagtaatttgggaggctgaggtgggaggattgcttgagctaagcagtttgagaccaccctggacaacttggtgaaactctgtctctacaaaaagatttaaaaattacccaggcatggtggtgtgctcctgtagtcccagctacctggtgggggatgtgggggtgttgaggtgagaggattgcttgagcctgggaggttgaggctgcagtgagccatgattgcactacagcactccagcctgggtcagagcaagatcctgtctcaaacaaaacaaaataaaacaaaagaatacgctgtcaatcaaattacaacataatgcttatcactaaggttgtttaagtattatacttattaaataactcaaagcacatgcatgaaaagaaaaatgtcagtgaaataaatcagtcaaggtgctcctacaacttttccacattcaccctctgaaccagtgtcactgatgtccatattttctatacgatattgtcctcatcaccagtactttgggcaccaagagcactgtgatgctgcattttttacagtgctctgttattgccccttggattttctttcaagctgctgaggctcatttggcaagtttcaatttttttgaaaaattactttatgaagcttgaagaaatattgagtataattaaactataatctaggcttatatacagcttaataatagttcagttccaaaagaaaagctattgcaggtgagaccgtaacatttcccaacacgattttaagacactgtgctgatttctcaaaacaactctgaggaacccatatttacagtagaaggagtttttatgaaaaatctggcattatgtatctttgttgcatgattatatatgtatgtacgtataatacaatgttagatgcaccatcacccccgaccccctgccgcacagttgaaaatccacatgtaacttttgactatcccaaaacttaactattaatagcctactgttgactggaagctttactgacaacataaacacatattgtgtatgttatatgtatgatatactatattcttataataaaagagaatgttgttaagaaaatcataaggaagaaaatatatttactatttattaagtggaagaggatcatcataaaggtcttcatccttgtcttcttcacgttaggtaggctgaggagaaggaagaggagggttggacttgctatctcgggggtggcagaggtggtagaaaatctgtgtttatgtagacctgtgcagttcaaacctgtgttgttcaagggtcaactgcatatgtatgtgtgtatgtatacagttatactatatatacagtatatacactatatacactgtgtgtgtgtatatatacacatataatccaacatatggactgtatatacacaaacacacacataatccaacatcataagaactagaaaacagaagttgtattccttaacatcagtattagagtgtagagtttgaggcttggatttagaaatgcttttcaacatgtagggtttggaaaaggagcaatcatcttgttttcaaaacctgaagtttttctcaggacttatgaccataactgccacagaggaaaaagggaagcttttcccactgtaattgttcatctgtgtcagaaagtcccatatcctgtgtagatcttataaatattttgctagatttatggcaaagagagacattgatgctgcaactgaagcaaaacacaaacttgaaaaagacaaacagaagaaacccaagaaaggaaggagaaggaaatccaatgggagacaagcttatttcatgaagatggaagatgttgggtttatgatgaatcattactgaattatcttggtgctgccaagcattgggctaggaatttctatttacttgattttttatgttgttgcaaatggtactgctttttaaatttccaattatgcattgtatataattaaatacaattgatttttaattgtaaaaaataaaaaaacaagaaagtctcatatccctgagaaaccattgcaataagaagggaatgaacaggttctcccaaagggagaatgtttgttgcttaattatgcttactgccctggccatcaggtataaactttacatttcctagcccaaggcttggcagcaccaagataattcagtaatagttcatcataaacccaatatcttccaacttcatgaaataagcttgtctcccattggatttccttctccttcctttcttgggtttcttctctgtctttttcaagtttgtgttttgcttcagttgccgcatcaatatctctgattttttttcttaatattttaagttctagggtacatgtgcacaacgtgcaggtttgttacatatgtatacatgtgccatgctggtgtgctgcacccattaactcatcatttacattaggtatttctcctaatgctatccctcccccctccccccaccccacaacaggctccggtgtgtgatgttccctaccctgtgtcccagtgttctcattgtttagttcccacctatgagtgagaagatgtagtgtttggttttctgtccttgtgatagtttgctcagaatgatggtttccagcttcatccatgtccctacaaaagacattaactcatcgttttttatggctgcatagtattccatggtatatatgtgccacattttcttaatccagtctactattgttggacatttgggttggttccaagtctttgctatcgtgaatagtgccacaataaacatatgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatctccttgtggttttgatttgcacttctctgatggccagtgatgatgagcattttttcatgtgcctgttggctacagaaatgtcttcttttgagaagtgtctgttcacacccttcacccactttttgatggggttgattttttcttgtaaatttgtttagattctttgtagattctggatattagccctttgtcagatgggtagattgcaaaaattttcccccattctgtaggttgctggttcactctgatggtagtttcttttgctgtgcagaagctctttagtttaattagatcccatttgtcaattttggcttttgttgccattgcttttggtgttttagacatgaagtccttgcccatgcctatggcctgaatggtattgcctaggttttcttctggggtttttatggttttaggtctaacatttaagtctttaatccatcttgaattaatttttgtataaggtgtaaggaagggatccagtttcagctttcaatatatggctagccagttctcccagcaccatttattaaatagggaatcctttccccatttcttgtttttgtcaggtttgtcaaagattagatgattgtagatgtgtggtactatttctgagggctctgttctgttccattggtctatatctctgttttggtaccagtaccatgctgttttggttactgtagccttgtagtatagtttgaagtcaggtagcgtgatgcctccagctttgttcttttggcttaggactgtcttggcaatgcaggctcttttttggttccatatgaactttaaaatagtttttttccaattctgtgaagaaagtcattggtagcttgatggggatggcattgaatctataagttaccttgggcagtatggccattttcacgatattgattcttcctatccatgagcatggaatgtttttccatttgtttgtgtcctcttttatttcgttgagcagtggtttgtagttctccttgaagaggtccttcatgtcccttgtaagtgggattcctaggtattttattctctttgaaacaattgtgaatgggggttcactcatgatttcactgtttgtctgttactggtgtataggaatgcttgtgatttttgtacattgattttgtatcctgagactttgctgaagttgcttatcagcttaatgagattttgggctgagacgatggggttttctaaatatacaatcatgtcatctgcaaacagagacaatttgacttcctcttttcctaactgaataccctttatttatttctcctgcctaattgccctggccagaacttccaacactatgttgaacaggagtggtgagagagggcatccctgtcttgtgccagttttcaaagggaatgcttcagtttttgcccattcagtatgatattggctgtgggtttatcataaatagctcttatattttgagatatgtcccatcaatacctaatttattgagagtttttagcatgaaggttgttgaattttgtcaaaggccttttctgcatctattgagataatcgtgtggtttttgtctttggttctgtttatatgatggataatgtttattgattttagtatgttgaaccagccttgcatctcaagggatgaagcccacttgaccgtggtggataagctttttgatgtgctgcttgattcagtttgccagtattttattgaggatttttgcattgattttcatcagggatattggtctaaaattcttttttgttgttgttgtgtccttgccaggctttggtatcaggatgatgctggcctcataaaatgagttagggaggattccctctttttctattgattgaaatagtttcagaaggaatggtaccagctgttgtttgtatccctggtaaaattcggctgtgaatccgtcttccaaaaaaaatccaggactttttttggttggtaagctattaatcattgcttcaatttcagagcctgttattggtctattcagggattcaacttcttcctagtttagtcttgggagggtgtatgtgtcgaggaatttacccatttcttctagattttctagtttattttcatggaggtgtttatagtattctctgatggtagtttgtatttccgtaggatcagtggtgatatcccctttatcattttttattgcatgtattctctcttttcttctttattagtcttgctagctgtctatcaattttgttgatcttttcaaaaaaccagctcctggattcattgattttttgaaggtttttttgtgtctctatctccttcagttctgctctgatcttagttatttcttgccttcagctagcttttgaatgtgtttgctcttgcttctatagttcttttaattgtgatgttagggtatcgattttagatcttttctgctttctcttgtgggcatttaacgctataaatttccctctgaacactgctttaaatgtctcctggagattctggtatgttgtgtctttgttctcattggtttcaaagaacatctttatttctgccttcatttcattatttacccagtagtcttccaaaactgaccacatagttggaagtaaagcactcctcagcaaatgtaaaagaacagaaattataacaaactgtctctcagaccacagtgcaatcaaattagaactcaggattaagaaactcactcaaaattgcacaactgcatggaaactgaatgtctctgatttttaagttgaaagtacatccttctaaaggcagtgagattcatattttttctgatctttcaacttcctatcttcttcattatagacatcttcttggtatctacaaagactgcattttcccctgttgcatattttgcatacattacaccattccattccccttcagttgagcagaaggcttctcatcctttggagaaaaaaatcacagtggtaattctgtgcttcctgtccccagagaaaggttcagtgtggaagatgatgtttgcactatcaccagttttggaataattaatattgcattctcctcctagttccattcagagcactgcgaggatagaacatccgtaaacactggggaatgtgaggatgtaatgtttctcatagttaaaacaaaagacacagggcttgtggccccaccctatgttgtgtgtcccaattgacatcctgaggaattttgattaggtccagatatcaccaatgaattgaatctttctgataaacactcagcataaaaggctaaagtaggtggatgatgggaaatctgttcagctacaaattttacattgtttttggaaacccagggaactggtccttctaaaactagctctgtgttctctttggtatcatttggtaatatccattgacactgaaagatcttgctaaaatgactttttgacaattgattctttccttcttgcatgaaaggctgagaggtaccatttcacattctgaaccgttcaatccctggtcaccaatgttcgcaaaaaggttggatatgcaaaaaatgtctgcatatgcttctaaaagagatcctctttcaagaaaaaatggtggaagatctactttagtaagatccatactaagcctaacctgtgacaagaagtgtgtggtaacgctcttatgctcctccatggaccctgcctcctccttgtcaggtctctcatcatgtgaatcaagagtcagcatcacttgttccattggatgtgaaagaattaagtgattctgtgctatctgggcactttagtctgttttccgcactgccatgtgtcaagattgacgcagattcagaagaatctattaagtgctttggggatgagccatgttgatgacattcatcagcattgtagaattcatcttcactgctggaataagagaattctgggattgtatttagagaagccattgacatggcttggagaagttagaccgctactaggtggtgaatgggcactgcctctactatttggtgttggagtctaatgatgtcccaaggcaattagtacaggtccaactggtcaggaagatgaactctgctctgtcttatgcagttgagtaggttccagagggaggtgagacagtctgggaaggcattgtgctgatcacaggttcccagggactaggttgatacactgcatctacaagattaatagtacttataattctatctgcgtgcttctcagcattattctggtcttcagcagtctgcatcaacacagtgcagtgtttcattgattccaccatgctatttgcttctctttgagagtttcagttttctttctctgcttattatctttgcagttttgaagcttgtgatcaaaaaactttaattgttctatcaagatttgtaggtgggcatcagtctctggagcggtggctcacgtctgtaatcccagcactttgggaggctgaggtgggtggaacacgaggtcaggagttcaagaccagcctggccaagacagtgaaatcccgtctctgctaaaaatacaaaaattagctgggtgcggtggcaggcgcctgcaatcccagctactggggaagctgaggcaggagaatcgcttgaacccaggggacagaggttgccgtgagccaagattgccccactacactccagcctgggtgacagagtgagacttcgtctgaaaaaaaaaagaagttaactttcctgtcaaagttttggacactaggaacaaatcctgaatccaaatctctggaggtgacaaggaaggaggcaaggaaagtgtgacatctgagcccatagcctggccctgggcaggcaccagggaccatgggactcaggggtggaggttaggcctctcccagaccctcagggtgtactcactccacaagtgtccagcaagaaagtaatttgcaagacccccacactctgtgcctccaggatagagagggggctgggggctgcttccgagcaccccttttccttctccacttgattggatcctcatttggcaagttttgatacttgtgcttcttgagcttatgggaaagtatcaacagaacagtttagacaacagtacatattccctcctcaggtttatttcaggttctactcagtttcaggtttatttcctgaaacttcaagaagttacatttatccaatgatatcaccaggaactgcaaccaagtaagtgcatgcacaggcaataataataatattatgattatcacatgtctaagaacaactataaaatgcatcccagttcacagttgttaaaatgtgtatgttggggggtagtttgtaggcattgcatgtatgtatgtatgtatgtatgtatatattagagacagggtcttactccgtcacccaggctggagtgcactggtatgatctagctcactgcaaccttgaattcctgggctcaagtgatcctccagcctcagcctcctgagtagctgggaatacaggtgcatgccaccatgcctggctaatttttaaaatttttgtacaggtagagtcttgttatttgctcaggccagtctcaaactcctggcctcaagtgatcccagcctctgaaagtgctaggattagagaggcatgagccaccacaccgggcctcaactgaaattcttccagagaagatagagaccaaataggcatatctctaagtcctaggtcccatcttcagttatgctagtcagttttttcctcttattcctccacataagattttgaaaagaggtttctactgctaaaaaaacaagtgtgaacccctgtcacacttgtatggccatttctagctttagcattctctaagtctataataatgctgcacaggctaagtaactgagtctcgaatttctgggaccttaactggcacaggcttcttccaaagtcttgggaggcatcctagcaatgtattcacaccaccatatggttttgtcaaattcgaaaaatgatatttttgtattttttttcttaaagaactccctcccctcaaattgtataaacttgaggcggcacaaaacctagatcttcctttgatcatacaattttatatcaagacagcacttaagttggccagaagagtcacatacatttgattctcacagaaacccaggatcctacagatgaaaaatctgaagcttttgaaggttagacaacttgcctaaggacaggtatcaggcaaatccttttgtgaggacttaaaactctaacttcagttctcattccacatccagtcttctttctgcactatcactttagttaacatgggttgtcttggcttgaccaggttgccaaagtgactcttatcataaaagagttctgaattctaattgcaagttctaagactatttttcttttattctgaatgtaaacatgaaactgtaaaaccaattgtagctcaagtagcctgtgaaagtcactttcacacgatgtgtaagagaatatttaccgatttgtattgagtaaaccacctgccaaaccctcacttgggaggccacaccagttccagagaataacaactttgtgttaaaattccagaaaaatatgcctgctgagtatcttttttgttgtgtttgtttaatctttgttaagctcagtgatatatgcacatataagaacatatttttctcatatctgaaatctggatacatacttcctgaaaatgtattactactgcctttgtttttttttcattgcatattttcctttcacagattcatcatgtagtctgaatataatacccactcttgttgtcaagcacaaacagaaaagagtacagtttccctttaaaagcacaatgccctattgatgcctttaaaagtcattaaagaatatctcacaaagcccaggagagcattacaataattgcttccctttcctaggtgaaaaaggacatatctgtcaaatagaaaagtgcagaagcaattaacaccttaatactctactgggaaattgcctgaattaacagagatgcttcatggttattgtatttctaaagtttagttactagcatgactgtcctcagtcatttccatttactttccccaggacaacagggctcggagttaggtatgggcatggcagagggtgtatttgagtgtttgcatatgaggcacacatggttcttcagtcacatgtttcagaggatgaatgcagaagtagggctggtgtatgcacttatgaaatcaatacgtaaggatacatatgttttaaatcaacttctcaggcctaaaaaaaccccacacttctggattctgtgctgcccacccatggaactgccttatcagtcctcttccagggctggggtactcaacagaaagtttatatttaccaggccttcctcagaaacagcggaggcacatgaacgaactggggagtgaatcaaacaggtaaaaacccttgtatatcagcggcaagatctagaaagagcctagcagtccaattcattatctctccctcttccaggagatgttagatggtgtttattgagtacagtctaggcatacctacctggttagaattttgagagacactgaaaaagtaaacagggcctgggtcccttttccttaggaagaaacaaacctgtaaattatagtaaaggtaaagtgtgtttccttcctcccaccccacccccaagcatggctattctatgagggatcagggcaactctcagaattctcagagaaaatcatatggggtgttctagtttccatttttacacaggtgaaatcagacaaaagtgaaaaaagacagcatggaaaaaagaaagtagtaatgaactcaggacaatgctgaaggaggagggggcagttggttcaccttgtctggtgacagggtaatctcaggtgaccttcaggagctatctggctcaacgcctatttccatttggttttctttgctacgtgtctacagtctccacccagtaatggtctgaatacccccagtgtgagaaactaatcctcccagaaagccatctatgccttcttcagatagcttccatggataataactcacatttattaaaaactttatatgcagtaggcctgacttggtatgccatggaggacggtgttctctatgatctcatatgttttctatatgacagttctctatgatccttaactcctgatgttcactgcccttagatgtcctctttccttgagtgtgggcatgacctatggcttacctctaaccagtagatatggcaaagcttccagatgcatgttgttatatatatgccgactatgcacatataacatatgtatatatgtcggcatatatatgttgtatatatgtcggcatatatatgttatatatatgccgactgtagcacctatcatgctcacagccttgtctcccttgtgggctttgaggctggggctgaaggcagcctctggggctgacagccagcaagaaaccaaagccctgaactgaattcggccaacaacctgggtgcgcctgggagtagatcctctctgagtcaagactcagtcgagactgctattctatttgacaccttgattgtagctctgtgagaccctaaaaaggaccagatgagccgtgcctagaatcctgacccacagaaactgtgggataataaacgtgtattgttttaagctgctaaatttgtagtaatattgttacatggtgatagataactaatgtaaatgctttatgtgtattaactcgtataatcctcattacactctcatttcacacaatgggaaaactgaagcatgaaactgaagcaaccagcttaattccacacagtagtaggtggcagggccggcattcaagtaaggcaggctagctccagagcctgcgttcctaaccagataggtgtgctgccttcctatgcttagaaagttctaccttaagctgcttcctagtctgattccctaaagcttgaccccacagcacgaatcaaacatccaaacacaggtgctagtcagagaaactgaaagaaacaagctgtgctggacacacatgtacagggtacggatgtgaaacagggtgaagagcaacaggtgctgcctcccagtattcaccagccaaacgagatgcttctgtgtttagacggtgactgctgagagggggatcatgctggttggtgccctctggcctatgagttctagttctgcctctaagatcatggaaaacatgataatcccttttccatatgagctgaaatatttcaaactattgatctttttttcccccaaatcctctattttctcttactcacataaatggtgagttgtttttgctgttctcttttgcaaatggtcttcttgacacgtgcagaaacaaatggttgtaggctctgtgtggtatcagctggcagagatgcctcgtcttcttcctcatctgcagggctgggtcagggatgccccccacccacccaagatatggttctgataggcagcgtcaattcactgatattctttcctgtcattatagcggttttaaaaaaattatccaggtaataaacaaatgcgttttagtgtaagattccaatgagacagaaggatttggggcaaagcccaagggcactcctctgcactctccttctactcctcccatctcagaggaagccactgtcaaaatttgtgccaacctttcactctctcttttaaaacactaacatttcacctaaattggattgaacaccacaaaatgacttgctgttttccaacataccaatatgtcttggagatcttttcatgacatggcctacaggtctacctcatacgtttaacagttttataaaccttcctagaataatgacatcctaatttgtttgaccattcctctattgatagatattttaggttgcttacaatatttcattaacatcttcaacatgcatctctgtacagactgacttgctattatattttatacccagttctgcccactttcatggtcaactccactctacttgtcctcttgcagctgactgaaggaactctctgttcccacttttcttttttttttttttagacggagtctcgctctgtcgccgccctggctggagtgcagtggtgtgatctcagctccgccttctggattcaagcgattcttatgcctcatcttcctggtataacaggcacccagccaccatgcccagctattttttttttctatttttaatagagacggggtttcaccatgttggccaggatcatcccgaacttctgacttcaggtgatctgcctgcctcagcctccgaaagtattgggattacaggcattagccaccgtgcccggcctccattcccacttttcaacagtgaatcagagttgggagaggtcccttcctattcctggtgacaccctcttccaaaccaactgacattctccctcagaggcagtgactgatgataacagtggttgtcaagtctacttatatatttttttgaagcattcctttatcagattaggatgattctaaaaattcaccaccttttatgagtagcaagcacagttacatcttcatgcacaggtgtgagtattattaaaggatatattcccagaaatattgggaaaaacatacattttaaaatatttttattgatgataccaatgtgtcttccaaaaagtttatattcctatgaacaattagaagtgtttatttttcggtatcctagataacacttgatataatcagcattttaaatatttaccacttcatttattataaactcctaaaactttctttccttcattccttgtgtctgaagagcagaagaagagttcttgccaccataatgacaaccaccttcatctggcctcctagaaagaatagatcctggataggctttattagcttataggcaatgttatcctgcaagaatggtagctaaaaggtgttcaggacaactagaaaatttttccaagttctgtagtcccaaataagaagaacataggcaagaagtctctgcttgtagaagctggtataaagttacttttagcatttagctgaaatactgagctactcagttccaatgttgtacctccagtggcttcaaaggagaaaaatcttaaagtagaaaggattgactttaaggttaaaagaaaccttatgccaaaggtaggcaaaatcatattaaaagaatgccctagctgtttagaatatattcaagtttctagagtcagataaagttaagccagagaattaaaataatgtataaacatgactatgaaatgaagataaaaatcaaaggtatgctgaaaggctggaatgagcaagaatctcaatttctatattgaaggatgccagaaatcttagacctctgggatatgtcctggcaacattttagaaaggattattataccactgaagaataaggaaggtaaaccaccaccatatagaaagataatatacactagttatgatattttagtatttcagtgggacttttagaaagatctctcataataacctgtagagaggatggactaccatgaactgagtgaaaatgatacccaaagcctgcaaatcagcatgcatgggtaaaaggcaagatctctgccggggatgctgcaaagctctgtccttggcactgctatgctcaaaattgttaacactatttgatgcttatcaaatttgaagctaattcattgctaagaagagtagtagatgtatgtgatgatcaggaatagagactatttcatcaagttggaaagagaagctgactcactcgagagctgtgtacatagctgaaagaagacagcctttgaattaaggtgattctaaactcaaatatcagtcccgttgttgggtagacttggacaagttacctaagcctctgtgagccttaatttcttcctccacaaaagagggataacacctctgttttttaaataaataagactgacatgatttttggtacataacagatgctcactagtagtactcttcctcctctcctcttctcaaacattactggcagaatataagagaaataaatgtgcagacaattgaatggagagtacagagttgcacagcattacacagagtactacccctcaagggtggaaacctagctcttaagagtgattcataagaataagacctgtatgtgttagttgatggcaagttcaatataaacaaacatcattatttcatttaaaaatacagtcataatctgcgttgagtattacatccagatcaggtgagctaatggttttcttgaactctgttcttttcagaccagcagcgtggcaaagtgtctagttttggctgctccatgctaaagaccattgacaaactaaagaaagactagcaggatatggaaaacatgttctataaggcagaaccggaggaaggaacatattttatctggtttaaacaacaacagcaactcaagcaagagatgatagatgtattcaagtatctgaatgactgactttggggaagctcagaaagattagaagagccagtgggtagcggttcaagataagaaacttcagtccatcagggtaaggaatgctcaacagagatgtaaaaaagcaggggttactttgtaagacagtaagtttcctgtgtctaaaaatattgaagcagaagaaattagatgtggagtttccaatagtgaaagtagaacacaaaggggaaaatatgtgtatgtgatgcacgcacatatttttttaggtgtttattagagaaagatcagtaagagcactccgagttccactctatcattctatttcatcattgtgtaagggttgatttataatattgatgagatcctaaggcaggtgatgaaaggagactctttgatttgacaaacatgggttgcactctgctatgaacactactgggcaaaactttgtgggtggaacttttaataaagatacattttcagctgggtgcagtggctcacgcctgtaattccagtactttgggaggctgagatgggaggattgcttgagcccaggaattcaaaaccatcctgggcaacatggcaagattgtgtacctacaaaaaaagttaaaaaaaaattagctgggcatagtggcatgtgcctgtggtctctgctactcggatgctgaagtgagaggatgacttgagcccaggaggtaaagcttttagtgagccatgatcatgccactgcactccagcctggctgacagagcaagatcctgctttaaaaccaaccaaccaatcaacaaaacaaataaacattttcttgaatttaagggactataaccttaaattaaatgtaagtctgcaatccaggaaaacaattgcagagcaacttgaaacaggatgagtgaaactgctgaaaacttcaataaaaatataaaatattctgggacaggcatggtggctcaggcctgtaatcccagcattttgggaagccaaggcaggtggatcaacagagggcaggagttcaataccagcctgactaatatggcaaaaccgcggtttttttttttttttttgtaaaaatacaaaattgaggggaggagcaaagatggccaaataggaacagctctggtctacagctcccagtgtgagcgacgcagaagacgggtgatttctgcatttccatctgaggtaccaggttcatctcactagggagtgccagacagtgggtgcaggtcagtgggtgcagcgcaccgtgcgcgagccaaagcagggcgaggcattgcctcactcgggaagtgcaaggggtcagggagttccctttcctagtcaaagaaacgggtgacagagggcacctggaaaatcgggtcactcccacccaaatactgcgcttttccaaagggcttaaaaaatggtgcaccaggagattatatcccgcacctggctcagagggtcctatgcccacggagtctcgctgattgctagcacagcagtctgagatcaaactgcaaggtggcagcgaggctgggggaggggcgcccacgattgcccaggcttgcttaggtaaacaaagcagccgggaagctccaacggggtggagcccaccacagctcaaggaggcctgcctgcctccgtaggctccacctctcggggcagggcacagacaaacaaaaagacagcagtaacctctgcagacttaaatctccctgtctgacagctttgaagagagcagtggttctcccagcacgcagctggagatctgagaacgggcagactgcctcctcaagtgggtccctgacccctgacccctgagcagcctaactgggaggcaccccccagtaggggcagactgacacctaacacagccgggtactcctctgagacaaaacttccagaggaacgatcagacagcagcattcacggttcacgaaaaaccactgttctgcagacaccgctgctgatacccaggcaaacagggtctggagtggacctctagcaaactccaacagacctgcagctgagggtcctgtctgttagaaggaaaactaacaaagagaaaggacatccacaccaaaaacccatctgtacatcaccatcatcaaagaccaaaagtagataaaaccacaaagatggggaaaaaacagagcagaaaaactggaaactctaaaaagcaaagcacctctcctcctccaaaggatcgcagttcctcaccagcaatggaacaaagctggacggagaatgactttgacaagttgagagaagaaggcttcagacgatcaaactacgagctacaggaggaaattcaaaccaaaggcaaagaagttaaaaactttgaaaaaaacttagatgaatgtataactagaataaccaatacagagaagtgcttaaaggagctgatgaagctgaaagccaaggctcgagaactacgtaaagaatgcagaagcctcaggagccgatgcgatcaactggaagaaagggtatcagcaatggaagatgaaacacgtgaaatgaagcaagaagggaagtttagagaaaaaagaataaaaagaaacaaacaaagcctccaagaaatatgggactatgtgaaaagaccaaatctacatctgattggtgtccgtgaaagtgacggggagaatggaaccaagttggaaaacactctgcaggatattatccaggagaacttccccaatctagcaaggcaggccaacattcatattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctcttggcagaaactctacaagccagaagacagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaactggtaccagctgctgcaaaatcatgccaaaatgtaaagaccatcgagactaggaagaaactgcatcaactaacgagcaaaatcaccagctaacatcatcatgacaggatcaaattcacacataacaatattaactttaaatgtaaagggactaaatgctccaattaaaagacacagactggcaaattggctaaagagtcaagacccatcagtgtgttgtactcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagtgacctacaaagagacttagactcccacacattaataatgggagactttaacaccccactgtcaacattagacagatcaacgagacagaaagtcaacaaggatacccaggaattgaactcagctctgcatcaagcggacctaatagacatctacagaactctccaccccaaatcaacagaatatacatttttttcagcaccacaccacagctattccaaaattgaccacatagttggaagtaaagctctcctcaggaaatgtaaaagaacagaaattataacaaactgtcagaccacagtgcaatcaaactagaactcaggattaagtaactcactcaaaaccactcaactacatggaaactgaacaacctgctcctgaatgactactgggtacataacgaaatgaaggcagaaataaagatgttctttgaaaccaaagagaacaaagatacaacataccagaatctctgggacacattcaaagcagcgtgtagagggaaattgatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatgaatccaggagctggttttttgaaaggatcaacaaaattgatagaccactagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattccttgatacatacactctcccaagactaaaccaggaagaagttgaatctctgaatagaccaataacaggagctgaaattgtggcaataatcaatagctttccaacgaaaaagaatccaggaccagatggattcacagccgaattctaccagaggtacaaggaggaactggtactattccttctgaaagtattccaatcaatagaaaaagagggaatcctccctaactcattttatgaggccagcatcatcctgataccaaagccaggcagagacacaacgaaaaaagagaattttagacccgtatccttgatgaacattgatgcaaaaatcctcaataaaatactggcaaactgaatccagcagcacatcaaaaagcttatccaccatgatcaagtgggcttcaaccctgggatgcaaggctgattcaatatatgcaaatcaataaatgtaatccagcatataaacagaaccaaagacaaaaaccacatgattatctcaatagatgcagaaaaggcctttgacaaaattcaacaacccttcatgctaaaaacactcaataaattaggtattgatgggacgtatctcaaaataataagagctatctatgacaaaccaacagccaatatcatactgaatgggcaaaaactggaagcattccctctgaaaactggcacaagacagggatgccctctctcaccactcctattcaacatagtgttggaagttctggccagggcaattaggcaggagaaggaaataaagggtattcaattaagaaaagaggaagtcaaattgtctctgtttgcagatgacatgattgtatatctagaaaaccccattgtctcagcccaaaatctccttaagctgataagcaacttcagcaaagtctcaggatacaaaatcaacgtacaaaaatcacaagcattcttatacaccaataacagacaaacagagagccaaatcatgagtgaactcccattcacaattgcttcaaagagagtaaaatacctaggaatccaacttacaagggacatgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactacactacaaggctacagtaaccaaaacagcatggtactggtaccaaaacagagatatagatcaatggaacagaacagagccctcagaaataacgccgcatatctacaaccatctgatctttgacaaacctgagaaaaacaagcaatggcgaaaggattccctatttaataaatggtgctgggaaaactggctagccatatgtagaaagctgaaactggatcccttccttacaccttacacaaaaattaattcaagatggattaaagacttaaacgttagacctaaaaccataaaaaccctagaagaaaacctaggcgttaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaaccaatttacaagaaaaaaacaaacaaccccatcaaaaagtgggcgaaggacgtgaacagacacctctcaaaagaagacatttacgcagccaaaaaacacatgaaaaaatgctcatcatcactggccatcagagaaatgcaaatcaaaaccacagtgatataccatctcacaccagttggaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgatccagccatcccattactgggtatatacccaaaggactataaatcatgctgctataaagacacatgcacacgtatgtttattgcggcattattcacaatagcaaagacttgcaaccaacccaaatgtccaacaatgatagactggattaagaaaatgtggcacatatataccatggaatactatgcagccataaaaaaggatgagttcatgtcctttgtagggacatggatgaaactggaaatcatcattctcagtaaactatcgcaagaacaaaaaaccaaacaccgcatattctcactcataggtgggaattgaacaatgagatcacatggacacaggaaggggaacatcacactctggggactgttgtggggtgggggaggtgggagggatagcattgggagatatacctaatgctagatgacgagttagtgggtgcagcgcaccagcatggcacatgtatacatatgtaactaacctgcacattgtgcacatgtaccctaaaacttaaagtataataaaaaaaaatacaaaattagccaggcgtggtggcacatctctgtaatcccagctactcgggaggctgaggcaggagaatcacttgaacccgggaggcggaggttgcaatgagctgaggtcacgccattgcatgccagctggggaaataaataaaataaaatattctgggtgttataaaaatgattatggaagggagaagttagaggagagaacccagtggaatggaatatgctatatgggaatgtcacgggcctcagcattagaagggtaagtttaatttgtccctttttaatttgaggaggcagggtttgtaagaaggaagaggggtctattagttagcgctatactgcactgcagggtaatactctgacagtgtcctaggtaatccactctcccagtctttgaaatgatacctcctctctctctgcgccttgaacatctccttcccctccatactctctgtggatgacctcacctcttatttcactaaggaaatagagcaatcagaagatgactcacacatcttctcagcagggactgtagcaccctcctgcctctatgcccttccacactgccttccctcccgctgacccgttggtgcacactggatgcacccctgcctcttttgtttttttatatttgattattttattattttatcaattatgatattcagatatacttcttttttttccttctttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccaccaccgtccccagagtgtgatattccccttcctgtgtccatatgatctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgctacattttcttaatccagtctatcattgttggacatttgggttggttgcaagtctttgctattgtgaataatgccgcaataaaaatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcattttttcatgtgttttttggctgcataaatgtcttcttttgagaagtgtctgacccctgcctcttcaaagactgcttttgcttttatcccctcttcctcctgcacgattttctctcattccactatatcatccgcatcagcacacgaacatgctgcatcctctcttatgtatatattttaaagttctccatagaccacatgctccctctggccactctcccatttttctgctccctttgatagagaaactctgtttagagttgtccacattctctgcctgttactcaagtcctattctcacctccacccattcaaatgaggcttttactcccaccttttcaccgaatctatttttgtcagggtcaccaaacctctcttcttatagaatcttatggccaattctcattcatctcatcatcaatatttgacctagtttttctctccctctttagtgacatgtggctcataacttggattccagggtactacattctcctgatcctcataatcactgcttttgtttcttcatatctttggctgaatcttccttcactgccaacctctgaggcttagtatgccccagtttcaaaccttggacctcatctcaatctatctgtgccacctagaagacctgtcgcccaccctcaagggtgtaactaccattgacaaactgagagcttcaaaatttctatctccacctaagctctcctctgagttccccactcccctgttccactgatccatttcttcctgggttattttctgtttcagtaaatggcatcagtatttacccaattgttaagagcaaaaaccctggaattatcccagacttctcttttcctctctcagcccacatccaatttgtcagtaggttatttaggttctttcttcaaaatttgaccatattttactacttccacctctacctcctagtctaagccatcatcatttcttgcctcaaatactgtggcagcctgctaactggtcttcttgtttccacttttgtctccttaaagtctattttccatatagcagttagagaaattaaaataaacaaaaaagaaattacatcaatacattaacccctacaatggcttcctatactgctcagaataatatccaaactcttaccatggcctaaaagctctacaggacacagccttgtctcttctccagactcatcccttacaccctcagccttgcttcccagtttctggccatgctcagccattcaatttggcataatattgttcaacctcctctctcttttcttgtttcttttcacttattagcagaagtttctttctctgtttatttaaaagccaaggtttttctgccttcagggactttgcatttgctcttcttttggcctagaatcctcttcctccagatcattacgtggttcaccactctcaccactcatttcaggcttactccaaagtcaccagctcatggaggccaaccttggcctttggaggcaatggaggcctcaggttttctatctgagcatggaccccataactttctgctcccacactctctactgtttacactagttcatttccctttattgtacatagcatagcctgaccttaggccaggcattcaatgtttgctgaatgcctgtttcaactgctagcctgccagctccaggaggacagaggctaataggctggattcacatctatattcctagcaccaggaacagtacctggcacacagtgactgctcaacgagtaactgttggataattacatgttgaatgaatgtatgagggtcagtttagaggaacactcagaatcaaaaagtgagagatcattttagttataatggatgtagcgagcaagtaaaggatgggccagagcaaaaaggagaatgcagcgagtgtgcacgggtgaagggcaagggatcaatgtgtcagtggtttacattccgtgcagaaggcagaggggttccaggggtgcaatcaaactgctaaagagagcaaagagctttgccaggtgctgtaaagtatttccacccacattttgaaggggaaatctttataacatctgtttaatgtgtagcccagtaataggttttagaaatgtataagaatatttgattttaaaagaatttgtgtatcacttatatattttatatatttatatatagatattatcagagtcagtgagtcaagactgactatgatgccacagaacacagtgactcgtttcattttctcggtgttattttacagctttgcattattctgtggttttaaaggggaaacataaagcatagttatggtgttaccagtttcagaataagtagttaaaagccttcttggccaattttaatttttttccttgactggaaagctctgaaaggcataagtgtatggaacgaactgtaacacaacccgaagccctggtagttcgcctcctcggtttctcctggtactcagttacttagagagataatggcatgagccctgtgaccccaagccattactcattaacccccctctaattgagggctctagtcaatgaggactgagatggatggagtctgtgacttggatggacagagatcacccacattcagaggcttctgctcacctcacactttcttgatacttctgagcagaggctcaactggccttgagaagtcagtcttcacatttcattctaagtaaggattctcttcaccaccttttcccttccctcactactcaggattatggtcaaaatttatatttaactggggtttatccaaggtctaccgttttctagccctgtaattttagacaagcgactttagctctcagaacttcagtttgctggtggggtgcagtggcttacgcttgtaatcccagcactttgggaggccgaggcaggtagatcatgaggtcaggagttcaagaccagcctggccaacataatgaaaccccatctctactaaaaatacaaaaattagctgggcatggtggtgtacgtctgtaatcccagctactcgggaggctgaggcaggagaatcgcttgaacctgggaggtggaggttgcagtgagctgagattgcaacattgcactccagcctgggtgacacagcaagaccgtgtccccctcctacaaaaaaaaaaattaaataaataaataaataaataaataaataaaagaacttcagtttgctcatgtgtaacaggggaattaataaaacttattttcccccggtgatgtttctgaggaagaaatgagatgatattcataaaaatggctagtccaatacttggtacttagcatgaaatacatggtaactagtacttgtataattattcccctcccccaccttctctctctctctctctctctctctctctctctgtctgtctgtctctctctctctcttactctcgctctaggttaggttactcctatgatcatttcattcttgttattccctaagctttggcgtaatattgttcaacttcctctttctcttttctcgtttcttttcatttgttaaaagaagcccccaaagcctttcactgtcattcaaatgacatgtttctgcactacaaatcaacaactacttactgactactgacaaagtgaagttttgtggttgtcaaagtcatgtcttctgagaagcatctcattccaagtcagtgtttcccaaagtaggtgtgtataaatattgatggatgcaagatgatttaaggtgacatagaaacctttgtttttaattttcagagttagaaaacatttatttatattagaaaaatatgattagcatataaaattacagagagtaaagcctacgataaacctaagtaaagaagtataccaatttaaacttacttaaaataatattaattatagtataggtggaacacaaatatataacaaaaatcatgaggatgacatgtgagtaactgacatttgggaagctgttctgagtcaatataaggtcaatagataagaaaagagtattaataggcccaacttctctattcaacagtaatctatgtaagatgcttcttcactttcctcagtgccaatcaagccatacatcttttacccaatttaattttctgaagtcacctacaaccctaggttgaaggtctagccaaacccaggaatgagagaattaatttttttttcactgcaaaagtaatagagggaagagactttttccttatagctcttatggacatatcctcagtcggcctctaaaatttttctgacactggaggctgttgctagctgtcatcagagtcactccgataccacatgtacctggagcacaacattgaccaagtgccacctctcctgtgacaaaggggtacccaaacggggattcgggaaatatcaaagcacagtcaccacaaaaaaatttcccctaaattgcatgctggaagaattattgtttaaaaatcacttgctgcatatgcaccactttattgtatttcagccaatgtttactaaggcatgaaagaagttcaaacataatagactgtcattcctccaaatcactaatgaaagctatggctctgaacacacaaatcaaggtgctggttttgccttgtgctatttgaggagcactcagtatgtactcccagccacatagcaaactggatcagttctctggaggagataattaatgcgtacctgccataataagtaatatgttcggctctgcattgctctatttatagactagggtttttcctcatattttttagcacttttctacaagcagaacatgtgaatgaatcactcttatcttgtcaattttattattaaatggtgctcaactttttcctagggtgttttaggactgcacagacattttctgggcaaacagaaacaaatgaggctggggggaacctctggcttttcaaagtctctagcttctggctgacctatattccattcattagtcttgggcagcaggcattttgttggaaatgtcatgttgggtggagcttcaaggccaaatgtgagaatctgctgcagcatacaatgagacagaaaacatgtggtcaacagagaacttgttgcacttttttttgtaggaaagtatgccagtcttagggccacagattcctcacagagaaaatctacctgctgacttttgcttattcattcattccacaagtattgatccaatacctaacatttactaagcactgttctatgcactggagataacaggtgaacaagatatagaggacctgccctcctgtagcttacattttagctagggactgagaaataaaaaaataataaatttatcagttaatttcatatagcgataactactatggaaaacaaaacaagacatgggagagggacagaatctcaggtatatttgcaatgctatcagtcttgactttataatcatagaaacttatctgtaaagaagcaatgtaatttagctactttcttaaatattcagtaattttaacactcgtaaacataattttaggttctttcttaaggctgacactgaatggctttggcagagtacacccggcccttagttctcattgtcctcactttggcccactgggagcttgtgaggatacagggacagcccaactgagaagcaaaggtacttatcccttggtattttccccatgttgatcatgtcctcattaatagcagattttgccttagtttctttgggcagcaaccgtgtactttgtatgacatttcatacttgcttgattcaactgactttggtttctcatccctgagatgcactcattttttttgtttatttttattttttactttttgagaggggctctcactctgtcacccaggctggagaacagtggtgcaatcaagattcactgcagccttgatttcctgggctcaggcaatcctcctacctcaatgtcctgagtagctgggaccacacgtgcatgccaccatccccagctgatttttgcattttttgtagagacagggtttcaccatgttgcccaggctgtaactcccaagctgaagagatctgcccgccttggcctcccaaagttctgggattataggtgtaagccactgtttctggcgtcactcatttttttggagagtctcaatagtagaactaaccagatgaagcagaaccaggcatttacacacctgaacagtggtatagctgtaaagtcctagtgtaaaagtcacactatatatcttctgtaataataaaaaattacacaaatgaagcatctaattatatgaataaaaaagactggaaacatttggaacagagagggcagaaccttcaaattcctgttgtagcctcttaacttaaggttaccagctcctccctggtgtcaagggtatggtattatggggattattttccagactttgattgttcaacagatgttgaatttcctggatgcattctaatcagcttgactgtatacatcttgggctactggacattttagattctcagcttcatatttttactacccacttccaaatacctaaatgtgagcaacaacaaagactgatgtaaactgtactcccttaagaccaaattgataagcatttcttacagtctaggaggggaaaagaaatcccacacaaacattcatggcattattctggatacagatttaagaaaatttccctgggtgcatcaaagtttagaaatgtaatagatatgaatatttgacatcttcctgcatttgtcaattgtccagaattctttgggcaattaatcaagagtgacataagcaaaaaaagatgtcctatatagaaagaggaggcaagtcaaataagtaatatactaactctaggctttgaggtcaagtgtagtatcctgtcttcccttcacaaatgagacagacattattaaatgcctcatctctaagtgggcaagaccacaaattattgcaaaatatgccaaactcaaagtctgtacagattttctctaatgacttggacaaacccttcaagtggtcaaacttcatttcaccagtaatctgtcaaatacaggagaatcaatagattctttttaataaacattgatatatggtagaatctgttagttctgaatacctttgtccttggaatttatcttatttttgaaaactaatggggagaaatgaaattgaaaatacatctccctaatatttttaatcaaatattaagtctctaatacaaacttaaactttggtgtcatagggacactcatgtcattttttactatcatccatattaaaattttcattaaaccttatggaaaactaaaaaatccttttattcttacatttaatgccatatgagacatgattaaaatgacaagttcccaaataacatgaataatgtatttctcctttatcgaaagcaaacgcattttgctcctaagagtgtttaatccatttcctttttcaggaagaggaaaggagggtgataaaaggatttacggttagaattggtatttaatgaaagacacatatttggcttgtgattataaaataactgctgtagttattctgagtttagataggagtcatatattttgacatgaataaaaacaaattatgattctgttaacattcagatttacctctttaggacagaaatgtttaaagttactctgtattagtcatggaaatagtagagtctatattaagaagccttatttctgtgtatgtatataaatgttaacttcaggaagcaccagatctacatttatagaataagtttcaaagaacagcttaaaatatcataaaacttagatagagaagcttaaggtgccttctgctactttacactctttttccactgcattccaccccattcatcagagaaagtgctaatatgaacggtcaaatccagtcatcaactttggaccactgggagtggagctttaggggagatataggcaaaagccatagctctgttaagatttcagcctcggctgggcacggtggctcacacctgtaatccctgcactttgggaggctgaggtgggcggatcacgaggtcatgagatggagaccatcctggtcaacatggtgaaaccccgtctctactaaaaatacaaaaaattagctgggtgtggtggtggatgcctgtagtcccagctgctggggaggctgaggcaggagaatggtgtgaacccgggaggtggagcttgcagtgagccgagatcgtgccactgtactccagcctgggtgacagagcaagactccgtctcaaaaaaaaaaaaaaaaaaaaaaaaagatttcagcctccttgtgtttgcttactccccagcagctgggacaggtcaatggccctggagctgcatcttacttgggaggggcctctgcatggagaaggtcagaaactagtacattagccaaactctcctttagggcttcttttcattggtgcacttttctctagaggcatctttccatgctaccggggtgttaaaaataccttgagggaagtaggattgggagtgagcacaggagaaggagactaagactgtaaatgtcatctagattaagcttgtccaatccacaacccataggctgtaatacagcccaggacggctttgaatgtgccccaacacaaatttgtaaatgttttaaaaacattatgagatttttttgtgattcttttttatttttattattactttttttagttcatcagctatcattagtgttagtgtattttatgtgtggcccaagacaattcttccaatgtggcccagggaagctaaaagattggactctcctgaattctggtgcttacagctctatatggtccagcttagtccaggagtggtcaggagaccacttcaggatttttcatttgaagctctggtaaataataaagaggatacatttacttggccttttcctctgtgcatttttctctctctcatggacttagtgggggcacaagtggacatggtaggtgattgctcaagacttctggatgttgggtttcacctctctttaagttacttcttggccaaagatctgagaatactcttctttttgccagaacaaaagttcataggtacttttaagtaagacagtaagggatcagaactccatgagtcattagtcagtcaggaggcaatttccaagaagtttgttaattctctccctaaaatactattaagtaataatctactgttaactactttggtttcttagccctctggctggtgcaatcttttttcttgaactgttctaaataactaagaaaattctgaacactcctaatatctctggcccctaccttaagagagatgaacaaaaagggttctatcaatggtcaagctccaggaaaacatctcgtaaaactcaccaacagttaatgattccagtgacttttaaatctaacataaagagaaggaaaaaacaaaattcatgatgaaaaataatgtgtgccacaaaccagggattatgatgaaccaattctgtgtatttaacatgtaacttaaaaaactactttatgactttaagaaaaaggaaggccttcaaatgtgttgtcatttagaatgtggcattagagaacccatgaaaagaaaacattgataatagcatatttgcttagtatcccatagagttgtaaggacactgggaagtctcctgcttcttcccagcagtggaatactcagtaccagtgaatgtagggtagccaagaaagaattgatgggtaactgatattcttgaacttcaaacgggatatttctttaatgctgacaaggagaaagaggataacacagtccagagctgactgtaatagtttttctaaatgcgaccagcatgaagaatgatgttttataggataaaatagaagacatctcggcactgggtgatgccatctaattgtagaattcaaattgctttagaatcttcaaagcaccaaaacaaggatgtataacatattcataatatgtgtcttcataagtcctatactttcaaaatgaatctgagcctttggaataagagtgaaaataaccacctgaaatttttataaaaataaagaataatcatgaagagagttactcacaaatgggattcatcttgctctttattcaaatggaaaattcttcctttcactgacacatttgccaaaccattccagttaatgtaggaaacaccactttgtttctcctgaattgctaaaactattgtactctaaaatcctgtagctgaggtttagctgtactcaatttgcttgtataaaatatataatacatcattttacataaacgtttaaatgcattaatgcttttaactcttctaagtacaattgcttccataaggaatttttccatgaattatttagttcagattgtttgaatagcattttgaatttcctttcctctttaatttcagaacttacatgtttttgtgtcattcacaaatcaaagcttcaaaatattgacgttttggggtaaagacatttaaagatatttcttcaaaatgttttgttggaaagacatatatatgactcattgtattacaataatatgactcacactttcctaaggaaacaaaatcacaaattttataagagctgtccaatggaagcaaactcaggttcaaagagatgagaagaaaagaataattttgcattcagcatacatgatctgttgcggcaattgtgaatcccttatttctgccagctatggctcagtaaagaaatggatgctattgtgaaagtcatcccctgaaaatgagatgagagtaagtaaatgagtagagttgatacaaattcaagtcattttgcaaaggattttacaatgatggattacaagatgaattctcacaagttggcaaggttttccaaagtctagcttttatgaatattgtttgaacaagtgttgtagaattcagtctatgctctgtgaaataacatgatttattattattattattatttttaccaagttggaattatttagaatcaccaaataacaggattcaaaagtaaaacagctgaaaaatccaacagtctggtctaacctgggatgctctgtctcctcacagccaacgctccatcaggcggctttgtctggctggcggatttagtgtagggactctcatctgcaaaggtacaatgaagcgtttggttaatttccatccagtttctaatgcagtgaagatttttaacggattgcaatccttctgcgagagagaagtggtacagtacagtggaaagtgtcggtaggcctgggtcctatacttgggttagctgtgggataaatctttgaaaatgttgtgaatatgtttcttcccctataaaagagagataaaattctcatctacttcttagggttgtcaggatcaaaagctatagtgctcgtgaagatatttatgaaacggtaagaagtatgcaaatatagtatacaaattatttgtcacctacatttattgataaataaataccagtgaataggtgtaatgaagacaaagaagaaataaaatggttcaatgggcactaagaataatcaggtagaaagaagaacaaagaaagtaaaaaggaaggtaatatttcagataagcagatgacagagagttagtattgcaagggaaataaagccactcagagttagtaggttcctcctgggagtgtgaactggcagccagtgcaaagcagagggatagagatgttcagagggaagaccagaggagctaggttgagaatagggaaggaacgatggtttggcaaaagaagacatatattgcaatgagctggtttgtgctcttttagaaagagatgaaaataacttgcagaattattaaaagagcaactgagaagacagaaggtctaaagcttaatgtatgtgtgagagttaggtaagaagctgaatgactaaaacagcaggtgacaagatcatggagacaatgggtccatccagctctaagtaaggtgatttttttttaaccttgaaaaggattttatctgactaggaataaaggagtagtaatctaggatggcaaatattaaggttaaaattgaaaggacaattcttcctaattgggatggtggcatttataaaaagtaaaagaaatgtgaataacacccttaaacatttcaagaataagatgcacatggcttgagtaaatagaatgtaaaataattatctagcatattcagtcaagctagataatctaaatgtcactgctggccacgctataagatgtatcgttgttgttaccattttataatagcaggaaatcgttaaagaatttaaagaaaccatactgtgcatgacaaactattacatataacaaggatttattcagaacaaggccttatcatctgagaatattaattctcccaactaaatagcttgtgtttcaaaattgaggaactcatttcctctctaggatgaacttctggtttgaaatgattcatgatttcttcataaaattaacaaggtctttatacgcaatgacaaaaggaaaagattaacactgctgtaagtggcaattaacttaaaaaatagaagtcacgctgtttcatgtttatatttaatttgtcacacaattttttatattcttccaaccataaagataaactaccaactttcagataccaattcaatcaatatcgcttttgctttagaagtggtatcttaggtcttcgactcttctctttgcaaacaccattttgagtataattaaaatccacaaaacaaaatacaaaatgtaaacattacactataaaagtctccctttgcctcaccattgtcacttgaatatttgagcgcttttctcacagtgttaataaacaggcaatatgcttcatttagcaccttttaaaacagacgtactatgtattaaaacctgggattctttataagactgctttaaaaatgtatttcctttcattgtccaaaaccttgaaacagtgtgtttatgagcatagagcactgagccagaaaataatcacaacaaccaggcttaggtacggcatcttggaagcctaaaagatttcctcagttttctatttgtcaagattccagccaattaaagtcttgaattgaatccagtgttggatttttataaagggcaataagagattttcccaggagactctggggttatctgcacttgatgctctattttaaggagctagttctttagaaatgtacccagtttgcatttcagaagtagtgaaccctggtaaaatggttttctcatttatatttgaaaacaacttccttgatttagaactgagatagtctagttgagcacatctttaaaaggttgaaactgaattatagatgaccacctggccagcctctccatcaccacccccaacctccactcctgctcccagtatcaagagtgaacttactgagcacaggcaaaagtaaataattatctagaagccaaatcttgtattggttaaaggatcagaatgaaaaagttcagtgttatctaatgttgtcccaagcagtgttattgctttcaccctcactgccaaagccaatcagtgtaaaagcaataattcctaatggaagggaggcagaggcttggcaacattgatcatcagagttaaggagggcatagcagcagagcagcatggcacaatgtaacacttggtttttaagagactttccttaagagtgtctctttattttaaataccttagaggcaccatggccttttataaaaagctacccatcacagaataaacaccagctctcttgacgtgatttactgaaagtcaactcttgattcaaacttgtttgaaaatagaaatggagaaaacacactgaatgaatccgtggctgatggctccacagtaggatactaaaggacaagagtgtccagggtgcatttcaaacccttgagcgtaaagtcatggagaactatggaggcttctatcttctcttgcgtctctaaatgcagctttatagatatatccctagaatttcatgcttataagggataatctagaccactctttcattataaatggaactaaggcccagaaagataaatttatagaagggcacacatctaaattgagtctagatgaaatttcttatgttcttagtcccatgttctttcttctttatcttatttccttttagatagacaataagatttcataagtcattgggtccacatgttgctgtgtcacaggagtgagtgagtgggcacactgtaccagcagagaccttgtatggtgtaagttaattgctacagtgaagcctttgaaaaggagcctgagccacagagccaattattttcgtgtgtatataaatcccattcttccctcctccacatatttgttgcctaaagcaaacaacacttacaaatggtactacagaactaatttatgcttttcagttcatttccttgaagataaaattcaaaagcaatgtcaatatagctcactgatccccaggatgagccttaaaagagtcactgaattataagatctatgttaataattttcctttgtttcattggagagatactaaataggctttcaagttacatccagatatataaacgaacaaaaaaaaggtcaaatgacaaggaaagaaatcaatcagaaccatccctagcacatcgtaggcattcactaaatgtttgctgataaaatatgtgaattaattatattcactttttcaaactagagcatttattgtaatcaaagaacctgaagaaagtgaaacatttgttataaagctatattccctcctacttctgcttttctttttctaggttgatagcctattccttttaaagtcacattatcatccaatagctattaagtattgacttaatgtgaaaaatctgactataaaaatggtatctacatatatttccttccattttcattcagattatagaatgatttattgaccaacctttaaaataatgtctttaaacaaaagaattatgattttcatagcagactctcagcccagacttcgatgatcatattaacaagggattctcactaaaagtcactacggggcaaagcagacattcagctagtgagctactgctcgctgaaatgaatgctccaagcaatcattaagggcatctcagggtatcagcactgccagccttttctaacgacatcttagcagctaggtaatcaccgtcacacatgatggccctccacaggggcttacatgttggtcacaataaggaagaacatgggtccctttagagtgacatctcatgaggctagggaaaaatgccctccattaacagggagaattgacatggtgacaaaggcacagaaagcattagtcaagcatacacttaaagcagaagaagaacaataggagggaccatctgtccctctcattccccccaatttggccagtctcctcatgtgccaaacactggaggggcaaacacagatcatttgttttgatcacatgaagctggtgtttataaacttggaaagcaaccagtgggcacctaaggagcaatgcttcactctgcatcacaaactgcctatgctggagctgggagaatcacattgtgaggaagggagtcaggtctcctcatgctctcaaatcctccaacgtttgcttggtatcaaacagcatccttgtgtcatcaggctggttcctgtttctccatttcctgagactctcatttctcactctgggctatgcagaggcacccgatatgaatatggtttcaggaatctctagctgtgttcaaagctttgctgaagaaagaaaatttaatttcctttggctgagactaatcgtcctatgctaaacaattcctagcaactaattatgcacaattgaggcacctgctaagccagcagacccccttaacatcttgattaggaaaaaataaggcatttggtgcagttaaacattatgaccatttcccagcagagaggagacaggcagggcatgccacagtgttcatgcatgtccttacaaacttgaaagaaaagtctggtttccattaatgaacaaaataaaatccgctgtggatgaaacaatctgtcccttgaattcaattaaatgccacacaatttagtacctactatgtgcaaactaagactaaaaatacacaaaagataatgacaccttcagtggagtggtgatggcagaatcattactacctacatttgagactagaacatggtactggattacccgacggggtgagtgagcatgggcttagggttaggtggaggtgaagcacaggatgagaaagggagatccaccattaggaatttatctatggttttttaatcagaaaagtcaagaaacaagccattttaggctttcagataacatggtagttttgtgtggtggggagccataatcttttcagtaactgggtcctgtgaacattttatcccagtcagcatgaacatatcatggttgcttctctcccatagacaccagccttccagttccatttgcttccctggtggtttgacagcacactttgaaatttaagcaagatttcctgaaggataactgttaaggctttttgacaacagagcttaattatatctttctcttcttgctaaaatgatgtgtaactacaatcacgggggccccgcataatttaaagaaattaaattgttcataattcctgatccaaataaccctatttttctagggccaagcaaaaagtgcattcatgatctctcctagagtcagaaggctgccaagtcctacacaggctttggctctacagctttggtatgtggaggctgcaacatttcatttccttccctaatctgatggagtggtccatacagctaagtttacaccagaagattagggaatgatctgagcttgatggcaagaagcagaggcagtgtgcttccctgtgatagtctctttcctatgaaaagatgacttcccccttctaccttccctcctcccttttgttatttgttttgcatctgcatggcattaatgtctatccttgactctgcaggtttcctcattgtttcataattcagacacaaatgtgctctatattcctaaagggaccagatcttttgcttttttttttttttttttttttttttttgagatagggtctcactctgtcaccctgcctggaatgcagtgatatgatcgtggctcactgcagcctcaaactcctgagctcaagtgctcctcccacctcagcctctgagcagctgggattgcaggtgcatgccaccaagcctgacttttttaaaattattttttatagaggctaggtctcactatgttgcccaggctggtctcaaaaactcctggcctcaagtgatcctcccacctcagtcttccataatgctggattataggcatgaaccaccacatctggctttcttttacttttgaactttggaaaaaaaaaaacacccaaacagagcacaatttcattttaagaacaaatatagagtggtttcttcacaatgatagaatgtcttctaattaaccataatctgataaacacttcagggattaaatattgaagctaaaaagaatggcaacaatatagctcacattgttttaggcctgtgttataagatcatttcttcccctactgctctattatctaactcttgcttctcaaaatgtggaccatggatgagcagcaggagcatacctgggaactgtcaaaaatgcagaatctcagcctccaccccaacccagggaatcagagtctgcatttagcaaaatctccaggttatttgtatgcacgttcatgtttggaaagccctgctccaactgatacgaccaacagcaactgcacaggtagtgaggatacacctgttccaatgtctcacttggttgcatcagaggcagcctacaaagcagctggcagaatgccagtcatatcagcaaattccaagagtatccccaggcctgcaatgatcaaattgctcatggaatggtttcttcaaatggaaaggaaactgttgtaatggtatggttttgagtgaattcaatcttcccttgatccattttaaacctctcaacaatcctgaaatggctgaattataggagtaactagatctatctaaggtcagattcactggagcaagtgactgattgtaataataatctattagtcaatttacattttaaggtggagagaggaaatggtattgaattactaccccttagctagtaaaggtcaaatgaaaataaaaagttatattctgcctcatggcagggacatgagggaagaatcttccatggcactgtctccttaaattcttcctcctcagatacaaatttgcttccttgcatctgcacagttctcctgcaaccaggaagggctccagcacagaacccagcctctgatctgcacacagggacaaacagaactgcgatggccccggagcatctggacaaccttgtggaagtggtctgtgctagctagtctgctcagtgatgcctgcaggccttttgggaaagtaatatctttagccaggttaatttgtaaatcctctctgaaattaatgagcatgaaattgcacattttctgcctctggcattcctattcctaatgtgtctgaatcacaaatgataactcctatgcttcttcctaatattgtttccagcaaggacagctgaaccagtctgttaatggcagtcacagacctgcctcatcaccgaagaatcaaaatttgtcaagggctggaatgtattccataaagttcattttcatgaccatatcagatcccaattaaaaacattaaaatcttaaattcagtatatctttcacattttttctttgtgagagggctatgtgctttaaagctttggtttagccatcagattatgccagctgacattttcagtctctcataggttcaataaatgcttagctttagaatgacaatttggtgcaaaatttggattgcctcagctgacattttcagtctctcataggttcaataagtgactagctttagaatgacaatttggtgcaaaatttggattacctcagagtaatgagtactggctatttaaaatcacattttaaattcttgtttaaaaagcacactattcttcaggaaaaagtatgtattaacaggtataaacttgctagaacatatccgagtattcctggagggataagaaccagtgtttgatttcatgtaatggcaactgagtggtaggattaatagaaatcaataatacatttggagtaattaaggtttctccatttttttttaactaatgaatatgaaattcagaagtcacttatatatatatatacatatatatatattcacaatttggactgcagtaaatttaggggaaaatttaaaatagtacataggttttccttagataattcaagaaagaatgtttaaaatgttctcatggaaaagactgaaagtgatttttaaacaaataagaatgattagtttcaaaactgaatcatttaaacaattatatctcttgactacttaaattgcttctttttttgccccttgtttggaacgtttttggatttctaatgtaaaccgtagagaaaaagagggagctttctgttaaatcagggctctcaagagtccttcttttacatgacattactgcaaaggtttccatatttagaaattttcagtatgatagctgctagaatgaagtcaagactgatgggaaaacaagcagcagcaaaatgcaatcaggatgacttcatttgaagaggtctaaatcttgtgccagtgtgtgaatgagcactgatgtctaggaaaatgatccacatatatctgtggggcggagcattcctgtgtatgtttgattattgagaaattagcctttaatgctctcacctgttgctctgacaatcggtgacaggataaaactttataacttcggtaactttaaaacctggttcagtggctcactatgatctttccttctttttttctgttaatcaagtgtagtgtaaattgatacatgtcaactgcaggcaaattatataaataattgatcagatagtcaccactgctgagaaatttctaaataaaatggaaataaaagtattatcaccactgtttagactcagtttccaatacacaaaatgaaaatgcctctatatctagcatcctggaataacaaggggacaatgtatagtatatatttataaccttgagtaacattttggagctaagagcacagatgattcttcccagggtcattgatttgactgaggaacaagggctatgtgtgattgcctagatgtgtgaaaatcactgtgcaactctcaactccctctctcgtgtcttaagtgtgtaacggccttagaaacaatggtccaaaggatgttcccaataagccaagggaaaccaagatttttccaggcatcaattttcattaatttttaaaacagtgaaataggtgatgggactttgtggtaatggagaaaatggattaagtcagaacttatcagagtgcaaagtcgatggcaggaaaagtaaacctcaggttgatgtccctggttgtatgtaaggggtataagttacacgaagaaaaatgagagtttaattataatcatatatttttagatgcctctttcattaaacagcaatcccactggtttcctctataagtaatctaaataatttcttagagatctgttatttcattctgagttcagtttgagtgtacttcagtcaaccagaagcctttttaatgtaaatgatactaataactttataaataattagagctaatacttacagagcattcatgagatgccaacatgagtctaaatcctttatatgtataatcttatctcttctcacaataactcaataaaatgtaaaataacaaaacagataattccattttacaaaaggagtagtggttttaagaaagaatttgtcctcatctaaataggttgcatggcaaatctgaaatggaactgctattatattaaagcctagggcagggcaggcatattacatgcctagcactctgcttggtacctcacatacattatcagtactcacaacaatgtaattgcacaggtacaattacataacttgaagtatggggatacagaggcttatagagatgaaattatgtgcctaaatttaccctggaagcaacaagcaaaaatgaagctttaacatacgtatctctcttagccaccacgatacactgtttaccaaaatttgattcacatccttacttggagagagagagagagagagagaaagagagagagtgtgtgtgtgtgtgcacgcgcacatgtgtgtataaagaaaggcactccttcacatagtagccactactgtgtatattctgcatgactaaatgtcactgatatagggacttggggctgcatttgaagatcttctgaaattgcagtttagaaaagaatatatcacctcacccaatttttagacatcacttcttcatcatgaattcttggtttaatttatgatataagatgcaagattctttccagcacataaacaaatcacttgaatgaatgcattttagccaagaagctccaagcattttagaagatgaaatctggctgaatttatttctctaactcccactctgagccaaccattctctacagatagaggatttatgaacttgttcctataaatggtttatcattttaaaatgaataaatactgggacactctcttttctcctttagtattctagacaacaagttcatggccttctgcttacaatatttcaaaccttttatgagtgttcatgtagccagagtggggaataaatcttggaccaggccacatctagcaacacaatgaagaaaatggtggtatgacttgtgtagctggcaaggagatcgctgagtctgcctttccttaccctctggctctccaggctcatctctacaaagagccaagctccatggcagaggtgctgccacctcaattctcagactcaggagtagctcatgcagcagagtcactgggtagacaggcatgaattttttgctagacttaagaattttctgaggaacttttgaaaccaaggtgattaacccactagccattatttccaagactgtcatccctcctggccttggatcatttcaggacctatctcagaactcacttttttatagactttagttttgaaaattcccaaatttaagctcaagtcctaagagcaggccagtgtcattatacaccatcttagaaccaacaccttcttgtctcatgtgggcagcaggtggggagggaggcaggggcagaaatcacatttggatgccttgggaataacatatttcatacacatgacttgaattgtcacatattttgctttattaattcattgctggatcaggcaatagcagatgactgcttatcaaacagatgacatgtgtttttaatgcacaattaaagtaggatttatcacggctgtcagaatccagggagtctgtgctttttgttattcaaagctgtagtttggatactctctggttttacagtgagatagtgattataaacacaaaacctcacaaaagtgttagaccagagagaggttttttgtttgtttgtttgttttcaacagtcttgctctgtcacccaggctggagtgcagtggtgtgatcttgactcactgcaacctccacctcccaggttcaagagattctgctgcctcagcctactgagtagctgggactacaggtgcataccaccatgactggctaatttttatatttttagtagagatggggtttcaccacgttggccaggctgttctcgaactcctgacctcagtgatcagccagcctcaacctcccaaagtgctgggatttcaggcataagccaccatgcccagcccagacatagtttttgtatggacaacatcaacaccattttcaactcactagagttttactgtactgcatagctctaccacttactagctgtgtgacctcggacaggttcagtttcgtcacctataaaatggaaatagtaacgaccacataggattgctgtgaggattgaacaaagcagtgtaaataaagtacccagagtggtctgagttcaagaagtggtggctctattcctttatctggaatagatgaggaagctgagtgatagacaaggaccagtaggaatcccacagtaacatgaaacaaattattattattattattattattatattatatatatatttttttacagcacttataatcctaccttaaaatcatcaacctgcttattgctatgctgtgaactcctttgagtaggggatttacttttacaatcatgggtattattacctcaaatttcacagatactaaaactgaatctctgtaaaactgaatctcagttacaaatctgtctaaggctatcaaaagctaataagaatcagagacaggattctaacttaggtctgcctgaaacaaaagaccatccttttcccaatgtcgccacactgcttcaatagagggggtttgcacaacacacaatcattagtggaaaggagagaaaactgggacctgaccattataaactaatcttcatgcaactcaaacctatacctaactttctaccacaataatgatgcagacacttgacatacttttggttttttatttaagctatgggctatcatacctgagtttttatgaagaaattcattgacattaaatggtctattatgactcaatttgtcaatggaaaataaaaattaaaacccccagatgcttagatttaatagtccaaagatgaccaaattatcttcatttgcttctaagacaaattattcagacatataatttcctcacaaattacttgcttgtctaactctccttgggttatgtctacctcatcaacttcactactttcttccataaatcttgcctgaacaaagattcaatttggataaacaaagaaaatgcaattcaattccacaaaatgtgattgtttaattttgaactgattttggagcattatactcaggactcttccaattttgcagtaaatgagttactgacatttacaaacatctagaataaaagaaaccattccttccatcactgtttgtcaattttattgttgaatctgctttgggacacttcaatcatgaaagtaatcatgtaaaactatattgaattctattagtaataataccttagaggaggttcatttatgataactgaaattttctctgactcagtctcatcagccatgtattttgccttaaggtattttaaaaatcaagaagtcaaagctttagaagtgtactcctaaggccttaactgaaccccattatattttgaaacataatttttatgaaatacaatattgatacgcaaatcagtcagaatttttgtgtaaacattgtttaaagtttctatatcagttgaatatcaatgccttatgagaaaatcaggaaggaatatatacatatatatacacacacgcatatatatatataaacacatacacatatatacagatacatagatacacacatacacttatattcatatatatttaacagatgtagacatctacatgtatctatttataagcactgacaagaacaagtatacatataaacagtagatccaaaaggactcctcaatcttaagacatccctcctctcctatcctgcagggcaaaatacaatgggcaaaagtcggaaaccaccatctctatctcagtgacttcttatggagccctgtggtagaatgaccaggaacttagagccaatggtaagaaccaagatagtacagagcttctgtactataccagggactttgaaatttcagaaaatgtatgctaaatttgtcctttatataattcatggactttggatttctacatttgagattgccatatgacattcagagatgctttcacagaaattgtaattcagcttagagacagcctacaaatatgaaacatatgcaatgccaggttcacagcttgtaaaagaacagaagaatagctatgtgaaaaattagtttatctcaggggtcaaaagtgataactcaagctcagcccaacagacattgcagaggtgggaatgaataccatttataatatgtactattcatacatccactgcatacagaaatagcttagaaaggttatgcatttgtgtgcagatctactgaatgatttgggtactgattttaagcacagcctgccttcacatttctccactgtataactatagcctttattggcttctcttttgcttaagacaagcttaacaaaaaacatttgacatttatcgtgatagaataaataacacataatggctattatgaatacaataagggtcagatgtttacttttttaacaattagggatgtattgctcaaaataagtaaaagcatttgtgcattacctgaatatcatcacatttatgtaaacagagatcataagcctgaaatatgtaagtaccactgatgccactcctgtcagcatcttccctctaggagatgatttcaaatgacattttttctttccaagtatgagagacattagctaaaaatctactaggtcaaaaaattctttttgttagactaagtagaaagctttgccattattgtcaaatatctacaaacctaattgaaaaaagatgttaaatttagtggagaaagaccagaaagccttaagcaacttgcataattagaccatcttttcccattgcctttacctttattattttgatcctaggaattcctttttgcatttcatacttgtgcataattaagatgaaatataatgcaaaggctgaactctcattctgtaagccctcagaaacatttgaggaatagctgttctatgactagtgtctataaaaattaaagattgatgtatagccactaaatgatctcttctcatttagactgaattatgtaaacctattataaattttataaatacaaagaaggcatacatttaccacatttatcttttctgccatcagcaaagataagctggttggaaatgtgagagaaggcaattctttatttttcttctacggtttatacaacagagtgcatatatgtattacacaacattcacacaatgcctaatgtttctaggcttatctcaagctagtcttgctgcaaacagtttgaacataagaatgagagttctttttgtagagagagaacatggcaagtggaagcagacaggttttatatcataaaatatttgaaacttggttcctccatttattttggtcaagttacataaatctctaagcttcaatttttttcatctctcaaataggaatactaatatatttttttcaaacttgtgcaaattaaccaatataatgcatataatgaccttggtctacagcataggctgaaaaaacacagccatgtgttgcttagtgatgaagatactttctgagaagtgtatcattaggtgatttcttccttgtgcaaacatcagagtgtacttacacaatcccagatggtatggtctactacacacctaggctatatattacagcctattgctcctaggctataaacctatacagcatgtgactgtgcagaatactgtaggcaactgtaacacaatagtatctgtgtatctcatatctaggctgggttcagtggttctgtgtgtaattccagcactttgggaggcctaggtgggaggaatgcttgagcccaggagttccagacaagcctgggtaacatagggggaccctgagtttaaaaagtttttcaagtgcctgtagtctcagctacttgggaagctgtggtgggaggatcacttgagcctgggaggttgaggctgcagtgagtcatgactgccactgcactccagcctcagtgacagagtgagaccctgttcaaaacaaacaaaccacaaaacaaaaataaaaaaaatttaaatatctaaatatagaaaaggtacaaatatgacactataatcttatggagccaccatcatataagcaatttgttgctgacagaaaccttgttatgcagcataccactgtatgatcttctccatgccactttggcctggtgcgattccatggacccctagggaatttgataaacattaatcgatcaaacaaaattttgtagaaaaaactcatgcaaatgaagatttttaaaagaatgttcttcttcatatgtttctattcaattaccggggaaagacagcatccaaacaacagagaatcagaacactgctgttcacatgtaatgatttgaattaattagagctgagttctgcagggctaaaaatggctccttaaaagcatagttaaataatcccctaaatacacaagaaacctattaagtataaaacttatctttaaaatataatatggtaaatcctcccagaggcataacttagtcccctaaaccagacacatcaggtgggcacatgccaattctttcatagcacgaggatatcatttattaaattaccactttaatagggccctagtggccctagaactaatgctccttataaaggtttaagttagaatgagggggaagatttgctcacctgatcctttatgcataattaccactaactgcacaaatctggcttgtatttattccattaagtacctccaatgatgtcattttgtctgcaccccaaatctgagatgtactttctgtctaggcatagaaaggttcctgtatgttacagttcagttcagaattttaattaaataaaatgagaaacaattgaaaaacaaggcatctacaatctttacataataagtaagcactggtatccttgctttacatgataaatgatgacaaaggacagggtagtatcattatccagtttggcaacaactatgaaaaaaaagaactttccgatttctgtctttaaaattttatttaaaaagtgaaatacggcaaaagatgattactcttgggtattacaaatcatctcccagctaggaagagagttctgtttggagagctggccagggcaaatcgatttgttctttccctgaatcactattagggtgcagtcactttttattcgacttaggtttcttctgtgcaaggatgaaataaaatgcttttgcatcctggagtttaaaacacttaaaacacagtattaggtaccatccacttctggtcagaaggtccacttggaaatcatgtttgaagacacatcagcattaatgctattttaaagcattcactgatcttttcattcttgacatttcagcagtattacaggaatcttccacttggctttgaatacaccatgtggttctggcttcccacctgcctcactgaccacaccttctcaacctctgttggtgcctccttccctttctcctcttcctttttcagacctataaataagtatatgccctaggattcagcccccttcttttatttatgccccttctttccttgctatcacatctacttccatgcctttaaatgctaaaagctctcatgtttatatctgcagccatgacctccccactgaactccagactcaggacatacagccgtctatctggcatctctgcttgaacatctaaaaggcattttaatcttaacatgtcccaaacagaactattgatttcccaacagccctcccccacaccatagcatcctcatctcatcagataatcacaccaaaaacatctggatcctctcttgcccttacattctgccctaagcccatatgcaagttctgtatgctcttccttagaatgtattgcaaatccattccttctcaccacttacactgttaccaccctggtcgatgccaccatcacctcttgcctgcaccattcgagacaacccctgaaacttatctatctactatgcatgcatgactgctgaagttaccttttaaaaattaaagaaaatcacagtacttcccagcttaaagttccccaggggcttccattatacttagaataatatccagatacctgaccatggtctacaaggccgtctgtaatccgaccccaacccatcatcttcaccttgtcttgtatctttctcctcttcattcactgctttcctcccactccttcaacgtgtcaagctcattctcaccttagaactttgactaaaccttgctactccttctgcctggaatattattcccttatgccttggcatgaccagcctcttctcaattattctaatcttacttaaatgttatctcttaaccttgatcatccttttccaagctgcttctcctttcccaagttcctatccattaacttattttcttctcaacacttagaactatctgaaatgtctatgtatttacctgtttaatgtctgtctcccttactagagtataaactccataagagcaggagtcttgtatattgtctatgtgtcttggcacatagttgatattcagtaagtattggctgaatattttgaatgcatttctaacctgcatacacatataatgatgtacagaaatcctataaaataagccaaacaagtaagatcctttatagtaatttaaataataaaatcatgttttttgtcatagagttcaaggactgggaagggtcttagaagttatagtgcaaccctcttttttacaatgttctgacgctcagaggaggggagccactagcagttcacaaagcaagagagaggtggagtcaggctgaccagatccccactgcagcttcaagtagagctggctgctccttatcgtatattatacctgggtggctgttagaactcactgattatacagtacaaagtaactccatttcagcaccaaagtgtatatccactctacatagcaagtaaaaataggactttgaatcataaatttcatctaccttaaatgaatacactagtgttcctaataaatggcaaacttttaaaaaaattttatttttaatttttgaaacggagtttcactcttgtcacccacactggagtatgcagtggtgtgatctcagttcattgcaactttcgcctcctgggttcaagcgattctcctgcctcagcctcccgagtagctgggattacaggtatccaccatcatgcccagctaatttttgtatttttagtagaggcagggtttcaccatgttggccaggttggtctcgaactccttacctcaggtgatccacccgcctcagcctcccaaagtgctgggattacaggcatgagccactgcatctggccttaaatggcaaactttgaattaaccacgatgcctgcattcaaacgtagaaggcctttttggggacaattaaatgatacatatctcttaaaaatatattcaggaaagttttaactgatgcttacagtttctcttcataaacatccctaaatatcacttccagagaatctgtatagctgtgtcttattatctgaatggctttaactaagggatataatgatgtacataatgcagcccccttgagtacctagggcattcctgaaaatcaagagaggcctgggccacaataaatttttgggattcttggtattcttttttttaaataaaaaaatactgaaatggtgttactaaaatgacaaaataactaaaacatttgtatttaacaaattaacatgttaaccccaaaaacagtattttataattataggctgtttaaaaaatgcttagtcttagtgcactagagcctctgtgatctactgcaggaacacatattatacaattgtactcctcatacttctgtgagtctctgtgacatgtgcatgcaaataatggtaacagtctaagtttgaggcttttgaaggggagacctggtcaagtggccctcaacactcatgacaggccttatgtatctctttgtttttgttttttacctccatccagctgcaagcaagcagtgtggggagaggatggtgggggatggggagatcttagcctccaaaagccagcaaaaactaagtatacaaaaggtgagggagggacagaaccttctcagtctcagaactttaaagccaacctaagcaaaaccaactgataactgatgggacctccttcatcttctctgagcactgcctctctgttcctcagggaaaaccaagtagctgtttgagattcacagtgactgtggcttagcccagaacaaggaccacctgctgtgaccacagccaaatcctgacatgcatcttccagatgtgaacggaaaccaaatcaaaatacccatctactagaataaatcacaagggcctcgggcgtgcagatgcatgctctgaaaggtctatctgttcctgagagggaaggcacaggagaaaggaaacaaaggttgtttccctaagagttagggagcaacttgacaagcaacagacgttttgtgtgtgtgtgtgtgtgtgtgtgtgtgtgtgtgtgtgtgtctgcacgtgtgtagatgggggaggtgaagagagttataactgtaggtccctttccatttcagaaaataacctctgtgttgggaccaagagacaactttgctttaattattcaaaaagaatccatctcaggtctgcctgtttcctccacacagccaacaagaaaaaaaaaaaaaaaaaaaaagatgcttgcaagttactgcaatggtggtcttattagtcttctttagtgacattatccatctaataggctttagttcttaattgtttttacaagaatgatgtttaatcaaagctaatgatatcagcgaacttgaatcaccacatgaactaatttagcaatatgaatgcttcatcacattctctctttatttctctcaatattaattagaaccactttccaaagaaagtggaagttccagggatgatctgaatatcccactttactacccacagtggacatattccaagagtctggccacagagagactggctttgattagagctcagtttttaagatattccaaatctgggatattaacttattcttgattttaacacatcataaccaaaaaacattataaaatgggcttatgttattaacagaaattcacagaaaaagaaatactactggctcatgaaagaaaagatgttcaacttcactcataagaaatgcatattaaagccacaggaaatataatctttttcacttcttagattagcaaaaacttgcaagttgatcaacatacatgcttttcaggctgtggggaaacttactctcatacatttcaggtgggaatatgatctgatataacctttaaagaggacaacttggcagtatttatcaacattatacatgcatataccatttgacccagaattctactactgtgatttatcttacagatatgtcttcccatgtacataataaatatattcgttatagcaatttcataataacacaatatttgaaatagctcaaaacttcaaacagactggaaacaactcaaatgtttctaaataaagaattggctaaatagagtagtacaacaacaagaaatcagtaggtgtagtgacaggcacctgttgtgccaacatgcaaagatctccaagatatattttcagtggaagcagcgaagtgcagagcagtgtgcatatgctatattttgttttaaaaacagaaaattacgaatataaatttatagttgcttctatttgcataaagaacatctggaagaattctaagaaaccaataaaagtggttttcattttgtgtacgaagtagaaactggctggtgggggatatggaggagagtgaatcttttcaccatatatcttctcatatgttttgagctttgaatcataaggctgtactagaaactacctgctttgaatctatctattaaaaaaaagtaaaaataaagcatgattgattaggatgtcataatttctgaattttccaaaaacatattgcatatatattactgaatatacttaaaatatcttttgcaactttctttgccaacaaagtctagtaaatataaaaagattaacattgaaagacattttattaatacatgtgcataatgaaatgtttatttatcaatatccactaatgcatgttgtgaatgaactttccttcacttcatacttgtaaaacaattaggaattaaagcttattggatggagactgctgaaaaaaggcaagcaccatcatcatctatagtaaaaacaaaaaatgagatgttcagtagctatcacgtcatcttggtaggataaataaagaatatatttatttatcgtaggttttgaatactgagaaattcgaactcgtattattctgtttcaaaaaaggatgttcaggcagatatgaaccgaagcaaatactcagataaaagtgtaaacaacgtttccttcaagctttgttgttgttgttacagttgtttgaggtcttctttgtgcaattaaaaatgaaagaaagaacccaaggaatgaagatcaagataagacaaaataagataaactagaacatatacattaaagtcaaagtaaaccctgtgaatagagaaatagtttgggatccatagggtgagcagcaagcagcactaaaatatgagtgctatttctcttttaaaacagagtacaaagcctataaaaggtacttttggatgggcacattatgttcataattcataattttaaaatgacccatgagaaccaggtactagaccatagggcctaatgagtattctagagtagaaaaaatgaacataaggaaagagagccattacgggtagatttccttgccctccacaaatcaaccacacttagggactattttctttcctcttagtggcacctttgacaaaaatagcagcccacaaaatttgcactaaaggcccacttcaaaaattagagcagtaaggttccagtgttgccatgtgccagaagtaaaagaaaaaagggccatacatgaacatggaaataaaatcaatgagggttacacaatggccaatttattaaactttttaatttttatctgctttgtgcaagaaaaccaaaaggaggaaataaaaagatttgagggcaattatgaagcaaaaaccttctaaaagtggttgcaaaaaacagatgactagatattatccatctaattttattgtccagtgaaagagcaacatccaaaggaaattctgcatgtacagagggttaaaaagggtaagattttaaaataccagttactattatattgtttttaattgttaaaggggaagtaaaagtaattgatcctttggggttgaacttactgcctcttaaaaacctctagtagcaacaactcttctttagaaaacatttcataatttcagtgagactttacatccattacttcatttgatgagtcgctatcatccatataatacagataatatatggagatcaaagctcagaggcattaagctacctgctcaagtttacataggtagaaagtagtggagcagagattcaaactcagttcatgacttcacaaattgtgtgctccacacatcctgaagaatatgaatatgtgcaagtaacggtaccctggcagtcttagattaaaatgagtcattcaattcctctcaagagtgactagctagggcctaaaggtattttgatgatttctgccaatgatctgctgagggagctctcaaaattaggttcaatgttagttatgaagacacatggatgcaatgccaccatccaggacctttgattccctgtacccaaaaggacaatataattttcagccatgagtggagcaatgaattgattttcctttgattcacattcctgagtaggctgctttagaaccatgggaaagcttccactctcaccttctggacattctacttcattatcaggctgatgttaacaataagagatgttcaaagaacaataaacatggctaagaagctggtgggattgattttacactccaggtaatagctctctgaggatactgtgcctttacaaagctgctgatcagtgcattctttctctttctttttcttttttttctttttctttatttctccttcctgccttccttccttccttttctccctctcgctctctttctcttcttatgacactcttcccacccctcacccccccaacccctcccccccagacttttaatggccaggggaggagggggaagagtggtgcataagctgcttcttcctcatcataaattaagggttggttgtagaaattcttttgaagactggaggctgcagcatgatgattcacttttcctgcccaaacttccctaattcactcaggtttagactcttccaaatcccagaggcaaaagataatgaataaattaagttttcagaaattactgtatttagaaaagttttaacatatttttggaaaagcattttataaattgcaaagcagagcgatttcatttacattttttatattatggtaaaatagacataacacaaattgttcattttaacaatttttaagtatacagttcaacaacattaagtacattcacagtgttgtgcacccatcacccctattatcttcagaacttttttttatcatcccaaactgaaactttgtactaattaaacaataacttcccattgtccccccacagttcctggtaacctctattctactttctgtctctatgaatttgcctattctaggcaactcacatagggcagtgacataatgtgtgtccttttgtatctggccttttcacttagcataatgtcttccaagtgtatccacatttcaagatgtatcaaactgcattaccttttattgctgaataatattcccttgtatgtatacattttgtttattcatctgttgatggacatttggctcgtgtccaccttttggctattgtgaataatgctgctctgaacagtgaggtacaagtatctgtttgagtccctgctttcaattctttggggtatatatgtaggcgtggaattgtggatcatatgttaattctatgtttaagtttttgaggaatccccaaactgttttccacagcagctacactattttatattccctctagtaatgcaaaagggttacagtttctccacattcctgctaatacttgctattttctgttttttaatagccatcctaatggatataaagtgctatcttactatggttttgatttgcatctccctaatgtctagtattgctgagtatcttttcttgtgcttatggcccatttgtgtatcttctttcgacaaaggtcttttccagtcctttgcccatctttgagttaggttgtttgtttttgcttttgctgttgagttgtaaaattctttatatattttggatattctttgtcagatatatgatctgcaaatattttctcccattccatgggttgccttttcattctgtcaataatgtactttgatgtacaaaaggttttaatttggagaagtccagtttatccttttttttcttctggtggctgtgcttttggtgtcatatccaagaaatcactgtactgattccactttgattaacctataatacaattaatttctaagcagaacccttgagttatgctacaagtcacttttgccccaaataaattccaaacaaatacaatgtgatggaggagggagaggaagtggggatgggtaatgggtacaaaaatatagatagaatgaataagatctaataagatctagtatttgatagcacaacagggtggctacagtcaacaataatttattgtgcatttaaaaataaggaaatatatttggattgtttgcaacacaaaaaaagataattgagatgctggataccccatttaccctaatgtaattattatacatgatatacctgtattaaaacatctcatataccccatgaatacatactatgtacccattaaaaccaaaaaatatatatacaatgtgagaggctaaagagcaagcatgccaggcaactgaatactgtttccaattgatcttaaggtccagacaacatggcacatggttttctctgttacctggtccctgcctacttttttagtttcatttcccccttgccatctaacttcaatgatctggaattctctgtctctaaaatactcttcattttccctatacctgccttactcatactcatccttctagtctcaacccagtcatcccctctttcgggatgtttcacatgatctgttcctatttccacctactattcatgcagtgaaagggttgatgtgctagtttgagctcctgcggcaccccatatgttgtttactacaagatttactatacagaattactgtttacttagctgtctccccctctatattatgaattccatgaggacattgagcatgattttagtttatttttattactatatcctcagtatctagaatacttcctgatgaacagtagatgctcagtaggtaactgccgaatgaatgaatgaatgaaccagactaatagccttgccaaaagttttctgtttctagaagtagttacaagaaatattttcatggagaggcataacatttagagatatagcctaagtctctctgcttttcttaataatttatcttcaatgaactttatttcataaatctttaatcaaagtagtgtcataagcactttataagtattaattcatttaaacttcacaataacttgataaggcattcttatctgcagtattcaggaaatgaaacagaagcacagagacgttaagtagcttgcccattgtcacatagctgctaactgggattgggcctacttaaagttgatcagtctgtatcatctcttggtatgatgagttccaactaaatgggaaacaatatatacttgaacatttcagtcttacaaggatggtcaagttcatggaatttataatttttctaaacttggctcacatcaccctcagatttatggtctagttttcctcctggaagccccaagtttcctaactggggctcacataccagtcatcccttccctctttctgtttcttctcagaacctgagtcacttcctcatttcttctgtaggctcagctgctggaagcactgggcatttcaagtgcaagtggaccatatttattttcaggattaaagacatttcctatttggtttttgatgtctctttggtttcaatttgatcaatgtactcaaacaactacttaaaatgaccataggacattttagctggtcgtagctccacataacattttataggaatatatgaattttttcttttaaatttattatcttttggtttccttcaataaaaccaatcttcagctacactattattattattgcagggaagcattttttgaaacacagctcctttataattaattcattcatttgttcatatatttattcagtaatttcagggtgcaacgcactgtgctagatgatggaaatacaattttatcctctaggagtcagtatctttcccacctaaacagatttctacaataagatagaagttaaacattcctctgattttgaatatttaaaaaccttgtaagaaaatgcattatttcaattggttcctctgtttccatatgcatgtttgccctctcaaaggtctagattatgttgcacagagatcagcaccattaatttggtttgaataattaaacaaaatgtcttattttggaaagtgcaaaaatatgtaacaagatgatttacaatttcacgtcaaaatgtgtaataggttgctatgattgtgattaatccctaaagagagaaaaaaattagaagtaaagtaacattttaaagtaaaatagatacattagaaattcatgattggatagattacaaaatgtctcttgcctctgaataataaatataatttattgattctctctgaatgcattagagaaataaagcatgtaaaacaatcatttaggctaagtacatacagcaaagaattgaaattatcctctgcagcaagtactaggctgatggataatagcatatacattcattttcatacctcttaccccttttaaatatatctctaaggaaagacagtggttatttgactttctccatgtgaaatttcccatgcagtgtagcacatctgtaaaagatgtgtgaaaagtacatttttctatcaggattttcattcatagttaattatttcatttagcacgagcaacatttccaatttaacttgttccagagactgtaatatttacagctaatttccagcaaaacatttagaaatggctcaaagtaaaaattcattactgggttttgccatgttttaaaacgtcaaatgcaaatgaaaatcaaggcaagactatactttacttttagatcatgtatttcagttcctttttttttttttaaataggtttggtgtaggtggtaagcttgtaatgtcattctttatttaaaacacaaggcagaaaggtctcaggaaggaagagacatatgttattatctgtcatgaccttatacttatgaatctggggacagatttggagaaaggtcttcaagtgaccagatgggctgccatgttatttaagttgcatatattataatagcttcattttgttcttaaccaatgtaactcgcatcttatcatttacattattgtcttgcttccattatggatggtatacattatgttttccccaaactgaactgactccttgatctgggttatgcatcctacttgcatacagacatattttcacatacgtactttcccatatgaatagatgaccagtagatcttataacacatttttctgagaatttacagtgctttaagttacatcaatttttaaagggactcaataaagtaataaaatttacacatttatattgaaatacagtcatttatactattatatgaaaaaccatagtgagtataagtgattttttattgtaattgctttctgacagtaggtataaaatgaagaaattcaaaatgatggaattacccttgaaatttgagccaacataagcagttttaaagtgttaagagtttaatgagaaacatcactgaggtggaaaaattatgcaaacgtaaattttaaatggagcttccaaaaaggaataattttaagatagtctagcaaatgtaaggggttgctattccttagatgagaagtttgataaaaatataaatagaataaagagtatatagagacatttgcaagtgtctcccatgtagcatttaataaaatatttattttatacctactaagaatttcgggtactgagagttccagagtgggagagaggaagcactatcagaaagagaatgactctctgtggatgtgacatgggctgacacttaaatgagaagaaggaaccagcccacttctggaggggagattctctaggcagagggaagaacaagcttatcagtctcaaaaacacaaaacagtttatttatctttcactttgggaggccgacgtgggcagatcaactgagctcaggagttggggaccagtctgggcaacttggtgaaacccccatctctatcaaaaatacaaaaaacaaacaaaaacaattggctagctatagtggcgtgcacctgtgctcccagctacttgggaggctgaggtgggtgaattgcttgagcatgggaagcagaggttgcagtgagctgagaccgcaccactgcactccagcctgggagacagagtaagaccccatctccaaaaaaaaaaaagtatatttacttttaaaaccaaatgctaaaagagtcaaacaaaagttcaattaaaaatcaatatatttataactaaagtacatattatcttctgaatataaatactacgtgtgcacaacaaatagtatagtatttctctagagaaaactgaggaaacatttcttaaatgtcttgaatataaaccacccatagctaggagtatctggataacctatattctgaaagcatttgcttagtttgccctgataaatgtgctctgtccttactttctcttggcttctctttctgctggtgtcttatgttctgttcccatccccagtaagctggggaaggtgagaaggccttactgtctcaattaaaaggaggtatagtcagcgtcaccactcctcatttcacagttctggacacgagcatagaatcctgatgagaaacagtcctgcttctttctgtagaaatgactctgcaggtgtcaagaagaaagggctctgagtcaggacaaacgagaacttggcactgatgctattttgccaggattcatgctctcatgctctctgaccatccctgcatggtccaagtaattcatttccatggacattaagctccaaatgtcattgtacactgtgccttcccattttctaaccacaggtgcttacagattaggctcttgcttaacctgccactggctgctgggccatcatctgccctacaaagcattatgacagctgtactcattcctttgatgaagaatacttagatgttctttctcatcagtcaaggtagctcacactcactttacaaatactatattactattggctcttcatcagatgatttctttgtggtagattccggtgcctatccttaagatgtttctgtactgctaaggagactgcaatcctgaaattcaacacaacaaccaagtctaccaaatctctggcaggactaccaaacagactcctaattgatttccctgattcttcttcatttcatcagagctcagtacacaaaacaaagtgaaaatatcagttcactttctcattcactcattaattcagcaaatatccacagtatgtattgaatattttccatgtgtcaagtatatgtctgacaagtgtcaaagctgactgtagcagttctcacagtgtagttggggagggtgagtaagttactgtagtggacgagtaatattcttgtctaattagcatccatttctcccttttcttctaatagtatctggatttatctgaggatacgtctttccccaagtcagccccatgccatttgagtggagctgattttccctgcagatttgaagaaggggttgcagagacctagttctagtcaatcagaacactggatcccctgggtgtagtgactggttcagagtcggggagtcattccctcagacatagcaggactcgacttgaggccctttgttggaaattttacaaaggaagaaaatctccttctgctagtcttggagctgggattgtgtaagggctccctggggagaagcctgcctgcctgggaatgagggtgagagggagggagagcctgagagggctggagagcaggagtgtgaggaggaggctaggggagaaagggagaaaggaaagagatttgtttgtgaattccaatacttgatcatttagatctagttgtgcccagagctgtaaggacgatgacagaagcactaacaaaccacaaaataagcatcgaggagaaatcccccaactctgcttggagcagctggggaaagccatagccacctggcacctgcccatccttcactattcttcaaatgtcatctcttcagagcaggctttctctagatcccttatttgttctaaatagattgtgagctcacagataccagagaacatggcttggtaattttatatctctagagctcatcactgtgcctgttagagggaatatacattatgccttcaataaaaattccttgagttcccctgtgtacctaggcctccagtgaaagcaggggtctgaacaggaccctaacactgccctgctttcaagggatttcccgtactaacatgtacaaggaaccagccttcagcaggaaatctaaactagcttgttccttttctcattttccctcctcctctcctgcttcctccagcccttttagtcctgttaacccctcatcagagtttaatacaaacatcaccatgccacttctctgaaagctttgccaatttaggcctagttttccttgttgtgtattcgcaaaatttcttgtaattttccttcatataaatcagggcacctctccaccaggggtgaatttgctcctttcctgagattatgtgacaacatctggagatatttttgattgtcacaactggggaagaggttgctgttggcacctagtggttagaggccggggacgctgctaaacacccagcaatgcccagaacagctcccacagcaaagaatgatccggcccaaaatgtcaatagggctgaagttaagcaccccttatataaataatcacagtttagagttaggcatctattttttaccccaccaaactatgaattccaaaagggcagggactaagtctgttttgcaccattgtacttccacacactcacaagtagtagctactcaacaatcatttttaaatgctatcattaaaggaatgttaaatctattctctgaaacacaatacaccattcaggtaatttttccttctttattgcaagtatgcatattagcatgcaaaatttaattctctgttttcatttatcatattctagaaacaaaagttctgaattgtatggctggattttggtgtaattgaggaggctctattccacaagaaaatatttgttttagtacattaggatattcttgggaagttgacaagacatattaaaatgaatgagcctggctggagcagtccctcacactttgcagcacatagtgctgacaagccttaacgacacaaatggcatgaagcctaacacatgtgatgaccagcatttcacagagttatcagagtggcactgtcatgttcctgaagcaaaaggtgatacaagctcctatacttcatctccgctccctaataacaataagcttggattccactgagccatgtcttcgatgactggtagttctaaagcctctaattataatcttgagtcgtaatatttgctttaaagctttaactcaagtgaacattcaaatgtaatttttccacagaagtcaatttctggaagggacacaatgtaaaaacacagggaaaagaacgtggttaattattaaaccaaatctgaaacaatgtactaaaataacacttaaaagcatgttacaaaccacactggacctactttcatccagaaatgtttgctttctccatgagggagtgaattctttaaatatacatagagccttcatttgaaagaatactaacccattcatctattacattcccatgttgaaattttgtgtgagaaaatatgtcaagattctagtttcatatagcttaattttaccttaaaaagacccacaagccagttttggttcttgttgtttttcctgaaagtctttgaatctcgggtttttactctattaagtataggccagggcttgggggcctttacacactttttttttaaataataaattttgcagctacaatatccaaggctctttctactaggtattgaagagaatataaaaaaattcagagctgggtgtggtggctcacacctgtaatcccagcactttgggaggctgagacaggcagatcactggaggccaggagtttgaggccagcctgggcaacatggtgaaaccctgtctctactaaaaatacaaaattatctgggcatggtggtgcatacctgtaatcccaggtacttaggaggctgaggcacgagactccttgaacctgggaggcagaggttgaaccaggatcaagccaccacactccagcccgggcaacagagcgagactctgtgtcaaggaaaaaaaaaaaaatcagaatccctgtcctcaaatcccaactctcagtctctctggatgtggactttttcctctggtctcttccctcaaggggcttaagttcttatggggcaaaaaacatggactttagagcttgatttgtataaaaatttttttgagtgaaagaatgaatcgcatttgccaggtgagaaaagtaagtcttggagaagttagttgaaaacagtttaaaatggagtctatcttcctgggtgtcttaaaggccatacattcaaaagttagctgtgctatcattatgagactgtctatgagggcatggacatgagggcagtgagcagagactcagagtggttcagttactctcttatgaatcaaagcaatagtctgcttctgcatcttatcacattttcagtgcaataaaagatgttttcaaataggtgaaagcctctattgaagaactgtctattcttaggattttactgagattacattgtagagaagaaatagccagaaagcatttctgcaaaactaaatctccacgtttgttggctatatttattgggataattttagtaataatagatgagaaaaataaaactttttttttttggagacagaatttcactcttatcccccaggctggagtgcagtggcatgatctccactcactgcaacctccgcctcccaggttcaaacgattctcctgcctcagccaaccaagagtagctgggattacaggtgcctgccaccatgcccggctaatttttgtatttatagtagagaaggggtttcaccatgttggccaggctggtcttgaactcctgacctcaagtgatctgcctgtcttggcctcccaaagtgctaggattacaggcatgagccatcgcgcctggctaaaactttctattactccaatgacagtaagcaaatcaggaaagctaatattttcttgggcatgggcttgattgaaaaaaaccgctgaagctggcgttatttcttattgatttttgtttcccacagagcatcttgtacattataggcacttgataaatatttgttcattggctctgcttactgctctgataaaagagatcttaaaggtgatattcaaatagaacatgaaaacctactaacaaaacaatactatctatacctaactgtttcattgagtataatagcactactaaagtcatatagagtgtacccattttcattgctgccattttcctccatttagcaagcattaagaagatgcgagatttctctctttctctctctctctttttaatacgatgcccatctactgtcatcatctgactttctgtgtaacaaagggaaaaagacaagtgatactatgcttattattatgggagactgatgacaaattacagcatagtggtcctaccatgtgagtcagttgatatagaaatttctatctaagcagaggattgtcacaaggtgagtattttaacgtgacagaactagagcagaacatgtaacactgaatatgtgccaaggactggctgcatattttatatgcattattttatttaagtatcgtataaccctatgaggtaggtatttcttcctacacaagctcataatggaaaataacatatgtgggactgtgaaggggaggtgagaatactgagaggatctcaggagcctgtctcctaccagggcttccaaggtggcattcagctccttggttattttaccatggttctcatctttgggcctctcccttgtaggtgtagaaacttgcattatcagcaagtcaagagtggccccatttctcagaagtaagaaatgcatcaccaaaccaaggggactggagtataatgagactggtggaagtatagtaagacatttgttgtcacaggtatagaacacttgctataaacagaactgcatgggagaaaaaataaaaccagaaggtcacaaggcaagtagggaatggaaacaaaataagctttatctaaagagaaggcaaagccattgtaattggagcccttggagctctcagcaacaacccctctctatctttacatcagggatgatctagttattgggcttggaacacttgaagaccactagctgaggtaccctctcttccctggatggtgccaatgtttccttctgccatcctcctttttcccatgcttccttccccaaaaaggaaggtttcttccctttttccagtgagaaccaaattccattctaatgaacactttccttatcgatttgtatagacacatttggtcaggtcacattcaggtcttgctttataaaattctttggtctcatgttgaggaaatggttcttaatctctttggggtcataaactcttttaagaatgtattgaaatacaaagacatataaattaaaatacatacaattttgagggatttcaagattcttagaaactcatactggaatccaagttttaaaaccactgcttaagaaaactgtgcataatcctgctcttatccattaatgtagtgataaggtgtatcagagtctatgagggacctataatccttatgaattgggattgattctattttataaagaagaaaattgaagctcagggtataagtgacttgcttaaggcccagtgagggcagaatacagaatatgtcagtctctgtagcagatataagaatatctgtaacttttttatttttttgagcagggtctctcactgttgccaaggctagagcgcagtgacacaatcttggctcactgaagccttgacctccagggctcaagtgatcctcccacttcagcctcccaagtagctggaactacatgtgtgtgccgctatgcccggctaatttttgtgtgtgtatgtgtatatatatatgtgtgtgtatatatatatatatgagtattttatatgtattatatataatatatataaaaatatattatatatatattatactataccatactacactatactatactatactatatatatatagtagagatggggttttgccatgttgcccaggctggtcttgaactcttgagctccagcaatcctcccacctcggcctcccaaagtgctgggattacaggcatgggctaatgcgcccagccaaatgtctgtaacttttaagatcactatttaaaaataaaactttcatcacaaattcaaaaaatccagaaagagaatgtggagagagagggaaatggcatttgtaacttttgagtacctgaagatggccacattttttttcttttagtcagtaaagacatggattaacttgccactatctgcattttacagaaaagtagaaatttcccgaggttaaataacttgcccagatttctttaactataagtgacagaactagaatttgaagtaggaaactaagaagttgtatttcataagctgtgctcttaccccctctgctatgtgacccctggccacagcctaagcaatttctggcttcactcatctctattggcaaggtcttaactgaagttgccaaaggcagtcaaataacatcctttaagcacacttgagagtgtgattgtgcaaaaacagtaaagcttcaagttcaaaagagtcagagtccaggataaccctcaggtggatgagaggcatatgattcatatcctttccttcagtttttcagagacataaaatggtttatgttcgacttcaagaatggtctatctttgcattttctttgtgtgttgtgttatacttcattaggcaacaaaggcttcttttcttctcctccaggtaataagtagtgatttatcacaatcacctgtcacatttaacttagcattcattccacgaaaagatttcccatacatttccaatgtgaaatttaaatgttaatgtccatagataaagaagtatagcagtatgtgttacattttttttcccactatgaaaaccattttcaggaatttagactgttaaataaccattccttttatgagactagctctaaaagatacatataaattttgaaatctatagtattacttggcaattttagtgctttactttttgcagccaatcatggaagacttgcttttatagctttctctgcagagtcatcttaattatagggaaatccctttacaaatggctttccatttacagtgcttcagctagaatctaaagttggttttattggaaatgataaaaaattactcttcctgagacacagagttaagaatcagaattggaaatgaactaagttcttttagctttagaaaaaaaatttaaattgatcatatattcttcccttctaaacagtttatcccaaagaggtttaacacagtaaaatctctttgactttcagacacttaagaaaatgtttcaaggcaaagaagtcatatagattatctaattcaatccacacatttaactgaatgtgagcttcacccaatttacagaactagtgatagagctgggactagaacccctgcctacggggtatcatttgtaccatttcagccacactctgcttccaatgttggactcttcttgtgctttctacataacccacatgggtgggagagatctctggacccaataacagaaatttattttagtctttctttatagcatctagacaacctggcatcatattatttgttcatttggctattgtttttctccttcaacaaatataaactccaggaggacaaataatctgtgacctctaatggtgtctggcacatagtaggagtcaataaataacttgttaaatggaatttcaaatttaaccttaaacattcttgtttaaaatacatagtttgggtcaggtgcagtggctcatgcctgtaattccagcactttgggaggctgaggtaggaagatggttgaggtcaggggttcaagacaaccctaggcaacatagcgagaccccatctttattaaaaaaaataaaaattagctgggcgtggcgatgcaggcttgtggtcctagctacttgcagggggtggctgaagcaagaggatcacttgagcccaggagttcaaggttacagcaaactgtgatcataccattgtactctagcctgggtgacagagtgagaccctgtctctaaaaaaaaaagaaaaaaagaaaaaagaaataaaatttatacgttacattttacttcctaaaatatccatgtttgctttgactggaattttaaataattaatatctgaatgtcttcagggaagaataattattcaacaagataaggaatcatcaaaagaaaacatcgtaaattccattatattaagggcttctactcaacaaaaagccaccataaagagattgtaaatatcagaaatcaagagaagaaaattgcaacacataaaagaaacaaaggattagtatccagaatacataaataacttctaaaaaccagtaaagaaaataaataccagttacccattaaaaatagtaaaagatataaacatatattttaaagaagagaaaacacaatcactaatggccagtaacgaccaataaaagtaagatcagctatttcacctctttagtaatcagggaaatgcaaactaaaaaccatggtaatatacccttagtctaatttaaagcaggaactcaaagagacatttgtacacccgtgttcataggagcattcttcacaacagcccgatggtggaagcaaccctactgtcgacagatggatgaatggataaacaaaatattctgtttacaaataatttacaatggaatattagccttaaaaaaggaagaaagtcttgtcacatgctataacataaactttgatgacattatgctaagtgaaataagcaaggcaaaaaggggcaaatactgtatggttccatttctatgaggcatccagagtagtcaaattcctagagactgaaagagaatggtggttaccaggggctgacaggagagggaacggggagttattgtttaataggtagagtttcagcttgagatgatgaaaaaaaggtctggaaatagattgtgttaacggttgtacaaccatatgaatgtacttaatgcctctgaactacgcacttaaatatggttaaaattgtaaagtttgttgtgaatgtttaccaacaaccacaatgagatatcattttatatccactagattgaaaacaaaaatctaacttctgacaatagcaagcatctgttaattgctatggaatgaattgtgtctcccatccaccctaaattcatatgttgaaccctaacctccccctaccttgaccatttcacaatatgactgcattggagatagggcctttaaggagctgattaaggttaaaatgaggtcttaagcatgaagccctgatccaacagagctggtgtctttataaaacagggggagacattagatctctgtgtgtgtgtgtgtgtgtgtgtgtgtgtgtgtgtgtgtctcactctctctctctctgtgccatgtgaggacatgaagagaaggtggccatctgcaaaccaggaaaagggccctcaccagaaaatcaaatcttgctgggaccttgatctcagactttccagcctccagaactgtgagaaaataaatttctgctgtctaagctgcccagtctatgacctattgttaggacagcctgagcaaactaagtaacagtggagcaacgggtgtcacatgctgctgatgggaggggacacagaacagtctggcctggtccagcacagctgcactggtgcaggcccataacccagccaggccgcttcatggtgtgcattccagggaacctagcgtgtgtgtaacataagacaagtagagggaagttaactggggcatcatttatattggcaaaatctggaaacaaccaaaatgtacactgatgggagagtagaaactgtataaaataaataaataaataaataataaaaaaagataaataagtttaaaaacacaggacaaccttatatttgggaagataaaggatgatgaaatctttgagggatatagaggggcttaacatggttaccaatattctgtattttaagctgggtgatgggcatgtgaatgtcttcttttgtcttcttttttaaaacatgtatgtccatctacatactacatactcttattttacacatctagtatacatagtaacaatttaaatgaataaaaatatgcaaacccaaaagcatatagcttaattttattaatcttggtccagaaatttttgttaataattttatatctctcctcttgttatttttgtatgtttttttttaaatttacagaagataaacagttaaagtaattaagctcgacttaaaaatttcaacttcttattttattcattcaaaatctgagcccgctgggagccaattttccataaagactgcagaatcctctactgatctcccaagtcctcctagtcttgctcagctccgttacacaattttccagcatatctgtctatcatatgataatgcaggagagagagaaatggaaggtcataaataaacagagtgtaaaacttcaagtttcagggcataactgggacagataactaagcaagcaaaattctgatataataaattacttgaactgcctgaaagagtcagctacataaatcacaattttactggaagtgctacaaaaatccatgctggctaccaaatgcactgtgaacactaaaaattcttttgtacgctgtcagccaagactccacatggtgtatgtaaagtctgagggccatttagatatatgccacaggcttctatacacaatgatcaagaacaactttccctctcagaatgagaacatagttgttcttatgaaagcagttatttttgttatggcttggggtgagagcgatggcaagttgttagaaagagtgagagtaaaaggttatgaatattgaaacccctaacaaataccatattttgcattttattccacaaattattttgagggttctgatgatgttacatataactgttttaggtgtactcacatttatcactttatttaatctgcaatatatacccttgataggtattacttctcccattttgtacattaaataaagagaaagaggttaaataacctgcccagggttacaatgtgagcaggtgagtgttaaaattcaaacctagttcttcttaatcaaaccccagtactttggccactgtactgtttcttactgccccacaaaatagttttttataatgacagacaaaatagttaacaagtcaagagctaatcagccaggctccttgattctttccctagtttaagcacttctcttacctttttggctatattcctactaattagtttttagtaagataaacaagaaataaaatacgaaatcaattttgtcaatttaggcccttctttaaaggtcagatcatcatgtctaaggtgagtgttgggatctcattctctctctctctcttttttttgtcttggtctcagctttacatcccatagctttacttgtaacacacacaaagtgcatatgatatagtgctggcctacagccagagttgtgaggtgacagtgcctgggtaaaaacccagggacaatactcaacagctctgtgcctttgggcattttacataagctccttgtgtttcagtttctttgtgaaatggggattagtttggctacgaggattaaacaatataatgtattaggttggtgcaaatctaattgcagtttaatagctaaagcatgtagtcaatcctggcatataacaagaggctaataaatggcattattattagtagcagatatacatatatacatatgtgtaaatattatatattttgtaatatatgcctaataaatgttaggtattcctattactattagtataccaccgttagtagggtactaatagtattactaatcacagagtatgctactactagcgaactgaagtgccatgtagggtgggaagaagtgagtactgaggcagaaaaggattagggagaccttctggaagaggctgagcttgagttatgtttcaaagggtaagcagaagttagctaaaggaagaagatgtgtgcattgggggagggcgttccaggaaagagggaatggcatttgtgaaagcacacagcatagaacagcacaatgtacaggctggatgggtgagggagaaaatcagggaccaattacagcaaagtgggaggagcagagatcaaatttaagtggattcattaaggattggatagcaagtggaaaatgactctttcaggtaggtgggttgtgaagagattaaatagttattccaggagttagaaagaaccacagaaaagaatgataaataatccagcataaaatgtccctttgaactatcattgcattcttagttttcaaatttttgaatcttctagttaaaagtctaaaatttcagagataaaagttgtaaaaaacatctgcttcaaatatcctcattgccatttttctattaaaaattaccacacatgaaaatgtgcaaaaactattctttcatgacacatatgagcaactggatgaatttagtacaagcacagttacactagtagaattaaaatagaagctgagacaagctctgaggaaacagaattaaacaacatcattctctatccatcctgaatgaccaacaaccccttgaacatatgctatgcctttccacatacccacacctctctctagaatgtccttcactcctttctttctggcctgatattttctacttggtcttcaaaattcagctgaagggtcacttctcctgaaagcctccaccaaccttccaaccagctttaggtgcttgttctcttggtcccaaagcatctcatgcatacttccatctcagctctttctacaccgtagtataattgttgctgttatgcttatttgaattactactaaactatgaagtttttgaagacagagatcatagttattcagaatagataccaggcctgactctatccctctaattccaagcacattacttagcacatattagttgctgaataaaaatatgcaatttgtcagttcaacatcagacaagcatagactgaaaaataaattggtcatccctagaataacaagatgtcttttaaacagattcctgatttctccatctcaaaactacaaatagattatatggcaaaatatcccagagatactcaagctagaagaaaagactcaaacgatgtctctcgaagttgattttgagagtgatgagaatgttctccttcttatgtccattaaaactcctttggtttccagatcagtctaccttcaaatcaacagttatgatttttcattcttgagaaagaagaacaactctcacatccacaaaataggccattatagcattactgggccattttctccacacacaagcataaaaaaactaagagagaattattcaaagaattaatgtttcaagcaaaagccattctgggttttgtcataatctttcaagggaattttctctctggttctcccaaagcatattttctgtacaaaggaaaatcacttgacttttaaagcaaaaacagacaaaatacatgtctggaagtagttcataaatcccactgggggaaaattccttatacaacaagaacagaacaacaacacagtgaatcagacaatgacaaaatccaacgcaagagtgccaataactttttttttccagaggatcccctaaatttctgcacaaatttctatgctagaggaggctgagtattaactatacatagtttagtcatatttttcctcattttagacaaacatggctttatctgacatgctgaggtagtaatcctttaggataatttgtcaatttatccattcacttaagtatgccaggctctgaggaaatggtagtaactgagacactgttgatgcctcacagaattcacagaaacagatgtctgcagtcaaatgtggtgagcacaaagatctgcacaggtgctaccactaaccaggggcaagggcagctaagccagccagtgggcgctttgacaaaaccatgtgggacatctgaggggagctttaagagatgagcctaaataagtcagattgggggaggaaggggtgggcctggatccctgaacacattcttatttagtttttaaatttttgaattttctaccctaaaagtctaaactttcagagataaaagttgtaaaatacacctgcttcacatatcctctttgccgtttttctataaaaattatcacacatgaaaatgagcaaaagctattctttcatgacacataggagcaactggatgaatttagtgcaagcacagttacactagtagaactaaaatgggagctgagacaagctctgaggaaatgttatttctttgagttaatacaagttaattcaaaagaaccctgagaattttgtaaagacctggaaggattcccaagggcattaattctgtgggtcacctctctctctcttaccttggccatgccttataaggatcgcagtgctaccatcacctagcattgttcagatcatgttcctactgaacatatgcgaagtagaaataagcatcaccttaaaagtgaaggacagagtaatagttttcataacagccatactgccaatagaaagggtatcctgaatggaaaaaataaagatcatagtgttgtagactgctttattcttcaacagaattgactgtgtgccctcagtgccaagttacaatgtgaattacaatgccaaacaagacacagagcttggacgaccttatcagtctcgtgggggagagaagccagtggacaggttcttacaatatagtgttaaatgccatcctaggggatgttacaggtgccaagagaaaacacaacaggaacaactaaaccagactttgcagggaggagggtggtgttgggaaagtgacatctaaatcaaggctggaaagaaaggtttacagaagaaaagggggatggagaggagagaactccagcaagagggaactccagctagaactccagcatgtgaaaggcagggaggcaccatgtgcctggtgcagtccatgggctagcagcagttcaggactgctagaaaggagtacagtggaaggggaaagagggtgcatgtgtgtgtgtgtgtggtagggcagagagagaaattgaagctagattgttaagtaagagccaggtcaccaatgagactatattaaagagtcggagccttatccccaggatgacggggagccatcatggtgtcttcagcacacaaatgacagaagcagattcctgctttaggaagaaccctatggatgccgggtggagaatgggttgaaagggatcagtcagggcccagaagggcagttaagaatctgatctaagtaatccaaagactaacatttgcaaattatgaacaatgattctaaaatccatttggaaggataaatgagtaagaataggcatacctccttcctaaccctctaccccatcccatctaagatattcaacttaagactaatgtaattaaaatacagtgataatagcacagaaataatgcagatgaatcaatggaacaaaaagtcaagaagcctaagtatatatgagaactcaggttattacaagggaggcaagtggaattgttttttaaaataaactaggctttgaccatatgtaataacaaaatatattctagacaaagatttaaatacgcaaaacaaagtaaaggcaattcataaaacaagacaagcagatgcaaaataaacacagataccaattattacccagcagattggcatggattaaagaagttcataatatccaggggcactgagattatggggaaataaggacccttctctactttggtaggagtgtttaaataggcatgtcctttctggaagacagtttaacaaaaggaaccaaaacttttaaaatgtgcgttgggtttcacccagaaaccctattcctagaaatgcatcctaaggaaataactagacagctacccaaacatgcatgtatcacagtggcaatagtaacattctgaataataaatatattagtgacaactaaaatgtcttgagacaatgaaatattatagaaccacttaatataaagatatcaaactattttaatgacatgaaatgatagtcacaaatatcagtacatgaataaacaaggttatagcatagtggggatagtacaattctgaaatacatatttgcctagaaaaaagggaaatttatatagaattattaatagtagttttctctggtgttagaattatgattggttttggtattattattattattttgaagcacagttttgctttgtcacccaggctcttagcttactgcagcctccacttccctggctcaagcgatcctcccacctcagcctcccagtagctgggattacaagtgtgcaccaccatgcccagctaatttttaaatgttttgtaaagataggttctcactatgttgcccaggctggtcttgaactcctgggctcaagcagtcctcctgcctcatccttccaaagtgctgggattacaggcatgagccactatgcctggcctggtttctgctttatccttacgtattttctgaaattgtcttgccatatgtattagtccattttcacactgctgataaagacataccagagactgggaagaaaaagatgtttaattggacttacggtcccatatggctggggaggccttagaatcatggtgggaggcgaaaggtacttcttacacggcagcggcaagagaaaatgaggaagatgtaaaagcagaaacccctgataaacccatcagatcttgtgagacttattctctaccaggagaacagtgtgggagaaactgcacccatgattcaaattatctcccaccaggtccctcccacaacacgtgataattatgggagtacaattcaagataagatttgggtggggacacagggccaaaccatatcaccaagagtacatattactctgatgatcagaaaaaacatatagtgttcatttttccttttgtgaagaactgccaagaataacattgatggtggagttaataacttgagagaaactacagaaagagcaattgcctgtatcacatttcaagtcattaacaagtgactgctccacagcctcttctctgtggattcaaaagaaaaactgatacagaaaaactttctaccaccaaacctcaaaagaagattgaaaatccttatcaggaaaaccagcagtattattgaataaattacaacatattttgcacttcaattgcacagataatgtagatactcatacaccactttcacactcaatccccatatcacatctctgcatttatcaaaccatgtcaaatattataatcagataacttagcataaagaaacatggctttatcttacgtaggactctgtctgacttgcaagaattctcatttactcatttaattctgtttttgcaattatgaaagaataaaaagctgtttcatctattttaattttgcatatcaagcacagcatacaatactatggtaaatgttttcataatagtctaaaatcagtagcaataaatgccaccttagttttgtaatgtataatttttcaatactcttgtttaaattagcatacagtctttaaaagaccatgtttagtggaagaacaggcatttttactggtagtaatagtatttctactaataaaaatgagttattattagaggaatttatttccccaatggctttatggtcaatcaaccacaaattcagattcacacccagttttagttttatcatggtatctttttcaacttctacaaataacaatttttaaatgaaaaatattgaaatactggaatgggctaattgaatttttctgccatctgcatagtatagagtttttaaattatggagcacatatagttcaatctccttatcttattgatgaggaaactaaagcccagagaaagtaagcagctcttctcatatctcaacagtcattaacagattggaaaacagaccttaggtcgcctgacctctattacagtgttttcttcactgcgctacagaaagtctgaggaccttatacatgcaacaatttacagaatgttctctcattcattgagctcccataataaccatgtggagtattactattattattctcattttacaaagggattaactttggcttggagaatttaagtgactttgtaacactttcagtcatgaagtccagtgctttagattccaaagccagagctttgccactcaaatcaatgctgggatgtgttttccggaattaactcccattaaaagcaatccattgctggaaaagttttggaagtataaaattaagtgtaaaattatataagaatcttataaaaagattcataaatttcaagataattattttccaagaaaaaaatcttttagagtatgcatcttctcaaagcatcagctttctatagataattaaaaattgaactcagagaataatgaaagcttaccactatttgacttagcaagaaattcaagaggactctgatccaggttaacctttgtatcaatatcaggaggctcatagtttaagtgaaaatcatcaatgtaagcgtctagggcttcggaggcagagaaatacagcttttctttatactgtatggagccatcagtattaaaggatatgctgttcagtattaaagttgctggaagataagattcagaagtgctaaactgatgtttcttaactgactctgccatggctttctcacaatgggccacaatgtccattcatctttcaagaaattctaaacacaaaaaaaggtacgttaagttttcagttaagtaggaatggataataatactcttggaatccttgctaatctttcatgtgtaattacttattaaaaatgaaattactctttatctccctttatgttttatgtatacttgactttcaagcaatgttcattgattgatagatgattagtttcattggcatgactgcaagtgtaaactgtgtttcagaaatatatttgggggaagggcgagagcggtggctcacggctgtaatcctagcgactggagaggccaaggcaggtggaacatttgaggtctggagttcgagaccagcctggccaacatggcaaaactccgtctctatgaaaaatacaaaaataagctggatgtggtggcgcgcacctgcagtcccagtgacttgggaggctgaagcaggagaattgcttaaacccggaacataagccttgctaggtgaccacataagagaggtactgctttccttcgttttcagttttacttgattaaacaagtgttctggaatcttgagatatttttatttgctacgttaaaagatggcagtcctccattatcacattctagttttcattcccttcacctgtccccaccccattgatgggataaggaaagtcacatataaattcaagatgaaagcaacagggggccctggcataatagtgatggcaaatagagaccaggtagcaagaagaggtgagtgctgaaaggagtagaattcaggcgagagggtgtcctctcatgtgatactctggctttggtacaggagttcagcagctgtagacctctctattctcaccttacatcaatcacttactctttgcaaaattataaaaggttgctacaattagtaccctcattttccagatgagaaaatggtggtacacacagattaagtaacttgtccaaagctgcagactagggaagcaacagccaggctgaactccagctgtggattctgagtctgaacttaaccattgtgctagactcccgccttatgagtgcagtaactgcccagatgacctgtaatcctctaaacgttcaccacaagttacatgcatcaatgtctgccaaaattgggtgccgaggttctgtggtttccaatatacttactcattggtatgtgtggggcgaaatgccattcatgtgacaataatatacacataagtaccaaagattaaatacttactttttcagccctttgaaatttaggtggacatgttgtattttcagaatgttacattatacgacatcataatacataaattttgcatctgtggaatatttttcagtttcctctaatatacacagaagcttttgagaatctgaagaaaactatgaatcaccttcccacaaaaatgcactttagcagacacagaggcaatgggttccaggattcctgaggcttgttcatggtcctcctgcatctgaattctagattaagaacttttgtctaaagaaattgacagaagtgaaaagaaaggaagagaaagaaggctaaccaggaaaagaaaaataagacccttattagggatggaacaaacaaatccaacatcacatattcttagagatatcatggtaaaaaatcttttgactttagaggccctgctcaaaaggtactttgtaaatcatgatcgtctttttcctcctccttctctggatttgtcagtatgaattaattactattacagatcagagatgatgggttttggaactaaagagacctgggttaaattcggtttatctttaccagctgtgtgccttaatcccctccctaacatatgattcctttattttaaattctgcttaataatctttagaccttgtagagtagctgcatctgtttgatttcctgctgctttgcactagcatagccatttcaggggtaagacattgaaatactttgaaaatagttgctaaaagctgcttccctccacccactcttcccccctccctccaccagtgccttcttgctaccgaggccctggcccacttcacctagaagccttcagacctgctcatgatccagcaacttaaggggcaccatctggctccacagatcccgctcctggcttgtggctcatgcccattctgcctggttggtgcctggccatatagattgttaaatgttttgaatatcatcccggaagggccgtggtatgcagtaagtgttagtgtttctcccttcctcatcctttagtgctttgcctttctctattctgcatatgtatcatgatttgaccaaatgatcacgagaatatggcttctcccttctctaagttccaacaaaataaggaatggatgggtatttgtagttcccagcttacggcagttgttcaataaatgtttgctgaactggacttcagccaaaatactccattcaccataaagcattccagtgtgactgatgcagttggtaaaaatgttctgaaagacggagtctgctgggtttattgacagctgctgagaagcaacaaaataggcaaatacagtaatgtattcgagtcaccaatttaatcagagaatggctgaatgcacagcgagcaagaagttgatgacagagtcggtgacattatcatgcatgttagtaatatttttgaggttcacttatggcaaatctttaacaccagactgtccagtatgcttccacagctcaaagtccaattttaactggagatttaaagacgttttctatatccacttagttgcatgaataacattgtaaaggaaagttgacaaatatttctaaaacaatctagaaaatcaatgtgtaagatacgccagtgatcctgataattgaacactatttataaacaagtttatttggtgactttcattttatcatgtacgtgggaaagtgcaaattcattctcttggtttttcaccgtataggctcacagggggttaagcaaagaagaaagtgaacattcttgtagtttaaaaagcaagaggaccatatgcaatagcttaaaaaaagaatctatatatttcttaactgtatatcaaataaaattgcagattgttcagatattttccctagcaatttcatgtttgaagttggtctggctcgattctcttgatagtatttttaaaaaagtattcatcctataaaatcctcagggtgcatgcatctaccaggaggcaacccacttcctgaagaatagacaatatttcaagtagagggactagagaaagccatcagctctgtatttgttatcaccttaggctaagtcaaactcagtcagataagctgagtccctcaagtctgggcagagaaaaaggtccagaaatttgtactaagttcagtttctccctctcattcaattcaattaaacacacaattattgactgacaatgtgcaaggaaccatgctgagcaccgtatagggatacaaagatgggctaggcattatttccctcacaaggagcttgtagcccagtaggaaagataaaagcagcacatgaatgtaacccaaggaaaggcatgctaaatgccatcgagcatccccaagagtggctgaaacacagaggagagggaaattacttctgtttgatggaaattggtaaagtttcattttagacagggtagttaaactaggacatgaaaaagacgtaggtttcggatacacggaaatgaggaaaatcgatatgtcaggaagaagaaacacagttgaagacattaaatagtaaaatcacacacatatggatgtaggaatatatcagatttccttgggctcctttccttctgtggaagagcaggctagaaattctatgttatgaaccaaagtggtgtgttttagggctagctattgtatctattttacagaaagggtaaaccgagccacagaaagtttttaaaggctctaggagaatgtgtctagcgagttatagagctcatattatttccactacaccacagtgtccactttgcctgtcgtgcccaacggcagctgaatgaagccagcaccgtctccactggccatttccttccaagtgcccaacggcgggtagctccacatccaagggagggcatcccactccacctgtgcagttctcagaaatctctacctcagtttaagccactgatagaagaatactcttaaaagtattcttaaaagatcttatgggcccaagtccatctatgccacctgtatctcaggctgcttgggggagacaagaagcaccatgacagatttatttcttaatcttgtgagctttttccaaagaacttggtaagcaaataaagtatgttttatgaaatagataccatcttaactattctcagtctgactcaagaaattataagcccttaaaaatcaagctgtgagtatgctatgttatggaatttgaattttagtagaatatagtcagtaagatgagttgcatagctttctggtagaaaagacctaatggaaatatgtcacacattatctcaatcactggacactgtgatcaagaataccttccttgagagataacttacacatgctggtcactatgattaactatcagcatttagaccattagctgatcttaatggtcacgaatgaggaatagaagaaaccagtgtttgaaatacatagagcataggactggccaaccctataatcttgagggttcaactcttccctcaaactactaccctactgcctcttgtttattcaacaaatctctattgtcaatgtagaaaggtaacacacagtagagtttaggagtctggctctgacaccacactgaccagcttcaaatctagcagcataaccttgggcaaactaattaacttctctctccctaaattgcttcatctccaaaatgagcatggtaaaaatatccaactcatagcactgctgtaaggactaaaagggttaatatgagtaaaatatttaagacaatatgtacatagtactactgtacacagttagtaattattattgcctgctatgacccagatgatgtgctagctcctcctagtagaacatttgtttcctatcatgatgcatatactttttggttttaggggattccagcctacctagtcaacaggtggtatagcaactctggaatattaagcaccaagaaaagaaacctagaatttcattccctgtatccatttatctccttaaatttacattccatagttgaagggattaccctaaagcaggatcaatatttggtttatttcacacactggaatcatctgtagagctcagaaaagcctgaggctggaggagaggcatcagcaaaatttaaactatttcccaaatcttaagctttgagagatactgtgttctgctctagggactgcttttctcccgatgtcatttagctttttccccagcattctcaatcctctttatttccaaatcagagaatactcatgattgttgttcttttaacgtggatatgagcacttgagcaaatgtagctgctgaaagactttaaaagattttattcactttaatacaccatggctaattggggaaaagagcaaacaagcacattaggattatatctgtaggcctataactgtttaccggcacactggcaacatgttaagtagaatgtgacaatactgggtaatgaggaaaaaaaattcatttgcttggggaaaatctctatggacctaactttgaggaggagggaggggagcatttactcatttttttctaaactaaatataatatcatccatcacttctaaatatttttttttaattaaggaaaaaaatactagaatgaagaagggaccaaacaggctgcccagatccatttcctaccataatgtacaccatattttgagagttttctcagtggaggttgtggcatctggaaatacttgtgagaaaaatttaaatactatgaagcaaagggggttctgaggagtatgttgaaatttaatggaagagaagtattctgccttttgggaaaggtgattcttcttaatgaaaaatcaaatgacttgaaacaaattcttatttcactacatctctaggcaaagtcctatagtagcagctatgggagtgaaatgggttggctgtgtccccacccaaatctcatctcaaaccgtaacccctataatccccacatgtcgagggagggacctcttaggaggtgattggatcatgggggtggtttcccccatgctattctcatgatagtgagtgagttctcatgagatctgatggttttacacatggcagtttcccctgggcttttctctctcacctgctgccatgtaagacatgcctgcttctccttctgccatgattgtaagtttcctgaggcctccccagccacacggaactgtgagtcaattaaacctctttcctttacaaattaccttgggtatttctttatagtagtgtgaaaatggactaatacagggagaaaacaagaaaacgtaggagatagtgctttgccttcatggagattctgatgctgtgggagagaagaaaaatgtgtttgaaagttagcagttggcactgggcaggtcatattagtctgctaatgactagagccaacaaatagaggtagacgctctgcacagcgggtgctagaaagcatttccctgctgatctgagtggccatgtccccatcactccaggtgcttttcctgctctgtgaccaaagctgatttcaataacaagaagtctggtctggccttttagaattcaataaaaagtttccactccagacactcttggacttccattagggcctgtgtatgccttgcatatggtggagagccagatgagggttatgaaacagactacagcttttcatccctagcttgtttgatctgtaaagtaagaatgccagttgctttacttgaaagactccagaggtagaaaagactatcttaaaagagtacaagagtaaagagtttaaattggttgttctgggataaattctatttgcttacaactagattttgtcagaaaagtcatggttgttccaggtgtgatggctttgttgctcttggtaagagttgaatccttggatttcttgatattgatttctagatctcaggctctccgtttctacatacaattttcactgaatttctaaacttaaaataaaaaaaaacctctttcctacaagtgttaatatttaatcagtctaattaccccatcataactttccaaatatctctttttaggtaaaataccaaattgttaaaaccagggcctttataaacattaggtgcccctgtaagctgaacagctcacatttttgcagaatattcaggcattttgaacttgccaacttatcccctggaagtatcacctagaatgagaactatttggtaaacagaatcagtgaacaatctcacacctctgtattagccattcctccacttcctaatctcatgtagtagaatagaagctttagcacagtattgccttatcttcagtttcttacatgcttaaatttggcagtttagcatttatgtcactgtgggaggatatcgaacccaagaaactgttgacgcacactagactaggaagaaactatttgctataagcatttggcagatgcactgtaaaccacacccaagataatcgactgcctgaaacatcaacacaattcagtggatacctccaatagactgctgcttatgcttaacacatagcaatgaaatttaaaacaaaatttagggggcatatctatactcaaaaacaagatttatacctctgtggaccaaactttgaactgaaatatacacaattgagtagagaccagaggtgtccagtcctactgggtcaggactggacagaggctgtgatgacctgatgttcacagcctcagagaacagagactaaaagcctttcacatgcaaaagtcaatgaattcaggatcactgcaggaaccagtggctgaggcagggcatccttgctacagaggctgaaaacgctgtggtcaccactcagcactgtgaccactgattgattggggtagagggaaagaacaaagctatcaggcaccaaacataggtgatagattgaaactttttcaacataggaatagaatccctagcagtgataagggagacaactacaaaaaatttggacaagaagaagtgatcttaaagaaaaaaaaatcacaaaatgactaaaaaaccaaattaaaccacactaaaactattcaagatgaacttgcaaagataaggtaaaataaagtatctaagtgaatacaacctgtgccaaaaacatgataaggaaaacaaatataggtcaagtcctacagaagagggttgtagagaggatttttggaaaggtaaaaaaggaaggaaaattttgtgaaaatgaaacaccatacgcaaaatcatggaagttgaatgtggaatgttgcttggtccctggttaagtatcagagcactaagaaaagaggagttaggagtagttggagagagaaatgtgctttataaattgacatggggccaaactatgctggtatgtaaataccaggaagagaagttgaacttgatttctaaataatggcagcaggacaaaggtgtgataagcaaggtggtagcatttactggaaggaggagaggagggctgtggggtcctcagatgtttggggaggtgatgagagttgttaagatatgacatgaggatgtctgcgccattatgtacaataaagatggaaagagatgttttaaaggtagaattcataaggaacagattgggttagccactggggataaacaagagggaaaatttaaatattgtaagtctgggaagctggtgccactaaagcaatggtgaaaattagaaaagacattcccctaggaataaagaaaaaaatctaatttagtcatgctgttttttacattcttattttattttcattacctctttaaagtattgtacgcaggaacatgaagaagacatgagatgtttaaacactcatcatcaagatttcacaaatgtatatcttttgttaaaattgtatcagatatttttaaagtaacaaaatgatccagatactactctggatcaacttctccaactcatatccctccacgttcccccaagaggcaaccactatccccaaatgggggttgttatcctcctgctgtgcacttttatgcttttcccacatttggatgttcttatacactattactttgtgtgctttaacaattcatataaaatcatgctgcaaatctttctgttttgttttaaagacttttttatggtggctttaggttctctgcaaaattgagaaaagggtaccgagatttcccatatgcctcctgccctgccacatgtgcagcctcccccactatcaacatcccacaccagtgtggtacatttgttacagctgtatctacattgatgcctcattatcacccaaagtccacagtttacagtagggttcactcttaactacttttcattctatgagtttggacaaatgtataatgacacgtatccaccatacactaatatttttttgcagtttttttgtactttttttttttttttttttttgagacagagtctcgctctgtcacccaggctggagtgcagtggcacgatcttggctcactgcaagctccgcctcccgggttcacgccattctcctgcctcagcctcctgagtagctgggactacaggtatccgccactgcgcccagctaattatttgtattcttttagtagagacggggtttcaccgtggtcttgatctcctgaccttgtgatctgcccgtcttggcctcccaaagtgctgggattacaggtgtgagccaccgcacctggccttctgtacttttatgctttgaacacatatatatgttaatacaaagagagctagtgtattgatatatcatttgagggaaattagatatactgaagatcaggtgaaggactggaactgtaagtattgatttgacacctataaatatatagggaataattgaactctgagtataaattttttctccaggcatccaatagactctgaggtttttgagagcaatgagcctgtctcattatctttgaaagccacatggtgccagtcatggtgtgatactcaacaaatgattgtcaaatgaataaatgaacaactttttctctctctgtagaatatgcaacacagcttggaaactggcagccacaggcaaaatttgaactataagtgaattttgttagccaacagtgtatttttttcaatagaataaatcttttaagattgggagatttcccattttaaaaaaaaacagatcctgggctttattgcaaaatctaaatatctgacaacacctggcttgtacttcagcctggcaataatcaaggtgagtagctgcagccctccttaaacagactaagtttccagtgtgacattaccacttcccagtgcctctctgacaccaagaccaattgtctcttaccacggattattgcttgcactgttgtttttcttatggtacggcatatttcactgtatcctagcttctaagaaagagggaaaaaattaaaatggactgaaaggtcccagtgcttcatgcaaaactggaaataacatatttctttgcaaaagtaaaggctgtatccttaggtgtttaatatgcaaacagtgtatctaggtcatgggggatggcacttatttattaattaaataaatattaaatgcctggctcttgaaggtatttcagtttgcaacccgacctcctcttctcagatacttttaagaaatgcagtatttacatgaactttaaagaaaatgaattttctctttggctttttagtatttagtctcacttggtttttatcccaatagaaaattctaataacctggaaaccttgctaatctcaattttctctactagattgacctagtagaaccagccatgattcttgtgtaatttactatcagcaaatatttccaaaaattgaaatcagtttgattttgatgtaaacaagaaaaaaaaatgggagcaattcattttaactctaactctaggattgccagttatagggaattaatcaaaaggttagatttgcctcaccaaattttcacctttaaatgatgtaagacagctctctaaatgacaatttatcaatcaaggatactcatcagcaagggtcctgaaaggaagatgatgatgagaagtagctgtcagcctctactgaaggaggaccctccccaccaccctggtcccgccccattcgccgccacaccactgcccaggtgaggttgaaccacttctgactttgggatgggaaggcagtggctttagcacccaatcctcataactggacagaatatagagtgtcaaaaaaggtggcagggactggctggctttatgtctcaagtagggtgtccttctgtcctaaactgagcctctattcaagctttactccaatcatcatcttagataaaatagatctttcaggtctgttacattaacagaagtttatttttatagaaaacatggtcttctgttagaaagtaatgttattagacttaaaagtaggggacatctgaacccttgctggagaagcagattctaaaagccacaccatcccttatcccatgtttgtatgaattcagacacttaatttccagccctgacgggtttcctttccactgcattttaaagctattcccgcatatctagcatgaacctaatcgccatgaaaatgtatgactcttcctagatggataagagaaaaacaacagacaaagcacgatggccgtaatgtctccaaggcgacaggagggattctattttaggggattttaaagtttgctcttaaatgtctgaaaaagtcatgtttcaagaatttaacttaaatttaggttcttacagaaacataaaaggtattttaaactttattagtcagtagtttacagttttctcacaccctaagaaggtaagtcctgataaacccttaagggggaattctctacatttaaagtgtacttattagtgaaagtaatggtatgaaattatttcaaaagttaataaacataaataaacatatatataagaatatttatacaactgatttgttaatgcaaaaaaacctctgaaaaataaagacaaaagaaatcaataagaatgatacaaatgatacacaagatttttgctactattaattagcaaattactttgagaacttaatgcaacctaagctaaccgtaggtttgggatgaggactctcttcgcagctagaaaagatccttgtaaatgtgaaggaatgcctagtaagtaaagtacggtagtaattaaaattgtagtcttgtattcctgtaatccattccttttgggagcatccttttgggggcatgactgcatgtggatatgataagcaaccaacttaaaatccttcatctagctggggcaggagaatggcgtgaacccgggaggtggagcttgtagtgagccaagatcgtgccactgcactccaggctgggtgacagagcgagactccatctcaaaaaaaaaaaagaaaaaaaaatccttcatctaaaaagcagctcctggccaggcatggtgcctcatgcctgtaatcccagcattctgggaggccaaggcaggaggactgtttcagcccaggagtttgagacctgggcaacacagggagatcctgtctctaaaaataaaaataaaataagataaaataaaataaaatagccaggtgtggtggcatgcacctgtgttcccaactacctgggaggctgaggggggaagattgcttcagcctgggaagttgaggcttcagtgagccatgatcatgccattgcactccagtctgagcaacacagtgagatcttgtctccaaaaaaaaaacaaaataaaacaaaaacaaacgaacaacaacaacataaaaggataaaaataaaaagcggctcctgaactccttgccttgcttaccctgctctagcaatactgtgccccgtgatgatccttacatgccaagttcattcctgctgcatggcttttgtacttgctcttctctctgtgtagaatactctaccctagatagtcatgtggctttcatgtcttggctcaagtatcacctaatcagaggctgttcctgactactccatttcaaatagcgctttccccctcactctgtaacctcacaccctctgttaactttctgcataacattgagtgtgcatttatttgaatatttgtttattgttttactctgccattagaagtgaagctccatggatgcagagacaaggcctattttatttgctgctgtgtaaaccctcaccacccagagttttatctcacacgtaggtgctcaataaatatttgtgaatgaataaatgaagttgtcattgtgcatttctttttgcaaacaactttgctctatttatttcataacaaaatacttaaaagttacatttccacatgcattaatacagtgtcacataatccttgaggatgtgaatgttaaggtgtttccatttcataagctcctaaaaaagaacacatgtaccagtctctgtattgattctaatttaatataaactctatatgtacacaatctaatagaacaattcttttacatttaaaattgctgttcattctgacagtatgttttgtatgttctctaaacatggacattttaaagatatagttcttgaaggacccagttttgtagcatatactcactgatgactcaataactattaactcttggtgacttgttgccatgcaattctcttgtaaattctctctagtggaaaagaaaaaggagttctaccttgcttttagaccacagaaatggtcttatatagtataaactcccaaaacgcatagagttaacacacaggttcaacacacaaaataaacaaagggttgtttttctattaaaatgattctatttgctgtaccaagatagcatcaaaataaatcaatgttcatgcttctttagagagaaaaactaaagtatctactgttttctatgattctcatgttgatgcctaaatgcataaaatgtgacggcctcagcccaactattctcttgtgaactgttagctgtctttgaagtaaggaatcaatattgtgttcacgttagaatttgtgactatcttcaaaccttagtttggctattaaaatggtctataaaattcataccctaaaataatagctaaatattaaatatcaaaatcaatatcataatatatctcctattataataatgcacctacgtattcaaatgaatgactgtagcttagtattggaatatttatcagattgttcttatgtcatgggtaaaccttcaatgctgtttgaggcactgaggaaaaatgattaaattaatgaattatcctctaattgatatttaaatcaagaacttatccatcagctaataacaaagtatcaattagttattattaatcaaggtctgttaaacaagatttgtattgtataattacaacatcttcaacatttatatttcatgaaaccataagactacataataattgtacaaaattttacaaagcaatttcacatacacatttctcataaaccagtttcagcccattgtttcatatggcagcacataacacatttctgctgcatgaagtgatgtttgaaaagaagcctacgttattagtttgtcaatttgcttttattcagatatttatatttatattattgattccctgctaggtgctaggtattaaggatactgagaggaataagatatgggctatgcccattagagtagtggctatttttgcagagcatccaataaatttgtgtgtatatgtttatatgtgtgtatatatttatgtatacatgtatacatgtgtattacatgtatacaaatatatattatacaaatatatcatcttatctttctaggatataaatagttatactctgaacacatataaatattgaagttggaatgaatgttatcattttaggaaaataaaagcataatatacagataaataatggctttcctggaaacgacagaaacatgcttaagtttccagttgtgatgcacctagaaattgagaaatacttgaaaaaatggctcctatacagtaatctgaaagcagaactgtccttcagattaggaggcaacttccatcgccaatttgagaaatttcaggaagagcttcctatgctgaatatcaactggccgaagagtgtacagttcttccgttggagatttaagtcatctaaaatttccagtgaaaaaggccaagtctttggagcactgaaacaatcaaaatccctaggagttaatttctcaaaagaggaattacttccatcaaacaacaaaaagttggctctgaaagtaaggttgtacgaaaatgaaagctttgttagattttggcaaaaaaaaaaaaaaggtggaggggagatgggaaaaaaaataaaccatacttactactattttcaatttgacttgggggaagtcctgtctagagaatttagcataatctttttcaaaacctcagagggcttccatatgaatattaaacaccatgtaacacatatcttacccttggtgttgtctaaaatttcactggagttgtaggaaagatcagataattcatacattttcgttttctcaagcaaatatttttctgagtttttgtctagttttacatttagcattactgtagtatcatctcaagcctgtacaatggccagtattctatttctatagttatcaacccattcttctttccatctctatccttaagacattttaagtcaaatgattaattcatccagaagtctttggcacttaatgtaatcatttcaagatttcactgtgtaccatttgggatagtaaaattttggccagaaatgatttatatagaacaaaggtcttttccttctcatacgtaacactgtagccattcccaccctgggttcagtgagagaatggagccctattattctaaagtatccatactcctgcgcatgtagaatgatattaattgtgtaccaaccttggaagaattaagaaaacaatcaatcaaagcattttcagggttctgcggttcagatgagtaacccaggttgagaaagaccgagatttactccattcaaaatgcccctctagagaggttttccctctaactgtggctaatatctattaatcctgactgcccccttgttattttctcagttcattgcctgctgtagtcaaaaattctgcttctttcctctccttcctctgaagtctctctctccacttccccattctacactcctggccctcaaaagtctatacaagttaaacacagtatggtggaaatcatgcataacctgtttaacttcacatctttttatagtatcatattcccttgagggcaaaaaagggaactttaatatatttctgctagcagctgatgagtcaagattcttgtgcctattataaaacttctccaaagggaagcatagaagcacacctttctttagatgattgggtgaattatttcatgatgcattttccatattttgtggtatacaagcccgtcccttcctaggatttggtaagaactactttaaaaaatttctattgcttacctaaatgttgaaaaagatctcatgaaaataacctcttcctaccagaatacttgatattctaccctgtttctcttcataaaaacaaagcaatggtaagcctgaaccactcaatctaatctcttgcattaaggagctagttttccactgtcgattactgctctacccttcctgatctcattgagatgaggttagacattttgtcatgttcactgatcttttctgcctttgattccataaacaggaaccatctatgagtcaagctgtacaatcttggattaaagcccaggctatcaatgctttttcaaagggtgtgccataatactgctgtcagaatcagtttggataagaatgcttgtttgacagatcaaattctaattctaaatggtatagcatcccctttctcattaacctttatcacagcaacttgataatgttctgagatcaattggaattatgcccacaagctctaccaaattgaaagatgactatcattctttatgtcattgttttattatgaagttgtattaattattgtcataaagagcttagcatagatacactaatgataaaatgcttatattttgtgaatattctctaatatataaataaaaaactgaacctcttcccaaaagtttacttattcatctatatggggggaaggtacattgtgtagagaatttaacttgccaggcttcaggcttctcaggaagaagctgtattcaaaagtagagtgtatgaaggtcatctacctctttcaccatctggggggccaatcagtaatagctgccttttaaatgttatgagttcaaatcatctctttttgcttcatggcacagagcttaatggtttgacagaattgacttgaaatgatttgacagattcaaaatgcagacagctctgcactttggaggtatgtgtggggtgggtgaaggagtccaattcaactacagacatgtctgtagtttatttctgtgcagaagtgagtggggagactctgtctaggaaagaacttgttaggctcctaaatttttgtaacaaagtgaaaactttgcctcctacacatatgaactctaaagcgtgtgtgtctaactttgtaaacaataccagagaatactggcacaggaggcaattctcaaaattcactgcaacgttttccgtttgcacctgccaagtgtgcacttgaaacaacttgcgtttgaaagccactgtctaaggatctaagaatggctggtgcatctatgctccaatctgtgttgagataaatgaatgctttccaaaaatctggtttctacagtgttagcgctacttgaagaaaggtcctatcaccaaataaattgggaaaatactggtttaaacaaaattaattggatttattttctatcaaacttctaagggtctttaatatgctaatatggttttgaatctacaaaagggagattacattttttttttttgcatttccaagacaatttaactcgaacccatttctgatggagtaactattcacatctagcagggttagttttatgaagaacaaaggttgggaaacactgagctagagctccaaaaatcaatatgctcagactctactacctgcatttcctgaagaaattacttccctgcattatgacatcatattgtgcccttggcttttgtagtgagtcaacagagaaagagttttaaaaataactttatatttttgccacaccataattatagtctctaacatacattagataaacattcatagtatatattccttctagaatttgttgccaggtatgattatgtcttcaggttcattaatgggcaatgagatttataaacacagtaagagcttcccctgcctaaccctcaaatgctagagaactaaaatgtgccttaatacaacaagaaacatattctgggttgctgaaaaattttcttcctaaataatattttgtgtcttttatattataattgggtatcttgatatttagcttccttatcattaagctgggttaataaatttcaccttaataattgtggtgaagaatgtaaggtatgaaaatttaattgacataggtacataatatacccagttcagtatctcaattatgataagcatgaaataaatggtagctattgttattagtaatgttaatattacttttaatcgttttgtttttctctttttaatgttaatggtacaggagagtaaaagataaaaagtaaaagttttcttcctccattctttctctccctcattccccttcctcaataggaatttttttttctttttactgcttcagtttccaaacttctgaaaataccagaataaatgttgcaatttcttggcttactaggttttcttttccttttttctttttagacagggtcttgctgtgccacctaggctagagtgcagtggggcgatcactgctcaccagtgtagtctcgatctccctgggtgaagagaacctcccacctcagtctcccaggtaactggcatgcaccaccacatctggctaattttgtaattttgtgtagagacaaggtcttgccatgttgcctgagctggtcttgaactcctgttctcaagcaatactcccatggcagcctcctaaaatgctgaggttacaggcgtgagctaacacaaccaaccaaaataaactttttattacaatatggcatacacaaagaatagtacacaattcaaaaatgaacaactaggtgagttttcagaaagtgaacatacctatataatcacaacttagaataagaaatagcagagctctggtatccccataagtgtgtgtgtcctccctgaagttaaccaccatcctaacttctaccctcatagatagatttggaatggttttgagatctgtcataaatgatatcatacacatttttcctgcttagcttctttgactcaacattatgtttgtgagaatcatgcattttattgcatggcagagtggtgcatagtatgccaataattaccacatgtatttatgcattctactgttaagggatatttgggttgtttccagttttgtgctattacaaacagtgctgctaggaccattcttgtacaagtcttttgagtcacgtagcatgcatttttttgggtataaaactaggagtgggactgctgggccatctgatatgcatacgttctgttgcagatactaccgaacagttttctaaaagtagtagtatcaaattatacttctatgagcagtatatgaaagttccaattgctttaaatctgggccaacttttcatactgtcagtccttttaattgtagttttccttaccatgtcaacttcacatggtattttacaacatattctatgtaagttaacacagttaacagccctatacttccctgcacttgtctttcccccacaaacataaagctagtcaggtatgtaactatctttatactgtaaaaacttatattaataacatttacgttcccttcctagttataatttttatgctttctctgtacagatagaatataaaattttaaatatgaataacaattataaaatgatgattatgtaaatatttttcactggagaatcaaatactatgatggaatccctaaagcaggagatgcattctatgttcctaaatctgtgctactcaatggagaatcttccaagtataaaggtcaagttcatctgccaaaaattttttaaaaacatgacacattttacattgcttcatatttggatttttacctcttgtccagcttttgtcccccttaggatttctatttgcctttcttgttcttgttgacaaaagaaaaattatatctttactttatcattaatttaatacattattaaaattctatcatattataattaatttgtcattattaagaaatccatattcttcatcaggccttctgccttgactctgatgactggttctcatttggattgactgtactctactatataactgctattctgggatatcattctgctgcactcttaaattagatccacagcttctcgactttcacactttcctctttcctagattacttctatatacatttttgcttaagtataatctccagtcattttttttctaagagcatgtgttggatttaaattttctgaatcattgcatacctaaaaatgtatttattttatgctcacccttgatagacatttttaggtttgaagcatttcttctcaaacattgaaaccttttttttttttgatttggtattgataaaaatctgacacgaagttgattctaattcctttataggaaacctatttttatttctcttgagaagttcttaggatcttctcattttccacgatgtcctggaagaggatttgtttatgtctttgtttagtaattttgcttagagctcaaagggccctttcaatctgaaaacatgtttgaatttggagaatttacaccaatcatttccattataatttctttccccttttctcgtctgctctccaaatgctttttaggttgatgttgtacctattcaattgatcttctatgtatctacatttttcaagtatttgccttaactttgtcaactgtttcttttagtgaatattaattttagcagtcatagttttatattctgtgaattctgtatatttctcttttgctcccttgtcattatagctggtcatgctttgtggatgtgataccttcttgaatgcaatattcacttgaatgcttctgaggctactcattagaatttttaaaaatctctcttttgttcctgaatcacctcttctttcttcaggtcagttgttagtccaaaagatgtcaatgatccctagttatcagtttacatttattaataaagaactaggttgcctaatacaagtagctggtgtgagttatagcactatgttttcttaaccactttttccccaggataacagggcatgatcactggcagacttcacccaaggcctcgggtgggagacaggcagcagggtgagcaggcagtacacttgcctattcctcaactccacaccaaaatggggagggctttcttggggggtcatcactacagatccatgaatttcttaagagactggctttctaattttagattagggaacaatagggaaggtgatgaaggtgaaggaggtgtttaactttctcagctgttccatccttcaaaaaatcatcttgttctctgcctccttcctctgcctgatttccaaaaaccacacaagtttgaagcctgtctgtggttccatggccaggaagggtggctcctccctctacttttcttgtatttgctctggattgtaatgtctgcttggtttatccactttccatcttccacaaatttctgaaaatctcttgtttcttgatatccttttctcctatttttagaactgccctttttacttatgctgatatttgggatgtagctgaggcaaaagtttgtggtcagtgtgccttgagtcactaatcctgatatagattttaacatttggaaggcatacatttaaaataaacaagtagcatctatacaaaatatcacaaggaattaatcactcttggaaactatctttactctgatactttctgagtcttcatagcctgtaaaccaaatttatcaacaaaccatttagaaaaacaaaggcaataaacgaaattcatttttgatctgtatgaggtcacctagctttatagattagaaaagactcaattcaatcagaaactctgtggggtcctagatattccccagattgaattcaattgggaattttgtcatgcagaattaacaatagtttgtccttcagcctccagctgcctggtgctgtttctggtcccctgccagtattttcctccagacagccttgagcaggctttgggaggaggaggggaaggaggaaggtatggaacacccctctagttaaataggaaattgggaaatcagcagatgttagaggatactaaagatcctcagaaaaggccgagtgcaggaatagctcacacctgtaatctcagcaccttgggaggccaagatgagaggatagcctgagcccaggagttgaagatcagcctgggcaaacatagggacatagggagacctcatcactatcaaaaagaaaaaaaaataataataataccagcatggtggggtcctagctacttgggggttgggggagtggcagggaggctgccgagacaggaggattgctcgggcctgggaggatgaggctgcagtaagccaagattgcaccactgcactccagctgggcaacagagagaccctgtctcaaaagaaacaaataagcaaaaaataaaaagatcttcagaatattcctggagctttctttccccatgtgatgtgaaaaatcaagaactctgatgaaaagaaaaggcattatctgaaacactccaagcccaaaacaaatgtgtgggattggttaagcccggagatctttaaaaattgacatcatttggccaggcatggtggctcacacctgtaatcccagcactttgggaggccaaggtgggcagatcacttggggtcaggagtttgagaccagccgggccaaaatacaacaaattagccaggtgtggtgatgggtgcctgtaatcccagctactcgggaggctgaggcaagagaatcacttgaacccaggaggcggaggctgcagtgagctgagatcgtgccactgcactgcagcctgggtgacagagtgagactctgtctcaataaataaataaataaataaataaatattaacattatccattcgacagatacttattgggcattttctttgtaccaaatactttgtacttgccagtgacataatggtaagtaaagcatggatactaattttcaaggaattcatagtctgatggttgtatacagataaacaaagaattatcatcaaatgtagaaagcataatgaaagccatctatacaggtttatgaatacacagagcaggagtacctattcagtggtgtgctggtaaatgtttaacaagtggctttgtcggggcatgccttgatttatagcatccatcaatgtctctggtgtaaatactcccactatggccaatttcagtctaccaacttgatgtcattgaatgtggagttgctaagagatgtgtggcacaccattatagagtagctctcccacatagatagagtagacttcaagagcacagaacataaaatgtagtaatgattagaaaatgatgaattgttagtattcattacctccgtttttaatatcatttaattgcaaatttatataattttaaatgattgtgtttacaagctagttcaaaaaattctttaacatttaacaattggctccatagaagatgactttaaccaatgaagtctactcttcattgtgggctagggcaacagactttctgcaccatacaaatgagggtgaactcctttgcatgagtagctatgtccattagcattgaaagaagacaagtaacagaagagaagagggagcaatgagaagagctgagatgctcagaacattgcaccgcatacaaccaaagcagaaaactttataaccctgcctttcaactattttctccatataataaccttccgcataaggggagaagaaagggagagatcagttagcccttaggtccctaaatagtaaggacaaaaaatcacatgaaaattacaatattcatttccatccccatggaacattccttccagtctatgctgatgtggactgccaaggagggcagacttgaagacttaacaaaatgatccactggaaatcctacgttagcagtggcgctcataacttcatacaggactgcaggctcagatttgcaggggtgttcacacagttctgtggaatgagagcaactcaggagtggactcagcaaatggttgagtcaactgtcatttttaaactatgtcttcaaaactctcaccaaaatgtatacacacaaatgcgttataacctgtatcaggcctcttttgattgcaaataacagaaagacctggctctaatgggcttaggtgttaaagacatttaatggctaacttaactgaagaagtctaagggagagctcagagctcccttaaggtagttcttgagcaggggctgaagtgatgacagtcagatatggtgtctctttcttttggatccactgccattttcagacaggctctgccctcaaagtcacaggaaggctatagcagtttcatagcccttatatctgctcagcttctcccttctagcagctgagtaaaattcctgggcttgtctctggctgaaacatatctagtagcatctctatgaagctgccagtacgttaggtccatggctcccaaactcagctaacacagtaaagtcacctggggaatgtgttaaaatgccaaagaacaggccacacttccaggcaattaaatcacaatctctggggttggatccaggcaacattattttcttaaggttacaaggtaattccaatggagagaaaaatttagaaacccctgaattgggtgctcataaaaataggagattttagactcatcttctgatttactaagaaagtcaagtttgattaatttccttaatgtccacctcaaagtctttcttcctatgctttcctgtctctgtgacaagagtgtccctcttgctcactctagctggctgccatctgtctcgtggtctcacactcacactgtcttgcctggttctagagttcatccctcttctagtttgcatcttgaaattttacctccctactggttctatccttttaaaaaatgctcagatttctcccatcctataatagccttccttatcccccatgaccccgccctccacccccacaggctgctgcccatctacagcctaactttcaccttcagacttcttaaaagagtggtctgcccttgttgcctttaatgcagagaatccttataatctggtttggacatcaataccctgtgaaaactgttctctcaaaggtcagcaatgacccacttacaaaacagaagggctgcttctcgcctctccttctctcatctttgctttggtttttagatattacggtatccaaacgctatttctcccactgtttttctctctgccacctctattagcttaagaaagccttggggaaaatgtgtgggacgtgtatcctaaacacatttctcagacaatatgtatcagaagacttgaaagtgaagatacatgaaggcaacaatttaaagcacaaaataaattctttaaagacaattcagtatcatgtattagactgaaaactgggaaacaaactaaagatatattatccacataaggaaatactacagagacagtaacagtttcctatgacaagtgtgtgctaatgtgcacaaatgggcagaatattaggaagaagatgtaagacaaaacatgtattatacatataatttcaacttattaaaaagcataataatttgtaaatcaatttgttttcctccattggtttccattattatgatgacaacatatctttagtgatatttagttttaccttttctcctaattcatctgttttgaaaatgaatagaaatttccttagtacaaatgtaacttattgtattcttcatatattcagctatttaataatgtagttggaattattagtaagaagctctttctcactttctaataccccgagctttgcctgaatttaggtggtcatcattgactgagacatccaagaccactgcttttattgctttttgtaatggcaaggtcaaagtttccttggtttgaagggtgcagtaacatcctttaaggagctacatgtaataaatatctgggtgcattttttttttggatatatgcgatactgaaacaaataattattttaaaaatctgcaaataagattttcttctgtatatttaataaagcagcagttactaattttaaatttaacataattctcatgtatatgggcaaaaaagtggtaagaaactaaaagagagaaaaagatgagtttcaaacactgacggcttgcctatccctagaaactatgtattttgcctcctctcaaatagtgggaagttatcaaattatatattttccgccagaataaagtgaatttactaatataagaatttcaaataaatcaactgtagtagaaaattaaatcattttgttatagctaacatgagtataaaacagttttcacaagtaatttttaatttacagattaagaaactgaaatttagtgggggaaattcagtttttttgtttgtttgtttttgccacacaagtaaaaataggaaagctaggaaaggttgacatatcttctaatttctaagtctattctatttcccctaccataaggaatgctgagagattagtgtggtgttgtcttgattaatttctctttattattctagataggcaggtctatggtttctatccgtttctagaagagaaaaaaaatggcaaaaatgaaacactggggttcctcctgtcctccacttgtgatcttaggaatgattcttaacttctctgaacctcttctttttcatctgtatggtggggataatgacgataatattgcaagatttaaatgagttagtacatgtaaaatgtttagaatagtacctggcagaaagtaagtgctcaataaatgttagctatccttatttccattcttcctcctaaacatttcccaaaagtatataagttaatcgattagaatgcctatcctacattggccctccttttcccagtaatgaaccagatatttcttcctaacctgctacaatcatataagaagggtgtagactccttcttgtttatatggggtcatacaaggcatagccaaaatttcctctggaggatgggtacctcctggaacgaggtaaagtatttctagcatccaattcccatttggaagacaggggagaaataaatgcgccattatgataattctaactagttatataaacgaaaagcttcagtccagtggagagtaaagcggtccaagccactgttcaatgtaaactccctcaaagcatgggctagaagcacagcaagaaatccatcacaatctggaccacgagcagcacttgcgcgagaacaagacctgcctgggacccagctgcagcattctcctgttcaagtggggtctctctatttgcaagagaaatatgccccatgccctagcaatagatgaaactccaataaaacaagacagacttactttgtgaaatatctattaagtgcatattattttaaaaagttgataggctagaaagataaatacgttaaatgcactagctttgatggcatgaaatgaaggggtggaggcaaagcagaaaggacatggttgcaggtgagatttggaaaggggtggaaagttaacgaggtggaggatacagttaagttgttccagatggcaggatctgacagagaaggccagcgagggttagcagaatggatgaggatggggagacaggagaaatgaggtccagcacagagagagagagcattctcaacccagatgatgatcagttctgaatcatatcacagagtggatgaggaatcattagagaagactgctgaaggaaccacaaggctagacacagacagatgggaaagagcaaagtgaccagaacagaaaatccaaggccaccagcaaaggagccatcaggtttggaacactgatactgaactctgtgatggattcagaattccttggattaaaagattctgcagatgagaaaagatgggaaatatttttcctcttccattaagacaaaacatttaaatgtgtttctttaattaagattacacttaggaaatgagtttctaaatagaagaacttttaaacacaggatgagtgtcagagtttaaagggatttagacgtcacctgagtaatccattaaaagtttatcagacaaactgtgagattgttcttgtcagagagaattgagaataagattactggttgtctgagatggttgagtttcagttctctctggaaacaagtcctagacgaatgtctgaccttccctttcaagcataatgattccatgattggggtaagtgtaaggaacaatgactgaaaaaatgagagtgagtgtgatcacaacccagccttttaatcttgctcagtgccagtggagagagcaatacccatacatgcccagacagcagaaaaggagaaaagatactgaggttgggaggagaaatcaggaagaagagagggagagagaaagaaagtagaatgcacagcagggagcagttccctgccagccacagatgtctcacttagacaccccattgggatgaaggtcaacggggctgcttatagtttgttagtgggaaagggacagggagagttaattctattttaggccatatgtgtatttgggaagagagagaaagtgaagataagtagaaaataaaatgacacgtaggccagctatgatgaaaaatgttgaagtctatactaaagtgaaggcaaaggtttccgacatgagctttgagccagtagagaaaagacagagagagagggtgggtggcagcaaaacaatgaaaggtgcccagagccgtgctccctgtggaatgtcagtaaatattaattggctgatgttggcattggtaggcagagtgaagcttgtgaaagaaaaatgccattgccagtggagcacgaaagttcagatctcggagctcaaaatggcagcacctgagcaagcagcagagtcacatcccatatcaccagagaaagtgattctctgcatatgaggccaaactgtctcaaggaaaagtaatcacacaatcatgacaagagaaaaagaacaaagtctgtgggagccatgaaaatatctccccttctctgagaacatactcccttcccctgaggtatggtagcccctagctgagaaaccagggctgtcccaggtaaacagctgtgaaggtaggtgccaagaagcctagatttacccactccagaaaacccttttgtcagatgtctctggaaacctcacaaaatgttattttgggatttggctctaaggttgggtaattggtagactctcattctggaggaagaaaagaacggcattgcttctttagatttcaatattagatgggaaacggaatgcttttgacggtgcttggtgttttcatgaaccaaagttcctctcataatggcaggcatgggccttttgggtaaaggttattttcttgctcttgttctacattggtaggtacctgataaggcaaaatgattgaaacagtggcttgaaacattaataagaaaatgactcaattcccaagtcagagaagtgctaagtttacctgaaatatattctactataatactgtggatcagtgtctatgtggagtgatccaaggacttgtctagaaatacatgttttatacatcttttaaaattacatctgacctaaagaaaaaatatttattgttcaataatatattcattttaaaaatgctttttacacctataaattgtcccagcccagaattctaagtgcaaaaatgtcagtgtctggcacatagtaggtacttaatcgatatttgttaagtatgtattagatatatgaagaatgtaagaatcaagtaaaaatatcaagaatgtgggtgtttgtagaaaattgtttcccttttattccatcattttctccttaagaaaattaagaagaaattgcaattgccatattgctttttcttgtgggtgatatcaaccacaaatagcaaggtagttttggagtcatgaagcaaacttccccctgctaagatctgggtaaggttttagccacaagaggcctaataaagctcttgaagcatttcctaagagctcacagaagatttaaatgccctactactttcaactagacaaatccaattcattttaacaaacagttttgaagtgcctactaagtgtaatgccttgtgctaaatgtctggaagagtgagtgttaggtggagccctcaatgggtataaagaaatatgtatgtttgggagttgagggtgagggtgtgggagttgtgtgagtagggagaatgggacaagaaagaaacttcaagtgtatatccacccctgtccccaaatacactcctgaccctaaaagaaaggtcattttaatattgtaattacatatgtttcctggttttatcattacagcttaagaaaacagcaccacaagtatgggtggggtgctagaactcaatgaatccactttggaacaagaagcatgggtggaacttgaacgttgttggacaagactgaagcagatggcaaggcaaggtaccgtgttactcaggtgcattcttgtaagtatttggacagccagttaaacacaaagaagaacccaattatggcaaattgattctgcaaagagattttattttaatcatcaactgacagtcttaagttaaataccaaatagagcagacataaagattttggaaaaaagtgtgaggtagcaactccaaagcagttatcaatactttcctcaattatctagatttttagcgactatcttagtaaacacttaaatctcctttcaatgcaggagatcaatgcttccataaaattcagaaaactgagaaagttaaaaatatttgtaagaactataaattgcttgggttcactctcttccttgtatgtagtacttataaaagaactgatacagatgaatagaaaatactgattgtttcatgtttatgatgtaagaagaccatcaacttctcaacatcaagataagtaaatgccaaaatcaggtcagaaaagaacttttcagaataagggcctgcctttaaaagtctcagccaaaaccgtaacagaaaggatagtctcttagtcatgatttataaacagaaattgtacgtctgtaccaattgtagaggataaagtcaaaacagaatttacagcctcctgctaatagcctaatttaaaatgtataatcttccctacatttcccccaaagtaccttttaaaggactcactctgctatccaaacaacttgcaaatgcattcggtaagttggtctacagtatttattctctttcctgttattgactcaagatctatttctcatgatttgctttgtgctcattcttctgccagataaaatattaattgcatttttagctgcactgctggtgatcaaagaattctgatatgtcaagctaaactgacagaaatagcatccattaacatatttataggttcagagcttctagaacataattatatccattaattactcaacagtactctatattacaggctgaaaaagaaaggcatttgcaactaaatacttttactcagaatgaagtttttttttaaataataaattttctctaaggaaggttctatctaaaggaaataaggcaagagagctcacatatctatatggacacaaggcaggatttttaaggcatccatttactaactttgcaatagaatgctcacaaagtaaacgagatggcacatccagaatggtttcaaataaaataataccttaaatattacagagaaatttaattactattttagagttctaagagtgacaatctgaagctggtaattcttgatgataagattccgagcaatgatttttactttcaaataaacttctagtattacataggaccaaagcatttggaattacatacttttctgaacatgcaattctaacacataaagaaattaaagctgtccagggaaaaagctcttaagatgttggaaagtcatagaacaaacaattattctgtggatccaccagctgtgcgagtcctgaatctgccagctgcatttagtatatgtatcatagaaaggacagtaacacacacttgactccttttggccagttaatcagcatgcaaaatgacggtttcccacaataacttcagcaccggacccaaacacattctcttttcagcaaagaatgaagtcattaaaaaaaaaatcacacaagctgctttcataatttcagcacgaacacaaccgagatgtaaggacagaaagcaaagccgagtctacctgtacatatgtatctatacatatttcactgagttctttgttgcctgacaataaattgcaaaggcagtcatatttgaaagtaaaaaccattaaactgtgtttataggatactgcaacagactcgctgagggaataacaaggaaagcacgatacctttagtaagtcgcctcagaatttgacaacggcatttaaaagagacagctatcattcttgctcactgctttctgtggcaaagtgtactcaaggctctctgctctggtggctgcagcagcagcagcatatgaattccttgcgcacataccaggagaaaggtagtcccagtggggagtgacaaagcttaattcctcttggctgatgcagaggtccgctacatgtcatctggcaaatctgtgtcattcactactactaccacccctgcctgccacagcctcctcccccttcacaatcacaatggcttagaaagtaatgccgtttcgatagcaacaaagcaccaaattgtacaaagcagggacgacactgtgtgaggagccattccataaatctaacgctaagcactgaacagtgcattctgtttaaggcaaaaggcgatgtatccagtcagttcagccaccatcagcccctttccttctcagcatcaagtcagtgtcctttatatgtctcatttaatgggaaatgcaagtgaaatgcttacactcttactttaggaagaaatgcatgggtcatgtactatgttctttaaacaacaaccaaaaaaaaaaaaaaaaaaaaggaaagaaaaagagggagggccgtttatatttgggattgaggaaagaatcacagttctgcctatagcggggaagcagctctaggacagagacctctttggtacttcctgaacctatgagagttaaggcagtgtctgtttatagagggaatacaagaaagggttagggctaggcagacaatcaggcagatggagtcccagcccctttaatcacccttccaaaaaaggacttggctggaaagcaacacagtcaagactgtttctaaagataccagaaataaaggcaaacaaggccaagtatttctatttttaatatactttattatactatttcccaaacaaccatcccccaaaccattcttctcattatgcaaataaaacggtcttgcgacatagcagatatttgtgagtatctgctccaatggagtgaagagcaaattaacaaacccttcacaatccattcacaaagtgataagaaggcggagcacacctcctcatctgccagcagcagcctgctcgccatatagtcaatacgaactaacatttggtagggaattttaatcaaaatccagaattctcccacaggagttaacataaacattcaggacaaaaaattagacagttggccaggaagtttaagaaaaaaaaaatcaattagtcaaaatgaaaagatatatcactgtctaaactacttgattaatatttctaggactttatgaattattcatacagttttattctctactcttcaggctgtgaaaaaactttcaagctggtttttaaaataacttccaacattccaaatttagtggtaaaactttcttttcttcattcataaattcaatatgaactcaaacaatttcaatccactgctattgaaatgcatatgctttgtattttgagtccaatagaaaaataatttgtgtgtgaaaaacatctgaatatcataagcatctactttaaaggtttttgaaaagaacagaattcttttaccaaggatggtctagctaaagcaaccactaatcaatagaaaatactatattaaatggactgcagtgcaaaatcaaatttttataattgttctgattagcataaatctttctttgaatttcaacccatattatgttcatctctattaggttatccctagaaatagtttagcctccttgatatttttttgctttaaatagaaatataccttagtactagagaactgagttactagctaaagtgagataaatacttacagttagctctttccaagattcttctccaaatctaacatatttcctaaaatccaggcactcagaatacgcagctgtcaattactattagtagaatcttgcctgtggaacaccaccaccccagcccagtctattcaaatacaactcaaaaccatacaggaatctcttgccttctgctattttgcagactcaaatccaatttgctttttccttatgactaaaatgatcaaatattttccccttttcctaatatgcttattttttttgttttgttttaaaagctctatcctctggtcccaagaaaggtcttcagaactactaaaatgtcctatttctttggcaggggaaataacccatcatggagctctttgaaaggtttctgagagcccaaactaggggattgttttttctctctttgaatactgtggctgccaatccatatctatcctattagtctgcccaggtgcagccccaggaatcttacagaaatggagcctcctggagtaattcttttccagaaaatgaacgaattcaccaggtattcccatcttcttccatttctggcctcgctaatgcttggagatttcctggggagccactcccaggtcaaccttcttgccctaaaccctttgtcctccctttgcctaatgcaagcttagcctcccatcctgaactctagcactggtaaaatgccttccaacaatgcaagccttctatctcaaaatgtatcgatctgtaggatgaaggtctcaaatggccaaggcaaccggtggaatgtggaccacaggctcctaacatgagctactacaaggcagagtgacctacatttcttggctaccagatcaatgtaagcatgtgtctttgggacctgtcatgaacatgttaattatggtggctcagctgtctagacagttcaaactttacaacatgctctgtgagggtcaccaagtaggggttatggaaaaagaaggcaggtaaaattgtacaaaatacagatttgattaagccccaatgtgatctgaagaagagtgagtgagctagttcaagaggtttacccctcttaaaaacacaaacacctcaatacatgaaaacatgggtttgctggattcagggcagactagtcccttaagatgataattcttatttcagggtttctttaaaacattagttttgctaaggtgtaatacaagtgtaccacgtttacatagaatttaatgaattagaaggcactttcacacataatgtatcatggagcgactctgttataggtttttgatgcagaaaaggaaaactggtttcagagaaggtgtttttcatcaaagtcattcagctagtaagtggtaaagaacaggaaagaaccatagcttctcacccctggctaatcattctttctcctcttgtttttcactgcttccttgccaccaatacaaaatgtgatctagtttacagggggacaaattcaattaacaaagtacctttaagtgcagttatcttttgacagagggaaaaactagtgcctatcaccttctcccctctgaagcacagctcatggttctaggaccaccctgaccagaaggaaccagaaacaggtgacagttaaggcaagtaccgtctggtgaaagaccattacgtatcaagtgtttacaggaatcccttctcactgcatggttagcccatcctgactggcctgtgtcatgctggttttgaaatatttggaatatcacctccattgacaatatggtactaattttatcataagaagggggtgggttgtggtgtatggacaaacaaaaccttaagattggctcaaagattccaatatagtctcaaaaccaaagcattccacagcttcatcagcaggtggcacacatagccccataatcttattctaattttctcatttccttgattctccgccattgtattcattcttttatataacatctccatcccaaaaataaatagcgctgtttggaggttcttctgattcttaacaagaaagaatcatcataaaccaaaaatgttctgccatatgcctaaacctggaaattcattttgcaaaaaaccaaaacaatgaggttaatcccacaaatactcaactattttatatcattagaatcaatttgattaaagtgctaaaataatttgcactttcttcaacttcataaatctttctgttacaaaatatacctgatagatcccatttatttgcttattcatttaactattacatttcttttcctttgcatgctgttgcttaaaaatgcttaacatgcttagctcactatttaaacagcatggaacatcctgacttggctagtattgaatatactgatccccacaccccctaccctgcaacacatacacagttattaaatgttgtgtatttcccaaatcttccgggtattttaaaactcagtgttctcggaggtcttaaaatgcgactctcacccactttttcatctccttacagacaacgtcactgactcattcttagcttattataatcggccatttttacttcccttttcaaagatgccaaaagcaaccatgagctcaaacatgttataattcttgtgaccactgtctgctacttagttcaactagtgtgtcaacatgagaccaaacattagggtcagacaagggagatgtacactgaacagaactcgccagtaatgagctgtcatgaaggactattaaaaaagcaagacccaatttgctgacacaggttctaagggtgtgaaaagttggtgtaattgcccaagacagaatttatcaggcattttttaaagcaaatattttatgagaaaacatttttatagaagtaatgatgccctttaggaagtgtcattaggacatactcttgcaaatctggggtgattaaaaagcacttagtagctcagggcctctggtgtgttgtgatataaaagggtgggtataatgcacacttcatgtgtcatttgcttatctaggcagggctctgatgcccgtaacagtgccaaggaaagaaggttgcctccactgaacatgaagagaccaggaaagctcctgtgaaggtaacaaccttagaaattcatcagctaaaagcatctggtggaaaatgttaaagatagaatatgtagaaattgagaaatgcttgtacaagaggaaaaatctaccagaaatcatcctcctaagagcctaggtatgtccaactgtttatggaggtattatgtaggagagaatggtgtaatggccaaaaacacagcttggaatcaaattgcctgactttgactcttggcttttgccactaaatggctgcgtgaccttgggcaagtttcttaacctttctgttcttcatttgcaaaacggtaaaaatcatttctaggcttgtttgaatggtaaactgagtttatctgtgtaacgtgcctagaacagagagcagtaacagcttttattagccactttgtatttggtaggaaatacaattgtacaatttgacacttgcttacagaacccagactcttccttaaattagctccatgtgattagtatggattggtttggtcagagaaatcataagcaggtggaattgggattaacaagtaaaacgcacccttttccacaacattttctgtcattacaatggcacgaagtaatttcccttctttgactcctgcaacctcttcctgttctcatgcctcttctttctctacccttaaatgtcggaattcccccaagctctgtcacagcatgttggtcaccttcttcagcattttatcctctcctagggctccagcaatgacttctttgctttgactctcaaatctcaactgtcagcccaaatttgctccctcatttaaaactcccttcccctggcgggggacggtggctcatacctgtaatgccagcactttgggaggccgaggtgggcagatcacttgaggtcaggagttcaagaccagtctggccaacatggtgaaaccctgtgtctactaaaaacacaaaaattagccaggcgtggtggtgcacacctgtaatcccagctactcaggaggctgaggcaggagaatcacttgaacccaagaggcggaggttgcagtgagcagagatcccaccagtgcactctagcctggatgacagagcaagactctgtcgaaatgaaatgaaatgaaatggaacaaaacgaaacgaaacgaaacaaaactaccttctctcatccttgagtccaacatctgtgggcagccttcatgaccatctccaactagatttgaactgtatcaagctccatttccttcccagtaggacacacgttcctcttccatgagctcactacatcatcaccctctttcttaagctcacctttaaaatacctcttaatatactcccacctgactgccagcatcctagtccagaccttcacagttactgtgcacaggagttttctcctacagacctttactgattaccttgttctaggcactgaggttctgggccccacacatgggttcttcctcctaactcatcccagaatcattgaccaacacttgcttttatttgtatgaatgtctgagtagttctttgggggcagggggaagtattacttttcaaattttgtagggctagtcaaattttgttctttttttttaagggctaaattaataagtactttaatataaataatctcatggatttaggatatcatacagctgagttatgtcagatactttgaccaacaatttgcagataaaagcacattatttgaataataaagaaaagtggaaacccaatagggagaggttctatatttatccaaattaaaaagattaattttcaatacatagactaaagctgtcttaaaagaatgttcattttccacactcccaggatatagcggtggtgggcttatgcgctactaggaaggaaagaaacacagctacttcaaaaatccaaccccaaccataaggagcagtgatgtgcgcacagcagctaggttagatcaagggaagaaattagatttctaaaacaggttggatgaagtagtttattgacagtactccctccatacccagcttatcaccctttcttgttttattttattcctatgtcactaatcaccatctaacacgctacctatttggattatttttctgtttattgtctgctgctccctgcccatggctttttttaaaactgagggcaggattttttggtctattttgttcattgtttagaacagtacctagcacatagcgccaatgttcaataaacttttgtcgaataaataaatgtgaaaggatttcccttctagtggatttcttttatatgcaatactgtttgtaaaactcttatggaaaagaggacgctcataaattactttaaaaaaacaacaatagctctgccactttaagagaaaattcttccaaataacatgattcttgaatgttaactgtttgcagaggagaaaaaggaaaaggcatgtgttttgtgcccacctttccagagcacacctcagattcattcctggtgcttctgacaagatcataaggaccctgttgttcaccaaatatgaagaaacatacagcccagctagttgttcactgaagtcagaggcagcaagagcaacaaagaaaaaggcaaagtaaagatgctaaaattaaaaatttgtcttggtctgtgtatgaaggaaataccaaatacacattcatcctgatagtagattctggtctaacatgcataattatagcctgtcaaggacataatgtatctctaaagtaattcatgcgtctgtttttggaagctctagtaatacattgctaaaaactctgtaattccatcttcaatagggctttgtactacaacaacctccaaactaacctgcttgctgttccagctgctattttgatgactttctttttgtggcataggaaggagctaagttttccatattaagaatgcatatattaaaaacaaactaactacaagaccttcttgctgttccagctgctattttgatgactttctttttgtggcataggaaggagttaagttttccatattaagaatgcatatattaaaaacaaactacaaagccaggccagtggctcacacctgtaatctcagcactttgggaggctgaggcaggaggatcacttgagcccaggagtttgaaaccaacatgggcaatatagtgagaccttgtctctaccaaaatattttaaaactcagcaggctcatgtgatggcacacacctgtggtcccagctactcaggaggcagaggtgggaggattgcttgagcccaggaggttgagctgtagtgaaccatgattgtgccactgcactccagcctgggtgagacagcaagaccctatctcaacaaaacaaaacaaaacaaacagacaaaaacaaaaacaaaaaccactacaataaagcctcctcaattctaagacacgttactccttcaaataaaactgtactgacaatattttaaggtatcctatcgagtatatattaacataattatcttttctgatacaatgaagtggaaatactctgtcaccccttcaagcaatgtgtactatgagtcaccaaaacacatgcaattaggtgacaaatactaacacctagaatattttaatcaaatatcactaactgtaataatggtggaaagtaaggaaaaggaaaattaaacatgggcaataggatggtagagttgaaagatgtctaaggagtcagaagcctcaggttaaaattctaatgtagttacatattggctgtttcatcttgggtaaaagtgactgagcacaccccctatgccagccaccatgatgggccctggatgtaaaaaggtgaaaaaaaaaatacaattcctttgctggaaaagtatattcacagggaaagttctaactcacaatactaaacatgtagttctaaattttaacttaaaagctacagaacccatttataccaaaggtcagttaatccacatgaattgctcatgcttaaacagcatcaagggctccttcctcttcagggaataacaccttaattttctcttgcggacccactctcggtccatgtggtgtgcatggagctggcactcccctacgtctacccctccaggtatgggtatcaaggctgactaagtggaacatacaatcccttagtcacggggactggtccagaaataggcagtcacacaagccatgctaatgagatgtaatcccagaacttttgttagaactgctgcaaagaagatagtctgcattccactgggaatggcaggctatgtacttggagttgctatcttatcaccacatgggaaaagctgactttgaatcataccaagacagaggaaaatagagtcgagggatggagagtgacatattcctggagatgccattggaacatccggattcatccatttctaaatccctaatacaccggacttagttacttcggtcagtatggtctccattttgctaatttagttggagttggatttctgtcacttgggatcaaagagtcttgtctaatactcttttttaagctttagattcttgatctgcaaaataaggcagttgtgtctctaaaattccttacagttctaccattctgttacagtactgaatttaccaatttcactgggctgctgtgatgatcaaattagataataaataagaaagcactttgtcaattttcaagtgctttacaaagagtacgactggctatgaaaataatattcaaatatatgtgtatttgtgtgtacactgaaaaattaggaggctccagagtccattccatttgtaatatagttatataagaagcatagactcagaaaacaacaaagaaaaaggtctcactcttgtgcttctctcttaggaaattcacattttaccaaatctcaaaggtttctgctcataatatcttgtcttcctaagttcattaccaaaacccagaagggtccttttctttcacttaaaaaaacagtgcctattattttccactttatttccataaaaatgacattaaagtgctccttggggatgttttgcaaacactttcaatcaccaatcactgactctgaaaaaaaaaaaaaaggaaaggcattttattttccttcaaaggaggaaacaaccctctaataatgtctaaaggggaaaagggctctataaaaatgggcgccgtgaaaaaccatggaaaagataaaagaagtcagggttgaaggacattcttcactgggtctcttcctctcatcaggcaccttcttaacatccaggtgcacaagccccctgcagtctagcaagtacaccttccctttcaggtctgcacagctgcacagtcaggcaagcagctactagagggcagcaaaggatcagaaatgggagtgcagggctcaggcaggctggctgggaactgaccagacgaccaaattgaggccagatacttgaagacaacctcggtccagtttcccatcaaaagacaggaaggatcatgggatccctctaagttcttagatgagtataacaaagcttgtgttgacagtaatccaaaaatttagcacagtatctggtgacagtaacagaggccgagttgtcaagaaacgaggggcacatgggaaagccaagggggagccgaagtccaggaaaagcaggcggaaggtcaggggaacctgggttctggtcagaattctgggaaccaatcaagtcaatcattgtcattgtcatcatgatcatcatcaacatggctagcactcacttacttctctgtgtgctagccatggcttaagtctatatatacatttcaaaaggcatatgcaggagaaacatttttacctagctttactgaggtgtatttggcataaaataaaaattgtatatattcaaggtatacaacatgatgatttaatatatatatacactgttaaatgaccacaatcaattaacatattcatcaccactcagcattgatgtgggtgtgacgggggtcatgagggtacttaagatctactctcttaccaaatttcaagtaaacaatacagtattattaactatagtcaccatgctgtacattagatctccagaacttattctttttgtaattgaaagttcgtaccctttgatcaacatctccccatttcccccactcccagacctctggcagccaccattttactcttttatgaattggacattttaatgtattgtaattttaaaattatttatttttatttatttatttatttatttttgagacagggcctcgctttcttgcccaggctagagtgcagggatgtgatcatggcttgctgtagcttcagcctccagggctcagacaattctcctgcctcagcctcctgagtagctgggaccacaggcaaatgccatcacacatggctaatttcttctattttctgtagagaagggctgtccctacattgcccaggctggtcttgaactcctgggctcaagcaatcctcctgccttggtctcctgaagtgctaggattacaggcgtgaaccaccacatccagccaaatttgacttttttagattccacatataagtgagatcatataatattggtctttctgtgtctggcttatttcacttaacataatatcctccaggctcatctatattgtagtaaatggcaggatttccttcttttcattgctcaataatattacacacacacacacacacacacacaccacatacaccatattttctttatttactcatttcttgatggacacttaggttgtttccacatattggctactgtgcaattaacacggagggtacaggtgtcttttcaagatgccgatttcatttcttttggatatatacccgcaagtgggattactggattgtttagtactatttttaattttttagaccaagcacgatggctcatgtctataaccccaagaatctgggacgtcaagtcaggagaaccagctgagctcaggagtttatgaccagcctaagcaacatagcgagaccttgtctctaataaaaattaaaaaaaaattttttcaaaaaattttttttaatttttattagagacaagttctcgctatgttgcttagaaaaattaaccaggcattgtggtgtgtgcctgtagtcccaggtatccgggaggctaaggcaggaggattgcttgagctcaggagtttgaagctgcagtgagctatgatcctgccactgcagtccagcctgggcaatagagcaagacccagtgtcaaaaacaaaacaacaaaacaaaaaaacctccatactgttttccataatggttgcactaatttacatttccaacaacagtgtaaataggttcccttttctccatgctagccagctatgctatttgctcaacccaagaaatacaagaattagtcaagggtaattttcattttatgagatttttgtttcatgctttaacttcagaactaacctccaccactcaactccagtgcaaccactactaaattcaatgacttctaaaccaaaccttatttgtcacttctcatagtcaaggtttttctttaaggaatgtgccttcagtcatttgtatctgtggtcctggtggaaggcaaaagcacaaactattagaaacattgggtttgttcaagtgctgtgatttgtgcttaggctgaataagaaaaactatcaaatgaatacactagaggtttcttccataaagcaaagggaaaagtctaaatatttcattaaaaatacaacagggaggaatttactttcaagtttttacaaggaattaaaaaatacatatacttttccaaagttagatccatcaacttttacctttcttgttatatagatctctgaatggttcttaatggttgcctacgttatcaagcctggaattcgacaatgctcccaccatgcccttgtccactcattcttccgaaagtttggttctaagtcccagtggtgaatgaaagtgtcctctttacaagcatcttttattctaaagctacctttcttttgcctttatatctaatactttatttttagaaatgacattaaaattagtccctaggaagagagtccttccatagattctctctcttaacttgtttgcgtagggaaatgcaggcgcttaattgatcaaaagggactcacagaaggatgaactattttgcagaagcatgctaatggaaatgcaccaaccgctaagacccactgctcacaggaagcatcataaaactggtgagctgatggaagtgcaaagctgtaaagtaacagccaaatttatctttttttaaaaaataaaaggtatcttccaagtagaaaattagagaaccatttgatataattcactgcatttgacagctttggagtagatttataccctgcttttttcctcccaccttcagttttccattatcaatctctcagcagggtttggatttcagcattggcaccaatagacagaactggaaacaagtgcattctgcaaatcactgcatgctcccatgtcataatctcaattctcattcctcagatacagattctaggttgcagctgcagattaaagtcaattctctaaaattacaactgtaatttctcacttatttcaggagttccaattgtgtaaccctgtaggaagtttcactcatatgaggaagttcaaatgaaacagaaatttgagtggagaattaagctgtcccttccttttttggcactgcgtctacatggcatcttacaactctttgattgctgtgatgacaggcagggccaaactagtcaggagacaaaagacaaggccatctatcaccattatttggaaatttcatctagcaaaggatttatgatctgttcattttggaggagatttaaaaaaaaacaaagattgaataaagtatgtctggtgatacatgaaaatgagatgatgagatggattttacagaagacctggggctgactgcatttggtcagaagtgccacattgtcatggcagagaggaggggatttgtctaggaccactgagcaccacagctgagagttctttgaaaaacaaccagtacccagagtatcccagaggcagtcaggacagcacagtgataagagtgtgggctctgggaccagactgcctgggtttgaatctaggaaatgagctacgacaagttactaaatattcctgtgcctcagtttctctagctactcataggattattacagaattatttcgtaagtcatgacttgtgctgaggagtcctgacctagaacagtacctaacatataacaaatgctggaaaccactgtaacctaacttcatagggtgttgagaatgttacaggagttatgaataaagtgtttaggatagtgcttgatacataaaaagtgctagggtgttagtcattattactatgaatgttgttataatagtaaccaataattagtagtaccagagttccttaacatagtatgtcccaagagagccaggtcatgagcttatgaatgacagggtgatgtctaaactcaggttatcaaactggcagctccagggccacacgtgacctgtaagtacgctcgttttgcctgagctatgtttagaaatgttttaaattatttgcacacttcagaaatgtctatagtttatttaaagttatgggtttgtggattctctttaaaaatcaagagctcatttcacattgggcctgcattcccgcatgcaactctcagttggggctggacaatggtggcctctttggatatttggggcatacattctccaggtcaccccagtccccactagggttccttcattcactgttatctgcctggcccttgtaggcacctgagtttgctgtccttctcccttgaatctattttaggccttccggggtgatatgctctcagacagaatttttttaaacacattctgggcccatctgagaatatgattttactggagctctccccggtaaaatgtacacaaatttatatgctcacatgacaactgcaagtggaccacggactccctaaagcccattcatgaaaaaatttcctgttttatgggtctattcatggacaagaaaattccattaatcctcattcttcattagatcactattgtatcaaggcgaatcccatgattttaaaaatagaaattatacagatacataaaatgaaggactatgctcaggaagagtaaatcctttgaactgatgataaatttagtggttgatttgattgcactcaaatttggcatctttataacaaaacaccacaccaacttgctatctaatttcacctcctaaacacttctcaattctgctacctcttctccagatttcttagcactctcagggccactgccagcccagacggtactattatgagcatcagaaacagcatctcttcctcaagacattttactgccatctgctggggaaaatgtgtcatactaactacatagattcatcacatctaagatgagaatgccacatactagacaggggtccttgaggagtgcacacctgcagaacagtttccagcatgatttgagttgtgagcatccctgacatgggctaagcatttctacttgaggccattatccagaggaggcagcagagagtggccattatgagctttgtagttttgagtttttaaaaaacttttttattttgaattacttttagacttaatgaaaagctgcaaaaaaatgtggaaacagagagtttccacatatcctttacctcttccccaaggagatttcatcctataataataaaaacaagggtttgaatcatgattctgataggatcttggcagatgggcacagtgccagctcacagtaaatgctcagtacgtattattatatgttgttatcatctgctagcatcactttccttaactataaatgaagataataaaaatatctagtgtgaggattatgttacattattagtaaagtatttagcatagtgcgtgataaacagtaatactattattgatattgctggtgatattaacttattatttctgaggtctaatattcttccccaacccacagtcacctagtacactgacatcctggttttctaagtataaaattataagtcattactattcctgagatgcttccatatcccagggaatagatgctggtaaccagttcccggattaccacagtagacatcccaaagatcaggaaatacccagagcctaagggcagagctagttgcaggctgagggtatggctaagtgagatctccttttgtgtcttatctgaggtccaacatctctctgaagcactaaagtcttactgataactgttgttgttataatttcataaaacaaaggcaaatctttttaaaataaggaagaaagctttttattcccacttccaaatcatctgtctctaaccaagtcataaagaccatcaggctgccagtgcagtacgatgtgttagatgttcaacaggagttcctagaacaggctctacctcctctgggtggagaagtggggctgaccatgtgtgaggaggagccttgctcatagggggaagacacttttctcaaagcactcctcaactgctgacccagcatgcaatctaacctgttttttttttttttatggcatctgtttacacaaattctgaccaggtggcaaattcttcccctctcctgtcagccacagtatgctggacagagaacacctgttccagaagtggactgattagcccaaggttgggatacacagcacgagctatgggccacacgagaggaggagatcctgtgacttgtcggtggttggctccactcctcctcttggccctagtccatgtctaccactaatgggattgatccatgggcataaatctgaaagcccttgctaggcaggtaggaggttatcttatccaaaactgctacagtgttgttgctagctgaaagcaaatgtttcaagcactggggagggaactagaggtacaaaattgaggttgataatcttcgtttttaaggagcttcttggggagggcattggtgaaggtgatagaatggaataaaaatatcacttaatgaatatcttttctgcaatgtcatttacatatgcagggtatctttaaacaagtaacaataattcagtggaatatcagctttattgatactatcagtaggatgtgtggatgcaaaagggagaaaacaaattagtgagaagaatggataaatgaggcagtaggaaaggttcacagaggaggtgggactggaggtggattgtgaaggataactaagagtctgtccatggtggagcaggcaaatattccaggagaagaaagaactggtagcatggggcaaatgggaatgaagcttgaaagaaaacggaaaaactaaatgaagaggggaagagagaatcaaatcacaatataggcataaaatggaataagctaatgattagcaaaattactattatctcaaaaccccattttttttttaaaggacaactcataacacttaccagctgtgccactctttagggtactttcacatctcaagaatggtcctttgacccagtagacatacagaaacacaagtcaacctattcatttctctcaatctacagaaaactctagctctgcaagctccttgtcatttgaagaatttgattcctgatgagtaagttgctagcctaaagaaaaataccaatctaaacattattaaggacagtgtaacaaagaagacattctacaaattctttattcctgatagtcataaagaggctacaaagagaatgagttagagaaaggtggaacatactcagcatgaaaaagaaattttaaaaagaattatggttaggccaggcgtggtggctctcgtctgtaatcccagcactttgggaggccgaggcgggcggatcacaaggtcaggagatcgagaccattctggccaacacagaccccgtctctactaaaaaaaacaaaaaacaaaaaacaaacaaacaaacaattagctgggcatggtggcgggcacctgtagtcccagctacttgggaggctgaggcaggagaatggcgtgaacccgggaggcagagcttgcagtaagctgagatcgcaccactgcactccagcctgggtgacagagcaagactctgtctcaaaaaaaaaaaaaaaaaaaaaaaaaaaagaattactgttatagattttgtgatccaagagggatgttaggcagcctgcacctaatagaatttggtagatgcaaaaaaagttgcttgttgaataaatgactgaatgttctacttcagtggtttataaactgtgcttcccagaggtggttctgggttctgtaaagcacaaagtaacttctgtacaacagtgaagtttcaaactactctgaagacaagtgtgatcccagtgcctgacatatagcaggtgctttataaacatttggtagtgaatgaatgaaggaacaagcaaatgtattaatggatagaggaatggaatagtttgaactttaacaaccatgaacaaaaggactaaaatctaaagggaaaaaagaccaattttccttctctcctgacctatctcaaactccatccttgctgtaacttatttccttttgcatcaagggaaatataaaaatgacaatgacctttccctcacatcagagagaggtggaaagaataaatatgttaatatgtgcaaagcttccagacttccttagagagagccactacaggtattaatttaattattatgagcttcttgcagaaacacagctgttacacctttaaacaaaccatttttgataatatttcagttatcttcaaacagaaggcagaatgggctagataaccatagggaaatggccgacaacacaaatgcacctggccctcagctccagactcacttggggctcaatttggggcagtcacacatttgagactactttttaagatacttttggttttgtggtgaagggctgagaagcgtgctaactggctgcactgagctgagtcaggcacagggatgaaactgatgcctctttctctgtccatagacagctccaaatctgaactaaattccaggagagaaggtgtaaggaagtgaaaagcaacagattcgaaagtatttttagtgggttactctctttgtaggaagttctggccttattcaaactatgtttctcatgtctatatattagacaaatggctctaatcagcaaatgcaaatcaagaccccctcaacaaagcgaagtgcaacaagaataaaagcttattgatcctcttgttatcgatctggaccatatatctagatttctctgtattctacaactagaaaaaatcttcagtatgcagtattaaatacagaaaagaattacggttacagtatttgtgatcctatatttgtagaaagcaatatgctttctacaatatttacaacaatcagagattaggagcttgaaaaagaatggagcacattgctaaatgagacttgtgccaccagatatggaggttcatgagatttgtctcaaaattcttctcttcaatcaatatgtatctagacttgaacatgcactgaaaagaattaacatgtcaaaaatgtaaccaggagtgaacaaagtaactaagatcacaattaattgtacttaatttagaaagaaagtgttttttacctgtcaactatggggaaacatcactttttagtatcaggacgccttgtgtttttaaaaaatatttgttgaagagtaaaagctgtacctgtgccttattttcatttgcacacaggatgtaaacacttgaaagttccaccatgaacccacattctacacacgcaaggcagaacttcacaaatgcttcccaggacagctctttttcaactatttcctatttgtcagtttggccaccaacccgcaagtctcctaggctagaaatctcggcagagttattttctcttttcttgccttcctccttccctgtttcttgtttgttcggtgaagataataatagtctggccccccacctcctttgttggctctagggtggtcctcccaccccatcccctccagaggttaatatgaatctacctatcgtatctagctgctctggaagcccagtaggtggaagcaccactcaagtcctctaccaatgttaccataacaaacttggttatttctttctttgactttttaaagcacagtttctggagtaagaaaaactgttcctactgtatgattgtgggcaaactcatattttcataagtggggaaaacagcagcctctacccttgcagcgttgttgggaggcttaagtgaagttctcagtcatgcagcaggctcagtaaatgccagctgttgctaccattactatcatctcctgtctattctcttctcacatcatccagccctcatccacacccacttcacactaggttaccacatgtgtcccacaagcagatactcatgactaaacaccatctttcccttggagtactggatactggatacacaaacacaaggaacagcctttactcttaaggagggtaagtctagtgtcccagacagacatatatagataattaaaagcaaaaatgcagtaagttagtacctggtggggcttctgtggttcaataactaacatttcttctttcttatcaaaggtcagaaacaacagagagtgatatggcttggctgtgtccccacctgaatctcatcttgaattgtagctcccataattcccatgtgttgtgggagggacctagtgggagataattgaattatgggtgcggtttccctcatactgttctcatggtagtgaataagtctcatgagatctgatggttttataaggggtttccccttttactcttccatttgctcttgactgccaccatgtaagacatgactttgctcctcattcgccttccaccatgattgtgaagtctcctcagctgtgtggaactgtgagttcattaagcctctttcagtcttgggaatgtctttattatcagtgtgagaagagactaatacagagaggtatataatggaatcaggcagatggcaagcaaaatatctcctttgttactaataaagctgatattgaagaaagtggcttagtatgagagttcaaagggctgaatggcacatccttactcacagggacttaagctgctaatgtcactagcagtgctgaacaaccacatccacctgcatgaggcccgccctgtagaatgaagggcgggaaggagtcaaggagtaccagctcccaaagagaagagagagggaggaactgagcatcacaaaggaacacattagatacctgagtccacctcctgggaggggcaagtcagggactagcatcatgcagcaaggcagggagagcttctcttcttctgcccaatcattagagattcagagtattgtagtagcagcagaagtgagtatacaacccagattgtggtgggggctgggggaaaccagagaaggaactcctgggggagtctcaaaggataaacaaacgttaggaaaataaagttagagaaaaggggaaagatgttccaggcagagggaaaagcatcagtgaaggaatggatctgaggcatggtgtgatgtatgctggagcaacaggtgctttgacatttctggggttttactaaaagttcagcctgggagtggcaaagcatgaggctggggaggtaggcaggaaagggatgggctgcggagcacatagagtggcatgttagagagtgggctttatcacaggtgatgggaaccagtgccagtggcagcttttttttttttttttaaattaagatttggggtttcaccacattgcccaggctggagtgcagtggctagtcacaggcatcatcacagctcactgcagcctcaaactccttggcttaagtgatcctcccgcctcaggctcctgagtagctaggatgacaggtgcatgccactgtgcctaactcagtgaaagcttttacccagagactgtgttttagacacactgctctggtggctgctaaggataggctgggggggagaatatcaagttagcttggaggatattctagtactgctagcaagagatgacaggggcctgaaccaggatgctggtatcagggagcaacaagacaggagggatttgagaaatattttggaggtatgactgacagaacttaggaaatgctttattgctgtctgaggctttctggctccatgatgtcctctttccaacccattctgaatcccccacgggctgcctaaggtcctgctatgggtcagccactatgctatgtgcttgacctacatgttcatcctcagactaacctcatgagacaggctaacctcattaataactcctgtctggcagaggaggaaacaggtttggaaaagggaaatctaagaagacctagtgaatagaagattgggttggaattcatatctaggtagtctgactccaaaacccgtgcaactaataaacacaaaccctcccttttctacacacatccattatggtcctactcctctactactttcccctatcacttgaattccaaagtgttcttctgggactcctctgcctcaccttaccccttcctcctcttcatagctgcctcttagccattgcttactctgatgcttttcctttgagtagctccaagctgcacgagtactttagctcaactactttagtagaattactttaataacacaaaaatacatttattttgtcaataggaaatatatgtacaaggtacaagacataaataatgtaactggaaatacagtaaaaaaaagtaaatcctctccaagatcctttctccagaggcaactactgttatcagtttatgaaatacatctggaaagatgtacaagaaacataccagaataaataactgcaagctctttaggctgcccatagaaaggcttctccaacttctaccttcaccacttttttcctcctctggattcctcctattatccacagtgcagtgccccagaattcagcacacaattaacctcaagttgtttcataaatataagccatgtctccttaacagcaatggctcttacatactaatctgagcattagacacacagtaagtgttcaataaatacctgctgatcaattaagcttccttgagttaaccctacacttgcttaaatggcgtatttcatgcaaacctttagctgaacccattcaaacagcctttacaatgattacttttgcagtagctatatacttaattggtcctcactctctttttagaactctaactgtacaagcagttgaaagagtgattttttaatggatgctgatgttatagtgaatacagtcattcagaagtctaacacattcaagtatcacagagctggtcatgcaacacaaattccaatgccactcagaattctggtcataaacgatgagaaaaagggagtaaaaatccctcctgtattacccgaagaacagtattatttctgccattttaatctgtttacactaggctatatactctgttgggctaatctttaaatattggccttattatattcatgatattccattaaaaggcaagcaccagatgcatttaatttactcttcaggggtatgattctcagataatctgtcagagaaggaccaaatgcttctttcactgtgatgcaatgatatttctatctaatagtgctctagaattatatttcctccccaaatttgggatctcttatgctaaattctctgcttttgttctcttgacagttttcagtcagtttaaatacctagagttctgctttcaaggtaatagttttttgatttttatttttaatgacagcaaaagttctatgaaagagttcatgtatatggcttgctctgtgtattttacaagcccaaagaaaattacatttcagagaaggtacatatccaattactaggaaatgagttacaacaaagtggccacagaagcagtgtaataaagacaacctcaattaaaaagtctccctaacaaagcaaaaaagagacacaatgcaatgcacattaatagcttactcaacacctaaacacagagtgggtgacaaaaaaggaaacgtctctctggtacaagttaatgaatcattctacttaacaagaggaggtctagaaaggggtaagggtcttttctgcaatcaatagaaaggagcagttagaattcaagagagaaaacaatacagtaatcttgggaaatattattttagacaatacttgttaattttaaatagttttaaagaaacaccatgagataaaagaagttaaagcaagcatatgtattgtgccatatacaccgtactgatgacagactgagctcctaccttcacgggacctttggaagatggacatgtaagtcactgcagtgttgggacttccaggatagagtctgcaacattgcttgaagcacagagaggagatctaatagccgggagaaaaggagtagagcagatgagggttctaggcatcagcaaagatatggtgccttgacagggactggcccacctggagtgtgaatgtgatctactaaggcttaagtttgcttgcagtgtatgtgtgtatgtctgtgtgtgcatgcacgcacatgtgcacatgcagcagggagagtggaattaaggtgaaagagtagtggatttctaagaccttgccaaagaatctgaacttcatcccaaaagtcatgaacttcagaaagattttaagccagagaagaggcatgataatatctatattaaaaagacaatcaggtagcaagtgtggaggatgcatgggagagggcaaagggagaggagggaagatccgctaggaggtggaggcaatcattcctgctgtaggtgatgaggaactgaaaaggagcagggctcatgatgggtggaaagaaagtagagatccaaggaatatgaatgacagaggatcaacagggcaactgacactgatgggtgtcaggagaggaagaaagaagagtccaggatgatgcccaaacttgatgctttggtgactggtgaagggtggaacactcattcacagaacaagagataagcaaggagaagcagccaaaacaacaccacagatatgtaaaattaagagtatcaactttaaacaagagccatgggttgggtgacattatgcctactagacattaagatatattacaaatccatagtaatgaaaaccatgtgtgtggggtggggagagggaaatgaggagttagtattgatgattgcacaccactgtgactgtaacagatgtcactaaattatacacttaaaaatggttcaaatggtaaaaataagaaaaagggaaggaaaaaaacacaagtgacaaaggtatgagaaggtacccatgtgtcaataaaaaagaatagatagacctaaagcagatcccagaataaaaagaatatagtagatgacaataaaaggatatatttatatcaaagatatagatggtgaaattgactaactactccaaaatatcaatttacatacatcacacaaacatcaaaataaactttagtttgataagcataacatgtaaaccaaaagaacataaaatatctagaaaaacatttaggtgaacatatcatcttttgatgaggaaacattttcaaagtattaaagcaatagaagaaattattaaaaaacagatttttataattaaaaaagctaatgttaaaaattcaaatgtaatcagaattgtaaagaattttatataaataagaaaaatgttaatattattctataaagaacacatgtggatcagtaaaaagatcactaacaagcaaatggaaaaaatggacaaaagatgtgaagaaacagtgggggtaaagaatcaacacaaataacaaataaacacatgaaaaactctttagtatcacaagtaatcacagaattgtgaaacagaacactgagatgtggttttcatctattaagtgttcccaagcactctgcagaatgtgtacccctacaggtggcaggaaagaggttaacagagtatcactttcccagagagcttaagaaccttaaaaaatgtttcttttctctcacccattaattacattggaatgatttatcctaaagaaacacagccaagatttttctatatcatttttcttcttgcttaaaaataaaagcacttgttgatcccttcctcccattattcctctagataattcctccatttcattcaagtctcagcctgtctctgaaccttgattgcactgccatctctcttgtacactgccatagcatcctgaagtcctcttcatgcatcttattatgcttgttctgacaatagtttgtctttctcttgtctagatgtcttatctaggcagtaagctccatgaaggtcttctgctctattacaatatacccatcaattaacagagcccttactacaaagtacttgttgaatgaagggatgcattaatgattagtaagaagtagggctgaaatcatttttacttttcttttttccctaagattccatgacaattttatgggacttttctattaagaataacagcaatggaagccattcaaaacagcatcctttcatacagttcacccactgaactaaaagtcaatactctaaactgtgaaatagttactatgtaggtaaaactaataaaactatccatttaatgctacaaagagaataaaatacctaggaatacatctaacaagggatatgaggagcctcttcaaaaagaactacaaaccactgcccaaggaaataagagaggacacaaacaaatggaaaaatgttccattctcatggacaggaagaatcaatatcgtgaaaatggccatactgcccaaagcaattcatagattcaatgctattcccatcaaactaccactgacattcttcacagaattagaaaaaactattttaaatttcatatgaaatcaaagaagaccctgtatagccaagacaatcctaagcaaaaagaacaaagctggaggcatcatgctacctgatttcaaactatactacaaggctacagtaaccaaaacagcatggtactggtaccaaaacagacatatagaccaatggaacagaacagatacttcagaaataacaccacacatctacaatcatctgatcttctacaaatctgataaaaacaagcaaaagggaaaggatctcctattcagtaaatggtgttaggaaaactggctagccatatgcggaaaactgaaactggaccccttcctcacaccttatataaaaattaactcaaggtggataaaagacttaaatgtaaaaccaaaaccatgaaaaccctagaagaaaacctaggcaataccaatcacgacacaggcataggcaaagacttcatgacaaaaacaccaaaagcaactgcaacaaaagccaaaattggcaagtgggatctaattaaaccaaagagcttctgcacagcaaaagaaactagcatcagagtgaacaagcaacctacagaatgggagaaaattcttgcaatctacccatctgacaaaggtctaatatctagaatttacaaggaacttaaacgtatttacaagaaaaagacaaccccatcaaaaagtgggcaaaggatatgaacagacacttgtcaaaagaagacatttacatggccaagaaacataaaaatgctcaacatcactgatcatcagagaaaggcaaatcaaaactgcaataagataccaagtcaggaaacaatagatgctggtgaggctgtggagaaatagaaaggcttttacactgttggtgggaatgtaaattagttcaaccattgtggaagacagtatggcgattcctcaaggatctagaatcagaaataccatttgacccagcaataccattactgggtatatacccaaaggaatataaatcattctaccataaagacacatgcacacgtatgcttattgcagcactatttacaataccaaagacatggaaccaacccacatgctgatcaatgatagactggataaagaaaatgtagtatatatacaccacgcaatactatgcagccataaaaaggaaggagatcatgccttttgcagggacagggatgaagccggaagccatcatcctcagcaaactaacacaataacagaaaaccaaacaccacatgctctcactcaaaagtaggagttgaatgttgagaacacatggacacagagaggggaagaacatacaccaggacctattggtgggtggtggctgaggggagggaacttggaggatgggtcaataggtgcagcaaaccaccatggcacacagatacctatgtaacaaacctgcacgttctgcccatgtatccctttttttttttaagaagaaataaaggaataaaaagaaaataattactaccacttaagtttgaacaaacaaaaatctatttaagatttttaaaaaatgttctttagtagggaaaaaataaaaacaaactcagccacctttcaacttgcaaactggctccccatgcataaagctgtccatgttatgttcacccttctactctgtaaccttctactctgtccccaaagtccacatgctcttagagacttccaaaattagaagcttcaagtcttctaagctgtagctgtttctctgagagcttcccataattggcccttagatagtgagatctaaggaattatttattattactgctgatttacacacttattttgacaggttaaaacataccatgtaagtaagcaacatgaataaaacgttgcttacattcagtctctaatgtacgatttaaaattacaaacacaatccttcttctctgagtagcagtgacagaccttgtgatttaactgtctgcgccaatcactgactaaaaaaaaaaaaaaaaaaaaaaaagatgtggaaaacctgtgctgggctatttagagacgcttaatgtccttggtctctcctagcacttcaagtaacacttctttttaaaagaggtaagattttttgcaagtgggggaaaagatggtagcaaccccctccctccacatccttcctgcatattcctcttttacaaagttggatgttggtgaaagtcttcataattcaaccattcctagaattattttcaatgccctgtaatgctgcgtactgaaaacccatcttttgctagaacaaggtcccatcagttttaaaatgttacatgttactgttttcctgaataataaaaaagaaattactagtgtcattaaacgtacatttgaaatgagacactatctggatgttaaaaaatataagaaaggcaggactattctaattatgcatagtactgaatgttagtcaaaggtccatcttgcgtgggagaggttattaacaattgtttaaaagaaatagaagaaatatgcatttccataatagtgtctattctaataatgctgttaatagtctaaaaggacatcttttcagaattccctgttaatatcttttgaatattctcagtgaactggtccataaaatctcagtgctctccaacataactggaatgtctcctgggacacatggatttcacagcatatgcacacagtagggagaatggaatgaggttgctcataatgcttttttacatcaataattgataaacagaattagacacagctccccaaggaatcaggtgtagcaaattacaggtaataaaaacttaaagaaaaaaaaatcctaacccctgtctaaaattttatttgtttaaactcgagctacctaatgaagagtgtctttaaggctgttaattcaaggtgatggtaaagtttaccatactagaattatattttgttagttcacttttaagttctgttaggatattttcatttgtatcttattttcttagttcgggcctaggtagaaaattaaaacagtatgtcaggtagaaaaagagaatatagatgaatatgtttatgcaaccagactaattttgtggtcatctatgatgaaaatacatgaaattaggttatatttatgtttaaattatatgtatatacttaaaaattatatgcatatactttttttattatactttaagttctggggtacatgtgcagaatgtgcagttttgttacataggtatacatgtgccatggtggtttgctgcacccatcaacccatcacttacattttaaaatccacaaactgaagtttatatttactttttctttgaatgccctcaagtaaatttagttgtggttgactccctctactggcaaaaaatgatattttttgaaaaaaaaatttttgtcaagaagttgacacgaaagaaacataatttgtaagctatcagatatattctctctgataaatattaccatgtgacatgatttttacaaccagaggaaattaatataaaagaaaagacagtagaccatcatgaattagaaaaaaaatgaaaaataagataaaagctcccacagcatttactatacagcaaataaaaagaaatactcaaaataaggcattttgaaacaaatttcagtgcttatccaagtagtcgttcagcttattcaaggacacataactttttaaatgaatgaaaaacaacatcttaggatgtggtctgagatctgtgagaagaaaaatgtttttgctcagtgtgtttttatcagtaacttcaaagaaaacttcaaaagcactcttatgaaaagggaacactcatgtactgttgggttaacagactcagaattcaaaaatgatctcaacagagtggcatatggattgactaaagagaatcccttatccatgggttccaaaccaaaaactcaaagttgtttttcatccttttcgtggcaaaacctgatctgagctggcaagaggttgtgaagtctgtatttgtcctacttagtgtgaatattttttctgtttcactgcattcatgttaacagtttgatgacagggagttgttcctagggttgggcgggggtagcctatgtatgtaacatacagtgaacactggggaaagggtactgtgttacctttcaaaggctgatagtacaagacaacacatgtgccttaaggatttctgataagagattgtgaacatataaaaacatgaaactaaaaaaagtaaatgtcagtactcacctaagtctaacaatttagcagcacaagtgcaggagcaaaagactcagatgaacagaatatttaataaaaggggatccgtttataggaagtttataggaagctgctattttttgaacacctactatttacccagacctttgctatttaggtattttgtagaatatcccttaactgggatttgtctgatatttttctcatgattagactggaattatatgttattaggaaggaaactaaggaaacgccattctcatcacatcacatcaaggatgcatactataaacctgacctttcactgcggtgatcacctggctgaggcaatggttgccaggttgctctgcagtgaagttcctctttttttctgctttcatactatattcattggaaaggagctactatgagtaacccacacataagaagtgaggatttatgttctacctctccagagtgtttttaaaagtagaagagggctgaattacatcttgaaagaagagaaatggctcaataaaataaacaaaatgcactctgccctttgggagattatgaactacttttggtaactcttaaaataataaatagtctctttaaaaaagtaagtggagcttcattgtctaaaccattctcaactgagaagtactctatggttatcctttttatgggaaacaagcaggtcagccattgtgcttctttcacatcttgaaaatgtcttattcttgaggtaagttaatatttatttgctaaaatatttgaatctggtatttaccaactcgattgatttgcttcaaatctttgtattaactttctcacatccattaacaaaatgcaggaaaccaatgcactttccttgagaatttactgttgctataacccctgagttaatgaccttaaatacaaagaagaaattcaactcccccgcccatcatgcactttgcaagacctttatgattacaaagaatcttaacataaataatgcaagatcgataacacagtaagccaaattgcatttaaaatattcatgcaattctttaaaaaaatacaaccacatattgctattcaggctaaggcctcttagggggaagagatacaatatatgaatgagtttgaatatctctgaaatgctcttatagaggaatcttccacaggcttctgcctttctggatcacttcacatagtatatgatagtagtacaaagcatagtgtttctaaaaatactagataatatggtatgtttggctcggatatggtagatttgtcttcaggcaatctgttgtgacttcatagagagtatcttttccttcattcttcatatatggtgatgtaatttaccagagcaatatagaaatagcttttggtattgatttagagctcagatgcataacctgatttagagcttgcttgctcagattcttgctattagaaaagtcttttcaaaatgtttggttaaaaaatctacttaataacaaaataatgagactatgggattttaataaagggtatccctaaaagcatccatttaaaaaggaaaaacaaacttcttaaaaatgaattcgtaattgatgcatgtcagttgtcattagtaaatacatgtctctgggaaatataattttgtaaatttataccaaaaattaaatacttttttaaaatttatgagcataattaaatcatcaagaaagttttctgaacatgatcaattttatctcaccatagatcacaaaaggttttgacatcaagaaagttaaattttgcctaagccatgacatatatcaataaagcaaaatttactgtgctcttagatattaaaaagcctaaaatatgacaggtataacatatatttatactcagctttgggattttttcttggtagaataattgagtgcacaaagatccaatccttggtaaatttatgtgtcttataaaggaaataactgtaaatccaagagcatgagtgcacaaataatggataaactaaaaatctacctaccaacaatattctttagggactcaaaattggcctgtctgggtctgccacaattagatctccatgagaaagtaggattaataatactgctaagaacactcaaacaattacttgccaagctgcgtgaacactatgggtcatagatcctaaatgagtaaatcaaatctagatcatttagttggtacgaaaagaatctcaaatgatttaggactttcatcattaaaaagtatatattcatgcaaaactaccacatgtgaaaaataaactgaatttagctatccaagaactatagtttactttttatgtagtgacaagttgtagaaaagtgacatttttaagaaacatgggtgctatcaaatcttaaaatataatacaatcatatacgtttcttaacattcaatgaaatgcattgtttccaagaagtttgaattctgatcacaatttatacttccagattttaagttaagcttggtatttaccaactggaaaatattttatattagtaaatcattatacaaaagtatggtacttttggtcaaaggtaatggatataatttatgcataaaaactaatattctcaagactcataagaattgggaaaatggaaaaacccttattttcagcatgaaacaagttaggatgtatatataggaatgttaaatgacttgtggagccaggtagtatgttcacatggctcaggttttctgcttcctctgaaatatctttcaattttgagcttcattttcagggaattgaagatgttagtgcatctttgtatagattttagtgaatctcacacacacacacatctatattaaatttcataatttttggcataaacattaaatgaagtcaaacataagcaaacggagaatatgcagatgaaatgcagtgagcaataatagtgtttgtggctggaactttatagaattgaggtcaaattataggctcatcctttgccactacgtgacctggggtgaatcactttcttcctaaatcacagcttctttatctgtaaaatatttgtcttataaactgttaggattaaatgagacaataacatttggaaagggcttggcccaaggctcagcacttattttgaattcctagtacttatcactatgtagaataatgagttttgcttgcgtgtcttcacttctaggcggtgaactcattgagggcaggggctacatctttttcatctctatattcctaggactatatcagccaatgattaagtctagaacaaatggtgtctaaagcatgatgagtgaacatgacatactcaaaaaattgaaactttcattaccacttctcttatccttgttataaacttttgagccagaaaaggtagaaaacagaccagcagactatttttcttccactaaaataacctaatatccttccatcaaaaatgtcatttattaatttttgtctttatgacagtcaaccttctactttctcaaagtagaagactggggagacagtaaacttgtttactcagagccaaagcagaaggtacttaagaaatagagcatctcttatgattcaaatgtctagccagtgattttcttcctcaacatttgtttattgatcacctattatgtgccaggtagtgtgtaaggtattaagaatagtgataagtacaacaatctctactcaaggaatttaaaatttaagaatgactgcactcagctagactaagctctgcctgagagtccccagggtgcttgtcaaaaatgcagcttcttggggtccccctcagaacagtagaagcagaatctgcagcagtagagaccaaaagtcaagatatttatctcttgaaccccccattcttggtgccgctgctcatgctgtgcagcttatctgaaatatcctccactgtccatcacccaccagacgcatcctttgttactcgactccagtgctacctcttcaaggaaactaccaaccattccttctctctcatagagttaattccttctttctcagactgtttactttatacctgtttttgttgatcagaaacttatcatgttgttatacatctgcttcccttactggcctagcagctctgtcaacagaaactaggtccttttcacctcagtatctaatacctagcacatagcctgtatgcagtggatggtcagcaaacatttactaaattataaatggaaacattttaaaagctccttgatagacaaagttgggaatttctttagagataggcaagggtaaaaaaattcatttaaattcaccctattgctcactctgtgacctaacacagtcaaattccccacactgaaggattgttttaacaagacatatcaattcattattattttaaaatttcttaccagatgtcttactttgtaatttctaagtccacaacttggtattctaaaccgatgtgaaacgttatctctgttttactttttaaatccacccatgatttcagtttggtctgatttaaacctactgaggactttttttagaaaatgaaactacaattcacgacttaaggagttggtatatttaggatatatttgaagtaaaaattttctatttacattttttatttcattgaaaatgatgatttaacttttgaaacactctaagcacaaaagactataagagttaatggaaatgcagaaaagatcagtgaaaaatataaactggcataatgatcaatgtcgttgccagatatgtcttttaagtctttcactttctattctgctactataaaagtttgtgccagaatctatttaaaataaatacattgcataatctcaatttgtttgtaattatactaaatagcctctttaaggagaccagcacaaaatgtttactccctttatagtttttggatatcaaaacataactattaaataatcatggcattttcatgcacaatttacaatgaacattaccttcttcagtatgctacaagaaaattatgtgtcattgtcttatttgatgagtacttattatgatgacctcttcaaaagcattattcattctgtacatttggtgaattctgttcaaatattccaggtagtcaagccagaaaatggggagtcagccttgattcatcctatctatccaatccatccatccaatccacccccctaccaactcacccatctatccattcaatccacccatccatccatccatccatccatccatccatccatccaatccaatccaatccaatccaatccaatccatttatacatccatccaacccatcagtcaaatcaaggttctataaattgtactccataacactctcttacaactcccttctccttcctatgcccacttccactgctctagtgtaggctttcatgtctgctttgtctcttccttcttcatcgacggccagggatccttctaacttctcagctgaaaaatcttcaactattttctactgccaagggcataaacatttaaactcttcagcaaggtgtacagggtctttcatgacctgcctcccaggttaactttatatttggccctgcccccttggacagtacttgctatactacttgtgctttctggagcctgtctcatggtcctgctctccccagacagtgctcatgctgccctgtccctacaaccctgtgaggagaagttcctcacttattggatgaacaaattcctattttagccaccagatctgaacttaaggataattctgccacagcaatgaattgtagcttgatgtgtgtgtgtgtgtgtgtgagagagagagagagagagagagagagagagagagagagagagagaactgtctcccctctagattaaacactgtgggcaggagcatttcttttcatctttgttgcccctgtaccaaaaggagagcctggcataaggaagatggccagtaaataccagctgaataaatcagtggttgtccacttcacctacacctaagactggtcttgctcagacctgttccagaaacaataaaaacattaaaatatgtagtaattgggaatataggcagagttataagcagcttaattaaaatacagtgggagctttgataaagacattttagatttagaagtttaagaagggaagaaatggtgactatttgaaaccatttaagagggttttccctcagaggaacattcatcaggccagctagtctctaggtacccctttgaccgaaagaagcatcgctcacccagcatgaatatttcactcacctatctatgattcttctcattgatgatgctttggagatttatttatacccatttctgctaaggaagatttgctgttggtgatatatttaggataacaggtattctcttatgaaaaatgaagtatccttcattttctgaggtcaattccccttaaaaaaattataataccccctcctaactttcctctgtaaggaagatcaaacgtgataaagtgtaactactttgagaagcattaaaaaaagatttattatttttattcccaacatatgtgaacacatttaatttgcattttttccttagtcaagtttaactgatttgagcaagtagaatttttaattagcaggaaagagattcaattgttttgatgattggtttcctcacctgaccatttattagaggctcctggggacagacaaatgtccaggccccactgcagcccagggaaatcaagacctccaggagagaagccctggggatttctgtgttaaaatttccccaagggtccatgataattagctaggttgaaaactgttactttaggtttctttttttttttaattttaataaattttgaaaaaaaaatttttaaattttattattattatactttaagttttagggtacatgtgcacacatgcaggtttcttatcctttaaggatttccttaaagtggaggcatgggttaagaatacagacatttgggccccaatagactgaattaagatctagatggttaacatccccctcccactcaccatgactctgtagtgacaggcacaaccaggtgtgtcaccacaggtgggaggcacttaggagtggcagaaaagggaagaaaatcgaggtggcaggtgggaggcttaaattccatgttttgaaacactttaattttttgacaccctcatcaactccatggtccccaactcttaagacaggaaactcaggcttgttctgagtactctagttcagctatttaagtggtctccactcttcatccttctcataaccaaacacagcccaggcaagaaatcaataaaattgctgagaacctgattactatttatataactctgcttttataacagaatatgttctgagtgccaaaaaccctaggcaggagtgatctttagaaacaaaacttattcttagatggaaaactctctcttctgttaccctagaaagaaaagtccaataagttatagaacatacatatttataacagcctgttcttatcacagaagaacaacaacttatggcagaaaattatttttcttgaattttgtagacagagggcagtatgtacatgccaactgtataagtaaaagcctatatgccaattttaaagaaaatgcttgctttatgacatctttgtgtaatggcccttttaaatctcaaaatattgtttagtcatttataatgggcttgaatttttgctcactgtaaaaaaaaaaaaagtcaccacatggcccaggaaggtgtttatttctttggcttagaaaatgtacgcatctgatgtcaccatagctttgcaaagggtgtatacacagatgcaatgacaagcatcgtgccagaaaactcagtggttaaaaatgataactaatcttgtcatgctctgtcattatgtaaatccaagaaatgtattgccaaagtgatttctattagtgccgttgaaaagagaattaaaaatgtaatcttcagcatatcattgtaagattgactctctctgtctgcttaggccttaaaatggtgatgcatattgaacagtcattgtgttggtcttttctttaactataaatgagattgcacttcaattcaatgtacccaattgataaacaaaattaaattagtgatgtttaaaaaaattgatttaaatcttactggtgttctagaggaagtctctcatttctgtgttttggttaatgcagctattcttggactacaagataacaaaatcagtagttctcctctgtaggaaacaatggggagatggcacatcttgtttcctgggtgtgccaggaaagatgtgttcctggacataggaacaatgatcaaatcagtgctgtgcagggtcatcacaacacagtttccatggagatctatctccggcattatactttggagattgcccttcaatttccttcaaatcccctaactagtctccaactgtagactcttcccactacatccacacaatggctggtcactcctccccggctgcaatgatgtcattcattaatgctcaggaattcctgccaccactaatgtcctgctgactctaagtcaccactggatacataagttgagggagcttctgctgcagtgattgccaaggtttgctccacttgttgagcctaaaaacctcctctaactccctcattttacaggcagaaaaagagagagccagtctggttaatattcagggtaatgtttctaacaatttcaaaaataataataactggaaataaaattaaaattattctaagctagttttataaaagaaagaaatccaagctgtagttctcagaacataggtatttccatgatcaattaagtttgagaagcagttggataaccaaaggtaagcagatttccttcttgcagaaatgttctctacatgttctttgtaggctgggtgcggtggctcatgcctgtaatcccagcactttgggaggctgaggtgggtggatcatctgaggtcaggagtttgagaccagcctaaccaacatagtgaaaccccatctctactaaaaatacaaaaaattagccaggcatggtggcaggcacctgtaatcccagctactctggaggctgaggcaggagaatcgcttgaagatgggaggtggaggttccactgagtcaagattatgccattgcactccagcctgggcaaaaagagtgaaactccatctcaaaaaataaaataaaataaatataaataaatattctttgtaaacttataggaagagttgtggtacatataaatgtttcctacatatttttgttcttttctcatagagcacctttgagatctagacacctgcagaacaaaagtgactatatcacctattgcccaactaagaaattttttagaataaaaggaagtatcttaatacttattactgggaaacaggcagaagctgggactgtcctggatggggtgtatggttaccatatagaggcaaaaaacaatacgaaacaaaacattttgaaagctaaagataatagaagagcagtcatagttctgtttctcaacttgaaggctacaatatacaagagtgaggggtactattctattttgctctagaagataataataataacgggaaaaaattcccatggaggaagaattttgcacaatgtgaaaagaactttttagcaagtacatttgtctgaaaagggaatgggttccattgaggagatgagagatcttccatccctcctcagggatagatgttaaccagtgagtgatggtttataagctaggagtaaatgacttctaagagccaactaatttttaatgattgtatcacttgactaataggaacttattgtaaatccctgagatagtatcacatttcaatccaaataaacaagattgtttcaggggaggactcaaaagtaccttataactcatctttttccaatttaccatttgatgaaaaactgtataaaaaattcactaccaaacaaatgaaacatcattaaatttgagtaactgagcttcatacaagtgaaaaaatactgaacacttttggccatgaggccttggtctctaaggaggccattagatttatgtaaaaattaatgctctgaaaatgcacaggggcagtgatgcaagaattaaacaactggaatgttcgggcttatgtacaatttatagacggacaaaggttaaagagtggaggaaaccttggggtcattctaattaagttggtacattttctcaacggacacaggcctacagatataaagtattctgcccaatatcacacaatgagtttggagcaggtattaatctgaataggacatgtagagaaagttaaaattattttgcctattctcacatactaaaatagcatctataaacaaattaagattaatttcagacattataaatgctgacttatctaattttatcaaaataggtagatacaggcataccttggagatattgcggatttggctctagatccctacttattgcaaattttggaataaatcaagtctcaagaattttggggtttcccagtgcatatagaagttatgcttacactacactgtagtctattaagtgtgcaataacattatatctaaaaagcaatgtacataccctaattaaaaaatatttcattgctaaacaaaaaatgctaaccatcatctgagccttcagcaagttataatctttttgctgatatagggtcttgccttgatgttaataattagggtggtgactgctgaaggttgggatggttgtggcaatttcttaaaataagacagtaataaagttggctgcgtcaattgattcttcctttcaggaaaggtttctctgtagcatgcaatgatagtattttacccacagtagaacttctttcaaaattgtagtcaatcctctcaaaccttgccactgcccataaagtttaagtaacattatatatctttcattgtcatttcaacaatgttcacagcattttcactaggagtagattccatctcaagaaaccactttctttgttcatccataagaagcaactcattatctgttcaagttttatcatgagattgcagcaattaggtcatatctttaggcttcccttctgattctaattctcttgttatttccaccatatctgcaattatctcctctactgaactcttgaacccctcaaagtcatttatgagggtaaaaatcaacttcttccaaattcctgttaatgttgatattttgaccacctcatatgaatcacaaatgttctgactgccatctagaatggtgattcctttccaaaaggttttcaatttactttgcccagatccatcagaggaatcactattgatggcagctataaccttacaaaatatatttcttaaataataagatctgaaagtcaaaattactccctgatccatgggctacagaatggatgttgtgttagcaggcatgaaaacaacattcatctccttgtatatttccaatcagagctcttgcatcacggtacattgtcaatgaacagtaatattttgaaaggaatctttttttctgagcagatctcgacaatgatcttaaaatattcagagtagatttagcatttagtaggaagagtagatttagcataattctttcttttttttaattgagacagagtctcactctgtcagtgctggagtgcagtggcagtatctcagctcactgcaacctccacctcccaggttcaagcaattctcatgcctcagcctcctgagtatctgggattacaggcacgtgccaccacacctggctaatttttgtatttttagtagagaaagcgttttatcatgttggccaggctggtcttgaactcctgaactcaggtgatccttccacctcagccttccaaagtgctggaatttagcataattcttaaggaccctatgattttttggaatggtaagtaagcattggcttcaacttaaaatcacaagtgcattagcccttaacaagagaatcaacccaatctgtaaaactctgaagccagtcattgacttctctctagctaggaaagtcccaaatgtcttcttcttctgatataaggctgcttaatctacaatgaaaatatgttgtttatactggcccctttcatcaattatatgagctagatcttctagttaacttgcagcttccacatcagcacttgctgcttcaccttgtacttttatgttatggagacagctcctttccttaaatctcatgaaccaacctcttctagcttcaaactttccttctgcagctttcttacctctctcagctttcacagaatggaagagggttagggcattgctctggattaggctttgatttaagggaatgttgcggctggtttgttctctccaaaccattaaaactttctccgtattgcagtaaggttgttttgccttcttataattagtgtgttcattggtgtagcacttttaatttctttcaaggagttttcctttgcattcacaacttggttaactatttggcgaaagagacctagctttcagcctatcttggcttacaacatgccttcctcaataagcttaatcattttcagtttttgatttaaagtgagagacatgtaaaccctgcattcagttgaacacttagaggtcattgcaggattattaattgacctaatttcaatattgttgtgtctcagggaataggaaggtcccaggagagggagacagacagggaaacaattggccagtggcataatcagaacacacacaacattgattaggtttgctgtcttctatgggtgcaggtcatggtgccccaaaacaattaaaatagtaagatcaaagatcactaaccacagatcaccataacagatataataataaagtgtaaaatattgtgagaattgccaaaatgtgacagagagacacgaagtgaacacatgctgttggaaaaatggtgttgatagattagctcaaccatcaattaataaaaaacacattttctgtgaagcacatagggaggccaataaaatgagggatgcctgtatgtagcttctggaataaatctctaatcctggaaaagacaatcaaaatacagataatacataattaattaatctttttagctttagtgtcctttgttaatgaatttcctattttacagatgagaaggtaaatgatatgaagataatacactaaaatggtaaaactagaattctatccccagtcacgttacttgaaagtacagtagtatttctattatgcttgcctgtctcctataactttattttgctaaagttatttttgatatttcataatattgaagccctttcatcaaatcaataaagcaaaacaaaacagaaaactctacatcagtggatccatttgtcctcaggcctttattcaccctatactgatccatcagagcaactggctgaatgcccagcctttgggcagcattcaccaaatattttttggaaaaaaaaaaaagaacaaatgaaagaaaaaaatcagttgcatttatacacatgggaatcttccacctagggtttttcatcttcttttctttctttctttctttctttctctctctctctctcttccttccttccttccttccttccttccttccttccttccttcctttctttctttctttctttcttttttttttttttttttttttttttgagacagagtctcactctgttgcccaggctggagtgcagtggtgcgatagcagctcattgcaacctccacctcctgggttcaagcaattctcctgcctcagcctcccgagtagctgggactacaggcgtgcgccaccatgcccaactaatctttgtatttttagtagagatggggtttcactatgttggccaggttggtctcaaactcctgacctcaggtgatccacccaccttggcctcccagagtgctaggatcacaggcatgagccaccacgcctggcctcattttctttttggcttgagaatgcaaacaaggagttctgcacccacacatggcttcaccatggagctttctgagacactgtaaagcaacaccatagcaaggtatctacatgtaaaacagtatgagatgcttcatgccaagaaaaagcaggacaaatacagaattaaaaattgtctgagggagcttccatacaaagaattcaagcataactaccagatttggggatcattttgtgaacacacgcctgatgaacagagcatggtgtttcaatgaaacaggtatttctttgattaggtcagtggtagagggaaagatgagttaggaaataatacccgaataaaacacagaaatggtgtttgtagaaatgacaggttaggaaagcatcatgcccttgtgccataacatcttgacatgactccagtccaaaataatagtttaagagttgaattagtacccaattacatttaggagactctgggaattcacgcttgagtaatgagagaagatagtttgtatgtaggtctgctaagttggaaatagctttttggaaagcctgttctggtatcccagagtgagaagttcctggcatatctgaacagggctggcagtcatttctttacacatatcagcatgcttttcagcaaactacctctgagatactttcatgagacaggagcagatggggtgccactgacaccaaaaggggcagaccactagtgtgacttcttggttaaagccagggcagaagggttcagcggtgctgagctgcactgagcatcatgctgcatgttttggctaactgaggcacaggaaatttcactgtatcacggttccttatttcatcaaatacatcatagaagcatacaacatttcagtgaaaagtcagtcagcttcagctgtgtttaccctaaaaactgacctcctcttgcttcagtgagggggctttgcttatgtgatgtccaaaatagactccagagacagtgctaacaatagttcatcttatggccttcatctgatgaccatgcagtattctgtaccatacgacccctcctttagaaattactccatgtttctgtgtccttttgtcttgggcacataaataaagcaactcccactcacagttgaccacatcaccatttgctgctcagtgaaaaaacccagggagttcagagaacctttgtctgcagaagtggaagggacaatctgcctgagggctaacccgatgtcagacatgctagctcgatgagcaggcttgtctatatctgactgcaggtgacttctctcagcctgcccacgggatctttctccacttggacacccaaatgaaaagcccatccattgaagattctttttaaaacaagagagccttttaaaaatacattaaaaaatagaagtaggccaggcacgatggctcatgcctgtaatcccagcgcttttggaggccaaggcaggtgggttacttaagctcaggagttcaagactagcctgggcaacataatgaaaccccagctttacaacaaattaaaaacaaaaacaaaaacagctggacatggtggtgcattcctgcagtcctagctactaagggggctgaggtaagaggatcacttgggcccagggaggtcaaggttgcagtgagtcatgatcacgccactgcactccagtctgggcaacagagtaagagcctgtctcaaaaaaacacaaaaatcgaaaacaaacaaaaataaaagtaatacatgaacattatataatgtaatgataaacactaacaaaattttaagaatacatcatctagagctaatgttgatattaactttacagttttttgttgttttatatataaatttacatattttagaccatatgtatacatatacataaaataagtaggtatatatactgcttttacaaaatgagatttttttctcacttggtatattatgaatatcttttaaaatcattaaatcacgtgtgtgtgtatgtacatgtgaaaattcacagaatcaaatattagagctagaaatgatgtaagcgatcatctgttccagcgtttctcaaacttttgactacacttaaactaaaaaataaattttacattgcactccagtacacacatttatattaatcatacacactcaaacacacacagtttcatataacaatacttactcttaccatgtaagaaatactttaatttccattttactttgatttctttaatgttggtaaagctcttctgcaaattcataactcactactgagttgtgatcccagtttttgaaaaacaaattcaataaaccccttcttttaaaaggaaaacatgctcagagacattaagtgatttcccaagatcacaaagtgaataaatagcattgtcaaaaccagaaacagatctacttgttttcagcccatgccatctctatctcctagcctcactgaatcactaattattggtagagaggtgtgcacatgtgtcagtgtgtgtttgtggtggtaatggcaccccaaaatatatagcatccccaaatataaagaaaaatgctcaacattttccatgagaaaaataaattaatgtaatagctgttttatgatccatgagttaattttctcacaccacactgctttacaatattgtaaggcagcaggtccagcaatttcttcaaatgaataaagatcaaactattaaagacacaagtcactagtttgaataactttgtattacaaaactgtagaatatgtaaaattatcactctatgagttggataaatatattgaatttatgaccttcaattgctttccttatctataaaatggaaatgactgccctagacgcctgaaagaatatagggcataactccaacaacaacaacaaaacaaaacaaacacaacaacaacaacaaaaaacaaacaactttaattcttgtttcgcccattccagtattttcagattgtgatctgggggcatgaacaatacctttttaaaaggttaagcacctatttataattgatctgacctctatcaaccaatgaagcagcctgtcatgcagttgtaatattttatgtccacagaggccccaaagtatattgcaatcatatacggaaactacactctgttgagcagggtatttttagcacagttctcaaagcatcgctgagctggaagaatttgaggcagtaaagttagccactatcttcattctgcccattaagtaagatcggctggatcctaaaatgaagtgacacccattatcagaggcaaagcaaatttcctcaagagaccaatgtgcccttcaggatattagctgctggccttcgcatttagaattagttaaacaaatgcagtatgtagttcagttaactgaccaaatcatttatattgtagtagtacaaaatacaaaatctctccttctaaatacgataaaaataaacatttctctaacacacagctcaaatttctcaaacaacatatactccatctggagtttaaagtcacgattagaagattctatgtgtatcacatgtgtgtgcacatgtgtgtatggttttaaaaagaaagcatatatttactcataatggtatggtagaactaagtactgcttcaaatttttcagtttcctgtaataggataacagctctgtacccataccatgtaacttcacaatgcctcgcagtggaataggtgggggcaaatatccctgccttgttgactttggccagtggattctggcataagtgacagaaagacagttctgaggtgaggtcttaaaaggcatcacatgcttctgctcagtcctcttgctcttgggccagcagccagtggaggaatatgaactgggtagctgctggttgcagaaagagagacccatggagcagagtgaaacccaacctgcatctgaagcaaagctgccccagtcatcccacagacccagagatgagaaaaacaaatggaggctgttgtaagtgctgagattttggggttgtctgttatgctgcattaatggaacaaacctaactgacacaaaagggaaaaatgcagaattagaatatttttattttactttttttcaatgccactgaaaattcttcattctttaaacacatagccttttgaaagaaggtagaaaaagactagaaatgccatggaaattaaggatggtagacctatgaggatctattaacataagatacactgtaggagctaaaatagatgaaatgggcatagaaatatgcatataagttcagaggagctgctgctattccagccttctgttggaaaaattctacattgagaaaggttttaatttgcccaagagcatgggcaagaaataatttcaatatttttacagtgctatccttgatgatgttcatcttgacctaagtccttgaattcaaaaatgttaattaaagtttgtaagtgttgatagaattttataaaaaagaccagatgctagaaagacaaaaaccccacaacagacacattgccaaagataaaagatccaccttgagggctttcatgttacaaaaatgaaatggagaaagataattcagattttaatgtagctcatattctacaatctatacaaatttccttatgttactttttaggattaggtttggctataagtgacagattatccaaattaatggtggcttaaacacagtaggatttcttgtctcttataaaatatgagtccagatctcaaaatttagaggcaataaatgcagggctgcaacggctcatcacaatgccacaggcccaggatctttcaatgttgttgctccacaattctcagcacacagtcacccctgctgccaaactctaagatggcctcctgacatccagccatcacacccgtattcagggggcagaatagaggaaacaataaagaagaacacgccctttctctggaagggcacttcccagacatctcatgtgatattttagtttatgcctttattggccagaacttaggttcacaggtacttttaaaccattatactcagaaaagaaactgagaattattttatcaaagaaggaatgaatggatacagggcaccagtagcctctgccacaattcttactatgttgagagtgtaacctataggcaagcagtaagcctataggttatagtctcacagcctgctctaagtcattgtggtacaccaagacaagaactttacagaaacagaaaaatagcatttcattttgagatctaaacaaaacactaacaacactaacccacagaatcgcagcatacataaaactaaggtgatgtctataaatccctcactccccttcctcccttcctttctttattggtattggttaaaatagaaagtctagtaatcactaaaatgatcccaaacatccaatcactcaaataaaaaaggagctgtgggttaactaggttaaggatacattcttcagacaaaatacgttaattttttttttttttttaaagagatgggttctcactatgtttcccaggctagacttaaactcctagactcaagtgatcttcccaccttggcctccagggtagctgggactatagatgtgcaccactgagcctaactaaaacatgctagtcttgactgctagcattaaaggcctaaatttgatggaaaaggcacatattatctgttactttctggtatttaattttaggtttttggctagtattaagaaaaaccatactgacattaatatatgcagttttattccaaataaaatatgtgacttatttgtaatgaaaatataaaggcaaatagtgagcataataaatacatatgtgccaggcaccatgttatgcacttaacattacatatttcacttaactcctttttcaaaagtaaatctagaaggaaggactattatatcttccaatttacagaatagagacttgaatgggtaagtaatttgttcatggtcgcatgctactcaatgatggaaggtaaaaccaggatacatatttttttttgagacggagtcttgctctgttgcccaggctggagtgcagtggtgcgatctcggcttacttcaagctctgcctcctgggttcatgccattctcctgcctcagcctccccagtagctgggacctcaggtgcccgccaccacgcccagctaattttttgtattttttagtagagacggggtttccccgtgttagccagcatggtctcgatctcctgacctcgtaatccacccacctcggcctcccaaagtgctgggattacaagagtgagccaccgcacccagccccagaatacatacttaagcctctctgactataagactcaagcttaatcactgctttactatagcatatatcttaaggaaaattgtatgcatcatagcgataactagaaaattacatatttgtctttatttttataattcttccttgtcttatcttctatttaagtgaatattcagaaaactctgtctccaatgcttcgcaaaaccagcatacagcagactgactcatatataatagccacttgatagctgtaaaatgactgaactatgaaattattacacctattagtagttctattttaatctactttccaataaatttatgccatactaatggtttttattttaccgtaaaatttaaaaagcacaaacatttcctagcgtcataaacagctccaccactctgaatttctactataaaatagtatctatcactaatggctagtagtggttttagaatcctgcaaattgtttcataaatagctataattgcaaatgtcttaatatttgaattgtgtgtatgtagcttacttaaaaattctaggagcaggaacaatggttgaaaaatgcatcatttattgcttaagtttatatttacaatttctgttactaaagatccatagcaatctcctgagtttacaagaattataattatctgtccaaaaaagctcaaatttcaaaaatatatgtgaaatatacatccttttcttaaaggtaagttacccacagaagatataaattgttaacctaaaatatacttgctcttaagtacaagcccaaagcctaaatggatactagtccaaaaataagataccaagagggtcatctacaaaaaaaaaaaaaaaaaaaactcatacatggtatttcccatgcccagtgtgctggggagaaggtgacggaccacagtactgaactgttatgcaggaaaagtacttaattcaaatttgaaaaaaaaatgtatattacctttctctctctctttttatgtgcctttggctgccctgtcactttaatgcctgaaactttaatggcattctatcaatagaatattctgtattcttgggaagaaaagacactaagcaagtgtggaaagcataattattaaccttaaaataaaagctgtttttatcattgttggttaaataacaaagggagactataagcctactcttctggctttggagtcatacagcccatgaagttttctagacacacacatttattcttagagagatctcattagatattttctctgcctgtggatttcattattttaaggaggattactggattgctaaagaagaaagaaataggtttcacggattcaaacaaaacagaatgaaataaaaaagaaaagaagtctttgttataagtaccattaaaagagattaaagatgaaaaccacttttggactatcattaagctggtattataacacattgggctgagaagagatattaaattgtgtcataaaatgatttttgacatttgactttttacatgtcttacatttagttttagggactgtgggatgaaggtgctataaccacataagatcactgtgcaatgttttggataagagcatttactgttaagtaagatgttatccagttgtccaatgagacctgtttataaccttttatacaatatctgccttatttaatcattgaaactataaataaacatggtgggaaaatgactacttgttacctgaaaatctatctgactgcacaaacattactagagcactacttggtgtcaaatactatggtagacaagaaaagaattaggtcataataaagaaattttaaaactatgggagatgtgcaacaatgtgaaggtgcttaatgccactgaactgtatactaaaagtggttaaaatggtaaattttatgttatgtatatttaatcacaattttaagaaatcttgagagaattcttcatggcagagtaaattaagtggactatggcaggctaacaatagaggcagggcctatttgtattgacacataaaatatgttgaggatatggcttttaaattttcaaatgtatttgtagtagattttagatttataagaaacttgtgttaattcaaaaaattgagaaatgcaatgttgatgaaattcattcttctaagttggtacccaaagccttgtatccaaatgcctctatatcaaatacaattgacccttgaataacacgggtttgaactgtgtgggtccacttatatgtagatttttttttcactaaaagttacacctgctcctcttgcctccccttccaccttctctacctcttctgtctctgcaacttctgaaacagcaagaccaatccctcttgttccttctcctactcagcctactcaacataaagatgataagcataaagacctttctaggctaggtatggtggctcacacctgtaatcccagtactttgagggggctgaagccagagtatcacttaaggacaggagttcaagaccagcctgagcaacatagtgagaccctgtttctaaaaaacagttacaaaattggctaagcatgttggtgcacacctgtagtcccagttacttgggaggcggaggtgggaggatcatttgagcctggaaagttgaggctgcagtgagctgtgattgtgttacttcactccagactgggcgacaccgtctcaaaacaaacaaacaaacaaaaaaaaaacaaaagaatgaagacctttttgatgacactcttccacttaatgaaaaggaaatacattttctcttgcttataattttcttaacactttttctctagcttactttattacaagaatatagtatataatacatataaaatatgtatcaactgactattgatgttatcagtaaggcttctggtcaacagtaggctattagcagttaagtttttagggaatcaaaagttatatgcagattttctgactatgcaagaggtcagtgcccctaatccccactttgttcaatgattatttgcaatgtaaaacactaaagtaacatgaaaaggatacttaaataacagaagatttgacaattcagaaaagtcattaaggattgtgctaggcccaaattttatcataataaagagtaattttgttatcaacaggaaaataatcgcagctttaagatgactttctatgttttttaaaaagggatgggttcttgctgtgttgcccaggttggactcaaactcctgggctcaagtgatcctcccaccttagcctcctgagaagcatccttgtagccaccatgccagaatctaattatttatatgctgaataaataagtatttactgtgggaaaataacaacgtggagagagggggttctgctgcttatacttgtttttatacattgttggttgtggtaaagactgctaattggtgaactaacatcccttttctttttttctaatatggaacactgatttttcagagtgatggcaatatactcaagccaataaactatacattttctacatgactaagtcatggctaataagatatgagtggatgtttctggatgggacttctgaggaaagtgccttaaagcagagggctgatgtagctgggatgtaactctttcctttgcccttcttcctccatggaacttggatgagatggctacagctcaggcagccatcttggggcctgaggtaacaaccacatgttaaggatgtccaagcaggaaaaatggaaggctcctgggtcccactggtgactgtagcatcactacacgtgggccaccaacctgtaaaattctcatcacagatgaaaaataatcaactaaatttttaaagccactatttttaggtctttatatctagcagctgtgtacaatatctaacccatccatcagtaaaataggaataaaatggatatgacatcccactgaagtaagacagccttcttcaaattttaaccaaaacatcctgtaggattttaacctcactgcataacacatgacagttttatttcaagggaaatcaaaggagagaggagctcctttcatgacatttcagaggtaagtgtgctaaagctgtggcactatcaccacagggcattattctaaacatggatgcttattgcttttttcaggagagaggtggttttctacgtacgctgcaactaggagaggcaaaaaggaaatgtggggcccacacagcaaaagcagcaggaatcaaagttgcttgctttgtaaatcctgagatcggaatgctacgtatgttaggctctcagaggtctagtttaataaaattcctattttaattacagcagcatccttaaagtgctatcattaaggttgtgtcagcaattacttttttacaaccttattttccagagaataataaaaatgtgtttggcactgatacctagggctgaaagctggcactcagctctccaactatgcgcttttccttgcttctgacaaattggaagagaacctgtactgtgcttccttgaaactgtgaaaattctaaatgatcagacctccaaattgctttgcctttgattgtctgaaattcaggtctatgaactgtcaggggcgatcactgctgtcatgtttcaggatgagaaatgtggtttctacagtaacaacagctcagattgattagggcttaaaaattaaaatcacccctctgaactgtactttaaagaaggaaacaagagtcaaaatacagaggtattcattttcttagtatacagatctatgatggaatgatttgtgaggaacaagatattttaagatattttaaaataaacaagatattttaaaaagggaaagaattagatcagtgtgggaagataacttcagaaacagataacttccctccatagatggacaggaataaacatttgttttgtgaatggtaggaagagtgttataaaaatgcagcaaaaaaggcagcattaggaaattcattcttaaaaagaaacatcgctagactaattgaggcttaaagaagagtggaatctcttataaaagtgattttatattaaaggctgcatattatgtcaagcctcaattatggtaataatattaagtctacgtaatataataactcaaatttattgagcatgaagtgtggacaggtcttttgataatatttttacatgtatgaactcatttaacatgaatgacaatcctgtgaggtgggtacttctatgatgtccttgcacagtttctccagtagaaactgggacaaagaaatgctcaaatgcttgtcctcacagcagtgatgggaagcaaaaagtggagtccctgttgttcttctcaataggatttataggagcgtgattgttctggattgtgtgcaaatctatggaatagtaagttttattataacagacttccatggttctatgaaaggatgagtgggttttaagatactcatagagaaagtaaaaatatgcttataatgtcgaagtaaataataagaattttctgaggcataggaaaaagactgcaagataaagagtaattctggagtaaagaaaagttataggaacaaagtcactaaaagagactgtgaagtcaataataaacacgctcactagcccagtgacagcggtggcaggggaatccaagagcataacaatctcacagtctggacataaatttctgactcacttcttactgcctggagtcattctaagacggctttatgacaaaagggaaaatctgattaaacttggtaggaagataaaaaagtttaagtggcagcaggaggggaaaaaaagaaatggaggtgacaagagaggagaaaacctgagaacaaaggtgacaggaaggggagagtaaggtgtcaggggaaagagaccatcaagaagtagtctgagaaaataggccaaataagcagggcaatcgatcataagtggcgggacttccagatgcaaaagctgccattacgaagacaaatctctccataatcccaggtcttaatcattttcagcctgactctatcccaaagacaatatgcctcagcattaaactgtatttacaggcactccctccactcccccatgactagtgggcaaagatggcccttgggatatcatgcagctgaatgagaagagggatcttgagacacatatgagatgtggcacccaggagaagaagagaaggtgaacataaacagttcacccttaaacaatgctgaggggttggggagggctgacccctgcacagtcaaaaatctgtgtatagcttttgactcccaccaaacttcactaagagcttactgttgaccagaaggctttctgataacataaacagtcaattattatatttttcttcagagacagggtcttgctctgttgcctaggctggaatacagtggcaccatcatagcacaccaatcatagctcactgtaacctccaactcctgggctccagcaatcctcttacctcaacctcccaagttgttaggattacaggtgtgcaccaccgtgcctggctaattttttttttttttttttttttttttttttttttttttttttttttaggatacagggtcttgctatgttttctaggttggtctcaaactctgcaattaacatatttttgtataagtattatatactgtattcttaaagctagaaagaaaatcataaggaagagaaaatagatttacttttcattgagtagaagtgggtcatcataagggtcttcatcctccttgtctttatgttcagtaggctgaggagcaggaggaaaagaaggggttgatgttgctatctcaggggtggcagaggtggaagaaaatctgcacactagtgaacccatgcaattcaagggtcaactatattttaaatgtttaaattgatattcatctgctactaaaagtccctgaaaaaaagttatatgaaaaatttaaaaagatatttggaaagaatttcactaggtagataaattgataccataaagatacattggaactagacaagatccactatgacattttctggaaaagtagtctgcaaattgaatatacatcagtgcttgctttgatatacagtttgcaagtcatttttttttttttttttgaaattgtgttaaaacccttacattctaacattccctgggctctgcagactgacaactattcatcagggattttcaggtacagctgcgaagcggcaaaaaatactaatgttagaagagctggccacgatcatgtgtgcatctgggtgggttgaataaattatggggctaaacaagggtcagtttccttcccttggatacaggggttactatgtcattcccctcagttgcataagatgcttgtttgcttaggttgcagttcactgtgactgactcgtttttttctttctaggttctgcaaattgtcctctgtttcacctctagtgatttccaggctaccctctatctctttctccttttttcaaatttgagatggagtctcactctgtcacctaggctggagtgcagtggcgcgatctcagctcattgcaacctccgcctcccaggttcaagaaattctgctgcctcaacctcctgagtagctggaattacaggcgtgtgccaccatacccagataatttttgtatttttaatagagaaggagcttcaccatgttggtcaggctggtcttgaactcctgacctcatgatccatctgccttggcctcccaaagtgctaggattacaggcatgagctcacctcagaaagtcatctcattactccttatctctccagcatttccagcataatttctatcttcctcttcctcgaactcagtatctctttgacaatatttttaaaagttagcaatattgccacatcacttcactgtatcttgcactcatttttttttactcttttattttgcccattctttccacaaatatttaatcattgcccaccaggtgccaggtgttatgttcgacatccaggataccacaaggaataaggcagaccgatgttatgcccacgtgaatttgaagttctaattaagaaggcagacattagacaggtgattgcctaatacagttgtgatcacgcactgaaaagagaaagggcaggctgcaaagagagcatactaatgggagctgaccagatgaaaggaatcaaggaaggattcacgtgggaaggagggcagacagaagggggttgaggggaattcacttctggtgcctgggaccccctggctggaaggcctgggggcagagagaagcacaggtgttgaaggactgggaagaagtgcagagatgggctgagagaaggcacagcaggaggagagctggcaaggcaggcagaggtaagaacatgggagcctggcaagtgatgtcatagatttctctttttcttttttttttctttttttttgagacagagtctccctctgtggcccaggctggagtgcagtggctctatctaggctcactgcaagctccgcctctcgggttcacaccattctcctgcctcagcctcccaagtagctgggaccacaggtacccgccaccacgcccgactaattttttgtatttttttagtagagacagggtttcaccatgttagccaagatggtctcgatctcctgaccttgtgatctgcctgcctcggcctcccaaagtgctaggatcacaggcatgaaccaccacgcccacccacttatttcattttttttaattgcaagaaacatatgaaaccatcagaggatttcaagcaggaaaaagaggtaaggcccattgttggttttgagagattgttcctgtgatgtgaagaagatgggtcagaaggagcaaaaggggacacagggagatgagctcaaggccccagtgatagtccaggggacagttgatgggggcttacattagcatgccagctgtgagaaggaatggaaatgggtgggcataagagagttaagtatggagaataaaggcgactcataaatgcccttgatatcctcctagtgcaatgacatgaaggtgtatatctgtttccagaatggaagctgacttttctacgttgcctctccactcatgccagaagccatcctacccaattcctcctttacatactcagggttcttctgtccttcactttgttcagaggttccccaggaactttgatccttgacttggagagccttatatatttgttcatagattaacatgattaataagtcagtacattctccagtgaccacaaacaccgggtctataatgtgctctggtcacgataaaattctgggctaaaaagtcatcaaagaagtaccttgtctactgtaactcatgccaacaggacaactaagagattagataataatcattatgattaacacctactgagtacttatgaatataccaggttttctagtttgatgatgaatgtaaacctcacagaactcttatgtcctataatttatctcaattttacagaagaaaagactgaggcttagaaggccaaagtaatttgcacaaagaatgtatggtggagccagcagtcttactctgcaactgactgacttatttgataaggtaatacacatctcacaagcagaagctttatcttctatgaaggaatctttggctccaagccccatgcaccagttaaaggcattgctgagatatcccacagtctcagtgatagccatatttgtcaaactgattattgagattctgattcccttagtgaggggagcatttaatagtcctccatggtgcgggggcagggaagtgacaggagagggagagcatcaggataaatagctaatgcatgctgggcataacacctaggtgatgggttgatgggtgcagcaaaccaccatggcacacatttacctatgaaacaaacctgcacatcctgcacatgtatcccagaacctaaaataaaataaaaaaaaaaaaaccagtcctccatccagtcccctctttctaacctgaaacccagcctcctttcatgttctgagaataaggaataatactgaataaggaaaaatcagcatcatgccaaacttcctataagtctgttgaggctcagtcctcaatagtagtctctacccatcttcctcactcatgaattctaggaaatggattaggaagctgagtctgtccccaagtctgcagcccagcagcctcaagactgagatcctccccttgtcagctctcccctgtgaccctgagtcctgccatttttatccaagctcttctgacagatgcccttaatgtgaactaaggagagcctcagatagagctgtgccaagaaacctggtgactgggtgtggtctggcaatcagatgtccttgttgctatgccatgtctgttagatcactgatgatgaatatacatcttgcaaaaatcaccgatttttcattctgtctggccttcctagccccacttttaccctagatggaaaagatctaatttcaggtttgccttcctcagctggatctggccatctgaatttaactggaccatcctcacccctgtccgtgcctatgagtcataagtgatacaaatgtcagcatcagcatcagtgtacagttcttgacttcaacaaaggatgttaagactgcagtcactccggtttttctcctagaatctgaactgtggccagaaataatttctggctcctggcccatggcatagatggtttgaaacctgagttctaacgccaaaagtgcttttaactcattaaagatgttggaaaaaccacttagccttctgttgattcatcccattagaagaatacaagccaaactatagggaggtaaatgaagactgtatttagaatcaaacttacatctataagagcagttaatatttatggagcactaatgtgccagacactgtgctagatgccttggataattatctcatgcaatcctcacaacaactcatgaatatataatgagattatttaaacgttatatttgagaaaaattaggcttggagagataaaaaaaaaaactaagattaaagagctaggacatgctggaagcaggagccaaccaaagtcctctttctcaaccctgggtggaggagttcatattctctctcagcatagccagatgcatatgtgatatgggcacatatgctttcaatgtatgcacatttaattttcaaagctagaaattcaattaaagaaaaaaaatgtccaatttgaccaaggctccttgaaacgggcttggttgtgaagaatgatgctcagaaaaacagctcccctttctctaacaattgttcccagctctctttcatagaagatgcaacatctactcctactaatacaaataaaagagaattattctgaagcaatttcttctcctaagtgctttttgtataggatatctatccataatcaacatttgatagcagttcttactttttaaaaaagtacttaaaaaccctttatttcaaagggattgtctgtagggcttgtccatgaaaataattctccaattatgctatacattctctttactcatctccacctcctacattaaaaataaactttccaaaacagataaaacaactacctaaaaagaaattaaccaactcagagggaaaatgtggggataaagtaagatcggcattcagaaagttaacttgtcgcagagataaaagatagtcccaccaacagggtatggggctaggccagcactatccagtagaaatattatgtgtgtcacatatgtaattttaaattttctgtagtcacatgtaagcaaatataaaaaaatgtgaaattaattttaataatatttatttaatgccaaaaatttcccatttcaacatgtaatcaatctaaacgttattaaggtttcatattggggggttgctaagatttggaatctggtatgtattctgtacttacagcacatctcaatttggactagctacatttcaaatgctctatagccagccacatgcagctagtggctatggtattatcagataggacagactagaccatcactaatctgtgaatattcttcaagtttctaaacataatggcttcccatctttagaaaacagccagctttttccttatgcttttctttgccaagcactgtttcttttcattgcttcccaacctctctaccaattcttcactcaactcatactaaagaaaacaattttctgtcaacagctcacaatactaaagtgtagaattatacaccactgtacctttttcttctctgctttatacagtaactaggttatttccctgctctagtattactttattttcatacctcttgcctttgatttatgagggctgccagtttctctgaggtttagtactgaaaactccataaagtttcctctctgagaggtctggtgtttctttctgacattaactgtgctgttatatttgcatttttactggaagccacctcaactcatctttctttcaaagaagttgggatattttgttacaaatgaactagtaataaaatagtttccttaggaaaacggagagaaactgataccaaacagaaatatttgcttgtaatcttcaaggaaccagtataaattgctacacgcagctatgccacccacaagggcatcctgacaagactaccagcacctcaagaagtagaatggattactacaggaaggtgattataaagtcaagtaaaaacaacaacagcacttccaggatcatcttgaagaaaggttaattggaaaggaagtgataaacagatttacactatttggataagaaggatctatggctatttctggtgtatcataatacactcatttactcagaaaaatgttaaaaaaaaaagtgcattgcaaagttgtttcaagtgagagatagaacaggaaatagaaaacaacatttgaggaagtggctgctccttccctagatgatcatataaaatggcaagctgagagaagaaaagggcaaatgagacatgatgaggtaataaaaaatagagaatgtcagtcaaatttattatctatttttgacaattaaaaccagtagttaattgtaggcagttaatgactagcaaaagtaggaggaaaaatagtcaatgtaagaattaaattcttattgaaaaaaagaacagtacatacctctctgtcataagaacaggtagcatttagaaaatgaaacttttcaatgtaccacagaaacagcagcctttcctgattggaagagatgtctacttcttaagacaaacaagcagccgtccaaaacccatggtagcaataatagacatgaaaaataaataaagaagagaaccattctccagctagaatgcaaggactgcatttactcacctaacatctaccccagggattagatggcatgcaacaggtactcattaaatatttgttgaaaatatttttggggaatgattatagctgtaggttactagtaggtatagttgtattcccaaatatgttggggtagaaacaatgctgagaaccactgggcgagtggcaacctcccccaaagtggaaggattaagtctgggtggtagcaggagtcttgctattatccaagctggtggagtgaccagggaaactttattatgaatcctaaacagagtaggggtcatgaggaggaaccctttcagaagccaaggtatgactgatccaattagatccgtggatcaagagccagggacctggaagaagtcaatatatcagccagaataaatagtgatcatactttccaagggacaagttgaatcaatgatgtccataacgtaaataggctttttttttgtgtgtgtgtgtgtggccatgcactcaacctttaccaggatcctgtcctggagtgtctaggatactgtgcaaatccccagattataagataacaaggaggaggaggaaagccaacattatccaataaagccagacaaagttaatagtgttaaaattggtgtgccggtaaattaatcaattttctattcaaaaacatcagttaccagtggattgccacaagggctacagctatggaaagactgaaatctttgtagaggacctttcctccattacatattcaagtgaaaggaggcaattttcattgacagtagcttctctaccttccactcaaaaatacagatcctatagctgtacagaattccttgtccttatctatgataatagtaatttctttttcaggttccttcagtgcttttccattgcttcctgtgtcttaattaaaatattatcttcatactatgagcatgctctctagagagctacctagctctcattcttccaggtgctgccagtggaaagttaccaaagcaagtaacagagtaagttaataaacaagcaaatgagtacatacataaatacatgaaaatgaaagtaataaaacattgcctaaatctaatttaatttattatactgttttcccatcatgccacaccagtacatttatcttctattcctgaaaaaaaaaggttcattcctataaggataggctttctcttccctttcacgctttctctagtcattacattttttctgcaattattagcctgctctttttaggacactgtgcccgggagataataaacataatgccctatatgtcctacacagatatttttgatgagcttctggttcctctttctccatgaatcctcagctagattcctgctgcctggtctgtcttcctgggtttgggtcctacggtgcattctgaccgccaagatttgtttgaataatagttcctgattgtgaagcaatctgctctggactgctaaactcattgcagacctccagctacatgttaacctttcattgcctggttctcctagaggcctggcccatcagcccatatatctcctgtctttgcacattagcccagctactagtgcttcagtctcagtacctcattctctgtatacaacccagtgccgcccagcctttgacactacttaaaggttattttccttcatcctttgagtaactcatccatcataatttagttttatacacagaaatcttactcaattatattacagacagttctattaatactgctgacatttactaaatgtgtagtattgtatggctatgttatatatcacagcaagaaattaatgaatttggcttctggttttaacaatcattctggtcctataaaaggcaaacttaggagtatcgctttgcaggggccacttgaatttcagggacaaacattttacacgtcacctgatggccataactgaaaggattgcttcatcagataaggtccatagataacaagcaacacggagatttctatggctccctggtggtaaagctgccaaattacctcaataggatgtcagactccaacatatataaactagtcagtaaaaaggactgcagttttgcagaatcagcatttaggaatggtcagtaaaaccctgaagaaaatacacaaatgacttacagattattcatatagagaacagaaagacttcctatgtttgctcaagactatagatgaatcaaagctgaagaaagacaaggtacatagagtaaataaattagaacccacatagagtaaataataaggaaaaacaggctgattaataaatgtagtcattcattcaacatttattctatgcccactaggtcccaaatattgcacttggagttctaaacacaaagataagcaagacaatgtttttgttcttgagcagcttaccttccagtggataaagcaaatacacgcatgaaagactacaatagaagataaatgctgtaggagaattatgcaaagcacttcacagagcagagagaaatgaccaatttcacagagcaagtagaagtaaacttagaggaatatcataaaaaggataagacttgacatgcagaaggagagggatagggacatttcaaaatgtaagaaaaggtcagaaacaccaaaggaaagaggtaaagatagtacagcgtactaaaaaagaccttttagaagcagggcacagaggtgtcccagaagccatgacaggagagatgttcagtgatcagagtatagtctgtaaggtcagaagcggcaaagccaggtcactgaagtgcagggcccctctgttcagcaacacccaatcagagatgggtggtactttggctgctgtggaggatactgaaagcttcaaatttgaaaaggataagttggtgtgcttaaagttagttctcaaatatattagcttaggatatttcacaaaatgaacaccataggaaggaccagtgcaggcagaagacaatacaaattctgcattggcagaatttgctggctgccacatcgattgaatataaaaacagtgaaaagggaaggaaacatcagaaatcttgttgtttgaaaaataaaataaagctgctgaactgactgggagaacttagaagagaaatcaatctctataagaagagctaaaagaaaatttataaatgaaagaacatccaaagagccacttatttccataacttattcatggatacattgcatatttcatagcattgaagcctgaaaatgtgttcacagcccagcagcattggcatctcctggaagtttgttagaaatgcagaatcttaggtggcacttcagacctgttcattcagaatctgcagttcattaagagccctatatgaatcacatgcacattgacgtttgagaggcacctttttatagaattggggaaattgtgcatgctacaaaaagggcaagaaagctgttgttaaggcactaagtgggaacatgtctttctccacctttggtaccctcctgttgctctctactcgtgctggtctaccagatgccccctggaatgccttagaatacctgcattacccacagggtagctacttccctatgactgagcttaattaggtactaagaggaaaagaatatgattatctcattaaaataagatctcaggtactaaggtgtgaaaggttgattggattaacattcccagcaagcattgacattttaagggaatttgctaatccaaatggatttctaattgacagtttacaggaaagagttatttttcagctgggaaggcttccaggtatctattgtccctgcccactgcaggccactgctagcagaacaataaattgttagaatccatttatgggcaaaatagcattataataaattaagccacattcatctgagttatggcaataatggtgatgagaggttgagctgattagctaagattaagttacatattatgataaaaatagagcataaatagataaggacagttttggatttaggattagaaataccaaaagagcctatttagttggatgtagaaaagaagtgaactgagaaggaaatgaacatattaaacactctcaaataaaactagatctctagaaagaatataagggattaaaaaaactgagtaaataaaatttatatccagattccttggctgtataaactacttaaaaattgaaaactaagctaacaaaaaggatattaaataacttgactaataaccatagcactgctgcctacacaatccaagaggcaactgtgtacatgaaaagaatatctttcagcagaagcttctaaaatcaagcaagctacacatccttgacagagactcaaaatgtaagttacatctgctaaacatgaagtaaaagaagcatttctttccgtgccttctgattgggatgaaaaacataggtaaagcttaagagaaaaataaaatggattaaaaaggaattttatttcaggccaacagggaatggaaaatgggcacaatagcacacaaagtaagaaaagcttatttggggatgagggataagtctgtattcagatttgagcaaaggcatatacccagcaagagctaaagtatttgacctttctgaaactcaatctcttaatctacaaaatgggtttaataataccaacatttttttcccccagggttgtcttgtgaactctgtgaaatgtacagagtgtctggctcaataaaaataaaaataaatatttgatctttaactccaaagggaataaaagatgagttacataatacattgaatacaatcaactataattcacgtaatacggattcagagattataaggaaagaatacattatttatgcatatatataaatttacatatgtgtaaatgagattacaaatgtggatataaatatgtatttgtttattgtcagtgtgtgtgtgtgtgtgtatttttttttgagatggagtcttgctctgttgcccaggctggagtgtagtggcacaatctcggctcactgcaacctccaccttctgggtttaagcgattctcctgcctcagcctcccaagtatctgggactacagggcacaccatcatgtcggctaatttctgtatttttagtagagatggggtttcaccttgttggccaggctagtctgaaactcctgacctcaagtgatccgcccaccttggtctcccaaagtgctgggattgcatgcgtgagccaccatgcttggcctcagttacttatgtaagaattttagagtctgggtgcaaatcctggcatcaccatacatagttgtataatcttagaagtcatatttaactctctttagctcagtttcctgaattgtaaaataagggtaatagtaatccctaatctcacatggttcccatggtacttgttcttgccaggttgccttttaactttcagtaccagtgttagtggcatgtatctatcgtaagttccaactaaccccaagctgtactgagaacactgtatgtgtctagcagccttaggatgatgtggtttaaggatctagagagactttaaggtccaattctatatttgttgtgcaaacaattaaagctgctttccttcacagccctgattctacacatggtctacgatttcttggctgtgtggactttctatatggtctttttttctatttcattgagtctgaaaagattgagtttatcttttcagattcaatgttctaatttgtttgctgctaccatttttaaaccaattgtttaaataacagggataaaacatgcattctataaaacatttgtactatacctgagtgtatccatccctagaggtaaccattcttatatactttacatgtttaaatcccagacttctctatataaacaatagacagacagatcactacctaggcagggataatgcacagcagacacttaataaacatttgttgagtgcatgcattaatatgcaaactgtatcagagactgctagttgcccgcaagtatccattcttcccattctactcttcttttatagaacccctgattttagctaggtgtttttattattatgttttaattagtacatgtatatctccttcattagaatgtgaactactcacgaagaaaaaccgtttaatccaatctcattttcataattccaaggacaacatctaacaccaactgggcataaaggaaatgttgaatggatgacaccacttattgatccacctgtttttctgaattgtttactcagtgtaatttgggaaagagaccaactcaattctcaatggcccctaccttattcaccccagttaacttgccttttctcagctgtgtaccatgcaatggctcataagcaaacaatggctatgagcaaactgatgaggctatttctgttctctaaattaattttctgtaagtaatttgtatattttctgcagtgttttactgactcttcttaaacgttgattttgtaaaactgtaatccttttttctaaccggtatgcagtagttagacttcctgtggcggtaatttggcagttttgccacttgggaataagtggggatgacttcatttcccagcctcccctgcagcaactggatgtgagcagaattcacatatgcatcttccggatgaccccctccctactgccaccaccaacccttttacccatcctgctggccaaaatgcagatataatggtggtgaggcatcttggatgaagaaaattccccggagatgtcagagcagcagcatagaaggagcctggctccctgttatggtggactgcttgtgtccacatggatacagagagagaaataaatttctcttaatgccttgcctaatacaaaagcagattatttcatctcatagtcttctcatttctcaggctgaaaaccaagtaccacttgaggtaatctgtactgattctgctgcctccccaaagtcaaccccaacaaactggagacaaggcattccaatgtgtatatgtctacagtgtacaccataggatgtgttcacacatttttcttctctctaatgagcagagattatatcagcttactttcctttgcccaatactgtcataacaggaaaattccacctgtcaagcatttaggtttggggagaattctatgatatccatggcatgagtttaaaaaacaggctttattaggaaatttatacatgccaagggtcccttgatcctttcatcatcccacagagaagcatgctggggcagggtgctgctattgctgcagtttgagtctgagtttcagtgaagaaatcctcctcttttgtgtgtcccctttttataggtaaagcaggggaagcagttgtcagtgcttggtacctgagagcctcaatatagggtgccagctgtttatatgaattgtcagagaaagacaagcccctggctactttagtctacctgtcaaggggaggaggtcacaggtcctgtaggaaactgggcataggtataacctcacacactgggtgaaggaggcaacccattctcccctaccttgttccactggtttaatcccagaggcaacagggtcaatccaggtttgacactgtgcagctttaaggacagagagctgcattagaataacaactttgaataaatctgttacattagaggagtgccaaagtctctacagatcacaaagagaattccatcacacagatttaaatgatacattctaacagcaatagagtttcataaaataagcaaaagacctgtgaaataggggttaagtcaccaaatgacagatatcaaagagaatttaaaataaattatttacatgtgatcattaaaacagcataggcaatgaacagtaattcatctcctaaagtaataggaagattgatttaaaccaataaagactaaaatattctaaggttgctataactttattctttttcatgttcatatatttattatagtagcctacttttgggaggataacattcatttaaaaaaatttttttaagttaaaataaaagtagtgcccaagtgagaaattgagaaagaattgtaaatgcagcttgtggaactctgcagggttcttattttagaccctaaggtaagaacattagagtgaaagccccccaaagtactttacattccatcattgaacattgtatctccatcaactctaaatgtaatgaaaaggaaaaggagaacagaagaataaaatactaggaaaactaagacagatagaggagttcggtgagtagagaagctaagagggatgtggctcttaacggatgctcaaagtacaggcagaaaaggggtaaccagctattctctcttctcatattctgcattctgtacccacccaaacccaaaacctcttgcacacacttcagaaattaaaggtaaaaacattcaggattgtttctgccaaaagggtaaggtggagtccagggcatgatgactgaatgcttagtttatttcatttctaacctggttcaaaagccacctcctccatgaagccttctctttctgctggtgtgaacacctcaagggcaggagttaggtcttcttgatattcatgactggctcttaggcagatgctccataaatgggcattgaattaaataagaatatagatttagggtggtgctttcattaacctcaatgagaaacatttcatggtttgtttagctaaaataaatagatttaggtttgtgtcaaatttatctcgcttataaacttggcaaatctgcttttaagtttcacatataatctgaaagtgctgacaacatgtgtcacaagctaatgtctacattatgatccaatggtgggaagtgaaatctaaagtgacttacatcaccttgctgcaatttcaaataaaaacaaagcacaaagccataatgaatcactgtcaataaggtaagcatgccacaaatccaaggggccaatgtaacaggaatggagagagagaatactagattatcattctcactggcaggacctcaactgttccacaaatcattcatgaaaatgcttcttgtagagagaaaagatttgtccatattatgaaacgatatatttataacaacagtcataacaaagtataatgtaacagtttattattgttataagcttccatttaagacacagtggaggctctggttaggatcatagcttggaatgaatgaagtgcactggttggggtgtcaagcatttttatcaaatacctacatagtcctccagctgtgagtttcattaaccttctgttttcaaagatactaaattcacatgtatatttaaagtgttttctagtttgaagcataaaataacatttagttttatagtaaattaaaccaagtgcattctgatacagaactgaatagagtactcctcaaaatatcatattttccaaggacagtcatacattttgtttatttgcaattttaaatacctagagaacaaggacttgttctcactattatatccaacttacagccttatacatataggcaattgatatatgtgatttgatggcataatacagaggccccttagttgctggtcagtatgaactgaattatttagctacagtaccatgggccagagacattgcttacctacacctatttaaataaaagccatttctgtgaagctgttagtaaattatcacctggttaattaaacactggatacctttgtgcttcactgtctagggaaactgtagggaaatatataaagcattaatgtgacccttgacttcaagattataatcttactaaaaaaaataaggcttgagtttttaaaaattacattaccaaaatataatgcctcaaataatagaataaatataacatctatttcaaaaataaattttagccaagaaaataagacaacaatggagaactatagctcaaacgctagcggaaacttctcagtagggcatttaagatcttctataatccagccctgaactaactttgtagtggtatttctctttgactccccagcccctacccaccaatgctgtgtattctagccaaaatagaacattcctcccttcccaaactctttcatgctcttatatcctaggtatatggctatccgaccccatttctcaatgtaaaataatctcactagagcaaaattactagtatttactaacatctgtgttctcttctatttgggcatatggctaaaatatattttccaacctctcttgtacttagatgtggctacgtatatgaatcatagaaaataaaatgtgaatggaaggaatggggccactttttgacttccatctgtagaccacttattctaaggatctgggacatggtaaagtaacagtaggaagaatccaaggtccccaaatcattctgtggcacgcagtcaccttccaccactgctgacctgctttgagctgttgacctgtgacctaagtgaaaaataaatcacctatgatgttatgccactgagatttgggagtttctctgttgtagcagctagcattatttaccttaaccaatatcttcatttatcttttcatcatacatcaaggtttcctccactcaaagtctttccctctgccttaggcagaactaatcaccctcttcattttgttcccagagcatttattatgtatatttattattcattgctgtctgaatcagcttgtgagatccttgaaagcagatactattttatttaactttgaattcttaacgcctatcccatagcagacactcaatgaatgtttactgaaagtggttaaatgactgatagtatctgataaagctgcattaatctaatagaaagcttatatatgagtttgatttagaacacaacagaaaaagaaaagatttttcatggttggtgagaaaatgttactgttggatccagcaatgtattcaattcacacttgaatgtcatgcttaaacagcatttccttggataaacatggttcattttttccctctccttttaacacttagcagtgtgaatcatcaaatccagccacaataaatgcatctcctcttagttgccccttaggggttaagtgacaacctgctggtaaataattatgatctgttgtgattttccagagtagttttatttttccttttgacaaaggaatatagacgatggatgtatacatctggtattcattcaataataatctagccacaagtaactgaaaaaaggtctgctgaacaaatgttaaaactgaaaatctgcaaaggtttatagtctatgttatcaaaaattgaaacaaaacccatacatttccaaggtgtttgtaagtcttatgtgcccacttccctccaaaagctgcaacacacaccgcagcgtttcttggggattataggtggaatgaagcaagcacacgtgtacatccacacacatgcacacacaggatacaattagattaagttgcgggtttaaataacgagagagacaacatattctatctcctgcagcttctatgagccattctgactcctagcaagggcagagagccgtcactacactgtctgctcaaggtagggtctcacaggatctaaaagcacaattttttctaaaccactgccctttaacactcagagctgataccattattccagaagtaagactaacatggagttctcttgattctcaagccaaaatcagcctgaggaagtccccattttcatgtaggagaaatgaaaacgggaggatagaaagtaataagagggtagaaagcccagatgcctctaaaaataactgcatgccagcattttgggaagccaatttccctgagtctgcctgcttcattctgataccctttcatctagttggctatcatgaaattgatcagaaggcaatgatcaaaaatccatttcactacacacaaaactatgccaccctttaggaagaagcaaacgagtatgattttcacattttctaaaatgccattatatctttttgctagggaatactgatggatataacttcccaaacataatgattattctagtaaaacaaaagaaagtgggccaaaataaaacatcaggaaacctgtgatctttatcagaaaattttcctattaaaaaaattccagagtaggaattgagaacacattttgacagtggtgcctgctaatatttaaaacagtaaaaaggcaatgaaaaaacaagcctttaatatttttttagaaatgtgaaatctcttaaagctgctctctttcattgcattatgtgataaataactaactaggactcactttatttttccttccaaaggcaaagagggcaaagaatgtggcgaactattttacattcatgctctacatccagccaggtggtcaccatacagtggtttctaatatgaggcaccctaatatcaaagccttttacattgttaaaaaataacaaagaaaggtatagtagcaatgaattcattagcacaaaaaaggatagcagtgtgtatcagacaaaagtcttatgcacatcttcatactcccttggctatgcttcctcccacctggggaactaagtttccaccaccagcgtcacctgctctgggagtgttgaatgttctcttgaggctgtggctgggcagtgggacctctccgttacccagctgaagtttctggattctctggccactcacagatgtgggagctggcagtccacactacagctggagaggccaatgcaacctggaaatgtcagggaattcactccccaaggggtgaactctgccctatgagaatggggagagagcagggcagataaatgccctcacctctctttttcactgttgtggagtgtggttcttttctccagcctatccagtagagttccatgtggcaagtgggtgcagctgcatggccaatggctgtgtcccttgttggtcttgagaagcagtaaccagccctggaaccactgcttcctgttgctttacttcctcccttgcctccttcccccatccttttaaaaattatggtaaaaagcacataaatgttaccatcttaaccttatttaagtgtacagaccagcagtgttaagtatatttacattgttgggcaacagatctctagaactccttcatcttgcaaaactgaaaccccatgcccactgagcaccaaatccccatttcccctcccccagaccctggcagccaccagtctactttctgcttctatgagtttcactactttagacacctcacgtgagtgcaatcatatcatatttgtcttttggtgactctcttcccttttccttcatctcactggcctgaatttgtatatccccaatgaagcattggtatttcgatctttgcttcagggtagtctttagaaaattctggctgggacaccatgttctgtataactgagcattaactcattggcgcagtgaacctgtctcctgaaaatagatccttgacttggatattaaaactagtctaaaacttgtatcatgtaataatgtttcatgttataagaactctttttctgatgaacacctggttctcacttcatagagcctcagtaatggtgggaattaaggtggtaggagtgataatgaaggtggtagtggcagtgggtggtagaagaggcagttaactagcattaagctctttgagccaggcagcatgcatcatctcatttaatcctgcctgcaatgaggtaaatttccttattgccatatgattcatatcatcattaccagatgacaactgagaatgtcaaggttaatcaagaacttgtctgagaccacagagccaatgaatggcaaagctggggtttgaatctaagcccttctgccttcagagactgccactaaccatgtggtgctagataaccgccactatctcagtcaaatccatctaaaccctatgtgccagaaacttctttaatttttaaatttttgtgagtacagagtaggtgtatatatttatgggatacatggaatattttgataaaggcatatagggacatcattatcacatgagggtaaatgaggtatccattacttcaagcatttatcatttctttatgttacaaatgatctaattattcttttatttttaaatgtacaataaattattgttgacggttgtcaccctgttgtgctatcaaatactagatcttattcatgtatttaactatatttttgtgcccgttagccatccctcctctcttccctcccacactgcctctcccagcctctggtaaccacctcacgtgagttggattgttttcatttttagcacccacaaataagtgagaatatgtgaagtttgtctttctgtgtctggcttatttcacttaacataatgaccttcagttctatccatgttattgcaaataataagatctcattttttttgtctgtataagtcaattctgtgtaagtaccacatttcccttatccattcatctgctgatgaacaaaggttcatcagcaacaaaggttgcttccaaatcttggctactgtgaatagtgcttcaacacatataggagtattgcagatacttcctcgatatactaatttcctttcttttggtaatatacctagcagttggattgctggaccatatggtagctccatttttagttttttaagggacctccaaattgttctccatagtggttgtactaattcatattcccacaacagtgtacgaaggttcccttttctctacatcctcatcaacacttgttattgcctgtcttttggataaaagccattttaactggggtaagacgatatctcactgtagttttgatttgcatctctctgatgatcaatgatgttcagcacctttcaggaacttttctcattgctttacattcatctttttggttgttggtaaatccccaacacaattctatgaaatgaaaagcctcattgatgcataaaaaatcttattatttttacccaaataaatctaggaagaaaataaagatcccatatattttactataaaaataaaacagaaaaaattacaaaatctgtgaaaaaaacaacatatatttacacaatgtagctggtttagaaatatttttagaaagcaagatgtattagttcgttttcatgctggtgataaagacatacctgaaactgggaacaaaaagagatttaattggacttacagttccacttggctggggaggcctcagaattatggtgggaggtaaaaggcatttcttacatggcagcagcaagagaaaaatgaggaacaaacaaaagcagaagctcctgataaacccatcagatcttgtgagacttattcactatcacaagaatagcatgggaaagactggcccccgtgattcaattacccccacccccggttcttcctacaacacatgggaattctgggagacacaattcaagttgacatttgggtggggacacagccaaatcatatcattctgcccctagcccctccaaatctcatgtcctcacatttcaaaaccaatcatgctttcccaacagtcctccaaagtcttaactcatctcagcattaacccaaaagtccatagtccaaaatctcatctgagacaaggcaagtcccttctgcctatgagcctgcaaaatcaaaagcaagctagttatttccaagatacaatggaggtacaggtactgggtaaacacagccattccaaatgggagaaattggcccaaacaaaggggatacagggcccatgcaagtccaaaatccagcagggcagtcaaattttaaaggtacaaaatgatcgcctttgactccaggtctcacatccaggtcatgctaatgcaagaggcaggttcccatggtcttgggcagctctgctcctgtggcttttcgggtacagcctccctcctggctgctttcatgggctggcattgagtgtctgcagcttttccaggcacatggttcaagctgtcagtggatctatcgttctggggtctggaggacggtgtccctcttctcacagctctgcccccagtagggactctgtatgggtgctcccaccccagatttgcattctgcattgccctagtagaagttctccatgaaggctccgcccctgcagcaaacttttgcctgggcatccaggagtttctatacatcttctgaaatctaggcggaggttcccaaaactcaaattttgacttctgtgcacccacaggctcaacaccatgtggaagctgccaaggcttgggacttccatcctctgaagccacagcatgagttctacattggcccctttcacccatggctggagccacagggcaccaagtccctaggctgcacacagcatggcaaccctgggcccagccctcaaaaccactttttcctcgtgggcctctgggcctgtgatgggaggagctgccatgaaggtctctgacatggcctggagacatcttccccatggtcttggggattaacattaggctccttgctacttatgcaaatttctgcatccagcttgaatttctcctcaaaaaaatcagtttgtcttttctactgcatcatcaggctgcaaattttctgaactattatgctctgcttcccttttaaaatgaaatgcttttaacagcacccaagtcaccttttgaatgctttgctgcttagaagtttcttctgccagataccctaaatcatctctctcaagttcaaagttccacaaatctctagagcaggggcaaaatgccgctagtctctttgctaaaacataacaataaatcacctttgctccagttcccaacaacttcctcatctccacctgaaaccacctcagcttggaccttattgttcataatactatcaacattttttttttttttgagatggagtcttgctctgtcgcccaggctgcagtgcaatggtgcaatctcggctcactgcaagctccgccttccgggttcacgccattctcctgcctcagcctccagagtagctgggactaaaggcacccaccaccatgcctggctaagtttttgtgtttttagtagagatggggtttcactgtgttagccaggatggtctcgatctcctgaccttgtgatccatgtgccttagcctcccaaagtgctgggattacaggtgtgagccaccttgcccagcacactatcagcatttttattaaagccattcaacaagtctctaggaggttccaaactttcccacattttcctgtcttcttctgagccctccaaactgtttcaacctctgcctgttacccagttccaaagtcgcttccatattttcaggtaccttttcagcaaccccctactcctggtactaatttctgtattagttcgttttcatgctgctgataaaaacaaaccccaaacaggggaaaataaaaagaggtttaattggatttacagttccacatggctggggaggcctcagaatcatggtgggaggtaaaaagcacttcttacgtggcggtggcaagagaaaaatgaaaaagcaaaagcagaattccttgataaacccatcagatctcatgagacttattcactgtcatgagaacagcacaagaaaataccagcccccatgattcagttaccttcctgtgggttcctcccacaaagtgtgggaattctgggagatacaattcaagctgagatttgggtggggacacagccaaaccctatcacaagaaatacttctgaaaacagaagagtattatgaatttaactggagataaaaatgactgcacaatgaagattacggaatatgaatattccacacatctcaatttgatctggaacttttctcagatcaaacttcaaattctgttagttagtatcttttttttttttttaattccccaaaagtagcctgggtcacctttgtctgttaaaatgacccagtgtgtcagataggtagtggaatgcagtgaaagctttgagctctatggaacctccaacttaccacacagtgtaagacagcatagcatgtcaccacaatttcttcaaatttactagtccatgcctctcaactgacttcgcaaaatggtctctgctttcttgcctttgtacatcatgagcacaatcagacatttacttctatcccattctttccttttcagctctccctaccccttcctgcttgactccactgtaacagatccttcgctaaatcttgcctttcctctatcccaagcatcactacagacaaacctttcttaagtacaagtcttttctccactcaaaaatttccacggattctcccttgtgtcttccaaattaagtacatgcatctttgtctgtcatccaagcccacacatctgccatgtcctccagccagagctgggtgcaagtcttccatgatactttttgctccagcttatttctgcatatttgcttattgtttccttacctaaaaggaagcccgtactgcctcaaccccagacttaccaatccttcggagaccttctctaatgttccagatcccacaaagtctcatttccttcctccattaaatgtaatttcttcttttccttgttccccgtcacattggaattgtgactctcctatggcacccagttaactctgccatgcattatctccctactcaactgaaagcttctcaaggacaggtatttcatattgacctgtgcctttcctttggagtctagcccacagcagggctcattaaatatacttttaaaggaagtagaagcttcaacacagcagtctcgaggacttatggtgttaataagctgggttctgaagaaatcctagagctagaagaatcaaaccccagcttcctcaagtctctgtgtttcattaagcaactaaacaagagagaagcaacaaatgtggtgcagcaaggaaaagcatggattctgtagccatgtggcctggggtgagtcctggctctaccccataccagctctgatgtgaacttgggcaggttacttatttctctctgcctcggtttcctcacctgtaaaatgaggatagttacatttcctatccctcagagttattaagaaaaataaatcagttaatatttgtatagcacttaactcagagcctggcacataataaattaaaataatgggaaaactaggtctccatggttttgctcttcccatgattatgacattcaattttgagatacaggcattttgaatttggagacactttctggtgatttacacttgctcagtatgaactttcctcaatagtaagtgtcaaggaataactgtcaacaaggagattctagactgaaggcaatttacctggccccaaggaagactcctactccacaactgcatcaacagtttcatttgcccctggtcagaggaggctgggaggaccccaatccctgatcagaggagcctacaatgaaaaacaaggggatggagcttcttagtcttcttattagtcttcctttccctctttcattttcctgttacttgttaatacttttcctattttctccttattgttaatttcaataatatatgttgtacaacttcatatatgctgtatgatttaatatatgctgtacaacttaaaatttgtggctaaacatctgcttaaatccttcggtgcatagatgcaaaagttggttcaattcaattctacaaacaccactaacaccattctgtacaagccactgtgcttatgctgggaaatcaaaaagaaatgagccaaagtccctgccctccaggaaactcatatttatttaaaggagacagacatgaacacacacaactgcaaggtaatgtattaaatgccttaatcggagcatatacaatgtgcagtggttacgcagattgattctgccctggggattggctttattaaaacatctaacaaattaataaacaatactggttgatttcatttcatcattccctgtgcttaatgtgttttgtatatgaggctgtttgcaggggctattgagctgaagtacagagcagtcactgatcatcatagtcttgatattctgtttacagaagccatgcccacatagtttgttctgttactgaaaatgcaaataaaagtgatacaattataaattgcaacacttttataaagaattataatttttataaaaaatttataatttaaaattggattattagatctctactgctaagctaatccttgctgtccttaaagcaaggacctggtgcatttgttttcctttgaacttccactatcagatttagattctgaccctctaaactacaaaggccactggctgcaactacagctagaaatcagacacccttgcaatccattctttcttccaagcttccctcaaaatcagctagtcatttgccggtttgaattgatgttccatctagcctactcctgtacaagttatctagtcttaagaaacaagctccacctcagacatgttttccatgtaaaattacaaacaactactgttctgaccacagtcaatgataattccccaggactcagcttgacagggacaaagaatgaagggaaagaaaactagatgcttgccagtatgactgttaaatgtcagctattttggagtttatccccacatgagatatttcttttgtactgtgaggacgatcactgaaaaaaacatgacaacataataaagccacggaagacaaccccatcattacagctgcaggaaataaaacatagattaatgtcaccaaagcacatgtcaggagggataatgatgatgtacacaaatgaatcttctcatcctggacaaagaacttaagtaccacctaaaaccggataataattatatacaaatcaccaacgacactgctatctgctaagcatgtattatactcacacattttcaaagagtttgttttatatttttctctcaaaattctcctcaagtcttcccacttgtattcaagtgacacaaattacaaagtggtgcagcaagcactgacattgcctaacaaggcaaatgcagcctgccatggacagctatgagacattgtgtccatactctaagtgccaagagcgagctgtgaacaagaaagctgtgcagctgtgaacaagagcagcaaaagtgatgtggaccatgcagaggggccatttggctgtccaaatcaaaactagatataaacaatcatttggaaaaataggttccatttgtgtttctggtcacagaaaactgcccacagagtgaaaaataatgagaaagaatctgaggccaatagctgatcaatataaggaatgtaaactccagtttgaataccaaagatagagggaactagaattattttaccttggctctaggctacagccatctattaattaatagtcttaatgtggtttagctactggatcatcacgttcatatcagccaagtgcaacctcaaggcaactgaactgctagaaaactgctttttcatttatgatgttttccataagagaaagcattactgaggaaaagttattattttacttatactaagacctttgaccaaaatttacactcaacttttcaggaatgtgctttacttcatagtaagatgttcaccaatacttgacagcaaatgaatgggttacaattactgaaaccccatctatgatttgtaaatcatggatacattctagaagcctttatatttattaagacctattaaaattcagttatttgtaaggacaaggggtggaaagggagtttgtgttttctctccctttttcttatattttttcctgttgggataaagtgtaaccagccataaagaatgtcacttgcatttgagcaaagccccctatctcttgtctgttttgcaaagccactgctgtgttctcctacagataaggagggcagcttaagtagtctgtaaaacgtaacaataacaacaatattactaatcacagctaattcttattttgtgcttcctatgtttcaaacactgttctaagtgctttatgtgaattagctcatcgaatccttacaaaactttatgaagtaggctctattattatccttattggatagataagaaagtttaggtatatatattttttctcataagtttatttacttgcagcttcaacagagtgcagaactgaaaggaggtagatttccttatctcactaaatatgtacccttcattgaaatcacatttggtcttcctcaatgatgagacaggcccttagccatagcctgttcatctgcctggtgatgatatttcctagattctgaaactcttaaagttgaagatgacctcggagtcatttagggcaatgctgcacccactgcaggaagcatattttttgaatgggtttctagccttcatctgaacacctctagcctctcttgtggatggagagctctggatgtcaaagctctcatcttccttcacactcatgacaatctttgaaatgactcctctttagaagaaaagatcttcttcctttgcagtgttgctctatgcaagtgaaacaggaaatgtcatagtttttttaaattagatcttacttaaaatcaagagtgtgatattgtggacttccacataagggaatgaagggggactaattctcatctgtgggttgggatatctaatcctcattcctagtggtcaccctctccttgcttcacactccatggtagcttcacatggcttctccactgtggaacatgctgacttttttctcacattgccttagggaaaaccactagaaacaaataatttgtagaattgatgttgagcaggaagctcttgagaaggaaagctgaaggagtatttttcttttataaacggtgtgaaaactcaccatccttgctctatttcagtgaaagaaatatacactagatttggaggaagaggcagaaatagaaaagatggggagacaggaagaagatgggaggagaatgaaccaggaggaaatgactgcagacataggatgtccttagttaaatagtgtgtgggcacagctgatcttcagaacttgcagaccactcaagactgttctggtaccaccatctaactttctacacccatgatccatcctcctccaggactcactacactgtggctcttgtttttttcctttcactatgaaaatatgctcagaggaaacacataaagctcatccacactgtgatataagtgactggctgacaactcgaaacactagccccatgaaaagtatattttcaacaagaattgaaatatcaaatcaaagggctgaagctccaggtcttgaatttcatatatcgaccaggaatggtagagatatctggggagtcagaagtcctttccaggactggcctccattctaggggctcccctggccttgctataaaagcacacccaggtcttccagatctgtgcatgtggccactcttctagaaggtggctggtattccagggacagctggcactcccttccttgctctttgccagcacacggcacacacaccttcattaaagcatttgtcacactgtactttgaggtcacatgactatgtcccccaccagactgtgagctcttggggagcagacactgggccttggtcacctttgtgttctcagcactttgtatcaggcctacatggtcacccattccttccaaatggctgccctgtgaggaaccaaacacactcggaagagcgctgcatgggtggccttccatgtagggagattcagtaacagtacaggaggttctcacgttacgagcaaaaccttgacttaaagatcaacagtcagggccaagactggctaattttttcattaaattataaatttgttagtgacatatttgtggattttatttagtggaattccaacctgctcttcctagttcagtgttgacacaaacatattcccagcaagtgaagtgttgagtaaaagctactgaagaatccattcatcattaagcaaacattccctatggataagagaatgaacaaatggataagggattcactgctacttccccttttccactggaattttctacccataacaaatacattaggtttgtctttaagtaataggagactcaaaactctatactacaacgttttaatgcatttatataaaatctgaaatgattttttttgtcattttctggattaatttctttaattttgctaccaacctaatcagctttaaatatcagaaagccattggatagcttttgaatgtaaatgcttttattttatttactttggaaactcagtttaaaatactattttttgccacgaagaagcaccttcaaatatcagattgtttttcaataaaggtactttaacaagatgtcttctctgagggatgaagagtgaggaggaggggaggaggggagaaaggaagcagttctcaaaagaagcatctaaggacaagaggcttaggaaaaaacaaagccacaaagaaaaccacttttattaccaataccctctttggtgagatgtttaaagagttatttcaactgaaaggtctgagacaggattaaaggcactagtgttctctgatacatctaactaaacaataaaagctgaagaagaaggctagtcacatcattttgccttctcagcaagtggctgtctctgtattaaaaaaaaaaaaaggctttaatcagtataactgacttttgacggtattaataggctaccaggctgatttcttgccgtaggctgaaaaactgcaaccaacatgagagaaaattacataaccactgaagcagaagacaagcaaataatttacacgtgactcaattgagatgtaggaccctgccacgatgctggtgtgcctctccttagctttgtccaccatggacataacatacatgttttggtgccatagtaaggcgatatcttataacaagataatagcctcgagttcttccccttttgaacaacgtgaaggtacaacaactcatttgtaaggtgccttgttaaaacaaccacagtcctcataggaagaggggagggttaagaatcaacgcaattcctgtcaaatgtgtatatgctgcaggcttatgaaagggagaatcaattcactccagcaatgagtaataacatctatgtccttgaagaagcactttgagaaatgctagagtcacagaactatacatccagtgacactgattaaatgctctatttggtctacattttattgaaggtggaggcagagcagcagattaatattgtttgctcctgcttataggaggaacattgggaaactgagtaggcatgtcttccaccagcaaatgccatttgagaattactggtactttctgatgaacttcactgaaattaatattttatataatctcagtgtagcaggcaaccactttcccaagttatataattgtggatcactgaagtatctgcctacaaatgcatgctcacatacaaacacatgcagctggagatgctacagatcttgttgtccggaacttgcaaccttgcaaattgcttccgtggcaataaagactagaattgccaatacagatgacgcacctcagtgaattgaggaagttaacgtgtgagagtgagtgtgacccagtgggctcaccagcaggctgaaggagtgaaggcaggaacaatgtgtccttactacaaccacctttctgattttcccaatggcgtggaggaaattatttaccttttccatgcacaggtcatagtgtaaggatatactatgtaaaataaatatgtcagctaaacactggttatacacaataacatctatccttttgatatggtgatattttattagtggtgactgaggacaaaagcaatgcttagtttttcacataacagggtgaaaaaaaactcaggtaacctgacccagaggacactgctgcacattagagtaactgagagacctctaaaacaattcttgtactcagcccacactccagatcaactctgtcagaatctctgggcatgtgacccagtgtttaaacctccccaggtaattccaacatgcagccactcttgagaaccaatggtatgggattccacaacagcacttcgcctccctaatccagtaggtcttgtgcatgagcttgcatgagaatcatctggagctctgttgaagagcagctggttgggccccacccccagagtttctgacgcagtaggtttggattggtgtttctaacaagttctcaggtgatgcggatgctgtggagggaccatatttgaggatcactgcctccatcaaaggtattcactgtacgaatctttctccaaatggaaatttttttttttttttttactttagcctttctgaaagtgtgtttcttggaccactgccatcagcatcccctggaggaaatggagatactgaggcccactcaaggtgaggcctcgtaaacttcaggtgccaccctccccaccctgtgattatgctccctgaagtttgagaaccactgttttacctcctctttctgcatgcttatgaaacagttctcccctaataaccaaaatgactcaagcatgaaaaggccaccagaccccaacatgagaagtgagaaacagcgaattccctgtggtgaggaatcttcactgcattattctgtgggccaggggacaagggcacgggtaccattttcagaacacatgtctgagaaattaactcagtcatggagaaaagtctgtgtatcctgagcacacacacttcgttatctctcttattgctgcaaatcctctgaatataggagggaaaaaaaaaatctccctttccagcaagttcactataacaaccaatggtctttttgcaatatttgtaatgtctttttggctatacctacttctacctctacacctcttgaactcacaaaaaataacagagtattaggaaaggaggatgtttcctttcccatcccaccttgctgacactctcaggtttaataagtaagagctagataataagagaactaaacaatattttatgagtttataatttaaaaattagtaacttgtttgaaggacaactgttggagctattcaagtatggcattttatcccaaatctgccactcaccaggttgtagccttggaggaaattatttaaccacctgtacccccatttcctcatctataaagtgggagtaataataaagcctacctcatggattattgaaatgaactaaaacatataaagcatttggcacagtgcctagcttatagcaagtgttcgataaatgtgagtttttgttttcatttttatatagtggacacagcaaatgctgaataaagaatgaaataaataaaaaactagccaaatgaataatatcaaaagcagtcctttaggactgtcaaacttcaaattcaaactaagttattgttcagggaacctaaaattcaagagtgcatggacagagtataattcagtatgaagttcaccaacaaaagtgatcccaaatttattttttgtagattggtcaagaccaagattattctgtgagggttatttctgtcaataaaaagaaaagaaggattcaggtcttgcacatcatgggacagactttttttaatcttttcaaaaaagattatgggaaatagcaagctgacggtcaccgctgggtcagcacctggagaagctggggcaagccaatgttagaggcccgtaaagtggccagacacaagcaggggactgaggaccacatgggcaatgaagcttgaaaaggtaagccaaacgggtcagggatctgtttaactttactctgtcatagagattttctcccatttttatttataaataaaataaggcatactccctatttcatggtaccagtaacctccacttattttaccagacaagcccaaagtgaaaacttagcagttggcggggtgcagtggctcatgcctataatcccagcactttgggaggccgaggcaggtggatcatgaggtcaggagttcgagaccagcctggccaacatggtgaaactccatctctactaaagatacaacaaattagccaggcatggtggtgcgcctgtaatcccagctactcgggaggctgaggcaggagaatcgcttgaacccaggaggcggaaattgcagtgagccaagatcacgccattgccttccaacctgggcaacagggcgagactctgtctcaaaagaaagatagaaagaaaaaaaaaccctcagcagttggcctatatgttgtagtttatcattcagagacatgccgaagactcagaatcagactcacactcacagcccattttatcttttggaggcttaatctcccacttaaattcagaaaattcttaaattcgtttttaatgatgatactcttattctcattattacatttttccaacctgatactcaaatgtaatatagtaatacaatgcaccattaagtctcaactatatttaaatgtatatcttgagccataatcatacaagaccttgcacagacacaacacacacatagatacagcaattcctataaagccaatgataaaattaaaatcaaaccattgagtacatcataaagtaatgcccatatgttgtttattgctatagatccatagggtatatgttaaggctgaattaaatttggggttcattttggtccaaagagacttggagataatttacttttggtcaatcccagcgcagagaggtccccaggaatgagtcagttcttaggctcactcagatccacagagttacacaaatgacctggcttttcagagcctactgggtcccaccccaaggccagagagtctcctgctgttggtttagaaagaaagaaagttctttaagcctgtaatgaataagaaatgttattttactagctctgacaagtgtctaagtccttagggtttgggccacatacagccaaaagtctcagatctaaatgaggttacatctgtggaggctcactgcaagtgccacggtctatagaaaagttttcaacatattaaaacaggatctgcacatacaaatggttcataaaaaggaccaaaggaccacaggaaaattataataaatatggtgataataaaggcgataactaaatagccaagacttatggagaacttgtattctagatgctgtgcagatattttacatggttatctcatttggtcctctaacagccccatgagataggtaagatatcatccccattttatagtttagggaaatgaggcttagtgatttcagttatttgtccaaggtcatgtgctcatagatggcagtgccagaatgtaaacctggtcctgtgatgtccagagctagagctctccatcccatcctcatctgactttcaatagagagcgattaagcagaggactcccaggtgtgtttagatcttaaatgagaaattataaaacacagaggaattgtcatataatcaagaaagaatactaaaatgtaatcccaaatgacagtgcagggagctaaaaccccaaataaaccatatccttcagaaaattgctgaaagcaacacattttattggtggagtccctgattgagaacatcaatcctgttggtgccaagcttcagccacagttgggcattttgaaggattaatgggatatgtctttaacagaggggtgtgaaaccatcaacaaaataacatgtgctaagggaaaaagctactattactaaaagacttgatctgaaaaggtaaaggcctcaggttagaggggcacctgattttgggttcattggtgtgtgttacccccaacatctaggcttgtgcggaactctggggattggagatagaaaagcattccttctttaaagccccttaggctttggtgagcacaaagtagctcagctctgaggcccttgtgacaaagtatagcacaaatgggagggaaagagcttttctcatttagactgattattgaaacccactggagacccaaattaggcctgagcacaagctggtagccatgcctcagaccatcaagagtggcaagatataagagaggaaaccttcccccaaatgtggcagctgggaaaatgaaacttcctacaccaagtggacaaaggatttccaaaacaagctggagtgcttgtctgttaaggaaattcaagaggaggaagaattctgcaattcttcagtgatgggtaggggtccacacaatggaatgggtaaagggaggcagagctgagaaatgacattttcgtagttactgaggtccgcatttaccttcaggtcagtgggaactttgaaagttgaggttaatgatgttatgtctggtcttggcaagaacaaagaaaagaaccaaatcatcgatgggcatttgggttggttccaagtctttgctattgtgagcagtgctgtaataaacatacctgtgcatgtgtctttatagtagaatgatttataatcctttgggtatatacccagtaatgggattgatgggtcaaatggtatttctggttctagatccttgaggaattgccacactgtgtgaagctggaaactatcattcttagcaaactaacacaggaacagaaaaccaaacaccgcatgttcttgctcataagtgggagttgaacaatgagaacacacggacatagggaggggatcatcacacaccagagcctgtcagggggtcgggggctaggggagtgatagcattaggagaaatacctaacgtagatgatgggttgataggtgcagcaaaccaccatggcatgtgtatacctatgtaacaaacctgcacattctgcacgtgtatcccagaacttaaagtataataataaaaacaaaaagaaaataaaagaaccaaatcactgcttttgttttgtggggatgggggttaactgctgtaatgttaagaaaatataaaaagcaaacagaagtattaaactttttggcatgtcttttctttatcaaagaaagcataatatgcaaaaatatactatgaggcagctcttagtgctttagtttaagtggactcaagacttcacacccaatggtttacatcaaaagatacaaatgatgaagatccaagaactgctgtgattaatctctgcatagtcatgggtaaacctgaatggtgctagaagatgggagttaaaaaaaaaaagtatcaaagttcaaagttcaaaaatggagaacagtatatttgacaatgaattcaatgagatattgacctgtagtagtaaaaggacaaaaccaaatgcttgaaaagtgactttcagggccaccatatactcattgtgtgactagggaacaatcttcctgcctctaatttgccatccatagaaatggaattcattaagatcattaacaggctcactccacctcctaaggtctgagggaggctcaaatgagatcatgttttcctatgaaaatgctctgaaaaccaaagctcttaaagttgccatgcccaatagttctatctacagtttatatagacagaaataaactcaacccaatatgaatgtgacacaactgaattaatgtgttaagaagtgacttaatgaagattaataaagcactcaacttgaacagtaagacaaaatccaaaagaatggaatgtaacagggacacacttgtcttaatatgtaaaacattattaatatgcacaggcctaagcaagtggggaggtgtagacttaactttggagcctttgatgtagaaaaaactttggagatttctttttaccacaagctaactatgagtcaagaatatgacctggatgataaaaagaaatgcaaccataggctacacgaatggaaatatcattccagtaagatagagtgggactggagctacacttgtactattgcagcctcaatgtactgtttggagagtgctttagatacactggcagtccatgggattttaagggctggcttagaatcctaatgaccataaacaagttttcatcaggaaaacaaagtattcaaagttctgaacagtcaatttactaatatactttagaatatagctcattaacaaagagggggagggggagaatacaggtacttggggctgtctcttacacagaatcactccctcccctgtgcaagcctctcatttcacaggtgcttgcttgcaaagatgatttggaaagatggaggtaaattaacatattgatttcccagcactctgaaggccataagcagacacactgggtcatgtttcaaatgatggaatgtgaaattaaattaaaggatgcatctgtgctcagcccctaattgccagcctagtggatgtttttaaggagcacagagagggaggagagagaataggaagaagcaaggtgaatgcattagaaagcctgaaaaacaagctgaaacaaagggggttgggacaattaagaatttctatgtgcagattaaagttgacagtgtctgttaaatacatctccataatttaaaatacacgtgagaggagtcatcagttggcatctttgacaacacagtagaagttgtagaatcattcccctggccacatttcaggtatctgaaaatgtaatatagttagaggaaattaatagctgggtctggttttttaaaatcatcttcatttgtcaattttagctttaaacatttgtcatgttagctttaatctaactggttctgggatggaatctattacaaaatagatcctaaacaaaaatattcacttcatctgtggcctatttctgtggtcaatcagctataaactagcctgtaactggacagagacctttcatttgatgaagataaaaattttaaatatatttaataataattatttataaagttatataattcacctctatttggtataaaataaaaagcagagaaaaaacaactgctctttctccaactctactgtgcagaaaattgatattctgtgatatactgataggtgttactagggggaaaaatggttttctgtggtcaaatcaatttgagaaacactggaataaagagttttctttcccgcagggcttctcaaaacgcttaatatgcttatgtgcaaggaggagggagacacagtatagcattgccaaaatggaacatttgttactatctccagggacccacacgttctgggaacacaggctaggaaaggctgctcagactcctgacccagcacacaatcctctgtccaaatccagttgcaaatcacatttcaaagattctgaaaactaagtgatggtatagtcaatggcctaatgacctcagcagccagatgcccaaggctacaggccagaaattgctgcatagtttcaagatgacaaaacagatagaagcaaataaagcgacaggaccctggtttaactgtatttactgtcacctacataggtatccaattcagtcctactcaggtttttgtatatttaaagaaatgcttactttagggattaaaaataagagaacaaattgactatttctatcctgaacactaaagatagaatacgtacttgttctcagctagcagtcaagagtaggtaatacaataaatcaaagactttcaccgacagttgaataatcactgaataacaataactttaattagtaaattaatgacataggattatatagcataattcaaacagaattaagcaaagttctagtcaaagggagagggtgtaaaaaaataagaggttagccctgctctcaagaagcttataataaagagtggaacacaaggacatgcacaagtaaatacagagcaatatttgctataatcgctgtaaagtgcaaatccatttgacagcccagagaagaggaagagcggggtagaatctacattatttataatttagagtgcagagtgattgctcaaagtgacgccaataagagaatacttttgcttattagattggcagaagtaaaattgttgatgaaatgccatagtgataacaggaaaacaatcactcccaaacactgtggatcacatacatttgtacagctttttcagaggcaacttggcattatctagaaaaattaaaaatagacattgtagctgtcattattaggaatttatcctgcacataagatcacacacatgtgcaaagatatgttgattccaggatatatacacggtcttgtagttctgataaaaacaggtcagaaacaacctaagtatccatctcaagagaagactggtaaatacatcctctgtaccacaggatgctttgtggctgctaatcagaacacagcagaccttcttacactcagagtgaaaggctcagtggtgacaggagccttgaaagtgcaacaaagtggcaaagccacacaggatctgctgcactccccaccctgacctcactcacgctgtgttcccctctcttgcctcactccagccacactggccttctgctcctcaaatgtgacaggtaccctcccaacttggtcttggtgctgccctcctcctcttggaacacccttccccctgagattcacctgtaactaacccccttgaatccttcaagatattgagcaaacctcaccttcttaatgaggtctactctgagcaccctatttgtgatggaaactgccccccaacacagaattttactttttctttttattcacagtacctatgactttctaacacacttgctatataatttacttacttagatgtttatcatctatctcttgcctctaaaatatagtctttgaaggcaggggtgttgaacagttctgtttactgatgtaaccaagtcccaagaaaagtgtgtggcacatagtaggttgtcaataagcatttgttgaattgaatggaccacacatatatgtacacatacatgcagatgcacatgcatgcatacctacacacacacgaacacacactttacctgagtacagaataactccaaaaagtatgtaagaaattgtgtttgactttgagaagaaagactaaagaagggaagatcagaagcatgcagaaatacaggaagtcttatttgccaatgtttaccctattatatgttattactttctttctccctccttccctccctctctcagtgtaatccattatagtagccactagccactcatagctaatgagcacttgaaacacgctagtccacatcaaaatgaactgtaaaatacacaccaaattttgaagaataatataaagaaagcaaaataccttactaataatttttatgtggattgcatggtaaaattatactatttgcaatatactggtataataaaatacatcattagagttaatttcacctgtttcttttggcattttaaaaggtggctacagtagaatatacaatcatatatgcagcttgaatttgtgatttgtattatatttctattgaacaataaaacgatctctccaaaaagaaattttacacacacacacacagacatattattaaaagtggcaaaaagactctgaagttagatagataggcagtcatgaactaaaaaccagctttgcttttacttaacttctctgagccttagtttcctttgccagtaaatggggatatgatcccctacaatattatagtggaaattaaaggagataaatgcatataagatacttgctacataaacgtaaaccatataatggtacagtgctggatttgtttctagaggaaatagtgtataaagctactataaaaccatgagccctaccaccaagcaagcagtaagacagtgtcgtttttctgcatgtttgtgtagcccgtgttacctatgacaaaaaaagaatgtaaagacaccctataaagaaacaaatcttgcacagaaaaacacaaactggagtcaaatgaagaaatgaataatttaattttcagtgtagtgctggaggtgctccaatctatgacatttctatatgtaaacagtctgatatattcgatacgtgcaaaattgctcagtagtaaaaactttagtagacataggaaagggaaaggggaatcaatggaaagctgtggagcttgtaccaacactgtccagatgtgacaggtgatcaagatacgaaggagaagtctgaactgacctcacctctagccaaaatttgaaaatgtgaggaagaactctatcccgttaatgtgagattaagagaagaacacattagctggccacatagctttgggagcacttttccccaaaaagagaaattcaaagaaaagatggagaaatcagaaaaccggctcaataaagatgaagtgctatacttcaggaaaatgtctttgttaacatataatttcaaggagaaaaactgaaatcagatttaagttgcccaaggacaatttgtctttcctattccaggtcaatatggcaggttttcaaattaagctggactttactatctgacaaaccacaagacatcaaacagaataataagaacctcttgaaaataaaaatcatgtgtaatgtagtgtagcatttattttagtggctgaatttattttaatggctttagaaatgattttagttctgtattcaaaaaaaaccattaagagtcacttaaatttttcagttacactttactgcattttatggggtagattttatgttataatactggtgaatttgtggatacaagaagaccttctgggcatattcctcatgaatgtcacacgtttattgtatcaaagaatattaaacatggaaacacttcttagtaagctgaggttcacaagacaaagcagcttagagatcataatgatagttatcatacaatcgggaaacctggattagtcattcacttttcattcgttcattcaacctactaatatttattgaacatctgtgtaacaggtactgggaatacagtgttgaacaagacagacaacattccatacataatagtgttttggggggacccagtaaacaagtaatatcacataatatgtgcagtagtgaaaataaaatggaataatgtggtagagaatgatggggaagctactgtagacaggaaggtcaagtctgaggacatggcatttaaaatgatatttgcatattaagaagtggtcagccacatgactatattcaggaagtacattccaattgaaaggccctaaagcaaagttaaagaacataaaaattagtgtggtgaatgtatcaggaggcagggaaggagcgggagatatggagtgggatttcatttggggtgtacttgggtaagatgttggtggtagtggcagcataatttgaggttttcccaagtccccacataaaaacagagcaactagttggtcaaaaccctaaggacaacacatacatcaaacccggagatgatgtatctcacaaactccaaattataagcaagtgaggacaagctaccaagaagagcaggaatcagtgtttgtgcaagagaaagcagagagaagcaagcaggcatctgatggatgcgggaacaggagaacctccaaatagtcagcaggtgttcactagagagtgttacatgccagtttggtaacagtggttgaaaatacccaagtcaaagccagtgagggctatgggctcacggcaagacccaaggggccatgtctgtagcagtcttgcccctgtgaactcttgaatctgaccaggtgggctcccttccaggacaggaccccatattgaggagaaactgctgggagtggaatcaaaattaatcaggacaggaacaacagcaatggaggaaagagaagatccagatgaaaggaaaggcatactttccaaagcagcatcccacaatgtctcccatgtactgtttacagtgtcaccttgacacctttcccattgagtgatgaggtctatatcctctccctttgaatctgggctgaattttgggacttgatcaacagaggatggcaaaagtgtctttatgtgacttttaaggccagatcataaaaatgccatgcactgccgctttgccctcttggaatactctatcttggaacccagctgtcatactgtgagaaagctcaaactagcccatgcagagaagccacatgtaggtattctggctcaactagaatacctgcatgtgctagaatacctacagttgagctgaggtttcagctaacactaagctgaggcccaagacagcgtggagcaggcaaactgtctgctgtgctccatctgaatccctgacccataaaggccaagagcatgataaaatgattattgttcaccactgagttctaggggagtttgttacccagcaggtaacggcgataccacagttttaattaaatattctgtctcgtggtaacatttataaggtacacttactttaaaagttgtcttaatttttggtaaattataaaacaaactcaatcccagtggaagggttcccctttcaaaagagtagcttaattgattggggtagcacaatcaattttcccttgctttcaatggcatctcttgctagaaaatgcttcaaaaactgtgccaggggaagtctgtttttgtttttccaaatgaagcagtgaggcttatttaggtatctttctttctgtcctttttaaagtaacttatttgcaaatggtagaaattgattaagtagaatgaccacataatttatcatccaaactagaaaaaatcatcaaaacagctttattgagatacagttcatataccaaaaaaattacccaagcaaagtatacacaatgttttcttattacactcatagagttctgcaaacatctccacaatctaattttagaatttttttcatctccctctaacctaggacaaattgaaaatgaaaggagcactaataataattatgcaagaacaataggtatgaatttggtatatccagagtctgtccaaggcaaactgaagtgaagcatcactgaggtagaagatacaggtattggagagaaagctgtataacttaattcaaaataggaggctgcatgaaggttttaaaacagataatcagaaaccttcttaggtaggggaagggtgtataaattggtatagccatttttgaaaactatttggcaatatctatcaaagctgaacatatgcatgtactatatgacctagcaattccactccaaaatataccaatggaaatgactactaaccgtatgatgatttcatttatataaacttcaaaaacatgcaaaagtaatctataacattacattccagatcaggatggtggttaaccttggataagaattagtgactagaaggagaggcataaagggaattttgaggtgctggctaatgttctacttcttgatctggatgctggtacatggttatgttcacttcttaaaaattcattaagttgtacacttagaatctgtgcactttttatataaatgttacacttcaataaaaatcctatatagaaatgaacaggtttgtgtttgataaagagatattaggaattcggattgagatcggattttcaagccctcccaattaacagaaagctatcttaaagaaagcaattaagagcagttagtgttcacacagtagcaagtggttgttaattttcttcttaacacctttctctggaactggaggcaatgaagttcctggggaaatagaagtggtgaaaaacaaaaggtctttccctgacataaaggaatgtttaagtaaagactgaaataattaactaccaattagaaacggagggggctttttgttttagtttgagtttttaaatgcttctgctaaccagaatagtattttagaattggaagtaattttcaagatcatgcaatcaatttctttcacttctggttatggaaactaagattcagagaactgatatgatagccccaaattgcataggtagttagtgacaaagctgggatcagaacccagtactcttgactcatgaaagatttttcctatttacaaaggtagttactcttactgcttgctatgtaacaatctctgcctaagttttcctattgctctcctctccacaagagatgatagataggtataacagttatctccattttacagagaaggaaactgaagatggttagagaagttaacatactttgacaaaattaaaaatcagttaagtagagatgccaggattctgatcatttctcactctggagtctgagattttaaccaaggggcaatactgcttctttgaattaatagtgcattgccatatttctcagctgaaaggcaaatgagtaaaggtacttttttttttttaagacactctgtcacccaggctggagtgcagtggcacaattttggcccactgcaacctctgcctcccgggttcaagcaattcttatgcctcagctacctgagtagctaggattacaggcatgcattaccacacttggctactttttgtactgttttagtagagacatgtgttttgccatgttggccaggctggtcttgaactcctggcctcatgtgattggcccatctcagcctaccaaagtgtttggattacaggcgtgagccaccatgcctggccacattgtttcttgattattataatgtcatggggaaaaaaagtgcatagtttgtttctgtgtcacagtccagttctcatttattcatatctgagaaaaatacatccatttgacaatggctaaccagtggcacccgcattttcctcttggcagcaacttataagtgaggtggctgtgcttaaaggtctaggagttaatcaacactcagagagatgatcttgcaaacatgacatgctttaatgatacatctttatttccttggcaatgttcttaacaacatttgataagcagggttaaaaattcatggccaacacatcgattttacagttttcttcttaagtatccacagatatttaagataaggtattctaaatagagtctaggtaaccacttataccttaaagtgctaaaaaaatactagttttgagttcaatactatctcaagtattgaactcaagtttgagttcaatatgaaaaaattcagataagaaattatatttggcaaaagacagcttgcgttaagatttgattttcctcacattctttctaaatatctaacctgtagtagaactgagacatttaagaagtgcaggctcattcatcatgcattgcaaaatgcatttcctttcaattcattcatattgtaagactatcaaggttaacagaagaacaaaaatggtatttactttccatataatcgtcataattttaaacttatataattaagaacagagggacagcagggaaaatggacgagaaggcctccaatttaagccaatatttcctctaatttttttttaagttgtaagtagataactatgttacatgaaaagtaaaataggaggattgagcataaatgatcactttatccagctataccccaaggatgataaatacgtggcctactttcactcccacagcagacatcactaattgatagggcctgctttcccaacaaacacagattcctctgacctcagaatttcccaatagtaacattgattatctattatttgcacagcactgtactaacctcttcacatgcatcatttcatttttataacctcacaatatcctaatgaggtaggtaatattatattctcttttagagatgtggacactgagaatcaggagttagttagcttaacagttggcaggggctgagtggcattgaaagccagactcattttaatccaatgtccatgctcgtaatgactaccctctaaagccagcttccaccagttgactgcagttagcacctaatctatttgctatcctaatttttatgtttacattcctgctatagcatcactaaccatggtcacaggaaagatgttactgctttcaggaaaaaaaaatcttttttaaaaactactccctggtcttagctttgtttttaagagtcacacaaagcatactcatgggttacgcatgttagcactattgtacctccaacctcctctctgttatttttctataaagtctcgtcttgaacagaatagacaccttctgttctttcagtcaggccatatgcacctttcatatgtctagtcattcttctctggcagtgcttcagtttgtccacatctccctgaagcaaataacatgttgcctgtgaggtctgaccagcccagagtacagtaggactaccactaccttccgtgttctggctctctttcttatcacatctgaaagctgatttttaaatcaatttcatactccactgacttgtactgaataatattttactaggtcaccataggccttgaactccaaataaaaaggtagatataagaagagggaagtagaaaaaagttaagagctacttgaagaaaaaaggttgagggccaggcatggtggctcatgcctgtaatcccagcactttgggaggctgaggtgggcagatcgcttgagctcaggagttcaagaccagcctgggcaacatggtgaaaccctgactcttccaagaatttaacatacatacatacatacatacatacatacatacatacatatatatatatatatatattagttgggcatggtagcactttcctatagtcccagctgctcacgaggctgacacagggggatcacttcagcctgggggatggaagctgtggtgagctctgattgtgccactgcactccagccttggcaacacagcaagaccctgtctcaaaaagaaaaaggttgaggcgatggaaatatttcgggtgggagaggctgcaagttccccatatcaaaatgtgtccttttatttaagtagaatatacttagccaaatgtagtaaagtgacccaatccaaaattctctcttactctgcctgaaattccatcatttagagattcatttgggttaataagcaaaaacaaataaaataaagccaaacaaaacaaaaacttcattaataataacttggattatcagacaatcacacacttaagtaacctttaaaaggaaagcagggctgggcatggtggctcacacctataatctcagcactttgggaggctgaggtgggaggattgcttgaggccaggagtttgagaccagcctgggcaaaatagagagactccaactctacaaaaaaatttaaaaattagccgggcatggtggcatgcaccaatagtcccagctattcaggaggctgaggtgggaggattgcttgagcccaggagatggaggctacagtgagatatgactgcaccactgtactctagcctgggtgacaaagcaagatcctgtcacacaaaaaaataaaaataaagcaatttggtttagcaagtgacactaagtttttgtattgaaattatagctttttgaatggaataagggttgaggaaaaggtgaagacgactaggaatttggagttgggggtagaaaatcaaaatcattctgctagatggatatgacaaccacattttgcaaaataaaaatcaatacacatggtcagatagaggaaagaggaatttggattggcacagtggccacacacatgagatgcatggataccacagaactttgttggtggacagacctggagggaacagcaccgtgtcttacagcaaactgcaagacagcagcagggctggggacagcttcaggaggcaacttcaccttcatggccattcaacctgagactagttaggctgttgctttctcttcctccccaacccaaaccatgtatctctggtctcatcctcagacactgactatggtctgcttttcccagcagcccccagtgctttacccagtatctactggtgagcactcaagggtgaatgttgctggaacaccaaatactctgcctgggaggtgctgcagctggagggagaatgatgagagccttggtctattggctctccagacatactgactcccaagggtcctcacatgactaggaaggggagaagccaacagtcattatcgagaggagccttgagcaacacccagtttatatgggactgcagggtggaaaacagcactaaggcttaacaaatgatctttgcttttgccactgacctaatacaatataatttaatcttaagaaccatgtaataattctattttctctctgaaaaagaaccacagctgaccctcaggtctaatccttttgatacctgaaagtgggggtgcagagtgggcgctggagaggaaggagaagaaatccaaaacaaaacaacaagccagctgctataaagctgtgactacagcttatgaggtttaaatttacgcacaagtaaccttggatacctagtatttgacccctaaatggccccagctgagcccaattactatctgtgcacacacatctgtgttttctgtaagtcaacacagtaataaggctttgttttcattctaaagctccagacagatgaactgaattcagtcctggggatgtgttctactaacaattaaaggttacacagaaagtttaggacgtttgtttccagaagacacactcatattgcaaaactgtggcttagcttttgctattgattttaaacaatatttagcaaaaattcttactgaggaggagaattctcttcccatttctgccatcaaaagaagatgttatcctgtacatctttaagtccaccagtgctatgagttgaatgtctgtgtcttccactgtgccccctcccctgcaaattcatatgctgaaatcctaaaccctaaggtgatgatggtattaagaagtgaagccttggggaggtgattagatcatgagggcagggcacagcttcatggatgggatcagtgcccttataaaagtgatcccagagtgttgccttgttccttctgtcatgtaaggacacagctagaaggcaccatctatgagcaacagaccctcacccaacaccgaatctacctgtgccttgatcttggaatgcccaagctccagaactatgagaaatacatttctgttgtctataaggtacccagtctatagtattttgttacagcagcctgaatgaactaagataccccccaaaagcaaactgtatgagttagaacaggtagggacttaaagagtgacagaagggtgccgtgggccttagtgatctgcctaccatcagccaaggcgccttattgtggtcacagcacctcaaggtttactttcctccactctgagttcatatgatttagattttggcttctgtcactttctccgggttccaggggtggggaagtgacccaggattggtcaactggagtatttcacacacccctgccataggggtggtcatggggcacaagacagattgatagaatccattcaagactatttagaaagcaaagttgagtgccaatggagaacagaacagaattctgctgcacctactatcgggacaacactgagactcttttttgttaaatacaaaaaacacaaaaataaaatacttttttttttttttaagctaaagccagtttgagctgcacttctgtagctttcccttaaaaagtctggacacagttgaggtcagtctgctggaattttatttctttgagtttactatggttgaacaataatatttaacatgaataaggtaggcagtattcggatggcccaaatgattgagacctcctagtatcctcctagtgttgaatactagggagatgtaatcccttcctcatgagtatagactggacctaatgactctcttctaatgaacagaaggctacagtgatgagatgtcacttctgaaattaaatttaaaaaaaaaaactgtgttttttttgtcttgcatgccctttcttgctctctctggcccacctattctaagagtgaccagttgccttgtttgagctgctcagtggagaggggcatttgccgggagaaaaagccctcacaaaactggtatctccatacaatagccatctagaacttggatcctgcctgcagctacgttggtgagcttagaagggatccctccccattccagccgagagatgattgtagccccagcctatactttggtcacagccttctgagagaccatgaacccgagtatccagctaagctgcaccagtattcctgatccacagaaactatgagagaagaaatgtttgtttttttaagctgccaaattttggggtaatttgtcatgcagcaaaagataactgatagaaaggaattaaacttaaatagattaacaataaaatacttatcctttgcctttgtgttatgttttccaagacaactctcaattactttatttttaggactttaaaatgcaatttcagtatattcaaggtcacagcataattctattaggttgacagaatatagtatttgagtagtaaaattctttacaaaaaggctcacacttgaaattccattctagtttagatgaatctgttttacaaatacacattgagaacctgcaatgttctaggcacaggagaattaagtcggatgggcagcttgtttcaaagagctctaagtccattcaggagaggagaaaatcccataagatttggaaataagtgaatcaggaggaatgccagtattcactagttgtgtgacactggataagccatttaaattttcagtgcttttgttttctcatctataaaatgaggaataacagtaacaacagctaatttatcaacttataagatggctagaaagaccaaaaaggacaatgtatgttatagcattgtaaaattttaaaataatataaaattataattattgcaatggttattaccaaaactataatatacaaactttgctgtacaaatagataatggtccataattaatttgctgtttactgtcatgtaaaaaattttttccattaactatttaaacatgtccttaaatttgaaatttgtattctaaacatagctgttttgatcactcttttcaaaaccatgcaatccgaattacttctcccttgaatataaaactctcatactttcatcttaatttattctctgtgacaagatagttacagtaattgtttacagaaaaactgaatgaaaattacaaggaacatgcaaattctaatcattttgattagaccaattaataacttttataagcagaaaagtttctatcttataaaaaggagaaaaaattttatttgatgttaaatttaaagtgtttagagctaccatttagaatccattaaatgttatcattacttctattgccttctccactaagctttaatataatttgtgattcattagatcaacattttgaggtcactgaaaaacactttattttcaatatgccactgtacttaaatttataattctagtccaaacagcagatcccttaataaaaatgcaccagcaagaataactgatttcattttagggaaaagatatcaacaataaactgctttggactgcgcaatcaatggttattgaattctggactccaagctaatatttccagctacataggtccttcagactcaagttgcccactttgcttttaatgaacaaggtcagaatcatgaatataagtactatgacaggaacagaatactttacctcaaaaaattttagccttgaggcatcgtaaactgtcaagtatctttccagtaggcctaaatattaatatacactttaaagttggagatagatctgtcccttgaaatccactattctagttgtctacagtttggtgtgaaataaaataaaattaaacatttattaagctctaactatggactaccccgggtgcagagggaatacaaagatgaagtataaagtagatgaaatagataaaatataatagaaaacttagataacgtaaggaatgagaaatgaattcaaggttcctagtttttagaggataatgcctttatagctaaaagagagaagaaaggtactgggaacatatttgggtaggagctaaggtattgagttcagtttaggaaaagtcaaaatctgaggtaatgcaccacccagaagacagttggaaagatagatccagagctcatttgtgacatctaaattacaaaacgagggaggcggagatagcccaggaagaattcagagagttagaagggccagtgctgaaccccagagttaaggggaaggagcgggaggaaggagaaggtatcaaagagaggctggaggactggaaagaagatgggtcacagaagccaagacaggaaagactcaaagaccaaaatgatgactggtacagttgctacaggaagctcaacgaagttaagaaagtcttaaagaccactaaatttggaataaggtgatcgctggtgatctctgctgaatccttttcagtagaatggcaggtgcagaatccagagggccacaaggcatcgctcaatcactctaagtgaaccaggcatctgctttgtgttttggggacaggaaagtacgtgctgcatagtggaagtttttgtaaaagatatttggaaggtgggagaagcagagtcaagtaaactaagaagtagcctctatcttcagttcagagtgtgtttccggatgggaggagcagactgggacttcagaagagaggtgcgatttgggaataattgcttagggaaagggaaagagagtggctggagataaagacaaaagattgatgactagtgttgagaaaccagctgaggctggaactcataaatctgtaatgtagccaaccaccatggttatacagtttttttcttccagtaatgtcagtagcaggagtgaagaccacagatggtttgatggagctaaggttgagcattggcagggttgtaaggatgaagtctcgaggagaaacaaatacttgaggggcctggtatcaggcctggtatcagggaactgaatacctaatcaaagaataactcaacaatactcttttttgatgtccttaatattagatatgtattatttcagcttttggggtacaagtggtttttagttacacagctgagttgtatactggtgctgagattttaatgcacctgtcacccgaatagtgtacattgtacccaatatgtagttttctatccctcattccccttaccctccctgcttctgagtctccagtgtccattgtaccactccgtatgtctttgcttagctcccactcaaaaatgggaacatgcagcatttgatttgccattcctgagttagagaagtcaacaatgttctcacatgtggggatgactggtagggaattgaagggcctggaaagtttaacattctggatttctcatgagaaagaggtgggaaaatgagattttatgaaacttttgaggagaaaaatagatacaaaaatagagaaagaacctgataaatgtaagagctaccaaatacgcttaacaaagcaaaagaactgatttggagcttttagaaatgatacactttactacgacttttctctacaaagcttaatatttgcactttgttcataacatcaaacaactccaaatcatatcagaccatttctttcttttttcttttttgcagtgcagtagcatgatcatggctcactacagccttgacctcctgggctcaagtgatccttctgcctcagtgtccacacccccttctcccaagtagctgggattacaggaacgcaccactatgactggctaattttaaaattttttgtaggagctgggcatggtggctcacacctgtaatcacagcactttgggaggccgaggggtgagcttgagttcaggagttcaagaacagcctgggcaatatggcaaaaccccatatctacaaaataaaataatttaaaaagtaaatttttcatagaggcagagtctccttatgttgcccaggctatatgggactatctctgaggtttgctattacaactcaaactaagagatctctgtctcatttaaataaaatattgcaatttctgattgaggaacactcaactttacaaagtaaaaactaaaaagtaaaaaacaaaaccttctaaatgaaaagaaaacatacctaattgtctgagaaaattacaacactccaagtagaacactttaacaaagccaagctcaaactggataacataaattacataacttgacactaagagttccctgaccactgttgccaataatccaaataatattcactaaaaatgcatatattttatagtaaataattttactctctttgagaaatatttcctatcagtaaatttgatatgtaagtatttactttattcatggaagaggagaatatgattcatgtgtgacttagcaatagaaaatataaataaataaaactagttcctatatagttttccaattctcatgaattctagatttatttggaattcctcagagaactctctgatcttatgaaagttttatacccacattcacatttttgtttatatagatgcattggttttttactgttccacttttcacaatttgagttctaggtattacagacacaaaatgcattcatattcaaatattgtgatggctggacatgacacaggacaatgtcacagccctcctgctcttgtactacgttgctgagggattatacacaaagctgagtcaaggtcccaactctaaactggatctgtttgctcaccttggtgataaattttcttccagtccaagtatgctgtgaattacatacatcagtccctaatttcagattcagtgggaaaaaaaacaacaacaacaaagtcacactagagtgtaaggtaaattctcctattcaaagtataattgaatacaaaataattgaatgaacgtactgagaagaacattcacctcattacaaaaatggttagtcataacagcatgttgcgtttgctgctttttctccttttggagccgtggaattatatccaagctgactcaggagtttatcaacccatcacgaggatggaggctgccatcatgaaggcacagttgactggcagcatggggaaggatggcacacagcactgcagttgggagctgggatattcctgccatggctctcagcacatagtagtgcttaatgcatattggctgataatagctaacataccgacaattgtgtaacattgagaaaattaagctcatttggctcaagttttatctggaaaataaagataatagtattagtctcatggagttgtgtggattaaatgagctaatgcacataaattacgaagcatagggcctagcatgcactgatctcaggagatcaagcataataaacttcgtagcatgtgttgaaaagaaaaaggtaggtctataagaatcttataaagtataaacactgctttccccttctattttccttgcatttggattctcaaaacatctgttgcaggagctgtgttttcctgtgctacacagagtagtagatggagaggaatagcatcggaatcattgatatggcaaactaagattcttacagccagagtatggttttctaaacttcctaatcatttcaaatacacgaatagtgactacaaagtaatgagataggtttctgtgggtggcttatgggaatcagtcttcttcacagctttttaagacagaaacatctatagatggtccaggcactgtcttagatgctggaatacaaagatgaggatatggcactcacaaaaggacactgtatgtaagtaatcacaaaacgatggagtaattgggggtgccattcacatacacaggggctccagggctaacccttgggagagtgagcagggttgtgggaaatttcacatgaaggcagtgtttgaagcaatgggaagtgtatgggggaggatacgattaaaaatacaccaagttcacagacttaaatacttacgttacttctattctgagctgtgtaatcttgagttagacattttctctctttaagccttaaacaattactgagcaaattactctgttgttagagatattaaatttatgtaaaatcagagggctggattggaagatcccaacagttcttaggtttaaaattccttttatgcctgatcatcttccaaatagtgctaaaaacaccattacacagaagatttggaatttttaagaataaaagagagaggtgtttgttcctataaatcatgaaaacttggcattggtagataaaaccagccataaataacagttttaaggtgatggggattccccaattctacttcaataatgaaagaccactgtaaatccataaagtggaaatttacaaccaactgctgagcacccgtacatctcaccctaaattttaacagctgttcccctaaaagtgatcacgattataagcagggtgaaatgtactgagcaaagtttttaaaggtataagttcatattcatgtcttcaaaatacttgcagaagttaattttttgcaggcagattacagtttacaaaaacaagtattaaccagagctgtaatcatttgtaaaactttccactacagcaatttgttaacctatatccaatttttagaatcagcaaggatgccactgttggcgtcacattccatattgcttacatttgacatgtgcctagttttatctcaaaaatggggcttcacaaatcaaatgttattttctgcacctgaaaattcaggaaccacatactactgccagcagaagcacaatgtgaaaacataagaccagcttagcagtaatcaaaagcacctgttttcacaaaatgtttgccactgttctgaaactacacataaattttaagtttgttggctagactcaatcgtgaaaagcagttcagataattatcagaaaacaggaatttcatcttacattaaatttatttttaaacataaaagtccaatcctctgaatcatatttaacacatagtaagttatgtagaaaataacttattccaacaagcaacatacaattccctgtttatctattgatagtaacataatctacaatagcaatataaagggtctaattctccacaaagcacagaagatggtgatgctgtgggctgtaacctgaaagaccctgtacaactttgtgcactttctggaaataatttctttgacatataatctttccttggacatacaaaagccattaagaatctttataatggagtgcacttgaaagactagggagaagcataaaataattttgttctacagaaaacaaacaacgactataaagcaatcatacattttagtatcctctgatgacatggtaagtgtacttttagcttaagaatcatgctcaatggatgtttaggatccaaatacagagaagattatgacacacttactaacactattctacagacagagcaaaccatcttttcatacccccaaatcaccacccccactttagacaatccctaactttgcaatagtatactaacagaagactcctctatgtgaatagcaacagcagtcctgcaaaataaaggttttctccagtaactatgtcccctttggccacagtcgtcttttacctgttagtgacatattgcaaaaagactttatgattaggcctggttttaaatctacatttttcctattctgagtgcattattcctaggaaaaaatggattcggaattaaaaaaaaaaactgatttaacaaatgaatgtcaaagaaacaagccatccagaagatggcaagggaagtactgtattagaatgaatacacttttatctctggaggctttatgccccagcctcctatccagattatacaatgactccatctcttcaatcagggtcatcccaacatcctgttctccaagaaggaacactgtatctcaaacgctcacccttctcaacacctccaccactccatcccaaaactttgatctggttttcttcattgtacttgccactagtttttctgttttctttttagcttgctgactccactagggcaaggacctcctctgtcttctgtaccacggtatctccagcatgtagaatgactcttgacacgtgcatcatcaagtaattgctgaatgaataaaaatggtgggatgcttaccacaaatacaatcttcctattcttgaaagaataaagatggtaagaagaaaattcaagcattatattttattatttacaatattattaattatgaataacttatttagtcacaatctcatactattttgagccagttcaaataatttctaaaacagaggtcttcaaaggtttggatatcaactgaaattcagctcagtttctacatatctataaacctacttgctgacgtttagtttaaatctacagatccaaataactcagtcccatggttggatgtttcagaaaagctttttggttgtaagattatgtaatagttagtgagatagtggggtagaattctaacacttcaaattttaaaaagcagattaaaaattctattatattctaatacaccactaggcatgtttccatctggcatcatggtgaatgatctggtgagaggtacatggggaagttgtgtgttccctctaaaacaagacttaactctctaaatgaaaagtaagggcaaagaatgttaaatgcactgcagttatgctgctaagcggaacgtcatctgtccaaatttgcccactagctatccccttcttccagctgtttgggatgtatgctgccctggggagacacagctctactgactacacctgccagtgattcctctctctctggggtcttcagcactctccactgggatttagaaccccattttacaaataggaaactgaagaagcatactgacccaggtgattcatccaaagtcacatagttttttagtcccattaagagaattatattttgggaggatgggaacttttatggaaagaatatagtttccatcggtggcatttattactatcaaatgaaaataactaaagaatcatattttccaaataagagcttaccaacactatcaaacttgaaactagctgatctgagttccaatctgagttctggtcctttctaattctctaacctagagaccttaaggactggaattagtgaatacaaccctgagaggagcctcttgatccttcatgtctgtctcctttggatgtgggcttgattccctcccagtccagaatggtttctccatgagcacagtgcactgagttgaatttgcaaactctcacaggagcattctgattgacctagctgtttatgaacagacaaatcactaaagactaaaacgtggtagttttctataattgtaacccaaattatcacagttttgatcaatcaataatgacagaactgaaggagaaacaggagcattttaaatatgaacattgctcttccaaggggaatgaaaaaggagttttaaggcagacaaatgatgaccactacatcatgcaaacagaaagcactagaatatgctttttattaaataaatagaagccttggtgatcttgtagaaatcaacaaaaaataagtagaaaacaagaaataaaaattaccacatggatgtgggcccaatacagagctcttctgtgtttgtatagttaaaacagaaatagcattgaaggaattactcacctccacatgccatatgttacatccgtgaaagagtaatgtgaataaaaaggaggcatgaaatcttattgcacattaaattcaatagagtctatgtttatttgggtcaagatatagattttgaacacatattgtatttcttgaaataagccagcaacttaacatataacttacaatgtatttaaaggaggcataggtttattcagtaacttgccttgtctggaaatgaacatgttcacattggaacgatttaaatgaaagctggatgtccatatagctgggatattgaagaaggaccttctatttcagatagcatgccgtactaactggactccgaagtccctcctaactctaatactgtttgaaataattatgccattttaagtcccctgaaataatattcactgatgaaggtagctatatttgcaaaccacagagcaaatgacaggtgacacagaaaatcacctatggtttttgagccaccgacaatcactttaattaacatcatctgtaaatataatatcatattaatttgacttgcagtattaaatcaggagtttgtttttgttcaggagtttaagataagatggcctactgttcaaaaaaataaagccacctatcagggaactaagtagttacaatttatatgtagatgatcctggaccttaaatatcatcagaaggctcatcagtgagctaaaacaaaagtggggatgagaggtgaaggaccagacccaataagggagtctggctgctattcccagttccacgacaatcagtggggactccgtaagttgattaacttgtttgtatatgttactttatctaaaaatatactcaggttgacaaagtagattctaaggtccctttcaactttagtatttctttattccatatagaaaaaaatatagcttgagacaagaaagttggtcatacaaaataaccagcccatggaacatgatagccaatcaattttcaacaagacaaatatactatagatggaaagcaattcttagggaagaaaaataagcagtatagtcataaaacaagcaagtttgccctatttctttataattgatgtttcttctaattcattcgggattttttgagttaaactaaatacagctaaggcttgaatcattcaggatttcacatccaagacctgtcagtctgatgatcccactatttttaacatagaaataaatggcttctatgcttgtaagcactagagaagtaaggacagcctatgaaatgtgcttccctctctccttccttttcccctccccagttccttcctcttccctgtcatcccccacagactgaggaaggcaagactccctttgattatgtgttcagctcttgcacatatttctgcacaaatcaggcatctttccaaagtatatgtcagagttctcactctagccttgtggcacacttatcaagaaagaaagtcctaattagacgtcagtttcctgaagcagagagggtgtggttacatgaatttaccaaagggggaaaactctaaaggaaccagtaagaataaattacttatctaatcacccacaccacagcctaaaaattatcattctacaaataccactgtcaatattgtttttcctctaagaagaacaatgcatcgtgtttttcaatgacatgaaagaaagtgaagcacccttttaaaatacgatttgaatatctaaggcactttaaagcctgaattgcctaactaggaattgtaaatgcatacaatgcatcataaaataatttagctaacaatgatttcatacacacacatcacaattactgctgaatatctattagaataggcaaacaacaacaacaaaacaacaaatgaaataatttgtacatacaaatgacccttttattcagaaggtctaagccatattcatgttcctccctctctccagtttccctgaaatgaccccagtaagaaaagttaattggtcactaatgactgccctgagagctttcccagacagcttttcttcaatctaggagagtcaggaagaccaagaacagcagttaccatggaggagtcccactcctaattccatactattacacaggtgtataagatgctagcgctgtacatgagagtggctcacatacctctattcataagagagaaacaaattcttctttctcaagtaattcagctgcatggacagcaagaggtcaggattgttatgtataagcacagtgttaagagattgcttctttaatatacattatctgtcttatagctggaatattatccggtgtggctaaataaaaatacacatgacaatagaatcagacattttatttttgtatgacacatgaattaacatatgacctgccagagcctataaaaagacattaccataacacagtatttagcgaaaaacaaaaacaccaaacataaaaaaatggaatgttagggtccttttctagctcttcactacattcaagtttatgacagttttgtaatcaaagcaagtttttctcaaggaaaaataccaaatgaatcatctttgtgagaatttcaaaaagtaaatggtgcttcttggtggatacgattaaataaaaaatgcagtctcggatttacaaacatcttcagaatttcaaaggtttatcaaaattctccaacactacttaatattcagtgatagattatgaccctaaagtaacaggaattctccccactgagcattcctgtcagaaaaacaattccctcaggatatttaggtgatttctttttgccttgaataccaatgaaaattctccagtcaatacctttacctaaattgttttggaaatcaagcaaagttcaaaatatatacaatatagttctataactgggaaaagctttagggacaaagccaccttgtatcacattttaaaagactaaaacccagaaatgtttggtgacttacccaaagcatgcgtctgtctagtttatttaaactctaactctagaattatgaaggatagatgagtgatgaaagcagtttttaaaaaaatcaaacatggccatctcatgtacattgacatacatcaagtcaatataaagtcagaggagatttaaaatcattctatcatcattgtcactgctaaaactgagttttgatggaatttcagaaaagtcatctattattaaaataacttcttttccatagcatttcaccctatggacattttaattcagactctggcatttaacaagattataagtgatgctgtatttaagatgaaggaatgggtggtgaaattctaaatcagaacccacaatagaagagacattaggataaaattaaatatcagaactggaaaatgtactacagggaggacagacttggagaattttctgggaggttctttttagctgactatttcattattacacatacaaagttcttgtggcaatcttctctaaaggaaaaactgacaagacagagggttaagtttctttcaagaagtaaacactctagggagaaaaagaagaatgacacttctggttcatcaatagcatcattaagatgtgaacatcatcagtaaattccaccacgttttcagccttaatgtagatagtttttctaagccgtctcgagaaacacatggggtataaacgtttaaattatgccaaaaactaattaaaacagatatgttgtagatgtaattgaatgcaaccatattacccatttgagaggactggttttaaggtcggtctcactctttaatgcttttctacagctctaagatgtaagtggatgtctcccctacccaattcagagaagccctgaaaccgaagccaaaagatgcactgagaagtcattgtattatatgacttatcttctttaaaagccctggctatttgacatttgatgaaatgccaaatcccaagtgcctgagtccactctgacacattctgtttattatgtagtagtttcaagttggggacccaatttgcaactaactccacaagttatatattacataatgggtatgttctgataaatcacaggaaaaacatgtcagtttcatatctaaaggaaatgacttttgatatttaacatcttatccttagcatggccttgacaaatgagataaaacgtgattctctttgagttatttcacttaatgtataaagactacttactatcttcattatataattgtcctaactctagtttgggaatatttcttagatacctccatatatagttcttcttgtcaagacattttataaacttacagagtaattctattgtttttaaattcttaccaaagctagtagtatgcaggcatttgagaaatattgttcaattctgtttctacaaacatatatcatggtacaaacctgagatggtatgaatctgactcagtatatattgactgcaaaaaatctgtacaatgtctaccagtctaattaaaagttcataagctccttttattcagtttctgagttttcagaattacacatgcaatctgacaatattttttgatgtgacataaattttagttaaattctaggatatagtacggaaacaaaatttaggaaacagagtgtcactctatcagaacacattattcatgtgcacacatttaaaagagaaacatctctaaaaccccgaggttactcaggtaaaagcaatacagccacattattcaagcaaatatcaaataattacaattttacattcttgtattattgccaccacatgaattttcaaccctcagtcttcatcaatcgcaacagaatttctagcatttagaaggaattctcatggctttcaataccacagaaattgggatttaaattatttattagttaatgctcagagtttataagtgggatgcattcatgattagacatcaaaagaccagaacgaattagaattgaaatataagtttataaagatccttattgaagaagacaaataaataatttttagctttttaaaaatgtagatcatacataactgtcatcttcccccatttggggcacatcataaactcagtgatctctgtgcatagctgctttctctctgcacccttaggcatttctgggcattttaaatctagtgggacaagtctaaaccttaccagaaacttaaagcgctgacagataaaagaaaactgctagttctcttctatttataagctaagtttcaaatgtctcaatatagacatattacggatactacaggtatcactgcttctagctgacagcaaataagaattaaccttatttaataacaaaattgtaaacatgcatcagagaaaggtacttgaacttccttgtacaaacaacacctgagattaatcacagataactgtctagaagtctgtatcaggagcattaagcattaacatcaacttgaacatgaacaattatttcttccaaatgagctagccttccctattctgaaagaaaaaggaaagcaacaactacaacagagcatattctggccacctactacgttggcttgcaacttttttgaatggcttattaaaataacataattaatttcacctaaaatattaacgatgtgtacagaccttggctggtgacactgtctagatgctattatctaatggctgttcttgcaacaaatcaagcaaaacatagcacttcagtacttacagactgctcacagagaacaccatctgagaaaccttttgcatttaagattaaggctccacacaaggtttattgttagccccagcatgcgagaaggaaccggaggatggagagaagcgcttacttcgaaaatgctctgaagcgtaataatagacatcctcatagccctcgtggtaatcctcttctggtcggtactttttcccctttcttctcctagatcttcttatcgccttgacaaaacccaggaagcggtccatctcttactcaccgtgcagcgcggcacagctagcacaagagcacagcaacagcccagctgctctgcgagccggtggagcatgaatgaccaataccaaacctggaccaggacagctacccttctatctacctctgggctaccatcaacacggcgactttggccatcggaggggaaagaaaataatagcgatatgggtttaccttgacaatatttctcatttagatcaataaactgtcaaatctgtaatttttttaaaaaaaaaagaggaaaagagaaagaaaatgaaatggtaataaaagactaagagaaaaaacaaacagcaaagctttggactttaaatagcttcaaaacaaagttcaagagattcagctgaggcaagaggagtcccagcacgagaatttcactatccaatatctccatcatctcatcatcggggcgggggtataggagaagggagggccggggaaacacattagtcaatggactgaaccaaagttagagactgaactgactttcctacctgctaatccaacaccctaatcctagcccacattatctcaaaacatgtgcttgggaaacctcttgaaaagctattgttttgcaatgggcgtactgattaaccctttgtgctcccttgcatatcatattaataagcagcaaagtggtttcatccatatgcacagccctcttgctgacaggagtgtgcagtatgtgttaattggagcagcagggagaaggctcagcagctgctttcaaatgacacgtttacccactgggcattaatgtattccaatcactgtttgatttaaatattaaaatgcacttcacagagaagcttctcataggcttagtaacagcataccataatcagcaaataaaggaaactgcctggtttaagggaaaagaaatacaaataatccaactcaacttagactgaactcaaatataaacctagctcaattgttacatttttaaaaaaacatgaaagtaaatgggctaaacagcaaacaaaacttaattcttcttggtgaagacagtggaaagagaaatttcataatatgctcacatgctgttcatcctttatctctaaaaatcacaagctttaaaaaattatttttaagaaccacaatcagaaacacttcatagtagacgagagaggtactctaaagtctagagaggtcagcattaatcatgaataatttttttttctctatagcttctttcttcttcaggtctttaagcgaaagagaacttttaacaccaggaaaaatctgatttgtttacaatataattaatcaagcatgtcagcatattacctatgaaactaatgatatactgcagctccatgttcccagaaatataatttttaaaaagccttcttactgaataaagatagttcaatatctgtgtaatgtcaagtttgtaggatcatcccagagggaactgactgcactttgcactctctgttagattcacaagcaatttgtctgtcttctagatttacacagttccctattttcagatataaattgataatgatggagcagggagaaatttacttagaaaggcaaatattcatcagccaagaacatatcacatctaaaatatgtagttactttcaatggttctgtgaagttcctttattcccagaagtttcccattttgtatgccttaggagtaagtttgtggaaagaaacactaacttaatgatgctgacaaaaagatgctataaaatgttttatgaacatctttaaattaaaaaaatcacttgtccttaggtttcttttttttttcttttttttttttttggtttcaaatcctttattattctgattccctcaaccaaaacaaactagaacaattaacaaataatgaatgagaaatttgaagatctggattttagacctgaatagtcactaaatatatgacaataataatacacaatcttttaatttaacctaacagctctaataatgaggtgaatgtcattatacctctatggatgagcaaaaaaaggttcaatggtgttttagtggtttgtccaagatcacaaagctaatattatcatggcaggtagtagcaggtatttttcataccagttcagagattattttgtctatctaagaattacatgcattcaagttcattcttttctatgtaaattttctcttgaaatggaatttgaaaaaattgtcaactttcatttttaatggaccaaacatatatcttggtttatgtgattaattcaagtatatgtgtcccccagagataatgcaggcaataaattttacgcaactacacttgaattttaactcttaaattagtagagtccatattaagttttgtagttttaagctcccagttcaatctaaaaggactaacttacagaagagatggtgctttactctttaatacaaagaagatcccttttgcatagaacaacttaaaacatttcactagagtttgattttttaattttggtatttaaagggactgattttctcaagcagtggtaagcaactatttttgcacaagaactaatgcagacaaagtaaaattatctacataccaaactctgttttcagaaataaacagaaattgtacataagcacctattttttttttttttacttctgaaggattacatttgttaacatttcagtatctgtaatgatagaatttttatatgagatgtggtttggtggtgctggggaggaggagttcagagtttagccatatatttgaaggcatacagcagaaggtgtaaaagctcattacaacaatcagagatgcttgggaagccaggataaggaagctgttatttaggggaggtccacttgggtcacagagaatgaaaggatgttgtaacagatgatgtgaaggagggaaagcatgagtatatgggccacaatctgaaagacagaagactagacaccgggtgctctgcctgaggggtggcggaggtaaacgagatcattttattcaattttcctgggtccatatttcttgatatggtttatatctgtgtccccaccaaatctcatgtcaaactgtaatccctagcactggaggtggggtctggtgagaggtaactggatcatggagatggattttccatgaatggtttagtaccatccccttggtactattctctcagcagtgagtgagttctcatgagatgtggcccgttaaaaatgtgtggcacctggccaggcgcggtggctcacgcctgtaatctctgcactttgggaggccgaggcaggtggatcaaaaggtcaggagatcgagaccatcctggctaacacggtgaaaccctgtctctactgaaaatacaaaaaaattagccaggcatggtggcgggcgcctgtagtcccagctactcgggaggctgaggcaagagaatggcgtgaacctgggaggtggagcttgcagtgagtagagaccccgccactgcactccagcctgggcgatggagtaaaaaagtgtggcaccttccccctctctctcttgctcctgctctggtcaagtgagatgctcactccccctttgcctttcaccatgactggaagcttcctgaggcctccccagaaatagatgccgctatgcttcctttacagcctgtagaactatgagccaattaaacctattttttatacataacccagtctcaggtatttctttatagcaatgtgagaacggactaatacacttctgaattttttcccatcttctgcactaaaatgatccatgtttagcaataaagggccaacctaaagccctttgtcaattcttggttgtattataatagctaactgttgtttaacaattgcttaacagttagctattataatacaaccaagaactgacagattagtagtgtagttcaagtccattcaattaggtgtaccactctttgcgtagagagaatggccctttcactccataccacaaactccagtaagaggtgctatttatcagttattgcactctatagtctaaactgatgggacagttgagaagttgcaaatggcagttcacagaatggcagtttatctcccacaaatacattttgtttggctcacatgaatgtttgtggttttgttcttggttttttgtttttttgtttttttggagacagactctagctcggtcacccagggtggagtgcagtagcacgatctcggctcactgcaacctcttcctcccaggttcaagcgattctcctgcctcagcctcccgagtagctaggattacaggcgcctgccaccatgtccagctactttttgtgttttgtttgtttgtttgtttgtttgagacgggttttcactgatctcaaactcctgaccttgtgatctgcccacctcggcctcccaaagtgctgggattaaaagcatgagccactgtttttctgttttgttttgtttttttttaaactgagcaaacatctaaagtcaagagatttcataaataaatcaaacgtttgtttttgtcttgaaatagcaaaagatttggtaaccttgagcctgattccaatatggcaactattgattagagctgagtggtggctgcctgccacccataaataaacatgtgctttccatttagctagagtccctccccagggtccaattcaatcattcagttaccacctggcccctgcaggcataaatgttgtgaacaatggttgaagtactatcctgactagccagtctcaaaacactaattactttaaaagaaattccagcacccctatattttgatgtaaagaaagcaggctattataataaattggttatcagttgagctaaatgttcactaaactataatattaaatttattagaaaaattcgttcacatgagaaaataaagcagtttgaagtattcaacaaaatgcatttcaaccagcaagggcaaatatatgttaacaaatatgtatttttcaagtactaattattttcttttttgggaagtaggcaattgcctatatagcatttacatgatttccgtactcttctgaactggattcttcatccccttttaggaaaaaagaaatggaccagctattgagattaaatcttcaatttataacctttcctagatcagcgattagggggttcccttcaatgcataattaaattgagtaatggttatagtattttttttgagtaacagtatgaaacacacagtctataagagaaatctttaagacattaaattaatctggcccttttagatttcatagcatctgcacgcaatgccaataatcgctgcagccttcatgtagccttgggagagataccctgacctactgaggatgagaatgggaaagaaaaaaacactctgttctctggcactaatggtattctcattagacccactcctactttattgtagcaaatgatttgtaatatcccttcttactaactgaaactcatagatcatgtaactcatgagcacataatttaaacacaaaatgtctttttttttttttttgagacagaatcttggtgtgttgcccaggctggagtccagtggtgcaatcacagctcactacagcctccacctctcagggtcaagcgatcctcccacctcagcctcctgagtagctcggactacaggcatgtctcaccacatacagctaatttttgttttgttttgagacagacagggtttcaccatctggctgatcttgaactccggagctccagcaatctgcccaccttggcctcccaaagtgctgggattacaggcatgagccaccacacctggcttaaacacaaaatgtcttaatgctgatatatatatttaataatacatatttcaaataaatggatctgagggcattgctacaacagaaaatatagttaaatccttgcaaccacttctaatgaataattctgaatttgagaggggatcagaagccattccatacatcatacagaaaataaaaaggtagacaggtagatatcagaataaaaaccagtatattcactgtacactaaaactgaaaaatacttcatgtctgtataacagtattagcttctaggctcaaataattataaatagattttcatttataagagtttttattggccaggcatggtggctcacagctgtaatgccagcactttgggaggccaaggcgggtggatcacctgagttcaggagtttgagaccagcctggccaacatggtgaaaccccgtctctactaaaaatacaaaaactagccaggtgtggtggtgcgtgcctgtaatcccagctactcgggaggcttaggcagcagaatcgcttgaacctgggaggcagaggttgcagtgagcgagatcacgccactgcactccagcctgggcaatgagagtgaaaccctgtgtcaaggaaaaaaaagagtttttactgataatagttatgtgaggtagataggatgcagaataaattttccgtttgtaaccacgtctccctcattttaatatttctagcactttcagccaccatccacgaaatgctagcaataatccccaatccccagcattgtgataacccaaaatacagaaaaaaatacttactatgtttaaaagactttttccacaaataattcttaattgggtctctaatttgattctgtccaatttctacttatttgtgttgtttattaaagcatagagccacctgcctaaacagtgataatataccctaagtttgctcatctgcaaattggtgaataaattaagccaattcatccatctgtgagctatttcaaggtcgaccctccattggctacaagattttgagttaaaaagacagtggaggacagtgcttacagtttgataatgtttgcttactgagcatgaaatgaaatttaactgtggcatgtctgcatttgtaaatttattgtggttgtttagacttcttgcaaaatgaaatgtcaggcagtcattctgagactgcaaatatattaggcttcaaagggctcagataactgaggttattgagttttcaaagatttttttctactttttttctaccatatagaatatgttcattcaataagtgtagaatgagcataaaagagcaaaagcataaaaataatttctgaatgtaaaatgctaagtgtgccgttctgactattataaggatttcaaaaatgttcattgtatcggaactcattttttcctgaaggtgtatgtgtcttaggaggaaagagttggactagaaagtctcttctagctacaagatgttatttttatgcagctagatgctttgaagtgatgaaaaatatagtgctaattatagtgtcttttaaggtaattgtgagacttcacggaatctatttaagctcaatgtttgatggttctgaagaatatattacctaatgccttctatttcccggaattcattccattttccttgtctctctctgattctctctctctctctgactctctcctctcttcctccttccctccctccttcccttctttctccttgccaacttgttcttttcaagctacttggagataagaaaagtctacttactttaagttatacatatttatttatttatatttgtctcttggttggttggtttttacccaagtactgaatttctaaaagctgagaattttatttattcatttggctacaggaacattttcttggtatttaaatttgttcctgtggtctcacttctaagctgtcataaataatctaatttaaatttctcttcttttccgtctctaaatgcattgccatgtgattcatctttcctgccttctcggcctttttctcttaaagccatttctttggcccccaatcctagctatgatttacaagcaaacttatttgggttaatagcaagtattttaaagcacttgtgagttttagattttttaacagccatttatccaatttgagttatccagcatttctgcctctcctttttacttttatttatttatttattcattttgcgatggagtatcactctgtcactcaggctggaatggagtggcgcaatcttggctcactgcaacttccacttcccgggttcaagcaattctccagcctcagcctcctgagtagctgggattacaggcacccaccaccatgcttggctaattttttgtatttttagtagagatggggtttcaccatgttagtccagctggtcttgaactcctgacctcaagtgatccgcctgcctcggcctcccgaagtgctgggattataggtgtgagccactgtgcctggcctcctctttacttttattattgagcatttatctggttcattcgtctgtttgttcatttatttactcaattgttcttcacacacataattacatgttcgatatttattatgcggtaggtgtgaaacagaatatggagggaaaattctaagtcatcattcgccttgatagtagctttagttacaagttcaagtaaagagtttaaaactgttagcttaaattacacttttagaatgtctacagctctaaggattcatttttttgccctataaaatgtatttagtgccagtcacatgctagatgtttaatccatgatggctttgaccaacttttagaactggtcctatttcacattcttgctggttgattttggtgtttgacatactttttaggaggaaaacattaaaggcccttgaataatttaaacagtatgtttccatgaactatgaagaatatgtgcttgtctcacactaaatctgattcatttattcgacaaatgcttcctgtgtgtctctagtgccaggcactattcacactctaaagatagaacagtgcatatgagggtaacactcctctcatggagctatattatagatgaggaggtgtgttagtctgtttgtgttactataaaggaatacctgagactgggtaatttataaagaaaagaggattattttggttcacggttccctaggctgtacaggaaatgtggtaaaggcatctgcttctggtgaaggcctcagggagcttatgattatggcagaaggtaaaggggaagcaagtatatcacacagtgagaaaggaagcaagagagaggaaaaggtgccgggctccttgtaaataaccagctctcatgtgaactaatagagagagaactcactcatcaccaaagaatgacactaagccattcaagagagatctgcaccgatgatccaaggacctccactaggccccacctccaacactggggatcacatttcaacatgaggtttggaggggagacacatcaaaccatatcagaggaaacagataacatacagtaaatacatcatcaaagtaatttccaatggtgagaagtgacaaggtgatgcaatggaagtgactctgggggctatatttgaatggggagagctgagaaaacattaccaggaggagacacaacttgagcaaagacctaaaaaatacaagaagatccattcaaccaaaggtgtgggggcagtacctttgatacagcatgaacaggaaggatgacaatactgagttggcattgtgccagggacaggaaggtgaccactgtggagaataataggagaggaagctaaagaggcagacaggggccagctcacctcaggctttccaggcccagatacaaattgtgggcttctattccacatgcattaggagcacatagaactcagtgcacagtgttaaatagggaagtgacatgatctacatttaagatgaatattctggttgtttatggaaaatgggcaagagtggaaatagggttctcagaaagaaatcaagcatgattctttgacttttggtgtgaataactggaaggataatactgtgatagtattactatgataggaataatggtggagatacaggtttaagggttgtgccttaaactattgtctatattatgtgtatatactttatatatagttataaattttatatatagttacatactttatatatagttataaatctatgaattttattttagaagtaaatgtaccaccttca

SEQ ID NO: 285 - DNA, 900291 bp, Homo sapiens
tttttaataaataaattttttgtttaaacggtatgttatttgaaagtgtactgtttaatgtttaaatgcaaggtgattttcagacatttcgttatttttaatttaatgttctcatgtcaaaataagttcaatatattttaatgtattcagacttattttatggaatactatggagtctattttgatcagtgctccatgtgtcttcaagttctttgatgttttcttttgcagtgtgcaactgctattacatacaggcaatgaatttcagatattttatttcccatattgtatttttcagctctagacattctaattggttcttttttgtgttttccacttttctccccattatgctcatgttttcctcaaattcttgagaatatttacattagccgtttatattagttttagtggcttaaaacaacagtcatttatcttaccgttctgtaggttgaactacagagtgaaatctctctcatgcttcgaatttctctgacttcctcttttgcaaccaaccaaaggaaagcctctacatttaaaggattcatgtgattaggttaggcttatctggataatctctctatctaagtcaattgattaataaccttaattatgtctgcacaagccctattgtcatgtaatataatagaaccattggggttattttagtattctgtctaccttgctgttttattatatttgtctgctcattcgaaaatatgtaattccaaaatctgttatttttctcctgcattttacatgccttataattttcactggattctgcacaatgtaaatgtaacagggttaagtgtcagtatttcactgtctacttttaacaattgttaaattttgttttagcaggcttaagttacttgcagatcagcgtgaagctttccagacttgtttctaagatgttttagggtaggtgtttagccctactattaaagtataatctttctagagactctactaaatgctctgagggttcaacaagggctctgcaaatgtctcctggtcagccagggtcagagcgcaaatgtctccttgcactgcatgaactctgatgcccttcccaaatagttgttattttcctgatgtcccagatcctcatcctatgttttcacagtttagttgttcagataaacttcaagggaacctcatacaggtttctggtcctctttttgtgtagccttcatcttgcgtatcttgtgtgtagccttcatcaagatgcaggtgacagcctccttaacctctctgaactctgatctctatctcctcaaatttatcaatctatcatggtcagcttgggtctgaatagtggcacgaagcagaaagtcatgacattcatagagctctcctaatttgttccccttctttgggaatcatggtctggagctgctaattacccaatggcttaaacaagttctttcatatattctgtctgattttctaatgattgggagtaagtgagaggggaagtctgggaccaattagttcatcatgaggaagcaaaaattctcaatcgaggttgattggctgaatgaatgtgcacaagagcttaccttctaccatctcccacagaaatgaggctagatctcaatttttatggtttataaataccttgttttttttttctttttgtggggatctgagggactgaacaaagtcataaaataaagaactggtatggctaagatactagcatcaacttgtcttacacaatttctatggagaaaggataatgagaaatgggccaaaatcacaaagaatcaaaacttgtaaggaacatacatgaataactaaagaaatattgtttgactcttaaatgaggtgactattaaacaatatagtagacggtctcataagacatattaaaacatattaagacatttcccagagggaatcacccaatattttgaacattttagaaatagatctataatatccaagttgactacactgaaagacacaaagcttatttggatggccaagttttggtattgtgaaaatagcgttattgtactcagttaatatttactgaattaagtaataaccagaaaggaaaacataccctcaactcacttcaagcaaggcactgaacttgagctcgatgcaggtaggctttgaacttggcagtttcagggttttaggggtggttgacagtagcatctcaataagctacaacaggacgtcacacagagagagggtcctaacaaagcaaagcagcttgtccaggaccttaagatacagtagaggtattcatagcatatgcaggtctagaagacagatagagaacagacattctctacctcttatatggaccatacatatgactgtgggaagagggaaaaaaaaaaaacagcaatcgaacaagcgggtaccaatggttcactagacatgccctgaaggtgccttcccaaagagtaaaaattcaggaaccccctgctgatataaatcagcatctactgatacacagacaagcaatagagtacagtagttaaaagcatgtctggggaacacagacacaagtgtgctctgcttctgtatccacaagctaggaagcacagtgactgaaacacagaccttggagacagattttctgggttcaaatctaagctctggcacttattatattgatgagattggcaacatttttaataactctgcagctcaatttctttatctgaaaaatagaggtaattataaaagtacttaccttatatatttggggaattaaataaattcctaatttactatgaagattaaatatatcagcatgtgtatgtcattggaacagtacctggatcaaagaaactaccagaaaagtgttatttaccatcattatttctgtttaaattagaataatgtcaataatagcaaacatgttcatagattcattgcagagattaaatgatgcattgcatataaactgcccatttcagtgcctaacacagagtaggtctccaataaacagaataagcctcacacattggtcagagttgattcaagaaatacatgaggttcaaccagcatattcaaatgcctccattgcccatagataagcaggtctttagaatgcaagggcgatgtggtttgattcttacaataaagcgaactgtactactttacaattactactagccctaaataggcaaaatatcatatcccacatatctaacacacatataaaaatctatactattgctgcccctcccctcccctcccttcccatcccctcccctcccctcccttcccatcccctcccctctcctcccctcccctcccctcccctctcctctcctctcctctcctctcctcctctcttttcttttcacagggtccggctctttctcccaggttggagtgcagtggcacaatcatggctcactgaaacctctgcctccagggctcaagccatcctcctacttcagcatctcaagtagctggagctaaagacacatgccactacatcaggctaatttttgtatttttttgtagtattgctacgtttcttatcatgagctgaacatgacaaagtgtatttttaagacaatttaaaagtccatcagttatactcaatcctttttaagttttaattttacttcccattcaactggtcatttaaagccagtgtaacgtggagtttgatagtatatcctcaaggtctagagtcaaatcaagaactgactccagggctactacgcttttatgtcgtagagttctaaactttccatagttcattctcagaggagtataagaatcagtagctaagaattaatagctgcttatcttgaagcagtaaccatctaaattagtaccctcaattttgagagactggactcacactagcttaaacagagcataaaatatattgggtgacaaaaggaaatgttcgaaggcaagtacagttggagacattgctggatccactgtcttgggagactttgtcagagctctgcttttcttttcatatcttggatttgcttcgttgtgagggttgattttttttttttctttttgagatggagtctcactctgttgcccaggttggagtgcagtggcacaatcttggatcactgtaacttccgcctccctggttcaaacagttctcctgcctcagcctcccgaatagctgggattacaggcatgcaccacgacacccagctaatttttgtatttttagtagagataaggtttcaccatgttggccaggctggtctcaaactcctgaccttaagtgatccacccgactcggcctcccaaagtgcttggattataggcgtgagccactacgccccgtggtgtaggttgattttattctcagacaggctttcttcatgttgtggaaacaacacctgctagaagcaccgggtctctatcttcatatatatttagctaggaggagtacatctgacttccagtattcatacataaaatttcaagttctttatctatctttggactcatcagctccaccaggggaagaaagagctcagttcagccaaccctagatgtgtgcctgtatctgagtttgggtagatggagcgttaggatccatctcaactcctgaaaaaggagaagggtgctttcccaaaggaatggctgatgatgttaccaaaagaagggaagggacattccgtgctctacacgtctaaggggcactgtagggagactgaaaggattataggggtagggtgaggtacaagaccttctggacgggcctaaagcagagaacagtttttgcctattaagtcaaagccattttgttttctgagtcacagctctggaaggaacaattggtttttttaaattgtagtacaaaatatgatggagagagatttgtacctggagaatcacttactgtatgagtgacttgccccaaagctgttgtttcatatacctacccaaagggcaggacaaaacagtcctgcctgtgtactgagagaagaaaagagtggaaacattgagacctcagaagaaagaaaactggggagtgagtttcctttggtccttaggtgagactctccttgtggctacccagacactgcatccaaagggcaatgagatctgagggatgtaacaagtaaggtctttctgaattgagtgcaatcgatgagacagagcactcatagagcatctggagtccagacttaagatatgtaagcttcaaggcaacaagatggtaaggaagataaactaaagaagcagtaacaaatggcagcatattgattaaactatactttttaccttcctaggcctccactttcggatctataaaataacattaataataatgatatatatcaaatgaggttatcttgagaattgatatctattgtgcctggtacctagtaaccaagtgaaaaatataagctcttggtaatattcattattcatataaaatgtacattaatataaatatattcatatactatttattaataataatataaatacttttagtaatgcctaaatacatttggctgcaagtaacagaaaacacagctaatacttacctatgcaatgagcagatttcttggcttatgtaactggaaatcaaaagaggaagcattggggataatttgatctagtggtacagggaacctctgtgtattgaactcatcttcaggcagctagcgaaagaactacaataatcctgggtctcatatctacgcagaatcatgccagatgcaagaagtgctttcagaaacccccatcaaacctttccctagatgtcactgccttgaattcctgagtgaactaatagaaaggaagataggattaccagtagggatcaatttcaatccacccattgcaggctctgtggagtgaatttctctgcacaataccaaggtttcttaacaaaatgggatcagaaaatggatgaatggatgctagttaagtgacgaaagttgtctattacaaatagataaagcaaaaaagtataacagacaaaaatggaatattctctctccaagataaagtgaacacccattcaaaagtacaataaaatgtgagattgtattttgaaatgcagaagatattgaagagtagaacatcttccagcagcagaacaacaaagaaaataagtaaaattaagatgatcaagaaaacaaaagaatatgaagtaagactgagacctttagttagttattttttactaaccccagagtgaggacagattgattactaaatagaatcaagcctgtgaatacattttatagcttacaatctttgtgcctaaaactaggttcccctccaattaaacctgacattttctaaccttaaagaacctggcccagttttacataaacctgtcttaaacagagatttctgtccatataatctcagaaaaccaaacaaaacgaataccgtgttccttatcaagtgccacatcctatgccatggttaaaggtataaagatgaattataaatcatatgtaatagatgtgtagtgattttgcaagctcagcatcactttccagttcgtctggtaacagacttctctttccatgtagtttaagtggtgctggtgcctggctagaaaaataggtctatgcttcctagctcctctaaccagcctacgggcatggccacagttattaattcctaagtgagcatttgactcaggaaggaccaatcaaagctttacctgcgagttaatcaggttctttaaggttagaatattttagtcctgcacattttttaaaaaagaaaatcacttcaaaatttactaattatctttaagttccagaaactgtctatagcgactaagaggaaaatgatttatctgtcaacatttctgctctgcccactttaagttttggtcactgtcaaataaagcagtagagaatggcaaaaccagttctgtgtcattcaacacatgagtgcttcttaggcacaaaacattatttgaaacatggtcccggataaaaagataaataatacccagcccttaccctcaaggatcttacaacttggcaagggaaataagacatgcacacagatgacagcaataaaggaaagataatgattgctaccagatgtttggggagaaggagcagagcaaagagagaacgcagaataaggcagcattcaacagtcagccaagaaatatttattgagcaatcattgggtgggaaatgaaaatggaagcacagagcatgagccgagacatgtgcaggtgaaaaatcaaatgacattacttgttactccaactctccaaatatttttgtcaccaagtttgtaataaatagcctgaaattaaaaatgaaataaggatatagtagtctctgtcaaagacagcctgaggtgctaatgcttaaacactaggatcatagtatgagtgttcctaagtatgcctctctattgctttatttatatcttcttccaaatgagttgatgctgccctaacagaatatctgttcagctatttcacctttttggtcttgtgtattagaacaggtgaattagaagaggattcttttggcttcaaacagaaagaaagtgctatataatttaaaaagttcagaggcaattcttcaagcatgtttggatccaggaatgcaaatgttttaattaagcctcaatctctctctcattctttatctttctctatctccatgtatttatcttactttggggttcatatatctccctgttcttgtggaagcccctggcacagcttcaggcttatattctcatagctccacaacttgcaggaaggagcaggtaccatcatggcatatggtcattcaacttgtgcatttgtgtagcaaggcattgagtctgaaggtgattcataggcacattgcgcacagagtagatttgtatattaattacagcactgttttctggaagctgactagaaaatatcttgttttgacaaaatcagaatagcacaacaattttccaaaaaagaaacaaagtattttgtggaaggggcccctttgtatctgacttatacagagatggcctatgtggtagtgataaccctatgtctccatcctggctgccccagcgaaagtccagggattatccctgaatggctctggttggactttctgcccaacctggaatagcactacagccagaaggatctgatgttctgattagccaagacttgatcacaggcagtgggatcagttctcctgaaaccatgaacattgaaacaagtaagaggggcatatccaaaaaaaaaaaaaaaaaaaaaaaaaaaattgatgggatgtccctgacaggaaaaacaacaacaacaacatcgacaacaaaaaccaaaaaccttctataccaggaaaccatcatagtgttctttgaatatacaaaaactggtctacacataatacaatagaaaatattggcctaaaaagagcaccatggccgaagggacatgacctattttaacagatgatttgagagttaaaagataacttggagggcatccaattcaatctcatcattttccagatggggaaactaaaacccagacagaggaacagaagtgctgagagcacacaagtattcggtggcggagacaaccaactacgtgccttttgacgttttcccccctacgatgatgataggtttcttcgttacattgccaacaaaaacaaaaagtatagtcttgtttctggttttctctccgccctaaaatctgtataatatgattttgctgccctccaacagaaagcctcaggaagagatggtttaacctccttaagtccgctcccatccccaaggacagacattcactttccttgaattggaagtagagccacttgttgctttaatgggccaaatgcggtctggacctgcaggaggagacgccgctcataaagagcttctcaattgcactgcaacctgtactggcatcctgactttgcccccaaaccccagccagagaaagacaaagaaaggcattcccaatcaatggggacacttgtgcctgccccctctttcttcttcctgccatcacctctttcctgctctttcttactggcaaaaactgccaccaggtgcaccagatgcatctctggaaataggtaggagggagtcttacacctgtcagtgctagaaagtgcgctctgcggagttctcagttgttccctctctgcaacgaagtaaaaagaagggatgcgtccgaggtttttgacacagacatgctggggaaacgcgtcagttcaaggagctctgactctagtgactactgaagaccagtgatgcactcccatgcctagcatctcctcttgacttctgtttccctgcagccaagctcagctcctggccctggaaacccctttgggtaaagcgtctttaagtcaagaatcaggctcctgtgtgcacgtgtggctttcttagcaaaaaactagcacaggcggctcaggagtagagtctagctagggtcttcccgcgcccctccctcactggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctccccccattccccagccgcccacccgtttcccccccttacctcagcacgcagcccctccctgcgtgatgatgcaaaccagtggggagggctggcgctgggaagggtggggagagaaggagagccagcgagggagggagggagtgggaggaggaggagagggagccgaacgaccatttaaagcgatagcagtccctgccctctccccagtgctgggctgttggagagagcgagcagcaagccggtgagcgcgagcgcggcgcgccggccggctaacccgagagcgcgaggcgccccaggctggcaggcgccgcgggacccctcaccctctctggtcgcccctccccggattcccccaccctccgtgcctgcaggagcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgatgaagttcccctgctgcgtgctggaggtgctcctgtgcgcgctggcggcggcggcgcgcggccaggagatgtacgccccgcactcaatccggatcgagggggacgtcaccctcggggggctgttccccgtgcacgccaagggtcccagcggagtgccctgcggcgacatcaagagggaaaacgggatccacaggctggaagcgatgctctacgccctggaccagatcaacagtgatcccaacctactgcccaacgtgacgctgggcgcgcggatcctggacacttgttccagggacacttacgcgctcgaacagtcgcttactttcgtccaggcgctcatccagaaggacacctccgacgtgcgctgcaccaacggcgaaccgccggttttcgtcaagccggagaaagtagttggagtgattggggcttcggggagttcggtctccatcatggtagccaacatcctgaggctcttccaggtagggatgcgctccctccggggcggagcacacagtggctacctgcgcccttaaccctaaaagctggcttggactccggtggtgcgggtcaggtcagccttcgctcatttcctccctggagatcctgccgaatccctcccaccccgctcgaggagataccttccctgcttggtttatttcccttccatctctcccctgtccacgctccactccatccggcttgacatctggatttatggccccatttacaagaagcaatctgcgaaaaacaaggcgatgatttaaatgggtttgcattagggtgaaatatggtccgaaaacaggctcgtaaaagtgccaggctcctaggagagctggttaggagaatggaataggaaagatgagacgatgcctggaaaccgggcatttcccaactccccagcttcccacccccaagccagcctgccaacctgcactcccttgaaaaatttggagacagccttaaggaggcacttcttaaatcgagggctccgtcttaacctagatgtggatgttaagtccgcatctccctcgggctgatttcccgacctgtagccagcctccgcgagagcccagggcgcgaggtgctgggaccttcctcaggtggagagatgctgcccgcagacgtgacccccggttggtttgctccgggcaatattttgcaccgtctaaattacatgtgcgatccggccactggccggagctgggcgatcagctttccactcctgccacttcagacctcagcccagggatgagctcacgcgaaacgaaatcgctctccctgcctcctccctcctcccccccgcccccctcacccactatctccctgacgcagaccccaagccaaatcctcggcttggaggacgattcccggagcgaggcatgaaggcgcccgttgggaggcagaggggtgcgtgaagcggggccccgtggtcctcctgctccggtgccggagggagacggagaaaaaatgggaggaaggcggatccggggccgctgagcggtgggttctgccgcagtgttctctcgcctcctgctccagcagcctctgccccatggctcctgagctgcactgggtaggaatgagtggctttggggtttggaaattgagtttcagggtctctgtgattgtaggttccctcctctgtgtctttccctatatgtgcatcactctctctttctgtctctgtctccttgctgttttttttttctctctgttttttctctccttttcaatctctccctcctttcctcctctgtcttcactcccaagttcttggttcatctccgtattaaaatgacccttttccagtgcatagcggctctctccctggctggtggtacccaaacctagttaatctcttccgcagatgtacacgctgatcctggcacctttatgctcctcatatctagagaaccggcccctctcaagtgctttcccaaaaggtgttgggcttcagaaggggactctgtgagacccaggctgtcatcacatcacctccaggagtgtgaagtttgcattcaggaaagaggagtgcccatccaaggctgcagcttgcatggcccctctgatcctctgagcatctctgacacttcctgagtgccatcatggaaatcctggcaggtctgcaaacccaaaagtgcttcggggctagccatcactctgagttccttgcttttgggaagaacctggcttgtagctgaaacccagagcccttccttcatctttgagcttaaagctagacaagttgaggtagcagtgcagcgggagaggatgaggtcagagacattacctgagaaccactgggggctggggtaggttacagtgttttccctgttagcctgtggggttaaaggcacaaaacgttttgtgtttagtattttaaaattattttgcctgtttcttcactcaccctgggcagtactgcggatcagcctgtctctgtctgaaaaaagagtgaaatgttaaagtcaagaaaggggttacagactaggctgagggactgtgtttgctgaaaaatattccagggggagctgattccttctctggtgtgtgaacctgaggcaacttgctagtggtgaaaaaaggggtggggggctggcctgacactaatttctccattccctgagctgaggagaaagtaacccaatgttagcgttagcgttatggctggggagtaaaaccattcagagaaaacactgtcattttcctctaatttgcaaattgcagctattcatgttggattgaatagctgagggaaaaagagcccctagttttcacctgcgtttatggagaagaggctggtagtctgaggaatgcaccaacttgtagcttgggatgcatgcaagctagataaaacagttggtttgtatgtgtcctggttaatcactgcccatgttggaatatgtgtttcatataccaacaatctcttccagtagccctttttgcgtgtgatcttagacgctcctgtcatgtaattccagtccccaggtttccagtgtctataagcctgcaaaatgagtagagagaataatggtatacacacccattgttcaaaggcacacttagagggagagaaaaaggatatagtgaatcttgtcggggatttctaggttcagttcaattaagattgtcctacataaaagaaactcctccaaatgattgaatttctagctttccagtgatttgagttttctttttcctctgttccctgcaggttgctttagggaccatgccaaaccgatcacttgagatatacgtttatagtgagataagactgtaggctagaagaaggaatacttagcgacttaaatggggggtgctgagcactgaagggaaggagggagaaatgagatggtaacagatgtaacaaatgctgctgcccccagcaaagtcaggaatgaaattccttcctggaaatttggacctgggcaagaatgactcctcagatgtaaatagtgtctatgactttgaattttcatttgactgctggtgtaccagattgaagacataagcttagcaagtcctctttctctcctctctttacacactgagtgggttagtacgatgacatgtctgaggacaggaatcatattcagtgggtcttcaaatcaatccaggaatttgaggctaatgaaattagtgtgtggccagggctctgccaactagaattaaatcactgcaactgccctgcaatgcattttcagcctcaaagaaacatcagggaggaatttctggagatttgttcctaagcttgcgcaaaataatactctcctaatgctaagaaagattaaacgtaaattaatattgactataagtaacatatttaaaaaaaatcatcacagagttgggatggctggaagtagagaggttatataatacggtgaccaatggataaatctcctctgaccactgtcttatgggcaataagtaaggtatattacagtggaaagtcatgggaacattttcattcaaaccctctccattattgacttgagagcaaacactcccagagtataaattacccttgctacattctgactctgaatgaataatatttcctgtgtagtgacatgctctacactatagacttggaattgaatggcatctgattcaggtggatttttttttttttttcctcccaaagcaagtagatggaaaaagcggtcaactctacccttgtcggagcataatgcaaatctaagtctgtggaccttgtatcataaatgaaatgctttagtaaatgtgtcaatgttttccttctgttaattgaaacttgaatgtaatatcaaacttttgggataatattttatacagaaatacctagatttttttttcttttctctctctccatcgtaatccgatagagctgagcacatagggtggtgtggtattactacggtggtgaaatttattagaaaggcaactttaacctacactttttataatttaataagtataggtgtcactgccatttggaatagtctctataacaatctctgcctccacatttactgtgttttaggaaatttacctaacagatggtgagtgggaaatttttaaaggggcatttttaaaaagagcagagggaaggaatgaagacatgcacatattatatttgaagacatctccatgtgtatttcgtgtatacatacccatgcaattaagatgtctttgggcatttttctctttaagaataattgaaacaatgaatgcatttacttcaacttcatgaacatttggagattaacaaattacaagtgctatatttcttacatatatacaggttatatcatagatataaaagaccatacttggattttacagtgtgttttagtctcaatcctgccattaactggctaagttaccctaaataaatctcttaatttttctaggcttcatttgccttatctgcttttttttttttctttaaaaatgtagtttctaaaagtctgtaatcttttttgtttagcttggaaaaaactttgtcttgtcaaaactgtctttgcatttccagctcccacttttggtgagtttgtgggaacttttaaaatatattttcacacagctctcttggtcattactagtcaagttaatttcctgtattcagactgcttttgtattatcttacaatttacttctcaatcatatatatcaaggctactggtagggaaaatgatctctcaggtcagcttactgaatgatcataagacacaaggcagggagtgagaactgtggaatttacagtggcagcaagctatagctttcgtatctccatgtagtattcccattcatcttgcaaaaatatcagacttttctctcccaaaactgagaaatgatgacatcctgcctatcttcctggccccagggatgaggtacgtggccaggtcaaatgaagcaggtgattggttcctttgtaatcgtttgacctcatccaggccaattagaatcttccccaagatgtttctctcagagataaatgggaacactatctcctctctctggaatttttaagctagggagatgtgattctggggctcccagtggccatccaacacaaggagagactttctgtagcatatagtcaagtagatgtgagtagggctgagtggtgggagagaggggagccctgctgatattctggaactcctacattcaactatatctgaatctagatatgtctgtgagtttctaggacgtgttattttttgaaacacatttctttttactattttgagtttgattttagccatgtgcagtggaaagcattatagcaaaagcagctgattttctgcattaatgtaaggttcactaactggcattcattcagtgaaaaatcaggctgtagataacactttctttactttaaacataattcttttagcccagcttcgggacattcaagactcgatgtccttctcttcccaacatttactgtaattgatttcagcctttgtgatcacatcttccctatctcgatgcagttgagagggaagacagacacttctgatgtaaactgcaggatgtataggcctcctatctgaaagctttggaaccacacttggttcctttcattaaagcaaatcttttgttgatatccccagggcacagaaacattttcatggtataatggaatacaaagtacattaaactcctgggtcactctacagtaagcaacaagcctaactctgcttcttgtccccttttacattaagtagacaattaaaaacagctgcaaacatatttcccaaccactaaaatgcatatatgatctctatgtaaaatgatatttatgcaacatatagtctgactggttaattaatggaccttttgtgaattgacacagtcaatatatatgttttctgcacataaaaaatcaaaacaataaaacctatgtacaggtaaatatctgtctgaaagagtgttgagtcaaccttcttcacattatatttccatgtttgacaagtaacctgctttcaactatatttacaactaaatgttttttgaatcacattattagattacaaaatcaaaaatcaaatatatgaatttcaatgatataggatatatgtcacattttatgcaaaccgactttctaatcttttttcaataaaagtagtagtaaccataataataatttgagtccttaccataagccactgtgccacgtgctaaaagtacttcatttcatttaattctcacagtagtcctgcaatgtacatattctcatcccattgttcagctcaggaaagtgattctcatagcccaaagtcacatagctggtaagtggcaaagtctggattcaaacttgtcagatttgtctgacaacaaaccactacgtatactgctcagttgttgcacaaatgcataaatgcttaaagtaattgcagattttcctatcctgaatttatagtggtttaaagacatcacagttgctgattgcttaagcgtatctatttacagaaatatatgttttattttaatcctacaacaagattaattttgtaggcccatagaaacttgagcacacaaacccttacctccaaatgaaaaatgcttgttctcccttatacaacaagtagccccgtatgcaggaaataaatatacagtagacttttcattcaaataaatgagaaaagatgtttcatcttgtcttgattcagtacccaccattatggattatgatggctctttctaaacttcatttcgttcactccaccctttctacaaacctcaagtagggaaatccatcattcagatatatgtgcaaagtgagaggactgttttaatacaattgctgaaagtcaagttgatagagcacaggaagtacatcctaataaatgcaacattaatgtttgtgtgggccgtggagggaagggtaggagagttttcagtttaatgggttattttgcctcttgctgtaaaagagctgcagcttaatagttttataattggtcatttgcagaattctccatctttgggtgttgtgcttttgtcattccacggctgctgactttcttttattcttgatggaaagtagcaagaaagtcacttaaagggctcagtgtagtcttctacattattgtttaaataaaaatatttccatttttaaagggctctttaaacatttttattatgttttaaacttgactgtgttctgaaggggttagctcatgcagacatcagggggaaggtttcccaggagaaaacacactctatcaaaggaattatcagaatttccatgtaggggttaagaatcaaattctggagcaagacaggcctggatttaaatccacacactccacttactgcctgtctgacgttgatcaaaaaggtaccacacctttcaccaattttcttatctttggaatgggtataataaaaatgtacctgtctgatagagtaattgcaaggattgcatgaagtatgcatggaaatattttgccactgagattagcatgtttaatacatttaaaagctatgttaaagttatcagatggacattaagtgtcaatattgcttaattaatcattattgctaattttgaattttgctgtttaattaccatagtagttatgctggattacactcttctctgtttcttctgctgaattgaaaatttacatacatatgtataatttacatctatctatctgtctatctatctatctatctatggagacagagagagagaaagagcaaaagagagaacagtgagacagatagaaggagagagagagtgagagataacacacacacacgtgcacagagagaacattttagtgacgttactcagtggaatgaaactttttatggaactgattaaaggaaataatgaattccatggacttaagataacagcaaggctaagagcagtggaagtctggcagccttgagcttgaattccattgtggaccctttctacctgcagagctttgggaaagttacacttttataagctttactccttctttccttatctttgttttttcctagaaatacttattaaacaccttccatgtgcgcttttctaaatgcttggacacatcagtaaaaaagtaaaagctctctctctccttctcctttcctcttcttttttttttctttttgcttctccctctcttctctcccttctccactctctcctccctcctctctctctcagcttacattctcatgtgtgaaaacagatggatgttataaatacatcctatggatgttacaagttggtgaacattatgggataaggaaaagaatgtggaacttgctgaagatggtcgggttggtagtgctaggggctataagtgtggtctctacttttaagtagggtaatagcgtagatttgatgaggtgacaattgagcaaagacttgaagcaagggagttggcatagtggatttaggggaagaccactccctgggagtaggaatgaccagtgccaaaactccaagcaaaaatgggcctggcatgttagaagaatattgtagaggccattgtggctgagtagagtcaatgaggaggaaggaacagcaggaggtcttgaggtcagagatgtgacggggctagttcatgcaaggccatcgcaggcattttgtcatttactctaaatgttggcagccagtggtaggattttagcagaggtatgagatgagctgtctcttgttctaaaaggacaatgctctgtggtattgagggtaagggcaaagagtagtatctgggagaacagagaagaggcatttccaggtaagatcgatggtttggtggcttgagcttctaagaagggatacgttttgaaggttgaaacaggatttccaggcagatagaatgtgggatgtgaaagaaagaacaggatcaagaccccttaacccaagattttgggcctgggcaactggaaagttgagattattatcatctgaaattgaaaagattcaattggggtggaacagggttaggggttaaggatcagttttggagacagaaggttccagaagtctgtaggtccgaagaaagatctgaactagagatacattgtgtaaaatggagacattaagaataattatccgaaagcgttattttaaagattgaatgaggaagtggaattagcactgtaggttctcaaaacacttagtaattagtgaaaaataattatctgaaatgaaagaaaatcctgtagtttgtttctgcagtaaaactgaacaaaacagtatctcattattttaataacatttgtgacacaattattctggtcagacaccataactataaacatttagaggaagcatttcagtttcctatgtttctccctgatgttataattgcaaccatattttgtaaggtttaaattagttggatagggtggctctttaatgacaatcaattctgagctacttagttaatgcaataatatactatttattattattattttatgttcttcattaaacttagttgaaaatttgtcatcactgatacgcatgatgaaatttaggtagttacccaggtgtttaagaaaaaaataaggggcttatcttaaaatatgcctatgcatacttactttcaacaatttcaccaggcatttcatgtatttccttgactttttaaattaaaaatatgacgggaaattttatctcgtaggttgtcatctccgtttaggtatttgaaaaccattaaacagattttgtggcttaaccaaaattctgttccattttcatttggctaccagatattggtccaagcatgtacttacaataaaaatgcatgaccatgttgtctcaacacatctatgattttattttaacactatcattatgtaagctatattttaattgtaattataacacattttatatcaacacacatacatttctagtgttcagggggaaagcagcgtgtagtaaattttatcaaaatatagcttctgaagaacggaacagagggtaattgtgtaattctgtatttaccataattaagttcagtagagttggcataataaaattaagattaaaaaaaatccccaaaccattgaggcatcctagctccctctcctccactcctttccacatcagagaacacatagttagcatctttctgtatagaaatcaagaaaaaacaggcaagtaaatgaatgacaggcatgagaagagtatggaaagagacatggaaaggaaatgttacttttggatttgggaggtatgaaagatccactagtttgtatgcctactgggaccacaatttctgaaacagttaagctaaaggtcaaaaatgctgtcccgccatccttatgaggagggacatacttatatgctaatcattgcaccctgtttcattgagaagattatcacaaaaactctattatatgaggcaaagtacattgtttttaaatgattgccatttcctcaactgccactctccaagcttgcatgctccatttctctctctcttactctcagtcttgctctttgtttgccttgatctcactctctctctttcatggattatttcagtctggagtgcaaggatggcttacgggagaagatcgttgtattttttttaattttactttaagtgctgggatacatgtacagacgtgcaggtttgttacataggtatacatgtgccatggtggtttgctgcacccatcaactcttcatctacattaggtatttctcctaatgctatccctcccttagcccccccaacccccgacaggccccggtgtgtgatgttcccctccctgtgtccatatgttcttgttgttcaactcccacttatgagtgagaacatgtggtgtttggtttcctgttcctgtgttagtttgctgagaatgatggtttccagcttcatccatgtccctacaaaggacatgaacgcatccatttttatggctgcatagtattccatagtgtatatgtgccacattttctttatccaggctatcattgatgggcatttgggttgttccaagtctttgctattctgagcagtgctgcaataaacatatgtgtgcatatgtctttacagtagaatgatttataatcctctgggtatatacccagtaatgggattgctgggtcaaatggtatttctggttctagatccctgaggaatcaccacactgtcttccacaatggttgaactaattttcactcccaccaacatttttttgggatgacggagtcttgctctgtcacgccctggagtgcagtggcgcgatctcggctcactgcaacttccacctcccaggttcaagcgattctcccgcctcagtctcctgagtagctgggattacaggcacccaccaccaggcctggctaattttttgtatttttagtggagacagggtttcaccatactggccaggctggtcccgaactcctgacctcaggtgatcctttggtcttggcctcccaaagtgttgggattacgggcgtgagccaccttggccagccagtaatttttgtatataaatatatatacagtatagcatagtggttaagagtacaggtgctgaacatagttcagattcctgctttccacttgctaaccatgtgagcttcagcaatttacctgattatcagggtctcactatccccaatggtgaaataatgttaacaatagatccgtctgcataggcctgttttcagtgttaaatgaggttcttcatggcaagcacttaatacaatgcctaccacacagtgaggtctattatttattattaatagtattagcgtcagtattttcagcatgccaggtactgtctttcctagccttattccattatcccctaactccagttcctgtcatgcaccctgtataagggcagggttgtcacagagcttttgcctatggtggtatctgacccctagtcatctctgaggctgggccagttcctggcatttattgttgcccattgaaacaatccctggttgaagaagggaagttggatgttaaggcaaagcagggtgaaagagagattgtttcatctcttcttcacctaggggattgagtgaaatattcatacatcagaaggataatcaggcaatgggcaaaatgcttaattatatagtttagtaattgagaccaagccaggcagactgaattttaactcctttccagcacatactgacggggaacttaggtgtttattgtaacctctctaagcctgtgtctacctctgaaagaaagaaataataatattaggatgtactgcatactgttgttgtgaagaatgaatgactagatccttctaaagcactaggcacattgtttggcatatagcaagtgctcaataaaggttagttgccataactgcttataataactcattatcagtaagtagctgaacaactccgagatccttccttttcttaaattgcacatgatctttgggacaaccagtttacatttatcaagtgtcgtttatatgaaaagcctcaggagcccagaagtctttaaactgtacccccagtcagagccagctccgggcaggccacatcaataccaccactaccaccatcatcattgccatccttactgatcaactggtcatattcagtactttctgtgtgccagataccaagcttatccctatatatggattacatcattttcttctcccactcgggtaggaaaaattcttatcattttactgataaagacactgaggtgttgaaaggataagcaacttgaccattagtgagagagacggagctaggatattcaagcccctgtctctctgacttcatgaacccttgaatgttattatactatatcctggtaagaaatttttctttcagccactcctgtgagagtagagaagcttcttgatttccatatctttctattccctatgacaccctagcctcagtactaggaggtagtgaaggggacctcttcaaagaccattcaaggaaaacttactcctttcagcctttcctgaatcaactaatattttatttccttcttaagaatccccacatgttcctttctgttagttaccttgacctcttagtattcttacattctacacatgactcatccactctatttaaagttaatttatttgaggtcaagtgtggggtcttactcatcctgaggtagaattatcctctatagcatctaactctatgcttttcatctggcaggacttctgcaaatatttatttcagttttgttgaattgtgcttatcaacagtacattaaaagttatgcagaaaatgctttctcataagggaaacattctaactaaaattgtagctatttttttaaataggattatcacagaggtcttggttctgcactttttttttttttagattatttcatattaccttattttaacatgtgttgataagcctgatgatatggtttggctgtgtccgcaacatccaactctcaccttgaattgtaataatccccatgtgctgagggcggggccaggtagaggtaaattgaatcatgggggtggtttcccccatactgttctcttggtagagaataagtctcacgagatctgatggttttataaacgagagttcccctgcacaagctctcttgcctgctgtcatgtaaggtgtagctttgctcttcattcgccttctgccatgattgtgaggcctccccagccgtgtggaactgtgagtcaattaaacctcttttctttataaattacccagtcttgggtatgtctttattagcagtgtgagaacagaccaatcacctgagttttctttatcaagcctacacatttttacctgcttataacttagcttattgattatgtcgttgacttatccatttacaaaaatattatttgatcatgccaggggtgaagtagggtggggaggtgcatcttagaaccataaattggttttctagaaaagtaacataaagaactggagttctctcatatttttgcagaactcattaattgttatatttttataattttattcattcttacttacagactatcttaaaagggtttaatctcaatttgttcatctttctctactcagtcttgatgggaagctggtaggttgaatggaagaaagttatggcatggccgggcgtagtggctcacgcgtgtaaccatagcactttgggaagccaaggcaggtggatcacctgaggtcaggagttcaaaaccagcctggccaacatggtgaaaccccatctctaccaaaaatataaaaattatccgggcatggcggcgggtacctgcgatcccagttactcgggaggctgaggcacaagaatcgcttgaacccgggaggcagcggtagcaatgagccgagatcgcaccactgcactccaatctgggtgacagagcgaggctccatctcaaaaaaaaaaaaaattattatggcatgaatcaagggccactgggtaggagtcagggccttgggctttcctgtttgtttgcttctccccagttaatattagctaatgccttgagtgcttgctgggtgtaagaaactttgctggctgtggcaaatggattgtttcatccaagttttttgagagtcatacagtgagaatgtatgttattatgacccccatagtgcacacatggagcagagctttgaagtgcctatatactcatgttaaaatatgatgatggtagagcttgaactcaggtcaatgtgactgataagtcagaggtttttaccactaattttttttttttttttttttgagaaggtgtctcgctgtatcgcccaggctggaatgcagtggcaccatctcggctcactgcaacctccgcctcctgggttcagacgattctcttgcctcagccactggagaagctgggattataggcacccgtcaccacgcccagctaatttttgtatttttaatagagacggggtttcactatattggccaggctggtctcaaactcctgacctcagatgatccacctgcttcagccttccaaagtgctgagattacaggcatgagccaccaaccccggcctaccactaaattgaagttgtgtaaccctacgaaggtgacacaattttaagtagcttctataatttcctcagctctttttgtaatgaagtctttgtctgattgcaagcttacaggaggtgaggagtgtgtggaggaatttcagccaattgaatggaattttccttaatatggatggagggctgttttatgacattaataaataaatccattcattcaaaatatattgagtatctactatgtgcaaaggcatttctcagcacttgcatcatgttagtgagcttctcttttttaaacttcccacagcaggcagagaagtctggtactggtttgcctgctatacggaggggtttgatgcagggagcctagctgattccacagtgtcaaaaccaagacaaactcacattaattcataggcaccttgacgccaggatacagcagcacacttggatcttactattgttgactgggattgatgataaaatagctttggatttgttatgaaaagtgggtatgttcatggacttcatggttctatatagatatgtagacacatcatgtgtcatcaacctgcagctacctgccatcccctgctactcctgcttttacatgccaagcaagggccttctcatctcgcttatggataagcttttaacagtggcaatggggcctagcatcacctagtaaccatatcactggctaaaccagtggtttttcaaattcgctctttgataggcccatgaggtagattgacattccgcttgtatgagtagaaaatggtgttcgtttataattcatcgggaagaaaataggccactggatataatttcctcaattaaaaaattttcatatagatggacatgaaaaattttaaattgaggatatatatacacatatacctacacagatatcacacacacacacacacacacacacacacacacacacacacacatatgacttctgctagtaaattacaaatgaaattgttagtagctctgtatacacataagcaggaaagtagctgatcagatttaactcaataacttacttttttttttttttacagatctgtggttacaactctatctacagatatatttgctgaagaaaatatttcttccaccttccacagcaaaattccattcatttaagaccaatacagcatgtcccaaatgtcttagtccagttttaatctttaatagcttcagaagtgtgaaattacaaacatgccccccaaaaatcatttgaaagtttaattatttaaatttctctttgtatttacatttgtggattttgaaaaatcaatatttaattgtactttgtttgttgctgtccttctgattgaagatggcaaacattgacttaaagaccaaaaagttgtaactaaatatgtattattcaaaattatcaaaactaaataagtgaccaagaaattcaaatgattagactttcaaagggtgattttttatgtgtttgcgtgtgtgtgtgtgtgtgtgtgtgtgtgtgtgtgtgtgtagtattttttcttctgaagaaactgatcttgaaactctactaagattttagggacatctagtttaatgagcaaatgctttgtgtctgggactgcagcatgcactagatatttaagagattaacataaaataataataataatacaaaaacaacaacacatcctctcagacatggaagaaaattccacttgagaaatggaccaatacatcacgcactaataaaatagcaaaggctctcaaacatcaatgtgctgaagaatcacatggcaagcatgccaagcaggcaagttccagggccccttctccaggtgtaaggctctagaaactatatttttcttgaatgctctcaggagattctgagattggtgttttcaattgccctcaaacttaagtctgcatcagatctgcctgaaagtttgttaaaacacacattgttgggctccaccctcagagtttctggattactagatttgcatttctaaccagttcccaggtgctgctatcactggtccaatgaccacactttaaaaacccattgcttacagaaaataccttcagtataggatgtgtgtttcatgaaagatgagtttacagagacccataggagtgcaaagggcctctaccctaaattggccaaaggtagtctaaaaactagctagatttttattgaaccaagcaagattataagaactttaattgaactacctcatttaatattttcaataagatacgtaagtcctacttaatgtccccaatttacagataaattaatttacccaagtcatacaaccagtaagtagtagattaaaaattcaaatctagaaagtctgattccagagcccacacacttttatacttatattattttcaattgacaaattataattgtattacatttatagaatacagtgtgatgtttttgatatatgaacatagtggagtgattagatcaagggaatcacacttacttgacgttgttttgtggcgatacatttgaaatttattctcttattttgaaagatataacacactacacccttacctgttctgttttacttattttgcttaatcattctgcttatatacaggggtaaaatgttgtcagcccaggctttctggaggaactgacctctgagtgtaatttttagaaagatgagtggacataaaaatattaccattttttaaaagatgttgtgaatagtatcaggacttctaaaagagccagacctcaccacacagttacctcaagcaaatctgatgattaatagtctagaataggaggataactatgggatgctaggaagaattctgggaacctgaggttagaattcagtatcgatttataatgagtttacctgcaataatagaacctgaataagagttacttacctaactttcctcatgtaacagtttggagattgtttttatgttaattcagccactaagtggtatccatgagggactaggttctcttatcttcctgtcccctcacctctggtgtgtcactgtgttacaagagagttgcaagacggctactgaatctgcagctgcattcccaatgtttaacccagaagaaagaacatttaaaaggggatgtggagcaaagaaagtatttaccaaaactcatcatcagactctcacttagatctcgttagctagggctttaaactggccaccttagttttgaggatattagggatttggcaatcagggttttgatagcagggaatgaggggagaatgggtaattaatcagatggctcacagagtctgcacagacttcattcccagtctccccgacaaagaaccccaaattctactttattttatgcattttaccttgaatagtggggaaaaattacttatctgtaaatagcctcctacaaagggtgcaattacataattatacaaccccctagagagcctctttcttctaaaaactctttgaaaaatgttcaaggttgaggatattttgatcttaatttagtaacttgcagttgattatcctggaatgacattctctttctctgcagatgtcctggcgggctttagaaacttctggaagaagtggacagagaattcttatggttcacatataaacaatatgaatcttttggaagaaaaattcatttagggaccaaaagcccctttatatctgattttttttccctctcaccaaattttcacaaattttcctttccaaaatgcctttgagcaaatctgtttgatatcaccccatccacttctcctgtctgaattctttattactaagaatccttcagcattccatctctcactcgtctttgtcaaaagcatttctcagtgtctttattccttctcgtctcgtatttggactcatctctcaaactgaaaaaggagatggctatggtttctccagaagcttggagaacttccctttgcaaaaaaaggtagcgatgttaattaacttgaaaggtaagcaatgtgtgtaatgcttctaataatttattaaaagtttattataatcagtatgttattataatttattataagtttatctctcagttactctgtagttcagtttggacttcactggcttagcaatcagttttctgctcagtgattcaagagcctaccgtttcaattatatgcctgtacattgtctcaaaaaggaaaggagacaggaaattgcaagctcaattataaactcattattcctcaaatacacattctttttttcttttaatttttatttttagttctggggtacatgtgcaggatgtgcaggtttgttacatgggtaaatgtgtgccatggtggtttgctgcactatcaacccattacataggtattaagcccagcatgcattttctatgtttcctaatgctctcccttccctcactccaccccccaacagtctccagtgtgtgttgttcccctccctgtgtccatgtgttctcattgttcagctcccatttataagtgagaacatgcggtgtttggttttctgtttctgcattagtttgctgaggataatgtcttccagctttatccacgtccctgcaaaggacattatatcattcattttatggctgcataatattccatggtttatatgtaccacattttctttatccagtctattgttgatgggcatttggtctaatacccacaatctacaaggaactcaaacaaattttaaagaaaaaaaaaacctcattaaaaatgggcaaaggacatgaacagatacttctcaaaagaagacattcatgcagcaaacaagcatgaaaaaaaactcaacatcactgatcattagagaaatgcaaatcaaatatacattcttataaaatttctggtagcgttctgtgggccagtaagcagtaatgtggccacactcagatgcatagacatggggaatactatcctaagccttatctcaacactgctacaatctggaggggctaaaaatgtttagtcaataggtgttcatttctgccacaatgatcgattagtctaaggcaattgaattgtgtgtgtgtgtgtgtgtgtgtgtgtgtgtgtattagtatgagctgaaacttgtggaagtccaccttaaaaatatagataaatccaactgtggttcactgttatctttcctggttgcagttgattactgttttccttcatcctctacctctcatccaccttagtatcagtgtggtaaaaactgaaagaaattattccaagatctccaattctttgaaaggtatagcatacctagaccctaacagttttactctgtacaacttttaccaattccaaatgatgaatttgtggaaaattaatgcagaaaaaaaggctgattttcttttgtacaaatactctgagccatgttgcagggtaattggaaaattcgggaaatctaaagcttcttgttgaaaattaaaatacttttaattataaaagtagcataaactcattgtggaaactacaaaaattaaaaaggcataaagaaaaagtataagccaggcatggtagcattagcttttagtcccagctactccagagcctaaggctgcatgtttgcttgagcccaggagttccaggctgccatgggctatagttgcaccactgccccccggcctggacaacacagcaagaccttgtttcccaaaaaaaaaataaaaagtataaataacttaaaatcccattatcccatttccaataaatgatcttcataacattcttgagatatttttgtttgtgggggtacacacaggcacaatgcaagcaaatatataatacttttaattattagaccaaactataaaaatgttttgtatcttttttgcttattagtatataatgagcatgattccatgtcatttaataaggctatatcacaaacttaaatagctcagcagcatttcattatttacgtagccagtttcctgccactcaaaatttaggtttacctctctcttttctttggtactacagaaaaatgagaaaaacatctttgtgcatatgtcttcctgcatttattcatttccttagaatgactttttagaaattgaagggccacttttcaatttgagtacatattgacgtatgagcctatggaagagttgcactaccttacctttctatcagcaatttaacatcgtgtgtagattctcacactctctacagtaccagcattagccatttatttcatttgtgccactctgttgagtaaaacatgagacctacatgattctaactatatttctttggttaataattgtgagattaaacttattttaatgtatttattgactgtttgtatttcttcttttgtgactttatgacctttatgcatttattcacattgatttacaataactttttatatattataatgtttattattttgttatagttttcaatgtaatttttcttttttaatttataaattataatctcatgtttatagaaattctttaatattgtctagtctattcaaaaacactttaatagttcagacacagggagaaatcatcagtcactctcttacattttataatcaatttatttcctttgccagtatgtgaatataactccttattttatattatgtttggaaatgatttattccctctgaaagggattatagcctctatgaaactgtaaagccagattttatatggcacatagggtgtataggaaaaatgaaaggccataaatcacactccattgaatattgccttatttataaagatggcattttaggttgtatacttgtcatcagataagcataattaattttgttagtattagcaagaacagcctaggaaagcttcacagcaagaagtgagtggttatgggagcaggaaatagcctctgtctcatccaaaacagcaaggacttgaaaccgtgaggatcctgcttatagaatcttgatccagtcagcccagccaacatgtgttgtcaagtagggcaagtagatttgagaagtctgagaagttatcttggtctcttctggaaatgagcagcaacgtactgtgcagggcagagatcatcagcacaaggtctggagacatggaactccccctatagccattaaagtcagtgtgagacaaaaatgccaatataagttatattgatgacagtatcagtgagatgacatttagtcctctaaaattccaacatgtttttgcagtgtgccatccattggtaaataggcagagccatttgacagatctattcagtacaatgaatgaatctggcactcacatttagaaaaaatgaaattatatcaatttgtcaagtacagtagctacctgttctgttttatttctccaggtagaactagatgacattgcaggcagtgagatgttatcatgtttgacccctggaactgtccaaaaatggaagaagctgcctcatcaggtagttaatttcttgtcattgggagtattaagtaggtttgtatgatcagcaagttaaagagcctatttatcatttctaaaatattgtacacactagtgcattcaggttagtataaagaattcctcacaatatattaggacagttttaaatattttaatttgattagacacaatcttttagttataaaaaacatcaccattttgaccatttaaatatgcctttattttctcttgtaacctagctgtgtagtcttgggcaagtcactacactgtcttggacacaattttcttttcctctttatttttttttctgagacagagtcttgctctgtcacccaggctggagcgcagtatcatgatctcagctcactgcaacactcgcctttggggttcaagcaattctcctgcctcagcctcctaagtagctgggattacagacgcccaccaccacacctggctgatttttgtattttaagtagagacagggtttcaccatgttatccaggctggtctcaaactcctgacctcgtgatccacccacctcggcctcccaaagtgctgggattacaggcgtgagccaccgcgcccggccagacacagttttcttcatgtgaggtagaaataacacatgcctttaaggactgcagaatgatgagtggtgatgttcttgaactcttccaatactccacatatatacattatttctatccctggaaaatttgcattaatgaaataaagcattcttagtataataagtctgagcagatgagaatttaagtgaaggttctatacacacctgatgcacgacaggcagacccccaaattgaggcttagcccgagagggttcttagcttcacccacgaaacaatttcaaaggcaagccagtggtgttaaacaacgacttttattgaagcagtagcctacagcagccgcagaggtactgcttcttgcagagcagggctaccccctaggcagcgtgcccagcttaggtagcttagagggagttctgcagtcatacttagacccacttttaattatatgcaaattaaggggcaacttatgcagaaatttctaggatgaaggttgtaacttccgggttgtccaggttgttgccgtgaaaaagggcagtaatttatgggtattgccatggcaatgataaaccaagatggcacattggtgggagtgtcttatgcggaggtgtttccaccctgacctgtttgagctagtccatcatttggtcaggtatccaagcccgacccccaaagcctagtcctgcctcctaccacacacccagaaatatggatttattcccatgtccggtgcaaatgtaggaaaagcattattttcttattataagggaggtattatgaagaccaaccaacttaaagagtttctgtgttggaaattgagagacctcatttccttctgtgtttaccccacaaatgcccgcaggggctctgaagttttgtagcagcaacctcatcttacatccttgtcattacaagtaaacagtgccacacaattaataactaataatagttacaagaaatatcacttattgaaggtctccagtctattaagtattttataattattaacatattgatggatgctatattttgttttcaagttagtttgagtttcttttcagctttactgacatataattgacagttaaaatttgtatatattcaacatgtaccacaagatgatttgatatatgtatacattgtggaatgtttaccacaatctaaataattagcacatctattgccacacatagttaccattgtgtgtgtgtgtgggtgtgtgtgtgtgtatggtgaggacactaagattttctctcttggcaaatttcaagtaaccagtgctgtattattaactatagtcaccatgttgtacattcgatctgaagggtactacattgttatggttaagagtgtagtcccgcatgttgtcaccataagtgggagctgaacaatgataacacatggacacagggaggggagcatcacacacccacacaccggggcctgtttgggagtgaggggctggggtagggatagcgttaggagaaatacctaatgtaaatgatgagttgatgggtgtagcaaactaacatggcacatgtatacctatgtaacaaacttgcatattgtgcacatgtaccttagaacttaaagtataataatagtaaaagaaaacagtatagtttctcaagctcaataattctgggttggaatctcacttccattatgtcttaattgagtgacttctggtccattgtttatgcttcatattcctcatgattttttttctgtaaaaaaatactaatgaattattgtctgatatatagaatatttgttgaatgaacacctgcttaggcgagatggtaaatgtgatgtttagcactgtgttacatatatcattactctgttaattcttgcagtaatttaactggtcagtaacaataataataataataataataataaacagtttaataaaatgcttaggatgtcctaagcactttgtatatataattcatttaatctatactacactattttatatagatattatcttccaagtttttttttcagaggacattgaggatcagcaagattgagtactttgcttaacccgtgaactcaggtcagaattactccaaacataatttttaactacaaaatgtctatcattctacctctgaatttgttgttgtttttaacttccatacatctgatttgaaattcctttatatatttggggaccttttcactttatgagtcttgttgagggacagtgcctttctcccactgtttaaactgaaaataccagacacatttacatgtaaacaatgtgaaggaaagttgactctctttatttttttttttagaagtaaagtttaaagtctttttattttattttattattattatgctttaagttttagggtacatgtgcacaatgtgcaggttagtcacatatgtatacatgtgccatgctggtgtgctgcacccattaacttgtcatttagcattaggtatatctcctaatgctatccctccccccttcccccaccccacaacagtccacagagtgtgatgttccccttcctgtgtccatgtgttctcattgttcaattcccacctatgagtgagaatatgcagtgcttggttttttgttcttgcgatagtttactgagaatgatgatttccaatttcatccatgtccctacaaaggacatgaactcatcattttttatggctgcatagtattccatggtgtatatatgccacattttcttaatccagtctatcattgctggacatttgggttggttccaagtctttgctattgtgaagagtgctgcaataaacatacgtgtgcatgtgtttttatagcagcaggatttatagtcctttgggtatataccccgtactgggatggctgggtcaaatggtatttctagttctagatccttgaggaatggccacactgtcttccacaatggttgaactaatttatacttgcgccaacaatgtaaaagcattcctatttctccacatcctctccagcacctgttgtttcctgactttttaatgattgccattctaactggtgtgagatagtatctcattgtggttttggtttgcatttctcttatggccagtgatggtgagcattttttcatgtgttttttggctgcataaatgtcttctgttgagaagtgtctgttcatgtcccttgcccacttttggatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgacctgaatggtaatgcttaggttttcttctagggtttttatggttttatgtctaacgtttaagtctttaatccatcttgaattaatttttgtataaggtgtaaggaagggatccagtttcagctttctacatatggctggccagttttcccagcaccatttattaaatagggaatcctttccccattgcttgtttttctcaggtttgtcaaagatcagatagctatagatatgcagcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctgttttttggttccatatgaactttaaagtagttttttccaattctgtgaagaaaatcattggtagcttgatggggatggcattgaatctataaattaccttgggcagtacggccattttcatgatattgattcttcctacccatgagcatggaatgttcttctatttgtttgtatcctctttatttcattgagcagtggtttgtagttctccttgaagaggtccttcacatcccttgtaagttggattcctaggtattttattctctttgaagcaattgtgaatgggagttcactcatgatttggctctctgtttgtctgttatttgtgtataagaatgcttgtgatttttgtacattgattttgtatcctgagactttgctgaagttgcttgtcagcttaaggagattttgggctgagacaatggggttttctagatatacaatcatgtcacctgcaaacagggacaatttgacttcctcttttcctaattgaatgccctttatttccttctcctgcctgattgacctggccagaacttccaacactatattgaataggagtgatgagagagggcatccctttcttgtgccagttttcaaagggaatgcttccagttttcgtccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggttctgtttatatgctggattacatttattgatttgcatatattgaaccagccttgcatcccagggatgaagcccacttaatcatcgtggataacctttttgatgtgctgctggatttggtttgccagtattttattgaggatttttgcatcaatgttcatcaaggatattggtctaaaattctcttttttggttgtgtctctgcctggctttggtatcagaatgatgctggcctcagcaaatgagttagggaggattccctctttttctattgattggaatagtttcagaaggaatggtaccagttcctccttgtacttctggtagaattcggctgtgaatccatctggtcctggactctttttggttggtaagctattaattattgccacaatttcagagcctgttattggtttattcagagattcaacttcttcctggtttagtcttgggagggtgtacgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctcttttttctttattagtcttggtagcggtctatcaattttgttgatcctttcaaaaaaccagctcctagattcattaattttttgaagggttttttgtgtctctatttccttcagttctgctctgattttagttattccttgccttctgctagcttttgaatgtgtttgctcttgcttttctagttcttgtaattgtgatgttagggtgtcaattttggatctttcgtgctttctcttgagggcatttaatgctataaatttctctctacacactgctttgaatgtgtcccagagattctggtatgttgtgtctttgttctcgttggtttcaaagatcatctttatttctgtcttcattccgttatgtagccagtagtcatttagtagcaggttgttcagtttgcatgtagttgagcggttttgagtgagtttcttaatcctgagttctagtttgattgcactgtggtctgagagacagtttgttgtaatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgtagagctgagttcaattcctgggtatccttgttaaatttctgtctcgttgatctgtctaatgttgacagtggggtgttaaagtctcccattattattgtgtgggagtctaagtgtctttgtaggtcactcaggacttgctttatgaacctgggtgctcctgtattgggtgtatatatatttaggatagttagctcttcttattgaattgatccctttaccattatgtaatggccttctttgtgtcttttgatctttgttggtttaaagtctgttttatcagaggctaggattgcaacccctgccattttttgttttccatttgcttggtagatcttcctccatccttttattttgagcctatatgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatattagctggttattttgctcattagttgatgcagtttcttcctggcctcgatggtctttacaatttggcatgattttgcagtggctggtaccggttgttgctttccgcgtttagtgcttccttcaggagctcttttagagcaggcctggtggtaacaaaatctctcagcatttgcttgtctgtaaagtattttatttctccttcacttatgaggcttagtttggctggatatgaaaatctgggttgaaaattcttttctttaggaatgttgaatattggcccccactctcttctggcttgtagagtttctgccgagagatccactgttagtctgatgggcttccctttgtgggtaacccgacctttctctctggctgcccttaacattttttccttcatttcaactttggcaaatctgacaattatgtgtgttggagttgctcttctcgaggagtatctttgtggcgttctctgtatttcctgaatctgaatgttggcctgccttgctagattggggaagttctcctttataatatcctgcagagtgttttccaacttggttctattctccccgtcactttcaggtaggccaatcagacatagatttggtcttttcacatagtcccatatttcttggatgctttgttcatttctttttattcttttttctgtaaacttcccttctcgcttcatttcattcatttcatcttccatcactgataccctttcttccagttggttgcatcggctcctgaggcttctgcattcttcacgtagttctcgagccttggctttcagctccatcagctcctttaagcacttctctgtattggttattctagttatacattcgtctaaatttttttctctttatcagtcttccttgaaactggaagacagtcagatgacctaggattggtcaattacactcaagtcctatattttgaattagaaatgaatgatatgaggaagcaaggacctcagagaagcccttccaggagtaattgaggaggcagcagtgcctgggtcagcatcccgtatcctgctcctgttgggtcagcgaggcaggcctgcacatacacttaattttgcatgattctataattttgatagcgtgccctaagttctggttctttagtctgcttctagttactgaaacttaatcaataacctttcaaaaatcattttctgctcaaatcagctgtatctggctcctgttgcttgcaaataagcactttcttgatatccacctacatatccaggaaggtataatatattcctgtcagggacaagagcaggaaagcttcctgagcatctgagagtgaggaaaaagaaggaagaattggagccaattctgcttgttttagaattgtatttgtagctgcccgttttacatatcacatgctaaacttcacctctctttacccaattacagacacctgaggggtaaactctgtgttggcaacccaacagccctctgtgctgggccacaggcatcccaggatgtgaaagacttccctcaatgtctttgttacttgaggctacatcattcctctctttggagatcagcttctgttgtgtgggacaaaacgatgcgaaacccgaactcaaatagaaagatacaaaaattagctacaggtgtgcatggcccagggatgaagttgagatttcatgtaatgtgtcctctttctgtcatgaccttgatgatgatgataatgatgatgatgatgatgatgacgatagcatcagtaacatttattgattttttcctagatgaagggcatatcatcttaataaccattttttaatctccactatgacctaatgaagtaagcattatattatttcaatatcctcgagggtcaaaaaaattaaggaagttattctagctcacaactgggtggtagaacaacaatgactggacactggatctgcctgaattatattgtgtgagcagagccacttacctatttctggcatattgtaactcagaagctctggggttattgtagagcagctgagtgtggttgaactaagatgtcttaatagataatattaatataaagtaaattactttaaagtatcttggcatatattgcgttactctcatatctgtcattggttctattggtaactgttgagaaactcataacgtgaatcctaattcggcctctaactcatcgtttatttgacctaattgaggcaattatctttgtgttgttttctttcctacagacataaactgagcatccaaaacatgcccaccatcttgtaagtatatgccattagttttataggtgctcaataagatggagaaagagaaaaagacacaaaaatacacctctcagcatttgaaatacagtcatcaatttttgtgccttttatattgtcagttccttttaacatttactaacacccacacaatttatatttttaataaagcaatttccttaccaaacattttacatttggttattagttatattctggtattctaacaataacactaataattataagctgttgaaaaattcatcagaccctacatttttatccccacatcctgaaaataaagtgggaaataaggtaaagagtagaaaatctgcctatgtttttcttcggatgacatgagatgctcacctaatatcactcctttagcattttctattaaattgttcattctttcctgggggcatatgaacagcttccattacggtaaatgtcagtcttgagtgcaaacctagaagagggcaaatggaaaacttttagacaataagtcaacttttcttcaaaagttcaaccactatacattccatggtgaaaatatttctatgtacagatgaaacctcttaggtttggggaaatttcaatagcagatagtgatcctgagtacacctagttcatttctctctgcttttcccccttgttacattgagattaaaatctgtagcagaattacatattaagcagtctaggaaattgatatgacatttggtctgaatctccaaagtaaattttagatgaagatgctatgaaattcacataagaaaaaatcatcagaaatatttttatattatcaaatgtactgcaataatgaaagcaaatcccacttctagctaatgaaacatgattctttaggtgatattatattgtggcagaaaagggatttatgtcatctattgtttctatcctaaaaatgctagaatgggagcaaataagccaaattaattgtaatatatacattgtaattgtaatatatacatacatctctataggtgtatatatatacatatgtgtgtatatatgtatatacaaatatatacacatatatattgcatacacacatgtgcacacatataagtaaaatttcaacttgcatcctcagagcaggttttgtggggaagataggatgtaaactgggtaggcttccagcagctttactcgattctgactttaggataaaatcaagcatttcaactggtcagtcagtctgaccttgatggaaaagcattcatctggatggaacactataattaaacatgcagttgtagagatgccctggctgtattattccagtgcctggaaggtattgaaacatctattttctctaggagatggaaaggtatctcaagtgaagtctaagtgtaataaacagaggccagtgctctttgttgggacattgctttgatcctataacaagtaacaatttcataatctgtttaagattgtctttatccaagagggttcttagcaataggagtagaaaagaaaagccgctctttctgggttcttgctctttgtctatgaaccagagaaggtgccaatagatgaaccaggtcacagctatccacagcaggagacaggacgattattaacactcaatctactggaaagtaaatggaagtctaaagaaagactccaaagatttctataccttatatacttgatacaccaaaagtgtcgcctcagtggatcccttcccccaaaatgccaatatgtttttgccagtgtgtgacagaatctgaggggtgaaattaaggaaaagaatggaaagctgccttaagattctagctctttgaacagggaacaaacaatacgttttcaataatcttagcaaccacacttgtaataatgaccatcagaataactgctgttttctgccatatggtaagaacactaccaaacttatttttttcttcaactttacaactcaaattctcttattattttcattttacaaattaggaaagtgaagctcagagatactgtcatttggccaagatcacacagctagtaagagataagtctgaaccctttttgttggataccaaagaccacaattttagtccttcagaatctatctcagagcatttgagtaagttaattttaaaaagtcctcctaatcagattgatcaggccattatattaggttaagcaaagtgggaaaatggcataagaatatttgaattgtaaatacaagaatttacttgcatctaagttatccacataatatttagctgatagcttcatgattacaacaactgaatggaaatgaacatgttttgctgtttggaataagattgcccattgagtaaaaatatatatttattcctcacccaatatgacatgaggtgcagacgacattgagatgccatctagtagtgctcctatgtagttcatcatgtcagcccagccaataattttaaaatgttttgagtctataatgaatgcacccataaagcatatttctaatcaatgcaaatattttcctatgctaaacccgagttaaattataacatgcagcataagattaatgggccattttttcttcatcagtttgttaaattacttagtttggaagccattccaaaggatgtgaattggagctgtgctgtgctgttgcaatgagattctgcttttttgatgaaagtattcccacgcctgccccttacttctagcttcttaggaaagaagggaaagtttcttctggtaaaaagtaacatgtttatgggctggctcatatagtatgaatgaaagaattatgtgtcttctaagccaagcctgttttggcatataaaataatttttacctatcatttcataaaatgaacatttgattttcaggtgaagtcttaggtcatttgactcctggatcactttcatgaatagattttgcttgatataacttgtaactcaatatattaactgcaattcagtctgcctagctgatgtgcataatctaaaatgcaagtccctgcagggtaagcattgcacctgcatcatcagtgtggcctgattttgagctcaacgtctagcatttaggagatgttcaataagtggtagtgaggtttgctttccactttagagagaggcagggtattcactcactcttgtgtctggtgaacactggatacaagaatcttgctacattattcttcatttccctttgtgtgcaggctgaagatttttttttccttcttaaaatgcctatctccacttgttttcctggaaaataactcttctttcttgaattcttagtcccattgttgactgcttgagattgcatttattacttcctcacaaagagaatttatttcgtcttcaactgtgctccaacaattgtgtgtgcatgtgaatgtatgtgtgtgctctattacaacagctatcatattgtatcatggttatttgtttgcctaagtgtttgaatgatcagaaagaattcttgagtgtggtgtatttctgtttgacagttatcctgagcaaattactccaacacatagtcggtgctcctaggatactggctgaattgaattacattttattgccaacatatagacaataatatctcattgttcttttgaattccagctgggaaatcagctggaaatgaaccctaaaagttctgtacctcatactattgaacagcttctttagttattgtgtatgggaagcagtactgcttgtcctgctagttctcaaagtgtggtactcagaccagcacatcagcatcactggggaattgcaaattcttgggccttgccctagacggaaagagtcagggactctgggattgagccccagtgtctgtgttttaacaaatgctccaggtgacttcaatgcctactcaagtttaagaaccaccagtttagatctagagcttaagctttaagcttggagcagacctgactcttaaactccactcagccattagagtgaccttgagcaagttactcctggtaccttctcaccatttttgtgtcttgcttagcttattgggataattacattagattagtgcattcaggagagtgcctgaaacacagtacgtgttcaataaatgctagctgttaccattatcatcgttcagaatgtattaactcatcctgaagacacatttcacataaaggtaataatgtggtttgtaaaattagcagcttagaagaaatgtattaagaagttcatcaaacaaggtttcagcaggaaatctgtggtactctgaaaagggcaatttgagcaggatgtagggaaacagagatagtgtagcattagtgggtcagcaaaagcttggccacttttatcactcttggtctagcagggaaggagaagaaaggcactgctggagagtgggggcctccccatagaggctgtggccttaagttgagggatgccgccatccatcactcagcaacttggcagggaggaaaccaaaggaataaacacctgacctcactcttctttcaccttttctctcatctcccatgggtgttctccattggtgaacccagtgagaagctagaaggcaaggacatccatcaagttaggccatgcgagacatccagggcacagagctggatggagaaagaattcgaaagggctgataggatatatattgtcagctgtaaaatcacttgtcgttctcatgtgatggccattacagaaacagagagagacaagtagttagtgcttatttggcagacccagaaagcttcagggtagaactggcatttgaattgggcgtgaaaggaaaatttgggttttaatgatgactatgaagtagggattggtgagagaccaaggacgaaagagtgtcattccaaatagagataaagcaatggcacaaagacaaaaaaaaaaaaaaaaaggcagggcagagcacgtggtagaaacagtgaatgttctgtgtgtgactgagcagaaatggaacaggcagaggctggaagttaagataaagtcaatatttgaataacatcagagttccctcctttaacctcaatttccaccttctactctcttcaccaagactaggaaaataaaagtgaacttaaattgggggccaaggatgacagtgtcaagaaaaagatacctcccaaaaataggttggctgaggttacctattttggctattttttttggaggggtaccaggtgtggtggtaccaacctcccagctactctggaggcgaaggcaggaagatcacttgagcccaggagctatgattgcacctctgcactacagggcagcagtatgagattctatctcaaaaaaacaaaaaaaaaaaatgaagaaagaaaagaaaagagcactggagcactgataagaccttggtgaagctgggtgcatgactggtggtattgccacagtagagtatgggcaagtggttgtgacaaattcaggctgggttcttgactcttgacttccatcaatttacttaaatgctctaggtttccatattgcaatcagtaaaataggggcaaaatctagcttcctcaagtgttgctgtgaggatctaataagaaatagaggtaagagttgagtccagtaatgaagtcggaaaacacatgagctaaggtgataatgatcataataagaataatagctatcatccattgaatgcttgttatatccctgatactgtgctagttcttttacatatcttttctcacttagttttatctatttctatagggaagacccaattgatgactcattaatgaggaaagtatcaaagtgaaaatgtactaggaaattaattcttaatgaatctgtcagctttttattacagggcatgtaaaatatctgacaaagagctgggcataaaatacttaattggacaacttttgataaaatattaacttaataagcataaataggttgaggatttttggagggcatgtgataataatagtattagtgtgatgtcttttgaaagtgctaagttctctagaggtcaaaaggagaggcaggaaaaggtgaaaagttttctctgaaagttatggggaaaccaggttgttaagacaacaaaatgggaagtcgtaaaaggtcaagttactcataggccttcttaaaataggtccatgagaaatgtttacagtgattggatgccagagaaaaagaaaatctctggcttcataaactgtaatttattttagacaaactgactaatgataaaaataaagacaatatgatggacttttgacagtttcattgaccaaactaagactaaaaagcctaaacatcaagatgttcatacttttaatcaacttcagaggtgagcaaagagaacatctgaaaagttaaggggcttttatccaaggtcacacatttaattagaggtgtgtgtgtgacataaacccatttctaaaattctcaagtcagtatctttacagaagtcaaatacgtctttgtcaaaaatagctttaacttacttccaggaaaaaggcaaaacaaaataattggagcaataatggatacagatataacagctaattcaagaatcccaaaataaaggtgaaaagtaaggaaattattagttaagataatctggaagtctactaaaaggggaatatgtttagagatggcaatttgggaacaatgtgtcctcaaaagtaaaagatcaaattacaagcagtttggggacctttaagagagattttatagattgaacaacaatttaagaataaaacaaggggctgacatgtgaacagcagcctggaaagtgttgcagaaaagccacatcactctaaacttcagtttctgtatatttggactgactggagggcgtgaaatcagttgttttaaaagcacaataaataatccaaccatctggcgaataatacaagctattctttgcacagacgttaatttatgcacttagacaccacttaaaactaaaattgaacaaaatacataatcttgatattattatataaaaaaaggaaagataacctttgccctgaataggcaggataaagatgagggcaaagatattcagaaggagagtattcttgaaaaaaattatattaacatctgttagctacatcagatttgaaatgcgatgatatacagaaagagaagtctactattgatttttaaaagggaatgtgttggctgaaagagagaagaagcttatagagagaccgaaagggttcttttaaggatatatttgaatgtcatttcaaaaaataaacacatttcccataacaatgcagtgaggttaaaagaataatgcaggtgaaagctttttggcccaaataaggtccatcagggctaggtattattgtttaacacaccacgacctagccctgcaagcaccaggctgtggctatttttacaagatccagtgcaacattcacagtatttctggcattagaacctggcacagatcattttgtttgcatttttgtgatgcctgctctactcagattgaataacccctcatttaaaaaactggaaaatagttttcttcatttagtttattctccaggttgagttttcctaactcttagagctctaaaattaatgattggatgtatattacatttacatttgtttttatttaggagttagccaggggtgacaatgtaattaaataagagttaatgacagatgccaaaatatgaataattaacagacaagttattttaatcatacatattatacaacaagatccatctgagaagtacaaatattaatagatataatttggttgcttaaaaagagtttttcttcctaccagtttagcaataagaagatttatgtaggctgggcgcagtggctcacgcctgtaatcccagtactttgggaggccaaggtgggtggatcatgaggtcaagagatcaagaccgtcctggccaacacggtgaaaccccatctctactaaaagtacaaaaattagctgagcgtggtggtgcgtgcctgtagtcccagctactcaggaggctgaggcaggagaatcgctggaacccgataggtggaggttgcagtgagccgagattgcaccattgcactccagcctggccagcctggtgacagagcaagactccgtctaaaaaaaaaaaaaaaaaaaaaaaaaaaaaaaaatatgtagaataatttgaagagagaaatcttttcatttttttctttgttttgttttgatttgtaatatatgtgaaatctttttgaggcctttggtaatacaccaagattaatgagtttttaactttgtgttgactagtatttttgttatttttaaatttttattttagctttaatcttttttgcttccatttatctttttatttaggaataatgtatttttctaagcatcataatatcagtgaagtcctcttaagtttctatttgttgaactctccttgactatacatttttgtatgtttttaattttctacatgtttgataagaacttgtctgtcttaagaacttttttttatttgccctatgaagataagatgtatggggatttccttgagcttaaactgagaaaaaaacctaatttttatatgaaaagacaaagactttattacgaagtgagttaatgttatatgtacatttgaaataatttattcacttcaaccagaccaccctgttcctaacctaacctccggattaatgtctaccgtgaagcacatacttctaatacatggcattgccttgtattacttcaggtccacagaaatttgttttgtcttctggcaaaaaagcattagctttttgcacaattttttaaaatgacagctatccaaattgcaagctggaagattgtgtatgaatacagaaaatgaaaaattttaggcaaccacaatgtctgggttaaacctttttatcatttggagaaagaatttggaacccaaagcccaaatttatagatttttaatgttattgaagtatattcctccattttatagataaaaatttgagttacagaaaatccaagttaaataagtttaacgtttagaactaagagtcaacttgccccagacacctgaataaacttgttctattatctcttaaattactattgtgtcctgtagtctattaattacaaatgcttctaagatttagtctttcaaagacttttataagaaaacaaaaatatattatttctgaaagcaaaacataattgtctagccagatctgcagactattaagataatttggagtgtcatccaagcagtgtctacttgtttattcttgaccttcaatttgacttgctcaagagtcgttaagagtgtagtaaggtatagtatgtacccttgagtttattaaacaacacgatcacaaacagactcctacacacacacacacacacacacacacacacacccctactctagagaatggaattttaagggttagaactttttatatgttttggatacagatggactattatttacttggcatgctaactaatgattctaaaacaattaaaaaccagcctctatcttaaaagctgatttctatttgctttctttgcatgggtgacatgagaacaatgatgatatatttataatgcttataagtcttaacacattgtgcatctttattttgtttttaggatacttagacaaattggaccatataccttattaatattaccctatcaacaatgtatatgatccatctatttcccaatattttatagggttttttttttttggtcttcccattcctgtgccagcttaattccttttttctctcctatgtagcattattgcattctttgagtcacttcacatgcaatctcccaactcatctctaatatttatttgtatggatttttgaaaaactgcctggattgttttgtgattcctaatttgtacaaaatagtagtgactacaaatcacatcctaggtcttaatttttcatgatataattatagttttaaaatacatctctgttgctgcatatgaacttaatttattgcttctgacaccatctcacattttcacataagttaataccaagttttacttatccattaccctagtgatgagaacgtaggctgttctcaacatttcacttccattataaagcaattatcaactctttttacatgtcccctctaggaacaggcagtttctctctggtttatactcagatatagaatggctaaggtagaagttgtatacgtactttaattcacgaattattccccagaatagcttcaccatttatctctcactagcagtttctctttaaccgtatccttaaccaacaaataatattagttcacattttaactcttggaaatctggcatatagaaattcacatgtaatttttgttttaattccacatttttgtgatgctaatgaggttgagtcttcatatacaatattgccatttctattttcccatctgtgaattgctcatccatgacctgtgctcatttttctaataaatgttatgtgttttcatttagatttgtaggtgttcgtttatgttcagatataaatccattattgattttttaatgttgtatatatcgtctacgtgtcacttctttttaaatctgactttggctccatttgttgtacataaatctataattttaatgtagccaaattcatccattttgcttatacaatatatgcttttatttgtttttttaaaaaaatctattttattccttactctgaaatcacaaagatatttgtttgtagttttttattctctctaaattttgtctttgacatttagatattaaactaattgaattttagtttcagacactgtgcaggattgtatttatagtatttagtagaatgatctctgaggaaaaactgtatgggtttaagtctcagttctgccacatacttcttaggttagtcattctactctcatgcttcagttttctcacctgtaaagtaggatactagtttgtgtctcataggatttctttgtgaaaattcagcaagctatataagacagtgcaatataagttgtatcgttaggttaggattcagctctgtgtctctttatataatgaacctctttccccaaagttggtaattcaacgttctcaacaggactatgatgctacctcttttgtgtacttcctatctttatatagttctatttctagaccatctgtttagttgcattttccatttctcacaacaggaccacaatgtttttaatcatcatgacttccttatgtgtgttttttttttcttttgagatgaggtctcagtctgttgcccaggctgtagtgcagtgatgccatcttggttcactgcagcctttacctcctgagctcaagttatcctccaccttcagtctcccaaataattagaactacaggcacatagcaccctccttggataatttgtgtattttttctgtagagactgggtcttgctatgttgcccaggctgctcttcaactcttggcctcaattctcctgtcccggctgcccaaatcgctgggattagaggcacaagctatcacacttggctcctaatatatcttaatatccggcagggcaagttctccgtcttggttttgctttcccaaactgccttagttgtctggagaacttcattcttccagaattaatttcaaaatcgctttttcacgctgtccttaaaaaaaggttggatttgtattggaattgcatttaacttatagattaatataaggagattgatattattagtgttacgttgtctcatccttaactagtgtgtatttcctttactcatgtgtcctttcatacagagttaaagtttttgctaggaagattttctgtaccatttgttatatgaagctctgtattctctatagtttttgttgatattacaagtgtatcttatattctatctggttattgatgctattggaaaatactattgattttagtatattgatcttttgtctagccaccatgttaagacttttttaaaatcagatttaatagcttattttcttgggtttccaaataaatgaatgatcaaaacatctataaaatgacatttcaatctatattctttgaaaccttatcccttcctctttctctctccctctccgtcttctgttggccaattccaatagataatgttaaacagagacagtaattttgaaaacctttattttgtttctctccttcagggaagtaataagatttttaaaaatattagcatggtaattttaattagtgttacacatatacataattttggtatatggccttggtcaaaaaaagataattcttatctggatctatatttataaaatgtttcctgcccaaaaagttttgagcttcattgggtggttcttatcccctatatctaatgaaatgatggtatgattttcttccttgatttaactaatgtagtcaatcatagtcatgattttctgatattgaactgaacttgcattctgagggataaacctaagtggccatattgattttgtgtaagttagcttttgttgcattataagccacctcacctttatttggcttaagatagcaatcacttgacaatttggggtgggttcaactgggaacatttttctcctggtttctcctggaataattcatacagtttcagttagctgatgaatcagcagggtgagatcttgtcagatgacgcctcacttacatctttcatggttgacttgggcaatgggggcacttgattcatgtataatatcgttaggatctgacaggctgctgggttccaacagcagcaagacaggtcaagctcctttgctgttatctcactgggcagctggaacaagttacatgctgaagctaagtcagtgctgaagtgggtggcccagggatgaggttgcaggaggggggattatgccattatttttgaaacatcctatcacattatttttaatattcttcaaaattctgtgaaataatattatactcagatttttggcttctatcttataagaacaatttgacttaaaaattttattcttattcagtttgatgtccttcttcaacctccaattctctctttccagactgggggcatttaaaataattgaagggaatagaaatgaatattacatcttagatcacatagacttagacaaatgggtcctatcatgcactgaggatgttcagaaggctctgatctcccagctgcctcttgaacccatatatgcatgaagcattttcaaggagtataatatacagtgtgtctcatttataccataccagcatttttcttatgtttttagctgctgtacaaagaattaaatttgaaagtatctccagggttgaaaaaaaagtttctctaaatataaattaaatttttaccttgatgcagtttttaacatccttacttaggtataattgatatacaaagaactgcacatatttagcatgtgcaatctgatgaatttggacatatgcgaacacccattataccatcaccacaatcaaggtaatagacaaattcaacacctcccaatattcccttaatgcatttttttataatcaatagtatgaaaagtaaactaaagatgggtacatttcttgagatgtattcttttattattattttagatacagtgtcttgccgtgttgcccaggctgtcttgaactcctgggctcaagcgatgcacccacctcagcctttcaatgtgctagaaatacaggcatgagccactatgcttggcctgttttttagttaaaaaatactaaattcttgaaaaaataaaaatacaaagtaaaaaggggaaattcttcatcgttcctgtctctcaccttcacaggtgaacctactgtaaagttaggatttcaactgtaaaaagtacatgagatgaaaatggtttgaaaaagtaccgtggagacgtgatcattaaagggttatgctgaacaagataagtaacagtctgatctctagttcaaaattattggcaagaagcggtgctttaacagcaaggtctaaaatcaaagaactatagttaaaactaaagaaaaagctagagattattgggtccaaattcacatttttcgtatcaggaacctgaaaatcataaatcatgaagtgatctctacttatttctaagtaattacacaatgctactttcccctagtttggccatgataaagagtggaggtagaaagaagaatgaaaagaaataaggccatttttgttttaaggaaccacggagagagaaaaattattgattttatcatttctgagagataagttcttttagaaacaaatgtctcattgaagtagggaaatataggacattatttagaaaaccacaacagtcctcttcattcaaccttcttcagggcaagcacacttttaagtttatttgtattacatagtattttagattataaaattgctttgtctttagaagtcagtttcttttagccatgtggggttattcttaatgtattgatctctctttccctctctgctttccctcccttactcccttactattagccagtaggaaagaagattacatatactgtacatacgctaaactatgcaataacaaaactaaaaaaatagctaatatcgttttgttaaagaagacaaagaaaataaaaagacaaagcaagcaagaaaatattccagctacagaatcttgagaaagtggaaagaatgtctgggtcctttctgtctttgagtagatgtgaaaagtagataccaaggtggcagctctctttctaatgtaggaatgccggttgagcctttattttgtttccaagacaacaatctgcttacgcggttctttcacagttatcttcacctttgaaaattaataatgatgaaaagaatactgtgtacttagatgatgtcttcttttcttttcgtctcatggactcaatgcacttaagcttgcagcaatgatctgtttaattctccggcaatcctgagagagtgccctgaaagggcagatgtgtttttccctcatttcgcagatgaaaaaactgaggttcagagaggctacatgactcagtcaaggtcattcattgtggtgatgccaacaccagaaataactcccctatttgcttgccttttcacaggtgattatccactggtccactctgactgctaaaattcactgtacctgtcctcgcacagagtccttgaagtgtccttttatgaggacactaagactatggcaagagtaatcagacacaaagaatactatataaaaagaccagtcttttttgttgactctatcccataaaatttctcagccacactgtatgagaaacatgagatgtctgttaagatcacgttcctattagaactagcaagaactagattttgcagagattaaagatatgtcttgtggtctgactgctgaagtgaatgctttgggagttagagatggatttctggctaggtaagtcaagaatgcccttttgcaattttttctccccatttcttagagactttaaattcatgatcgacatcatatattataattcagtaccattcatcatccatgttgcacgtatgtccaggaaagaaagttgcataagtcattaaatcctttcatgaattcaaaaacttatgaccctaggtttagctcagcaggtagtttactagaattattaaattacccctgttatggacatacaagaacatgacgtctgatttacctgtctcttcataaaatgaaaatagaactgagaggttagggcaaacttttgcatccaactcttgtagtcatctaaggaggtgatcatttattactactaagcctgccctttgattggtggttactccaaaatcaataatagtaaaactgtccaactctttgaagatgtttttctctctgccttctatccctcacgtgtataataaagcaaaccacccatttgcctttctaattatctggtgtcaattactaattggagtaagttaaatcttcccctataaactccttcaggacagacctgagaccttatttttcactatctttccagcagacagcatattccttgactcagattaagatctcagaaatgttagttagatgggtggatcaattgttggtccaattgttggtgtcttgcaggacagaaattaactaaaagtactgagatttccactgtatataaaaaagaaatgatttaagtcagggaaatatgccactacttttccttcccatgttcattacagtaattaccccagtctatcatgacattctttccctttgggtctagactcgatatcaggatccttctgcacaatataaatcacgtattcctgtttgatttcaattgggacacaagaaaaatcttgttttctatccatgatatataaattaaggaaaatagtaaatttttatgtaaaaatttagatttatagaatagaaaaagtagttttcaagaactgacctaatacagactttagggggcaaatttatgtctaattgagagcctttctagatatgattcctcaatggactgatcctccatatataaaaattctatattaaatccttatataggattttatctatataagatacatgatgtcagcttcctcattggggagttgggctgaaggaaaaaaatcaagaggtacatgggataattaaaaactggcatcatcatcaataagtagtatgtgaaaattaatatttagtagatagggtaaatggacaatgagaaatggagaggtctcacattgagtagactcatcactaatccataggtatcaccagtgtgccaatgtagcaatgaattagggtattcaatgctagatactgtaacaaaccctccttaaatccaggtggtatgacttaataaatgtttatttcacatggtggaggcaaatgtagttcaggcaattatttcttaacagatcaccttcaagtagtcaatcaggaacccatgtctcttccatcttggaatgttggtgtcttaaatacacagcctcctgagttaaaacagaaggggacacaggcagtgtgcaaggtttcctggccaagtctggaagtggaggacatatagccttttggccagaatgcaaaatcatgacctccacctaaatacagtgagcctataaaaggagtgttctctttagttgggctcagtgttctctttagtttgtacacatgtaggcctggctacatggaggctgaggcaagagaattgcttgaggccagaaattcgagaatgttctgggcaacatagcaagaacccacctcttaacaaacaaaggattgttctctgcccaggaagaggaaaccaaagcatctcattctctaggacacagttgaagatgggtaatctgtgacaaagaagagcaatgtttgcagatggtgacaagtgaagattgagaaagattgatttcttagtcatggaggagcactgtcccatctaacagagttctatattgcaataaattaagtcatccactagaaaccaccaatccagtacaaatatttgtatctaccaagcactgtaatagcaactgcaacctaccactatttttttcctgggccctggttgatttctagtatttggtatcaagacatgagcaattaacttgatgtgggcattagccccctcataggagcttctaatcatccttaaccaaaaacaacaggaaagagggcagatttatttctctgcttatgagaaagtaccttctataatctggcacttttttttgccacattcaaataattttttcttcatgtttcttggcctacttaatactattattaaattctccctcagcctttatttggccaaaatatataaccacattttcttttgccattcccttaaaagaatccttcttttgcttatttactttttagaatacctaatgagaatttgaaaatcatgtaatataaaaagataaatagtagaaatttcttctgggacttatgttccttcatccaaccagtttaagagcccttaccccttgacaactgttattagtttcttatgtgtccatcagagttttctgtgtatatatgcaaatacacatatgcatgtttcagaagttattatataataaaattacagaagcaggaaactggaaaaagtcatctcagtaaatgtttgtactacaagacaagtggtagccactagggaaagtaaccaaataacccatctttgctatttatttttcaaatcggatttaagaagggatttttcatggctaatgaaaacttctactttagctcttgcttatttccattcatttatgttttaaaacttttttgtttagtttcaaaaattgtttttagttttatttaagcgaagagtaaatcttccaaagttaaaaaatatcattcttaaaagagagattaatttaggcttagtggaattgatatgaagctaagaacatatgataatcatatgcattagacgttttcaaaatgatttgcatcgtgtcagccacattcaagtccatcgactgtaagaaaaatgattcggtaattaagttggctttgaagattgattacacttggttactaaataagatctcagtgttaagccagattctccctctcccaaccatgttccaaagaacactagttttatcagacagccatctgattgtttagtgctttcttcttaaggttattaagtattttgaatatcacctatgctcccacaggacattaattgatatcaagtaaaggaaagtaataaaaaagaattttataattagtgaaatatgtttgggaaatgctgcattagataaaattaaatatgtttcttcactacaggacttctaagatgtagaatgagctataatatgccctgtgaattttcatgtgaagtaggtgttggtgtgaagaatttttaaacttcatttggctatgcaaacctttgttggtggaacgttttaaaggaaacttgtttctagcaactttgggaaatgctgtcctactttcagctgtgccattgaaatcttagcagttggagggaggcccaccaacaagctcatccaatttccaatatagaaatcttcactatatccgtgctatcctctcatttggctgtggatgaatattttgataacagaatgttcgatgccatacagatcagctgattctatggttggaatgcttttctgttaggaagctttaacttcaatgtcttttttacagttagaaaattttaacttttaagagttcacttattggacatagatctgatctctggatttaaaaaatcccacttaagaaatttttattaatcatagacaaattctacctagaaaaaatgctaaaataagttataaatagtgatcaaagattgatttaaaataattttttagaataaattgtgatttgaaatttatgtcaaaataggttgttattaagtgaataaaaccacattttctgttgtgtttcataaattcaagctaaatagcacttatgcacaattgtaataatttaaaaaacaattacatgttgttttgagtgattattccaacaaaattggattatagcattattcccttccctccactgaatattcaacattagcagttcaaatcaaacaggattcttctggtaaaaattcactgaaggagttcatcagttttcctaagccctctcctaatcatttgatactcaaagaaatatatcttgtaactcctattgtgtccatttatcttttaatatatgtagctatatgtctttgccagatccccatttagcaatggcttcgtgtatttattctggaagatttctgatattattttcattggctttatcagtgtaaatgggtagctagatgatatccaatctgcaaaatttaggatttcacattgcacttatttgcattttatttcttttgtgtggtatgatgttcatatcttgcattcatcaatgagtaatcaactaaaactaaatgggtaggttaccaacttagaaaagttggaattttggggcaatttaaaattgtgaggatgtgaataatgaacacttggatgacaagaaatccgttatgtgaaaatacttaccagggaactttgccaatttgatgtactctattcttatctttttctagttcttggttacgaagttcttaactttccagtaatactgaatttctgactatttgcagacctcctcatttctgggtctagttataataaaccttttggtttcattctttattcataaagtgatgtttctagtccggccagaggttgttctgttcaagttttagagtacgcacagttttagtagcaaaagtaggtatgggttgtttgcaaccactcagttttccacctaaccctacttctgatcagcttgatgcaatagatagatagacaaccagacagaatgatagagttcataactttgaccaacaatctgtgaccttggccttcttggcgtgccatgccttctcaaaaacagtctgccagataaaatatcattttttctcttggtattcaggatactacatactcctgtctttaaaaactccctcccattataactcctcatttatttctttcacacactgaacatccattcacctgaactacatttaattacctgtggtacgaattgttttctccttttctgttccaaagtatccccatttctctgcctagaaaattccttcatgttattcacaggactgaatcctcctttgccttcaagtactttagaaaatgctattctttccaggatcaacatgtcaattaatcaataaaccattagtaggttcataagttgcttcaatgaagttcttcaactactaaaaataaagttgtcaatctttagtagtgatggttatattgcttccacagtcatatattctaaaaataacttacttcattttatgctctctaaaatgatattaaaatattcttcattgttttagctattttcacaatagctttcatgatagctatttaggtgtttttttttgagaccgagtcttgctttgtctcccaggctggagtgaatggcactgtcttggctcactgcaacctctgcctcccgggttcaagtgattctcctgcctcagcctcctgagtagctgggattacaggaatgcaccagcacgcctggctaatttttgtatttttagtagagatggggtttcaccatgttggtcaggctggtctcaaactccagacctcatgatccacctgcctcggcctcccaaagtactgagattacaggtgtgagccaccgtgcccggccctattttcacattttgatatgtctatgataccagtctcttgaagacataaagtatttattaacaatttttttcagttttctagtattttgccatgtttttcatttagtggatgttcaataaagttgacttcaaaattttagagagcaaagaaaatttccctcaatcctccccatctctattcaagaccagtgtggcccctatcgttctttgcacaacattatttggttataacagctaggccgatatttttgacaggaactcaagaggacaaaaagaaaattctgcatgtattgagactgaagctgatgtatgcatttgcttcaagacttattccttattgctccaggactaaatattccttacttaggacttactgctccaggtccttattgctccaggactgcatggtccttattcagcattataaatgtattcttaaacatatgtaataaagagtcacgcttttatgattttgtgatgaatcttatataaaatagtcatccatatttacaaatacttttcagagtgcaattcttttgaaagttttatttttacccctctgtatacaacaatcatttcacaattaaaaagagccaaaataacagtttttggtggttgtcgttgctgttgtgctctgctatgtttttgttttatcccatgttgtaccttggagatgatgggcttttaaaatctcatgtataaatattgagtttttacggtcacttggatggcagatataaataaatgtgaatccttacaatatttctaaattcttgattttaaaatgggaagcacattctcaacgttcatcttttcatactgtcatcaaatttcttactttaacaaaaatcgcttggttctatgcataccaatgaacctgcatgttacattttcaagctcatgctaatatgttctttgcaaaatacagaaactttctttctatgtattcattgactttcactattcatcaaggtggtataaatgcttaggtgatgctgaccaaaaggcatctaaattcatggaaatgaatgtgaaaatgggacaacagaattcagtatcacaactaatgggcttgatactctattttacctttcacccaaacataataacagtaaattttttttaaccaaagactgagttctatgtgtagttccaagaagaaatattatgcttaatccatcttttctttcctagcccatgagcttcagcctatgtggataatggcaaagtcagagtttgattgttttctgtctgttctaatcagtggtatagacaacaaataagaactcagtttgggaagaattctgggagtagactcagagtaaactttcaacaaggcactatctttgttgatgttgcagccaaccaaaatcattgatctggttacatatttatttgttcttacaaagtcctgtttttgtgcattcagcaaatttcctgaaggctactgtgtgtcagacactaaagatacaataatgggcaaaacagacagagctcatgtagtcatgaatcttctgttttggaaagcttgatggtactaaaggtacccacaggaaggaccgattcagacattaatgaaacagtcacacaaatgtaaaatataaaataaatatgtgatgccataaaagcaagtgaaaggagaaccaacattatcaggagttccaagaaagacttttctaagtgctatttgaactgagaccagaggaatgcattaagcaagtagtggcagtatagggggagtcactgaaatgagcaataaagggatacctttgactaagtaatttataaacaacagaaattcatttcttagagttctagaggctgggaagtccacaatcaaggtgccagcagattcagtgtctggtgagggctctcggcatcttgggcaccttctatgtgtcctcacatggtggaaggggggaacaagctgcctcagtcctcttataaggacactaatcccattcatgagaactctgccctgattatctaattacctcctaaagaccctacctattggactggtgattcgatttcgacatataaatcttggggagacacaagcattcagatcatagcagaggtaaaactttattaattcatttttttttcattcagaacctactatgtgtctatactattctcaatcctgatatgtaagaagaaaaaaatgtttctaagaaactgaaatggtggctgggtgggggcagaaaatgttgcaggttgagatggattcaaaacaatcactgttaagtaacccttaggagttttcaaaattcagatatagatgtttcctttttattgggaggaggaggtgcagatactgcctagcgattctattcagaagaatcccagccatgccagtcactagttgtgtgacctcaggcaagttacttaaagtctttgtacctcagttttctcaactgtccattgataatgttgataataccttcattatagatttgggtgagaatttggtaagaggttaggactatacccagcatttagcgtctatataaatattatatattgtagttatatggtattgttgctcagtttgctaaattagatatagattgagaaaaataaatgtaattaaataatggtgaatgttgactgtagatttacttaagtaaattgtaagtgataaaacttttcatataaggttaaataaaatttagatggggagacaaaaatgttggaagaggcaaaaatgatgatgcaaattgattgaaatatatgtattataaaatagcacctaggaaaactggaaatcaatgaagttttgttaattgcttttttttttttttttttggaaagagaagatggatgtttgtaataaacttaaatgaaagagttttaaaaatggttccctgggaatgcagaggcacaaacaaatgctcataattttgtggcttgggctaaagcatttctcaaatgtccttgaaagttcccaaagacaatctttcctcaggaaagtatttctcctgtgagtaaataatgttcttgcctagaaatgaaatgtagtaatatattacattgcaactgaattgatagcaagactggcagatgaagttcagaaaaaaatgtcacattggaaactaggatttgaggctcatatctatattttcataactccttaaggggctccctccatagtaaatcaaaatagtacagaaagaagttttgactattctttacctcttcattaaagggatcaatttggaattattattgcaccaataccatcctgccttaaattttgtatggtttagctgcacaattgataagctaaggtttcttttcaccatataaaaggtcctttttaagcagtcatataacaacgacatttaaaatatttgcttgcttttaatgaaagctttgtactttccaaagtgctttctaaatgcatctctgtgagtcaggtaaaacaagtcctgtcaacagtattttacagaagaggaaacaaaggctgtaaaggaaagcttcttgctcaaggtcattctgtgagctagacaaggacttcatcacaggaatgactcaaagttcaggagggaatacagcagggaaagcttaagccttcagttcatttttacacgagaatttttgcctatcgccttgtaggacgacatagggaataaactgtattaggtacccagttcctccttcgtgttacttaagagtctggtgaggtatttaggttggacgtattctgttctaatgaagataaatttgacatcctgatggctgatcccatgtgctttagaatttgaatcccagctccatcacttactagttgtgtatccttggagaaagtttcttaacctcttgatgcctgtttccccttccattaagtgtcaattttaatattatcttctatgtttattcattcattcatctaacaaatattggctaagagctcactacatgtcaagtactctgccaagaatagttaagttccctagagtgccagaaacacttttcagtggatagcagaagtcagtagagctgagaagtaaggttgaaactgaccttaggagaagattaaaggctcagataataggagaaatgactctcacacacttccaggatgtaggcctggaggtattcggagccatggtgcgttgtgattttggacatactgcacttccagtcccggtttccaaatctagagaatggattgattcaacatacctcacagagttaatttggtagggattaaatgagggaacatatgggatgtgacacaggaagcagtggataaattattacatatgagtatgtttgtaaacaaaatcaatctttatggccccgctgcatagcaagtgatcacagcactctaattttctggttgagcctgacattgacacatcaggcagatcttactttttgaatcaatggaaaattcttgcctcattggtctaatgtcacttaattttggttctttatgtatggagacataagtaaaggaaatcttaaaataaatgtattttattttattattttattttattttttgagacagagtctcactctgtcaccctggctggagtgcagtggtgccatcttggctcactgcaacctccaactcctgggttcaagcgattcttctgccccagccgcctaagtagctgcgattataagtgcccaccaccatgcctggctaatttttttttttttttttttttaatagagatggggtttccaccatgttggccaggctggtctcaaactcctgacctcaggtgatccacccaccttggcctcccaaagtgctgggattacaggagtgagccaccgcacctggccagaaatatattttatatcttatgcttcaaaacgtagaaaaacattattgtattgttcatcttttttttttttttggacacgctgatcagctagttttttcctctgcagccaggcaaaacagaatctgaagaaaacactttaaaattttgatttcaaatataagatcatggggttctttccctactcaacttagattaatgggaatcatcaactttagggttttaatatggataaagataactatcgaagattctaaattatttaatttttgatattatatttaaccatggtaggaaattaggatttgactaaaacatactccttccttttcctgtaccttagctttttcatacaggaatgtgcctgttccactttgagatgctcaaccaggtgaggtgctaaaactagaggtgaagcttagtttctgcttattcattctatctgaatgagatggcaattattaagcaaatgtttgccatacaatttttataaagttgaatataacacagtggttaagacttagggagacaaagctatcttgtattcttttgctctgccaattgattaatatataatacatataaccagcagaagctgtaaagtatgatttaaatgtaaggcataattttctcatttatttcaccttaaatgcatttatactctttattatttatagaagagttttgagattgctaagctttaattagtgacatagcaataataaatttttatcaatccctaaattaacaaaaatgatgattgatgggccaggcacagtggctcacacttgtaatcctagcactttgggaggccgaggcgagaggattacttgaggtcatgagttcaagaccagcctggccaacatggtgaaacctcatctctacaaaaatacaaaaaattagctgggcatggtggcatgcacaagtaatccaagctgctcaggaggccgaggcacaagaatcgctggaacctgggaggtggaggctgcatgagctgagagattgtgccactgcactgcagcctgggcaacagagtgagactccatgtcaaaaaaaaaaaaaaatgatgattgatgacttttcccacaaatattggataatacctctgcagatcaagtcaaattagttaagtgtctatattttactctcatgagttgcccagttaaatccccagcctgttttcattcactctaatacccatgatttccactgcttggggctgggtctccttctccttttggatgcctgggtttgactgagttgtacttcacgagctgctgatagttacctgagaagggccttctatatgagcttcttgtatttcatatattatttcattttgcttcactggacccagacatgctcttggaattgtatgtttccaaaaatatcaccagcatgtctctagccaataggaagatcatgatctaaagatacatcttagattatcagaaccttagagaaatctaaagaggcaaataattttaaaatagcagcatttgcttctggagactggctgacactcttatgtgaaccagtgtgaaaatgacttctgaaggcatccgtcacattggcttcgagaagtctgttccttcagcaaatgtattagtccatgctgcatccccactttggcttatctgtgtggtttggttctagctcccagcaggaacaaaagctgccgagaggcaacttgtttggcttgggagcatgcccaatgtgaaaagtttgcaggcagaatccgaaagagcagctgcaagaggagagatgggggtaggtgacagctaatgattcagaaagcaatttccatgagagccttctgctgaacaggaggcagcagtgcccgggagatagtttaccatctaatgccgggctggtttcaataagccaagtcctttttctgtcagtacctgtgccccgagggaaagcgcagccaacagcttctatttacctgaaatagtaggacacactaattagaatttcaaagagcttacatctattaaaacgtgtggatccattttatcctaaggctcaggatgcccagcctcatataaactgatttaacaacaaacgtttaagtacaaatccaaagccatctatctagtattccttcacaacttcttgtgtaccaggctctgcactgtgttgctttccatactgtgtcttattgagtaatagacctccgaaatgggtgttgaaggttcctaccaagggatctgtgtacaagaaaccatagccaggaaagaccaaattattatttgttaaaagtgagcttggccctgttatctcattttggaattcagaatggcttctctctctctcctctccccccaaatcacagatgactagaacacaggacaagcctaagctaatatgatttactcagaatcacagaccgagatgctgggactgactgtgtagcacacttgccactttctaatacagtaactcctctcactgctcaatagacgtcatggttgttggtcaataaagatcacaattcttcttccaggaacaggttggagggccgtggggttaggttttcaattccctcgcaaacatttgacgactaagcatgttccgagcacgcctctttctgacatgcttgattcctttttttatagatgtgcaactgaagcagaagctaagcgacatcctcagatcacatagcccatgcttttaacctatcatactacttaaacttcctcacctgccagtttactttttctcttgaagtctgagaaactgaacacagttccagatagaaatgaacaaccaggaagacgcttgaaatgctcttatttttccattaccgaagatagtcactttttttaagtgaagtcttctagctttttcgtggtcataagtaactaatgatatgcttcaattgattaaaatggcctagcattctccaactgtaatacttcatagaaagttggctgttatatttccctaagtcctatgcatgtttctagagattagatgctgtcaaatagctttcttgaaataaatacaagattctggtttttaaatttatcacttcttttactcttgcagtggctttttttgaattgttggacatgatagatatgggaaatacttcattagatcacaaattttagaacctataacatacatatagaacagaactttaaacagagattagaggaagctaagttactagaaaatgtagtataaatcattattgaaatagagcttaacacattataattcatctgaaaagaagctcagattatgattgtcagttatttaatgttctgttcaaagataatgaaaacactgttaaaggtatggtattttgactgccattggaatggtctgatttcaaacagcaatgcattagttgtgcttaaatggataaagaatgttgaataagtgaagagaaaataggagaactgcattctaatcttatcttggccactgacaggaataaagttgacttttaggctatcaaacaaacattttcttttcttttcttgttttattttctttatctttttcttttttttgcaacggagtcttgctctgttgcccagctggagtacacttgcggaatctcggctcattgcaacctctgcccccaggactcaagcgattctcccacctcagcttcccgagtagctgggactactggtgtgtgtcatcatgcctggctaatttttgtatttttagtagagatggggtttcactatgttggccaggctggtctcggacttctgacctcagatgatccacctgcctcggtctcccaaactgctgggattacaggcgtgagctaccacgcccagcccacacgaacatgaaaaaaaaaagctaactcagttttctcacctgtaacatgaagaagtggccatttaaaaaataatagttgattatctttagttctgtaattttagaagcatcttgatttgatttatgcataaactctcacaagaaaaaaatgtccttttatttctaaaatgtctgtaacattggattaacatagcaaatgaaatcttttgaggattgttcaaagggtcaccaatttagaattcatctcctctgttggtttttattttttgttttaacttttactatatctatgatagggtttttttccccctgcactgggactgacagatggaatggttaaagaaacacatcaacacttattttagatactttgttatcagacccattctgtgaactttgctctatccatgaattatttatttcatttgatgtgtttttccctggattcataaaatttcattttgtcatgatgtttcttcccgtttatgggactataaatgcagctgactaaacctctttaatggctgaacacatatcatgtctttgagtgaaggatgtgatttctctttctgttcacagacatgttcacattttcatttatttgcttttcttctgttcactcatgacaatagtgtcagtggagaaataaaatgatgacatctgatacttatttaagttggagtcagaagacttgagctttctctaactttttagatttgctagctttatagcaatgtgtacctcacttgttttctctgaatctcagttcctcttctataaaatgtgaataattatgcctataacacaatgtagttagaatggtaaacagaaaagaaattcttcccatctgctctcgtgttggagaaaaataattgaactgactttcatcagatttggaagtttgcaatggtccgtttgaaaatattagctaaatgggatactgtgaagaccctctgaaggcacttcaaagagatagacaaatatctccaagatcatcaaaatcaaagataaaatgagaagcattttgacctttcatcaggagacagatgatgtataatttcagtagttcttaactttggctatagatggagaatctcttggggaactttaaaaaatcttaaagcccagacagttacttacaccaattaaatatgaatttctggggctagagagttgcaccaagacattggtatattttaagactcacaggatggttcctatatgcagtgaagattgagaactctacatatgttaagatattgtggctaagtatcacaaaagtggatgttgtcacagggtagttctgcttcttacatgggcaactccatgccaatgagtagcaacatgaattctttaaaaattttacatagaagccagttttatagatatatataaacactgtaagaggctaccagacattaattaaagaaactcagagtatgttagcattaaaagcatatctccaacacaatgtcagtagaagggatggaagggattctggggctgtgatatggatgcctccatacctggatcattgagagagagacaggaaatatctccaaatcactgaaattttcagaaaagcctgtgattcttttgggagtcatgatattagggctcatgacccttgactcttgtttcataatatagggacccacagttacatacgaagtctatacctgaggcttcttatatggtagaagtggaaaggacaaatattttttactgaagaaagaaaaagagatatgagtggggagaatggagtaaagaaagagaaaagcaaaagtaatccatctagagaagacttacttttgggcaatccctcatcgtataatcatgtgtatttcttccttccatttcatgctttactctatataggcatttaatagtttgtcttccacatattttaagttccattaaggagattgatgtctgctggcattttgttttctggattccaggcacttagcaaagtccctcaataagcatttgttgaatgaatgcatgaattaatgaatgaatgaatcaatcaatttaacttcaaactcagcacccttctcaaaagagttacctgctttataccatacttgagaaggttacgttgttttatcattaggccaaaatcgaatcaatcaatcaatttaacttcaaactcagcaccctcctcagatgagttacctgctttataccatacttaagaaggttatgttgtcatatcattaggtctaaaagagaaaccaggatcttgattttagaacttgaggtcatctcttctatcatctcatacaatgtaggaattcactctataaaccaggtagtggtcatctagtctcattttgagagctcttgtgatctgaatgctctagttgatgatttaactcatcctgtatataaatagctatagctgctatgaagtccttccttatatctgcctccctgaagcatcttacccattgatcctaccttgtcctggtggaactggaatgaaaaatattccagtctcacatacatacattggcacttcagatatttgtagcccatcatcacatccctaaagtcttctcttcgggtcaaatattgtagtgtttttcctataaatcatgtgagagtatgtctaggctcctcaccattttgtttatccctgttttcactcgcttttgttttctaaagttacttcccccaaattgtgctcagactgggatttcgtgcttcaaatgtggtccatctgagaaagagggaccccccaaaacctcccacacacatgcacgtacacccaaggaaaactatatttctattaaatgtaattcttatgtcataaaatctatatatgtttatttaaaaaataaaaacaatatagaatagcataaagaaaaacacaaaaatccttcagaatagctcattagctaaagacaagccctttcagattctttcatatccattgatctatctgcttttttctacatatatcatttgtgcattcatttgtgtcaacatcacataaacacacatgcaaacatatgtacataattttacctaaatagaaatatagtgttttaatcttatgttttaagactgattataagtactgagcattattacctgacaataattttagttccacattaaagtttgcaaaactcctgaatgttagctaaaatgcagcccacagatactttctttctaccctccaagacctgcacaacgttttaaaagccaggacattttgcagcttctcctgcgaagaggataatctggtgatattgagtctgtagtcttacaaggatgtgatggaaactgaaaggcaggtgtctcctctacaatgagcaggtgctccccaaacagcttagccattagcttggcctgtttcttgcaaaaagccgatgcaaccacccctcgggttgagttagtgtcccctgaacatcaccattttaataactgtagaactatatgcaagggataaaccaggattgatttcataaatctccttttgataggccttaatgttggttccatattttccgttttgtgaatagagttgcggcaaacatctttgtacaacatatttacccagatacctgataatttattataatgaaattctacactggatgtaaatcattgagccaaaatagacttttagaactacttttcttctttttatcatagtcaggtccatggaagcagcccgcatctttcactcgcactgtgttaagcaaaatttgaccactgtatatgtagacataggtaaaacatagaattgttcaaacttcatgttatacaatttaaatatgtgccataaaataagtaagtagaattgttagaaaaatgaagctgggcatggtggctcattcctgtaatcccagcactttgggaggctgaggtagacggatcacttgaggccaggagtttgagaccggcctggccaacatggtgaaaccttgtctttactaaaaacacaaaaattagccaggcatggtggtgcatgcttgtaatcccagctattcgggaggctgaggcaggagaagtgcttaaactcaggaggcagaagttgcagtgagccgagatcatgccactgcactccagcctgggtgacagagctagactcttgtcagaaaagaaagaagaaagagaagaaagaaagagagagagaaagaaagaaagaaagaaagaaagaaagaaagaaagaaagaaagaaagaaagaagagaaaagaaagaaagaaatctagtagttaaattaggaaaattattaaatacagaaaaatttagaaaaaaatatactttagagagaataaatatcatcattgctattttttccactattacatgcatttatgttcatatgcatatgtaaatctactcattttatacacagtttaataatgttaagatatgctgtttatgtcatttttatctatattacattttcaattaacatcataacatggccatttcccatatgatctagtgttcttcatttagataatttgtaagttgctgaatattccaatatatggggtcacttatttaaataatctcctattattcggcacttaagttgttcccaagtttttcgttttacaaacaatgttccagttagtgccattgtacatagatttctgttacttcttctggtttcacacttagaacacatttctaaatatgtaatcactaggtcgcaaatccacttgtaactcacataggcaatttttcagaaatctaaatctagaccttcacatttgaaattatttcagttatatcccttttatctgttttgctccttttttttttttctacactgctgaggtaggtattttaacacatccctcattgatcctgttgcctcttccaagcacgttgcttggtttgcattaactgggcattttcccaaaatgtcccttggaattcccccaaagatagttgctcaataccactctctttcccaggtactaaaaaatgcagttgtaatgacttgttaacttgtagatatgattaagccccacagttttcccatgaaagtttactatttggcactggtcctgcaggaaggtggcaatgttactcacacagtgaatttgcattgatattcgatataggcatcatggcatatgaggaagcaaaatctgagaaaggatttaaatgtgaaagtcattatgcaaatgataaatattatttattattaagtataattaatagttgccaagcagatgtttttcctaaccaagtgccatataccttttaaaataaatgtttgtaattaataacatttagatagggggaaaataagtttttctcaactttttcattatagcccagattttgccaggcaaacaacttgatagaatcaatagaagcttagttaagcaggtgataatcttctcttggcctccaatttatcactaaatggcttttccatggattgcaatcattgaaaggttgtaattgtagccttctgctatatttactgttagaaaatgttcttttaaattgagcacgctgtgggtttgtgaacacttgtttgtcattcatgatgattaggttcccccatatttgaactggtacataaaatgccagtcatagtgttttaaagtgatttttccctcggcagttttgattagatgccttgggtcagtgcttagttaatatcttgcaccacttggcttctgtaagcaaatgagagagctgaacattccacccacgacctgcttggaaagctgataaataattggaaaaggacagtaatatctgtaagactttcaatctgttccattcagtgtgatattggtattataacacaagccaagttgtcagtaaaaaatcacagtcaaagcattctgagtagttgacggaggtgtgagaaaggagtatttcagttttataaagatggttcctctagctggcaagagggcgcatattcattttttaataacacacagagcatccacccctgctccttgtccccatgactattctgtttagacctccatgccttcccaactgcctctcccctcttagcagctgctcatttcaggacttgctttggaatatctactggagacagcactgaggtgcccaaaattaactcagaatccagaaactagtgaaaggtatgggaactaaaattgaatagttataaggtggtaccgtgttcatgaagatgatacagtagcagactgcctgctgtatatcacacagtaggtatgctgtctttttactttatttttttttcccagggacaagagaatagaattatgtctatctgttcatgcttgggattaccagtgcatattgtctacaattgtaagataaaactagaggacaggtattgatgcagtctttgactgtcaataagatgcatataacagataaaatggggcctacacccagccctgtttacaatgacagacttgttaaaatgagcatctatcagaacattaaaaattgattacaatcctaagtggcctggaggtgtgtagggaaggtgaaagatgctgacggcacacactgtccaggtgctgtcagaatgttttaggggctgatagagagtatatgccctgccatggatcttttccacatcagatgggaacaacgcttctcctccggagatcaatacctcatacaaatttttacaaggcagaccccacaaacgtggtgtctggagtaatcatttgattttccccaacccatatgtggctgtggaatgaaataaagctaatgttcaggcaaacaaagggtattgaaaatgatacatgttctggagtgagacagactgtgtggcaatcccaaccctactgttgacttagttcagtaaattgaacaagttctttatattctctgaactgcagttgccttgtctgtaggtggaaatagggtcagtccttgctgggttaatgtagtattagagataatatatgtgaaaagccaagcatagtactgatattaaaaagacagtaaaagcggtagctgtttctataattcaggaaaaatgttatatctgacatagaccatcctaaagtgaaacaatgttcgataaaacttactggaagaacatagagtaggcaagaggtcaaacgattgcgtgtctatatcctatgattataacacatcaaattatatccaaataggttctcaatatgtagtgtaggcaacacatttccaattaattataagaactaagcctttataattttttggtgtcttagtgtttgatttttttaatcttaataatgtattagagtgcctctgagtttagctcttactaaattataaaggcactcattttagacctaaatatatggttcacccaatgcaggtggggaaaaaaacaaacatttttggcagactgactctggcttgctggggctctgttctcagttcacagaccaaggagtatcgtcagccagactgataggttgatcatttctaagtgtacttggtttagatcaagatgtcaatttccagcagcaataggcacttgcagatagtctcattttcttgagcataagaatgcgtcttttcctatatttttgagaatatactagctgctggcccatgtaaaaactatgaagttattaaaggacactcaatgcttcccacctggtcatttttctcaccttcaggagtagcctcaaatgtgaactgcctccagttactgggatgccccatcctttcccactgtcattacctccacactcataatcgcttctatcaattctagcacctaaaggagccaggctttgtatccatttatattgttcactttatattagctgaaattgcactagctcttgcccctgtcaaatggatatcaatctttcattcattagttaaaaatatgaaccacttaaatcaggaagtgcaagacagtatcatcttgagggccttttttgaatgattagtggtggctgcccagaaacactcataagagaagagttcagaacatgtcaaggctttgtctagccatagtggagaatgccgtgacttactagcaatgtctgcccttggtaaaagagaaaataatagaaataggaagagtgacatagaggactgaaaggatggccactctcaggcttctcatccttgctcttagtgcccttcttggagactgggatcatgttcccaccttccattacgtggctgtagagtccatttccaaactattcatttgttccttcaatttcccattaattcctgcccatcctcctgactcagaaacttcatgcattctgttccctcagactggatgctttgctgaggatcccttctccaaagtgccccctgcaagaaggctctaccttatttactctaagaaacgacaccagtttgttgtatgttgtagcactcccctcttttgtgccatagaaattatataaatttgtaattattccttgatatgtttatttgtgtatttattaccccctgcaccaaatgctaaactcagtgagctcaagaaccgtgtctctctttttggctattccctcatactcagcacagatgcctggaaggcagtaggcatttgaaacgctggaatgcattcaagtttggggattccaacttaatcaaataaggttcctgacttcctacatctcatattctagtgaagaagaaagtcgattaagtaaattattatgatgcaatgagacaaaagcaatacaggcataagggaatattgctgcgtgggtagggtgacaggtgtagagatagcatcacagatgtaatggtaaggttgggttttgaagagtaagacttaaaaataaacctcaataaaatttctgtgtaagaaaagttaaacactgcaacaactgctctctatttgaatgttatgttctaccattgaagttttatttgtgaatcgaatgactagatattttaacatgtacctatagtagcatcctaaatgcattttaaaagaaatataaaggatactttgcctaccgagggcccacaattaggcttttcctttaaggatattcttagtcttaaccctttatcctgctttgtacttgatatatccccatttattctgatcgagtagcccagatggaagctttttgtccatttgcaaaggtcagtgggggttatgtgagcatgagtctgctgaaattttaagcaaaaaatggcccaagcatttcttatagtttggggacatgtagttatagtgaaataatttagataaatgaaactggacttgtcttttagatttaaaaacataatttggggataataaaggaaacatcattactagtctagcaagggatatttaaaataaaaggtggttttatgtacgctgctaactttcttacagcttcaatgataaattattagatattatgttcatcatatcgggaggtcacatataactttccagttgaagttttttagaaattggctggaattttttgttttgtttatttttttaatgttttcttctttctctctttttttttttttttttttttgagacagagtctcgccctgtcagccaggctggagtgcaatggcgcgatctcggctcactgcaatcttcgactcctgggttcatttgattctcctgcctcagcctcctgagtagctgggatcacaggcacctaccaccatgcccggctaatttttgtatttctaatagagtcggagtttcaccatgttggccaagctggtctcagactcctgacctcaggtgatccacctgccttggcctcccaaagtgctgggattgcaggcatgagccaccgtgcctagcctttaatgtttttataagttagaaaggaagagagggagggatgaatgaagaaagaataaagcaaaacatttccttaaatcacatttaaaataaggtggagtttaataaaatacaggaaggaaggctgaaagacaatagttattataagccaaaagcttttacaattatattatagcacttgagagagaagtagtgctttttgttggcccctatgatttccccaaaacatgttcattctccttgactcaatcatgttcaaaggagagtttccttgttaggttggtaaaacaggatcatatccaggcttaattggactctaaactgattgtagttctgtataaacctacacatcatgtatacatagaagcagaaacagtatttaaatccaatagatgctgcttactttaagatgaaagacatctaatgaattttaaagtggaaaaatttatgcaaagtcaactcctattgtatttgaaatacgggaggacattgatataaaatgcaacttgcaacttgtttaagataaaactaaaatagaagcaaggataactgcaagccatgacttgcaagatcaaatcagaacttttaagtcctctccttgaaagaataaagatcagttatgtgcctaatacttgttttgtaatcaggccacattttaccaaatctggcgagaaaagaaaattaaaaaaaaaaacaaaacaaaacattgccagttattctgagtcaggtacaaaactgtgccagagtggtaatcagggcttgatcctactattcaggaaagaataaaccagaatagtaactttctttcttttttagttagccaatacaaatggtaggaaatattgacttataaacttttgttcaactaagtgattctctagagaaggaaccaacaggatcagggtggaaagttaaatgaggacaaggttgggctaagtgagggaaagtaaggagctttccgagctaagacagttccaatgtgtgactgacaaactcactcatgagtatggggaggttcatttttcacatctgccagtatacaccatggtccattcaataaaaccagggtagaattgaccactatgtctagattaattataatctattattcatccattcactagggattgaaggccttgaaactttcagtgtggtatttaggtactcagaaaatctcccttgaatgaatggatgagccataagaaaatctgtttactaggagacacacagtggtattttctatttatttttttcattcaccatttcacaatttttaatatcgtttctgtaccagggctgtactgggcacagatacaatagtaaggtaccatgaaaactgccccccaccctgccccatctcttcattacattaggaaagaataatattagaaaacaaaaccaactagagagtatatcattacaattcggagttagtttatcttaaagattatggtgctcaaagttaccatgaagacattagaatgagtgtatatgagtatttgtatgtatctataggagggtataactgcatatatttttggaagagatttgacagaccatgctagtggagaacagatatagaggagagaagagcaggggtggagatgactcggttgttgtggtgcaggtgagacatgatctagtttaaatgaggacggtggcagggcaaggtgagatacttttcagttcagaaacatatttaggatgaaaatatcaatagaactagatgaagtttggattggtaggggaattttgagaaggactcctagatttttgcctcacatgatgtttacattatgccctgagaaaaaaaagaatattggaagatgacagtcttcccccaaacagaattatgttgcgaaaacaataatgggctaatcatccctcttcaaggttctcagtgaacactaacattttagaagttctgagaaactcagtaacatttaaatttgttcccttttggttcattgatcattaccaaaacttatttcatcttgcatcccttgccctcggcactaaccctagaacaaacatgaaaacacagttgatttggaaaactagaacatgattcatgttatgtccttagttagagggagcatttcatgtagtagaatgaaagagaaattgttaggaacaattaaatgattccttctacttgattccacaaaatcagtaagagttattgattatgccttaaatgtgtactatccacattgtacttatgttcactttatgactaattaaatgtaaaacaacattcactgaatgaaaattcagtttattgtaaagctgctaggctttttttttttgaaaaggaagtctatgtattaacatttacatcatagaaatatggcaaagctcaaagaataatgaaaaattaacctgaaatctcccaccctaagagaaacattgatagtattttaatatatattctttgtgacagtttctggtttattgcccctcaaggtctaaattcaccctttttacctgctctgtgaaaacagatctgagccttttacatagtatttcctttgccagctggcatgatattatggtttaccaacagatggcactggagagacattgcagaaggaaaggctttgatttctgtttcttatttttaaattattattattattattattattattattattattgagacagagtctcgctctgtcatccaggctggagtgcaatggtgagatcttggctcactgcaacctccgcctcctgggttcaagcaattctcctgcctcagcctcccaagtagcttggattacaggtgtgtgccaacacgcacggctaatttttgtatttttagtagagacagggtttcaccatgttggccagccatgttgaccaggctggtctcgaattcctgacctcaggtgatctacccacctcggactccctgattgctgggattccaggtgtgagccaccactcccagcctttgctttctgtttctaatgtgcttgcttggaagtctcccagaggcctctccagtgtccagctcacaaagctcggtgactttcccagcacccagctctgcaacacctgtgatttctccagcattcaaggttcctccagcacccagctgtctcagctctgaggtctctccctcggtgttctgctcttgcagtgcacacaactcccatagctggcttcagcagtagagggcagccagcagcttctcacaggtcccatcaagaggttctgtaatagagtgtctttggtaagacacctccccataaacagcttttcctggaagcctagagggtggttttccaataagttccaaagagcctatttctggatcccagttgtaccggtgtggcaccacagaaacttctgtgttatccaatgagccacagtcatgctctctccaactaggcctggatttcttcttagcctgagggtaacttgttattcctcatatctgctactcttctatttttttgagttctctttacttatcaccattcattctctcattactctaattcctggatgtacttaaaaattcttttttattaaattgtttatgctggagttgttatgtgatttttctctcctgattggacccaggatgataattgattagtcttctaatctttgtgtgtgttattttaatgtttaaaagaatcacaagtcccctttccacgacattctatgagtttctacattattattttaatggcagcctagtaatccatgatagtagtagatacttcatcatttgttccatcccttattattagacatataaaatgttttatttttattattagacatatatactgctttcaaattgtgaacaatgctcaggtgttcacccttggacctaaatctttgttgacatccataatgatttccttgcaattaactcttagtcatttggacattttagtcaatggcaaatgatgaacacactttgtaaagtgctttatgtaattccaggggaattttgaacatattatttaggggtataatgtaacatcagatagaagtataagaagaaagaaagtcacggtatttattctctcctgccaaactttcatagcaggaattcgaaaagtctctcctgtaacacaagaactgaaacaagatttgagaatgagccattaaatatcaattatcataaatcacttcttgctgctgctttgattaaatgttttccttgtgttttacaattgggaattccacctcatcagaagaatggaaaatgggaaaggatgaaatgatttcgtgtatcttggttattcttagaagcaagtgctttgagaaagaaaacaaattgttaacctcagcatcttaaacaaattgagtttggctgatttcctgtgcttagagaaaagatccccatagcttcatctggaaggcctcatccactggcccagttgttgttttcttgacatgaatgcatctagtataaataatctttaatattgagttaaacatttaaggatgtttcaggttaatttgaacaaatgaaggaatgatcctgattggtaaccattgaaaattctctcccacagggaaggaaccaaacagcctcagacactcttcctgaaagtggtcatcttaattcaacatttatgtctgtgatttgcttacaggggttttctgaatgagcttgtagaaacaccagtctttagtcagccactggaagatttgcaagaaatgctgtgctaatctcagaacaaggaggtgtaatttctattatctgttatcacaatgtaatcataaaaacaggcacgtggcaagcttgttgttgtggtcatgatcattatcatcaataacacactgccacttattgagcacttactatgtagactacatgcctcttgtctatgatttatttagttaatcctcacaagtctcttaataagtaaatactgatgacatcctcattttacagataaagatgctgagtggggaaaagttaagaaattggctatgatgacacaattacccatctgttcagccagtgcacaagttaggttgtctgactccaatgacaacagcctgagcaccttcattcaactcctttaggccttcattccaatagagtctctaagaaacaatggattatggattattatcaagtcaaatgattagattgttccccttcattcaccattttgaactgaaattgcttggatttctcaaatgtattatagtgctatatggtctggcattgttattatcaacttctttcccatcataaacacatttgacaaataaaattcacttgtatcatattctaccatgtggctttccagaagtattacacaaagtcaaagtctgtagtttttgcatagtgtcttccagtccagctgtaactccactgctctgtctcccactgatcctagagtcttcagttgaggagctacagtccggtaaaattgagaaagatgtgctggcttgacaaatatatcttgagcaccattaacgtgcaaaagtctggatcactgcggtaggcttagaggggatttaaaaataataagacagcttaagagagacaggcattgacaccattgacaaaatcacttcaatcttaaggcagtgaagaaaggagggaggtgaggagagggacgtgttagcagggcccattctcacatttcttaattggaattttgctttttaaaggtgagccacttctgggaaattctggaccatgaaggttttgttcagagcttaaaaagcctgacaaaaaaatgaaggagactggttgtaatggaggtagacaggtagaaaatcatgaagttgtgtcttatcaacaagggaaggtcaagctcacatctgaaccccaaaacttgggaaatccattgatattccttcttattataaaatgcctgttaaggcacttgctgtttatttcttagtaggcattgtggcagaaaatcaaattaattcagtgcataaactaacccctctcgatctcttgcttaaatgtataagcagaataccaactgctagagttttatatgtttcattttgattttttctgcacaagttatacaggatagcaaaatcacaagatgttcaacagaactcaataaatatttaatgcaacctttttttagatatgagaaaactccagctcagttaagaaaagttacttgatctatacatatagaaccaaaaaaacaaatctgttaaggctttaggctttagttgtaataagaaatatccagttgtactccctcccagttttgtgagtcatgtggtagtgattcacatcattatcaatcaataaatctgattcttcacatacagaatactttgtcttgacttcataggataacacctcctaccacctccaaacatgtgggtgagggaaaagataatcaaagattttaagtaaatctggattaaaaaaaaaaaacagttattcacattgttattttgggcacagaggaatagttgaatgccacatttaaatagaaagcatatatatttcacatttataaatctttagattctgtatgtgtcatgaaaaatgtaagttttagatagtgagatgtatgaaattaatttcaactctgtgtcaaaaagctccacagtaggcaattaatgcataaaacaccagggattgctgccctaaagcctccattgccagatgaaattacagacctcaaatcccatcattatcctggtatttattttttgtttgtgtggtctaggaaagatataatcttaaattgaatatttacctaatcagcaggctaaggatgttttctggtttctatccccttcaaatctagagcaaagtttctggctgtgagtgttaacatgttacccatattctaggctactactgcttactgttttcatttcatgatttacaaaatgataatattcatatgccacactggggtgaaccagagggggtttaaatgaagtttggtgaaaatcttattataccttttaaaattaaacaactataataagaatacaatatagggtatttggaaatatatgaaatatttaatttacatagcacttttgaaacgtttttaattttattatgtatttatttatttactttgagatggagtctccctctgccaccaggctggaatgcagtggcacaatcgtggctcactgcagactccgcctcccgggttcaagcgatactcctgcctcaacctcccaagtagctgggactacaggtgcgcaccaccatgcccagctaatttttatatttttagtagagatggggtttcaccatgttggccaggatggtctcgatctcttgacctcattatctgcccatctcggcctccgaaagtgctgggattacaggagtgaaccactgcgcccggcccgtttttaatttaagtgagaaatttgttcttactcaacaaacataagtttttctatcagatcttatgctttaactcacacctataattctggtcaatatgcttcaatagtgctattttccaatttttgatagtcatattcaataagaaactttttatcatttttacaaccattgagaaatttacaagttcattttttaaaagaacctacagtttcttctttctttcacacacataggcaattgaaataacttctgataatgtgtatcaaattaaattcaatccaagtttgtttttacaagtatgtcatagtaatgatggtgctctattttgtagaaggaacaaggctatatttgaacccccattttctatgtagcttggacatctatttaacagtcatatcatcttcatgtgaagatagagatatggaataaccacctaagttcttcctcacctactctaccctgcaatatgagttttcctagaaattcctgcagtcacttcttcatagtgagcactggcacacactgcagctggctgctgcagaaatcgatgtccacatgggttgaacgttgagcaaattatggtaaacccatgggtggagatgttgctcattgtgtttgccgcctgtggccacttaagcctccatcagtccctgcctctcttgagtcacctttccagaagactctggagttgctactcatggctggacgtcaatagctccagcattccaggtaaactagcctccccgcctgggaacccgaaaggccaagggagtcattatcttatgtgccacttacacacattagtttccaaactgtgtacctcagcagactggctagaaccctctgctttaggtatacgacttagaactgtcttgaagaacttttaaagtaataccaaaatggcaaacgtctctattttttaccctttctttatctacactgaacctgaagtctttgggagctgaaaacattgactttttatattgaatagatacttattctttgtcttttattcaaaacaatcagcaggaaggtaacaaactttggatgaaaaagtcaagttaggttggtgctttgccttagtcagaaaggtttatgaagagaaattgaggatgaagaacaaaatagatgagctttatctgctagatctaacctctaatcgtgtgacttaattccactatttgaaggattttcaactgatttagacaaagccacatttaaatacaggtcaaaaaggcattctaaagtcaaatggaaattatttggtttcgagtggtcttgatgtagaaataatagttttattctttgtatatttcagtctcttcattcattcattcatttgtacttgcattcttattttcattcatttaagtatcaattcatatattcatgaggcatttgttggtgtggtattgatctaggtgctgggctagataggtgaacaagtcattacctttactttggaggccctgtcagtcttgtgtggaatcctgtaggttatcacataactattgtaaaatttgacaagtaccgttttagtcgtatgaacagaatagaatatcaggaacaacaatttcattcagtcttgttatatatttgactatttagttgttcaacatgcaaaactttccaataaaggttgtaatattgaagggtaaatccaagtgttaatcacttttattttaagcatgttgtattatcaaatgctttggatagaagtcactataccttattgaatgtattttcagctcttttttttttattatccctccctaccttccccttctctgtaagtatggattttgtttttgtaaagtggcaatactgccataattactaccagtaaattgtgaggattaaaagatataatatatctaaagggcttatttttaacagctttttgaggtataattcacatgaaataaactgcatgtaattaaaatgcacaatataagttttgacttatgtgtaaatctgtaaaacccatcaccacaatatctgatgttcacaaaacttcctcctgtgtcttctttttgttaattaagcttccgtcagatttatttacatcttctgaaatgttattgaaaagagctcacatagtcactattggcttccattactcagcataataattttgagatttgtccatgttattgtctatattaatagtgtattccttttaagtgctaaattctattccattgtatagttcacaccacagtttgttccatatacttgttgatgggaatttaggttattgccagttaatttagctattaaaaaattaaagctactatgaatatttgtgtacaagcttttgtgtgggtgcctgcttttatttctcttcagtaaatacctggatggatcatatggtaagaatatgcttaactttttaagaaattgccaaactgttttccaaagcggttgtaccagtttacatttccataagcattgtatgagatgtccagttattctttatctccaacaaactgtgtcggcaatctgtttaaagtttagccattcgagtatgcatggagtgatatctcattgtgattttgatttgaattttctggtgatgaatgatttttattatatcattggattattttgccatctttatgcttttgataaagtgtctgttcaaatctttgtccactttttggtaagttggttccttattgtcaagtttttaaaatacttcatatattctagagacaagttctttatcagacacatacattgaagttgtttttcagctggcagcatatctttttgttttcttaccagagtctttcaaaaaactgaagttttcagttgtgataaagtctaatttatatatattttttcttttatggaccataaaagaaaaaatttttgtgtgttgtctaacaaatctttgcccaatattttcttctatgttttgatttagatgttttatagttttatacatttaggtctatagtctatttttcattaatttttctatacaatgtgtgttatgaattaaagttgattatttgcatatgaaaatccaattatttcagcaccaacatctccattgaattgcctttgttacaaatctgatgccaaaaaaataaaatctgttgccagtgtatgtataggtcaatttatagattctattctgcttcatttgtatatctgtttatctttatgccgatatcctactttgtcaattagtgtagccttataacacatattgaagttgagtaatatggatcatttagctttgttctttaaggttatgttgcctattctaaatatttgcatgtccacattcgttttagacttagcttgtcaattttaacaaaatcacctgttgggttatgtttggggtttcattgaatgtattcatcaatttgagcaaaattgtcttctaaacaattctgagcttactgattaatgaaaaaggtaactcagtttatttaggtaatttttaatttcctcagcaatgtttgttcattaagtgtacgggtgttgtacatcttttgttgctttttatatctaaatattttaaatttctgatgctataggaaatgatatttttgaaaactattttcaattctttatttctagcatatagaaatattgtacatttggttttgtatactgaccttttattttgcaattctcataaactcattttttagttttataaactttttttgtgaattccacctgattttctatatatgtgaccataccgtcttcaaataaagacaaattaatctctgtttttcatttgcatggttttcttttttcttttagtctcattgcatgggctagaatctctagtacaagattgaatagaagtggcaagaaaagatattcttgtattgttcctcatcttagagaaaagactttcaatctttcattactaagtatgttgttaaccgtagattttttcatagataccctttatgaggttgaggaagttccccttttctcctggttttctcatagttttttatcaggaatggatgttggttttaactgatttttctgcatctatggagattacttatatggcttttctttttaaagtttgtcaatatgttaaattatcttgattgctttccaaatgctgagccagccttacatttttaggatgaacctacttggtcatgacaaatgatcatttttatatgttgttggatttgatttccttaaattttgttgagtctttgcatatgtattcctgagaggtattgttctgtagttttcttttcttataatgcatttttccccgtacttttgctatctggataaatttagccatgtggaatgagctgggaaggatttgccctcctcacgttttcgaacttcatgttgaattgatattatttctgtcttacttatttggtagaatttactagtaaatatatctggacctggagtttttattgtgagaaggttttgcatcacaagttcattttcagcctactcaggttctctatttattaagtgagcccttttaacatgtctttgatctaaaatatcaatttcatggcacaaagtgttcataaatttctttattatccttttaatatctgtagaatctatagttatgttgcctctctcatttctgatactggtaatttgtgactttctcttccttgtttttcttgatcagtctgactagaattttttttttatttttttaaattatactttaagttttagggtacatgtgcacaatgtgcaggtttgttacatatgtatacatgtgccatgttggtgtgatgcacccattaactcgtcatttagcattagttatatctcctaatgctgtccctcccgcctccccccaccccacaacagtccccagtgtgtgatgttccccttcctgtgtccatgtgttctcattgttcaattcccatctatgagtgagaacatgcaatgtttggttttttgtccttgtgatagtttgctgagaatgatggtttccagcttcattcatgcccctacaaaggacacgaactcatcattttttatggctgcatagtattccatggtgtatatgtgccacattttcttaatccagtctatcattgttggacatttcagttggttccaagtctttgctcttgtgaatagtgccgcaataaacatacatgtgcatgtgtctttatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattctaaccggtgtgagatggtacctcattgtggttttgatttgcatttctctgatggccagtgatggtgagcattttttcatgtgttttttggctgcataaatgtcttcttttgagaagtgtctgttcatatccttcacccactttttggtggggttgtttttttcttgtaaatttgtttgagttcattgtagattctggatattagccctttgtcagatgagtaggttgcgaaaattttctcccgttttgtaggttgcctgttcactatgacagtgatttcttttgctgtgcagaagctctttagtttaattagatcccatttgtcaattttgtcttttgttgccattgcttttggtgttttagacatgaagtacttgcccatgcctatgtcctgaatcatattgcctagctttccttctagggtttttatggttttaggtctaacatttaagtctttaatccatcttgaattaatttttgtataaggtgtaaggaagggatccagtttcagctttctacatatggctagccagttttcccagcaccatttattaaacagggaatcctttccccatttcttgtttttgtcaggtttgtcaaagatcagatagttgtagatatttggcattatttctgagggctctgttatgttccattggtctatatctctgttttggtaccagtaccatgctgttttggttactgtagccctgtagtatagtttgaagtcaggtagcgtgatgcttccagctttgttcttttggcttaggattgacatggcaatgcaggctcttttttggttccatatgaactttaaagtagttttttccaattctgtgaagaaattcattggtagcttgatggggatggcattgaatctataaattaccttgggcagtatggccattttcatgatattgattcttcctacccatgagcatggaatgttcttccatttgtttatatcctcttttatttcattgagcagtggtttgtagttctaggtccttcacatcccttgtaagttggaatcctatgtattttattctctttgaagcaattgtgaatgggagttcactcatgatttggctctctgtttgtctgttattgctgtataagaaagcttgtgatttttgcacattgattttgtatcctgagactttgctgaagttgcttatcagcttaaggagattttgggctgagaggatggggttttctagatatacaatcatgtcatctgcaaacagggagaatttgacttcttcttttcctaattgaatgccctttatttccttatcctgcctgattgccctggccagaacttccaacactatgttgaatacgagtggtgagagagggcatccctgtcttgtgccagttttcaaaaggaatgcttccagtttttgtccattcagtatgatattggctgtgggtttgtcgtagatagctcttattattttgagctatgtcccatcaatacctaatttattgagagtttttagcatgaagggttgttgaattttgtcaaacgccttttctgcgtttattgagataataatgtggtttttgtctttggttctgtttatatgctggattacgtttattgattttcatacgttgaaccagccttgcatcccagggatgaggcccacttgatcatggtggataagctttttgatgtgctgctggattcggtttgccagtattttattgaggatttttgcatcaatgttcgtcaaggatattggtctaaaattctctcttttttgttatgtctctgccaggctttggcattaggatgatgctggcctcataaaatgagttagggaggattccctctttttctattgattggaatggtttcagaaggaatggtaccagctcctccttgtacctctggtagaattcgactgtgaatccatctggtcctggactttttttggttggtaagctattaattattgcctcaatttcagagcctgttattggtctattcagagattcaacttcttcctggtttagtcttgggagagtgtatgtgtcgaggaatttatgcatttcttctagattttctagtttatttgtgtagaggtgtttatagtgttctctgatggtagtctgtatttctgtgagattggtggtgatatcccctttatcattttttattgcatcgatttgattcttctctcttttcttctttattagtcttgctagcagtctatcaattttgttgatcttttcaaaaaaccagctcctggattcattgatttttttgaagggtttattgtgtctctatttccttcagttctgctctgattttagttatttcttgccttcttgtagcctttgaatgtgtttgctgttgcttctctagttcttttaattgtgatgttagggtgtcaattttagatctttctgctttctcttgtgggcatttagtgctgtaaatttccctctacacactgctttgaatgtgtcccagagattctggtatgttgtgtctttgttctcattggtttcaaagaacatctttatttctgccttcattttgttatgtacccagtagtcattcaggagctggttgttcagttcccatgtagctgagcggttttgagtgagtttcttaatcctgagttctagtttgattgcactgtggtctgagagacagtttgttataatttctgttcttttacatttgctgaggagtgctttacttccacctatgaggtcaattttggaataggtgtggtgtggttctgagaagaatgtatattctgttgatttggggtggagagttctgtagatgtctattaggtccgcttggtgcagagctgagttcaattcctgtatatccttgttaactttctgtcttgttgacctgtctaatattgacagtgcagtgttaaagtctcccattattattgtgtgggtgtctaagtctctttgtaggtcactaaggacttgctttatgaatctgggtgctcctgtattgggtgcatatatatttaggatagttagttcttcttgttgaattgatccctttaccattatgtaatggccttctttgtgtgttttgatctttgttggtttaaagtctgttttatccaagactaagattgcaacccctgcctttttgtgttttccatttgcttggtagatcttcctccatccttttgttttgagcttatgtgtgtctctgcatgtgagatgggtttcctgaatacagcacactgatgggtcttgactctttatccaatttgccagtctgtgtcttttaattggagcatttagcccatttacatttaaggttagtattgttatgtgtgaattttatcctatcattatgatgttagctggttattttgctcattagttgatgcagtttattcctagcctcgatggtctttacaatttggcatgtttttgcagtggctggtaccggttgttcctttccatgtttaatgcttccttcaggagctcttttagagcaggcctggtggtgacaaaatctctcagcatttgcttgtctgtaaagtattttatttttccttcatttatgaagcttagtttggctgaatatgaaattctgggttgaaaattcttttctttaggaatattgaatattggcccccactctcttctggcttgtagagtttctgctgagagatctgctgttagtctgatgggcttctctttgtgggtaacccgacctttctctctggttgcccttaacattttttccttcatttcaactttggtgaatctgacaattatgtgtcttggagttgctcttctcgaggagtatctttgtggcattctctgtatttcctgaatctgaatgttggcctgacttgctagattggggaagttctcctggataatatcctgcagagtgttttccaacttggttccattctccctgtcactttcaggtacaccaatcagacgtagatttggtcttttcacatagtcccatatttcttggaggctttgtttgtttcgttttattcttttttctctaaacttcttttcacacttcattgtattcatttgatcttccatctctgataccctttcttcccgttgatcacatcagttactgaggattgtgcatttgtcatgtagttcttgtgccgtgcttttcagctccatcagttcctttaacgacttctctgcattggttattctagttatccattcgtctaattttttttcaaagtttttaatttctttgccgttggttcgaacttccttctttagctcggagtagtttgatcttctgaagccttcctctctcaactcatcaaagtcattctccatctagctatttcctttgctggtgaggagctgcattcctttggaggaggagaggcactctgatttttagagtttccagtttttctgctctgttttttccccatctttgtggtttttatctacctttggtctttgatgatggtgatgtacagatgggcttttggtgtagatgtcctttctgtttgttagttttccttctaatagtcaggaccctcagctgcaggtctgttggagtttactggaggtccactccagaccctgtttgcctgggtatcagcagcagtggctgcagaacagtggatattggtgaactgcaaatgctgctacctgatcgttcctccggaaattttgtctcagaggagtacccggccgtgtgaggtgtcagtacgcccctactggggggtgcctcccagttaggctgctggggggtcagggacccgcttgaggagccagtctgcccgttctcagatctccagctgcatgctgggagaaccactgctctcttcaaaactgtcagacagggacatttaagtctgcagaggttattgctgtcttttgtttgtctgtgccctgcccccagaggtggagcctacagaggcaggcaggcctccttgagctgtggtgggctccacccagttcaagcttcagggccgctttgtttacctactcaagcctgagcaatggcaggcgcccctcccccagccttgctgctgccttgcagtttgatctcagactgctgtgctagcagtgagcgaggctccatgggcgtaggaccctctgagccaggtgtgggatataatctcccagtgtgccgtttgataagccctctggaaaagtgcagtattagggtgagagtgacccgattttccaggtgcagtctgtcacccctttctttgactaggaaagggaattccctgaccccttgcgcttcccgggtgaggtgatgcctctccctgcttcggctcacgcacagtgcgctgcacccactgtccggcactccccagtgagatgaacccagtacctcagttgtaaatgcagaaatcacccatcttctgcgtcgctcacactggaagctgtagactggagctgttcctattcggccatcttggctccacccccagtctgactagaagtttacgaatgttattaatttttcaaagaatcagctttgtgcctgaattattttcctcctttttaaaatttttatactatcatttcaggctgatttttattatttttttcttcagcttactttgggtatagttttctctttttattctgatcttttagtgtgaaatctggggtaattgatttgaggtctttcttcttttttctaatataggcatttaatgctataaatttccccttaagtactactttagtggtattctacaaatactgacgtgttgtgttttcattaacatttagtttaaaacagttttaatttcccttgtgatttcttctttgattcctaggttattttgcagtacattatttagtttacaagtatttgggatatttctagagatctttctgttattgatttctaattagcagaacttgcatcttttaaggtttactgaggcttgttttatggtccagaacatgccctatcttggtaaatgttccaagtcccctttcagaaaaaaatatatgtgtgttccattattgttcagtggaaggttctataaatgtcaattaggtcaagttagttgatagtggggtaaaagtccagtgtacccttactcacttttctatctacttattctcttaattattgtgcttcatatattttgtagctctgttttttgcctagagattgagaactattatgtcctcttgataaattgtcccctttatcattatgaaatgattttctttatccctggtagtattttgttttctgaaatccactttgcctgatttaatgtaaccacttacctttttttttaactggtgattattgatattgtaaggtttacatctatcatcttgctatttgttttctatttgtttcagatttcaaatattcttgagctttatttgaggatgcagtgatattacttgggaaacagtttcattcattctggtgttccttccaagggtcgttaggaaggaacagaatcatatttagtctaaggttattccctacaacctaggccagacccttccaagtcctcaacccactatcccatgaattatgaggttttcctgtctgggtagtggaaacaggcatgatttcagggcctgtgtgcgcctattacctctaaaccttgttttttctgatttctttgcatgcatgcaccaaacagcactctgctaaatgcttgagggagaaaccctttgtggatctctggaggtctctttgtgtgcagctctattatttctggtattctgtcctattaattctggctgcagtaatctctccagttgcctctgtgactcttcaactgaagaagtcttttgggctctgtcttatttcccctcctgcattttggcctaaaatctctatgaatgcgataagctggggcagtcataggactcattttgtttgtttcccatctctcaggggaaaactgatccttaatgatctaatttcttaaaaatttgtttcatgtatttgtttgcttattgttttgctttttgttttgttttgtttttgagcgtttcaggtaagaaggtaaatccagcccctattactctaatttagctagaatagggaatacaaaaggatgcaaaattgaattaatagtaccatatgactttctttcctatattagtttgttaccaacatcctcgtggttaaaatgaaactttaggtttccctgtggatttttctaatgtagtcatgaagcaaaattccaacgacaatggatagttgactgcacaatacaacaactgttcttaatgaaataaagaagattcacattcctacattatattagtgagggcaatatgagctggtgtaacaacagttctctatattttagtgactgaacgtgaagaaaagtttcatttcttgttcacattggagtagaacatgatgtttccaatgtgctgcagactttttttgatgaaataacttggggacccagattctttcatcccctgtctctgtcatttcccagtgcctcagaattttttgttttgtttttgttttgaatacagttagaagacagagaagagggtgcagaagccacattgttctccatcacctaaacccagatatgatactcattacttcaactcacatgccttggcaagatctagatgcaggaggttctggcaactgttgccctgacaagccaacatatagcaacagctgtaccccaaaaaggcaagcaagctctctgctgaattgctcaccatctcttgacaaacataaagaactctttggtcttttaaccccttctaaaatatatgcttcatttttccccccatgcctccaactctgatgctgtgcagtagcctcaatgtctctttcatccactcacgctcttaagggagccttcttcttttgtataactaaaaaagcacactaggtttcttttcatagcacaatccccacatttgtatcaaaatcacacatcacatctcaccaggtgattgctgaataatctcagggactgtggagtccatacaaaaggaagccatgattagcttcaaagcatttgtgaagtagacctgcttggctccctttcagccaggtaggctagtacctgttggacttctttgggattagtagactgctccctccagtgacataaaaaaatcataagccagatagggaagttatgagaattaaatgagataattcatgtgaggtgctaaacatggtcccaggcacatatagaaagcaattcataatcaaagctcttgtaattattagttaatggtaggattttaaggaaatatttaagtgccctccttgtggatggcgataatatattgaaaaagttaagctcgtattgttttcttcaacaaaaaaaattggtatattatgtatatataaaacaaatatgcatagaatgtaccccacaaatacttacaaacataatatatgcatatttgttctatgcatagaacgtgtaatgatcaagtcaggatattcagggtatacatcactgaagtatttatcctaccagtgtgttgtgtacatgtcaagtcctttcttctagctattttgaaagatataataccttgttgttaactatagtcaccctactcttctatcaaacattcaaactttttctgcaattaacttatgttgtttttaactatagtcaccctactcttctattaaccagtagaacttatgctgcaatgaaagcataataagctttcattatgtgctagctgtctgattcttcaagaaaatgggttttccccctcaccttctgacatatccctaaaataaggtctgaacacctgtaactgaatccccttataagttttcaccacccagaaagaggcagcaaagaataccaataaacaactttggttctgaattctgaaatcaaggcccagcttgaattacttactattgattacttactagccctgtgagctccaattcagaattcaaggtccaggtctattacttactatctgtgtgagctctagcaacctctttgcaaatctgtgaaatttagtcagtgacattccttcatagaaacattatcaatggagagagataatatatgtaaagtacttagcagagaagatggtgtatagtaagtgcctaataaatgttattataattaatatgattataaagaagaggcagtaaaatgtagtaggtagaatattgagattggagggagatgactcaaatttatgtctaggttttgttgcttttaactgctgaggctcagtattctcaccaataaagtggggttaataatattcccctccaggggttgaaggagtgattgtattataaagtatgtgaaagtaaataaaaccttgcctcaaacccataaaatcttaattgcgtgtaaaaattctttacttcatttatagtatctgtcaccctaggcaagttgacctttctttcacataaattatgtcttttatttggccttctgtagttagtatcaaaacaagacaaaacaaaacaagattgtaaacaattataaagaataatactgcatacagcatcattatttaagaatagaatgacggccggggctggtggcttacgcctgtaatcccagcactttgggaggccgatgcgggcagatcacctgagaccaggagctccagaccagcctggtccaacacggtgaagccccgtctctactaaaaatacaaaaattagctgggcatggtggtgggagcctgtaatcccagctactcaggagactgaggcaggagaatctcttgaacctggaagttagaggttgcagtgagccgagatcacaccactgcactccagcctgggtgacagagccaggctccatcaaaaaaaaaaagaagaatagaatgacagggctgggcacagtgactcacgcctgtaatcctagaactttaggaggctgagatgggcagattgtgaggtcaggagtttgagaccagcgtggccaacatggtgacaccccttctctactaaaaatacaaaattttttgggtgtcatggcacatggctgtaatcccagccacttgggaggctgaggcacgagaatcacatgaacccttaaggcagagattgcaatgagtcgagatcatgccactgcactccagattggacgacacagtgagactctatctcaaaaaaaaaaaaaatagaatgacattcttttcctgaaagaatgtgaccgttgaaattatgaagaaagaccactgctggatttgtgcagtgacatttctgaaacacattgtatatggcataaattgctttaatcacaaaggagagaaatattaatatctgtgctcctgtaagctctaccccaagttaattttaaagttattagtaaagacaaattccattgggttattgagtgccttgctagagaatctcaatacaaaggtttagcaaagtatacccataaattcagcaacacatacaactagcttattgcaattcaggcgggaaaataactctctaaggcagggatcacgcatgagttttgccgtatgggccaactctcatgcattgcattgtagtcggaaagattctgaggtcaagtctgaagtcaacagtcgaaaggggttctgatctacaaataatattctactatgggtgttagtggggagagatgacagtgtgctgcctgttcaccctccctctgctctgatgtggtttctaattcacattagaggattaatcattacagagaagccctgctcctctcagacctttctctctaagactttgggcaaacgccggcaccatgtttttcattcatttttttcttttctcttattattgtatgagaagaaaaccagagagatttctgtggcatattttccacactctctcttctgttctcctagggagatgcccttctatcctgtctcagtttcccaatcctaaacgtccttcaaaagtaagttcaagctcatcttttctgtgcatgtttacctgctcagtactgctcacatgaatctctcgcaactccaaacgcctgaaaaaaggtttatatctcacaattgagtgttccgttgtagaatgtctcttatatatctttagagtgttactatgtcttgttcaagtagcacaggggccgggaaatacaatttgaagggagaggctaatctttaaaggcagtcattgattgtattttaaattacaatttacaaccccatggtaatgaacacataggctaaacaaatataaactcaattaaaataacatgcaatgatactttacaaaaatgctgctgagaagaacatcgagtttacatcatgctgaatatctaaaaatagctagatgactatttaaccttctatttatatgtatagatatagcgttataattttcccactagaatttaattttatattatagaccctttcagtgccttcagtgaccctatgagtgtctttttaagattgcctttggaccctggtgtcgttttgggactgccactaagtgcaatcctaaaattttccataaagattcactcttgcttttatttcacaaggtgtttccatttagttaaaattaatctctctgttgaaggaatttctcccaggactcagagctttccattcttgattaaggtgtctcacttgtcagcttgctgagggcagggatctcagagcatagctcaatggcagccgaagccccggtgtgatgtgtggcattgcttcattccagaacgagtgttccctgagggctgcatttgacatctgcaaaacgctccctctgcatttgcactctcaacactgacacaaaaatgtaagccttgttttgtagtgtcccataggcagcacatcttgcataaaatattttaaactgtatttcaccttcgtgtaggtttgttttactggtttctgcatatgtcccaagttaaagcattgctgcagaccaatttcattcccaccccgatttaccctcctctcatttgcacattgtaacatagcaaggggacacctttcctcatatccaccatcagcccatcccctactgctctattgtccaagatatttaccagcacaagtaacaccttcaatgtttcatccattcattcaatgtaataagtggtgagaaaacacagtgaaaaagagggatatatttctggtcgacttggagttgacaatccagaggaaagacattatataaacaggtattccactaactctaaaagacacttggatgcattttacaaagataaagtacagactgttataatataacgtagaatggcaaacaggagctcacctattttggaagcaggtgatcaggggaacacagaaggatgttttaaataactctgttgaggtaaaatttacatgtaatacacggcatacatgtacacacactatttcattatgtgtatatatgtgtgtgtgtgtgtgtgtatatatatatacccactagccatcatcgtaatcaaaacatcaaatttaccacccccaaagttttcttgtgcccctatgcaatctttgttactctctatatattagtttacatttcctagaattttataaaaatggtatcaggcttttttttttttggaagagtctggtttattttactcagcataatggtttgagatacatctgtgctattttgtgttatcaatagtttactcttcttattggttgactaattgataaattatttacttttttgttgctgaatagtaatcttctgtgagggtgtactacaatttatttatctgttcacctgctgatggacatttgagaaattttcaggcttgtcttttgtaaataaagctgttgcaaatatttgtctacaagtatttgtgtggatgttattctttcattttccctgggtaaatatctaggagtggaatttctgggacataatttcattttctaagacatttggtcattgaataaatggcagtgacggtggtctagaccttacataaccgatgtctgacatgtatctgagagttgaagctgagttaaactaaatacaaaaaaactttcctaagaactaatatggatgttaccaatttcataccctaaaatccatgactttggattataagagagtccttctagctctcattcaaaaatctatttgatacctactttatacagttcaaataaatccaggtaccaagtttctcatactagagcatattagaagcagaaaatccagtggttgaagagaagaattaatgcagataagtgaaagcatataccacagcaaaaaaagtgaaaagattgaaaaacataaaattataactcaaaacccataatcaaaatggtactttaaggccatgatgtccaggggcatatggccctgtaggcgtcatttgattaaagtggaggaaatttttgatggtgaaaattaaaatgctaatctgaaagtgatagctatgcttgattgtgtaatatgtggcagaattaaggctaagctctctctacacatgatctcatttcattcacataatgaccctatgaagtaggtattgatacattttacagaggaagaaaggaaagcttagagaagttaagtacctttgctttggttgtatggctcatggccatgactctagcctgcctactctaagtaatcaagaaaagattaaattatgttatttttacctatgtaaaaataataataaattttaaaagaattccatcaaaactagattttttttccttcaaatttggaattcttcaggaagatggttaaggtatgtaaaatagcagttaaagtagaaacatccattccctaatcatggaaaataaatgaagtttttctataaatgctttctaataattacattaccctttgtgatgctctgtgaggctatgaaaagactctaggaaactgggcttcctgaaaagtggcaagagtttaatgctaatactagacaatatattaccccatctgacctcattaagggttgcagttaccatgtttagttacaaagcacatatatccctcaaatgagtccacagttttttaaaataggaagtcccagacatgtgatcgatcaccagattcatttagaatccatttatctttatgacaatatgtattatggatcatcagcccataatcatgcagactctattaatgctcattgtccgtatggtgattttaaaatgtggtgtctctactgggaggttagtttttttcacacttgtgagtaacaaatggaaactcatggagaggtatggtttctctctgtctcttggactcttatctgaaggtgtttctttctgtagcaccagaaaagaggctgaacatctaaaaactggaggaggtcagactaatagaagattagatttaggaagtttctgcttatatcaataggtcctccaaaccaataacaactataatcctaaacatactttgcttaaagactaattctagtgttaaatcaggcaaacatcaactaaccagacctttcttttaagggaagcttccagccccagtgtgtatcccaggcaatgactcaagctgagccacccccaatccattcccctgctcttcccgacctctttccagtgtgccttcttctttgtatttcactgttttggatttaagaaatttgcaaagaattctttgtggtcctgataaagattttccagctctcttttccagctatgacatcactttagcacctttgaagcccactaatcaatgtatataaccaatgatcaccaacccccaacccaatccaaatcaacatctctccacacttcctatgcttctgacactaatttatctcccaccaaaatactaccagattaatcccatcatgcctttattcccattttactctgtaaccaccaaaaaatccaagcatcccaggattttaaatacccagaatttatccctataacccgttatatcccttaactaacataatcttccatttctttccaattcctcactctccaaaacattttcaatgtattccctggaacatgcagtctgtcattagcaaaattcccaatctccaatattttctcttattgttttcttcctcttctgacttgaatagaaaattgacttcccttgatgacccaggttcccttattttcccctaagaggagaatgcctttttctgctccttctacctatggtggggcctgggggttggatgtcattctctttctctcttattgctgtttctcagacatttctgattcaaaaaactcactgtattaaaaacacaggccaacaaaatgtactatcctggttgtcatagttgtctgctaaattttactcatttctccttattttctgaatatttttgcttgcagccttctgtttttctctcactatttttgtccttatttctggtgatttcaaaatttacactgatcgtttgcccaaaatcccagtctctctcacttccttgacctgtgtacatatgagatcttctcttccacctgatttcagccactcattcctttggaaatatcctataacttattatcagtaagagtgaaatttgcgaaatctcaatcactagcatcttgtgttctcacagccacctccttctcttcataatatcacgctaaagataccagtctgacaatttgcaggcccctttcagatctctgaaaaccctgtcaattccaccttacgcagtttaactgctactcttcttgtcataatcattcccttgctcataccttcaactcctttgcctcttctccatttgttgactttcctggcaaaccctctcataactctccacctattagactgctgaattgaggaggtagaatatggcttgagaaaaatgcacaagcagtactgactggtcattcctgagtgtctccatggacctttacaccaaccagaaattctactccacaccctccatcaatcgcactttctcctctccacttaaccattcatcctatctgtcttctttttacttccattgattctacttatttcatttaaaaatagcatagacacaatcaaaagaaaacgccttaccttcctacaaccaaatctactggcccagctgcattttcccatggataatacctccttgttcttaactagggcaaaaccatccactcatgtcctgtagaccctcccttctgtcccactggagccctgtcctcatgcagttatttcttcagttttctgtatgctcagcatatggatctgtactagattatccctcctgaggtataaacatactacactacaccatcccatctaaaaaaaaataaaataaactaactacaaacttcctacagccagggttccatatctcttttcttcctttttagaaaaactccttgaaagaaatagtccaaactacttcaacttccagtttttccttaattcactgcaactgaggtttcatctccacatcttccatcttgctaaattttatggtacgtcctcattcattaccttatgcatacttttgataccatatgagctagatctcccttagcatttactttgctgtattgtacttgtttgtctactcccacctaaatttaggaaacgtgaagactatcatttttgtccccgcacttgcatagccttgcacaatcctggtatacagctgaataattttttgtcgaataaatgcatgacaaaattaatcatggttagtgatatctgaggaaattatatctactgacactagagctatgaattatatctactgacactagaaatatagcaaagtgaagaaagctaagcaggaaacagtatgttagaatcagtcaaaaggagaaaaaaaggtggcccacatacaaaatgagaaaggaaaactcactagcactacaaagataaaacctgaggaacatgaatataatgagattttcttcaacagtcaatgaggacaataatgatatgaaaataatgaataatgatgacatatacttattcctatcagtgacacaaataatgcaggtgagaagtggttaaacatgacaaggttcagttagtgtaagtagtttgttaaggtcacacaactagtagtgccaagagtgggattcaaacccagaactgactaaaagtcttgctcttaactacaatgctacattgcagtgtgaattttaccaccaaagcagtgaaggagggggacagttccaggtttcatcaagaagactaatagcccaataggagaaaagtggagataattttttcttaaaaaagaaaaggaacaaatgctgtaatcatgttacatttcaagttttaagctgtttacttgtctctggctatcatcaatcatgaagtgattgtgaggaagtatacttcaaggttaaatgcaaggggaaactgccttcatttctggaaaactgccaaagggcccatgtatagttcatttctctgcagtgtgtaattgcagcttttataaataagattaaaaaagagccttggtggtctatggtaacccttattttctttggagatgttttccaggtggccagtgttctgcaaagtgggtataactgctgcttcagcataaacacaaagctctgcaattttgccaggagagaagtaaattatttgccaaaatagaaccatgtggaaaactcagaagttttaggttctgaagaacttttatgggctgacattttgcattctttagctcagcaaccccaaatatctactatataattaagaacaacatccgagtaatactactgtcagcatctggatgtttatggagctctatcatgcacaaagatgtatagattactgcataaaaaatatatctctgctcatgatgtaaaccaacactaactgaagaagagaatgcactaataacctgggcatggcggtgcaatctgtagtcccagcaactttgggggctgaaacaggagaattgcttgagcccaggagtttcaggttacagtgagccctccagcctgggtgacagagccagagcttgcctctaactaaataaaggaaattttatcccaatacatatcattcattccaaaatgtgtgtatatgtttagcatttttaaaatcatggtacagtttacaatgaatgtgggtcatagtttaattggtaacattttattcctttcttatgtaaaatagtggtgtgacttacatgaatggcatcctagcttcagagatttatacacaaatattaaggatactctcagtatgagtgagaaatatatgcttatttttttcgtctccactctgcacatcagatttgccatgctgaagttctgttggagttttctctacttgataaaagcttgtttttgacactttaatgccttcaagctactgccttcatttcaccaacttaatttccatacaagaccatctacatttgctgcctccatattctcaccactgattcaccaccatccaccacccctatttccttactcaatgcttaattgaaattgttattttgaagatcagcaatagccccttaatcaacaaatttaaaggcctcttgatagcttttgacgctgttaaatatctctcctgtctcagtcagcggggctgctatgacaaagtactatggactgggtggcttataaacaacagaaattttctcacagttctgtagtctagaagtcccagattagactgccaatctggttggggttctggtgagggcccttttctgagttgcaaactgtgaacttatcattgtatcctcacttggtggaaagagagttagttagggagctctctggggtcccttttatgagggcactaatcccattcatgaggattacgcattgtgtaaggacttaaacagtaagtccgtaacatccctcctcttcaaacttcttgccccccatggtgacttgtcctacttctcagacatatccagtcccttctttgctcactctacttcttccacatgccttcataatataaacgtggtttaagattcagccttcaattctttacacttcccccagaaatcaacaagtctcccatctgcaattatagtctccatgtatgtaaataatcctaaaaggttaatttctatcagtttcctctcctcaaagatagtttctctcagatgaccatccattttgacatatttgcaattttttatttctgctgtcacatcagcagaaaaccaaactcatgattgttcttttgtaccagctgcccctccagatttcttggtatctgacagcaatgccgttagcgttctccctgtcttctgtgttcaatatctcagtgtcactttcacttgtctctttttttctgtcccttgaatttatgtttgataattgactgggtgctttcttccaaatgtctattttatctggccttcattttctgctttctttgccaccactctggcccagatccatgcttctgaccaattaaccattgtgggaaatgtgggtaccagggaagcagcaagtaaaggtcaagagctgggtgacatcatgctgcttctctggtactcagaaataaatgatgagcaaaaagaccctaggtgggagagagcctgccacttccccctgaagaggaactgatggaaaactaatgcagctgaagcacagagaggacagagaaaagttgttcaagaacaatccagtcttctgtgtcagatgacatttgcttaacaatgttaccttctctcctttcatttttcctcttatctttttattttttatttttattttttggagacagagttttgctctgtcacccaggctggagtgcagtgatgtgatcgtggctcactgcagcctcaacctcccaggctcaagcaatcctcccgtcttagcctccccagtagctgggacttgtggaactataggcatgtgccaccatgcccggctaatttttttatgtttttatttttgtagagatgggggtctcactatgttgcccaggctggtcttgcatttctggactcaagagatcttcctgccacagcctcccaaagtgttgggattacaggtgtgagccaccatacctggcctctcctttcatcttattggcaggcacttcctgcctgcacctgataggtcaggtagacaatgtaacatttattttaaaattaaaatcttaggttgttcttaattgtctccaactcaatttccgcctacagatgagtaaatgacttttcaatgctctctggggagtaaatgagcaaggttctgctcgcatccatctgagtggtgctattgaggggtctgctgattacagataggcaggagtaggaagttcagcaacctctcagcagttccacaaacaaggcacactcaagttgagaaatatccacaccaaaaagaaacggtgttttggtcatccctgtcaccaacaccctatcctttgtgccaaggtgatctgaaagattttcagatctggagtggataattactttgcaggaatgtttcagaaggaatgcacatatcacgagtgctatacgaaatgcccttggggctctctcccagcccaggtccttccgatgttaacaaagaatttactgtgactccatcagtatgagctagattcatggaattttttttatacttccagaatttatgtattttggtggcatcgttttaatcttcttccttatcagaccacataattagtgtaggcaggaggtgaaagagttgtgacaatgtaatactccttcacatttggttgttctcttttggagatcaaaacagaataatcaagtaggaggagaaaaatgtaaggatgcaaggttggactagtacttctgagatcttctaagctgaggattttctggggtctccagctaataaacagaagctgttatatttttgcagtttatatttcttgcaatgaatacatattcttagagagcagaaacagtgtttaccaaaaggtgaacttccctaagattgcccattaactctcattcaggcatgaattcgtataatcatttccttgtcttcttatacttaccttgcaaataaactttaaaagatggaaaggcctatgtttaatgtatatgatgaatcagtgtatctattagaaagttccaaatgttgccataatgaaaaataggtcaaagaggatggtggcttaaagtcagatataaaaactttggcaataaatgactagtaaaacaaaagagtctctgtaattgctaataaactcaatttattgagcccagatgtggtggtaagagcaggagttttggagcagatatctgggagtataaatcttggtcctaccatttataatgtatgtgatctttggccatgatgaggcttaacctctttcaccttcaggtatctctcctataagggggaataataataatatcttacaaaataatgatgaagattagagttgattaaataatatcaggtatgtgactctattatagcacagtgactgctgaagtattttattgactttcaaactcctggcctcaagtgatcctcccacctcagtattttattgactttcaaccagtgttggtaaccattatggaatttgctttgagttgccaaactatagtaaggccttaataagacttcctttttttatttttatttatttttattttttggagacagagtctggctctgccacccaggctggaatgcattgacacaatcacagctcactcactgcagccacaaactcctgggcacaggtgatcttcccagctcagcctccagagcagctgggactataggcatgccccaccaagcctagctactcctttttgtgcgttttgtagagacagggttttgccatgttgccaggctgatctccaactcctgggctcaaatgatcggctcactttggtctcccaaagtgttgggattacaggcgtgagccaccacgcctggctcggacttactgatttaccctaatcggctctgttgtttcacacaatatcttcttactttatcattaaagttgggatgagtttatgtaatatacatcataaattatcatatattttcagtctttatgaagaagaatacagcttttggagggtatttttcctatgtagtcaataaggatgaacaacgttatatattgatacagaacaaatataaaacaaaaactattatgtcccatgtgaaatgctgaacctcagtgctttatttcaatacaggactggggactaggcagacatgagctggaatcctcattctgccatttcatacagtggttctcaaacctggctgcccatcagaatgccctgtgggtgtccattcaattaaatcagcctctggggtgtggagaggaggagggcaaggagatctgggcattggtatttgttaaaaacaaaaacaaacaagttattgaaatcaagttgagagtttagtagctgtgtgaattagggacattgatttaccctgagacttgtgtattccctagggctgccataacaaagcactacaaactgggtgggcttgaacaaaaacaaatgtattgtctacaaatatctggaggccagaagttcaaaatcagtgtgccagcagggtctttctcttttccaaggctctagggaaagtatctgtttcatgcatatctcttagcttgtgatagtctctcggattcctcggctgttagatggctacatcttctccattgtttcttcacatcatctttcctctgtgcctgtctgtctctgtgtcgaaatttcttcttattatgagaacactagtctcattagagtccaccctaatgaactcattttattttgattacctctgtaaggaccgtattcctaagaaaggtcgtattctgagatattggtggttagaacttcaaatatatttttggagggacataattcaacacatgacagttactatatgcatctggaaaatggggataataatcgcacttctttcattttattgagagaatgaagtgggatcatttacttaaaatgcttattgcaacattaagttggaaataagctattttaatatttgctgtgtatcaggatcattattttaatattttgttctcattatcattatttattttatgatcttttatttttcccttccttttcagaggaatacccaagacttttgtgctcctttgggctcaggagagttttttattgcagggtcaagaagtagaagctgactcaagacagttcccctccatatctttcaaggcatcatgaaaagtgtctgaaagcaaggcacttaaccattgttacccattccatacatttaccagaattaccacatgtgtaccgctctgtagaatatgagcccagggttgtcagattttctaattctttgagtacaccagaaattcaatttgtgtgtaaaatctaccaaaaattgaatgttgacaactaatttcattcctgcctaactcactccaatttcaatgatgtcatgttagtagcataaatttggttatattgggagtagttacaccactaaaatcaggaagctctacaaaccagggtgttttttttttctttcttgtgagccagtaatttaaaaactaccagcacatcctttttattttgcttgctttttttgttaatttttgtaatttatagttttcaaagttggccccatcagggcaggttaggtagtatgacttaataatgtcctgaaaattatctatctctgcctgactaatataggtcattttacacacataagttggttttttacatttcaaagaaatatgtttagctataatatctgtttccatcttcaaaatagcaggtagttatcattatccccattacataaatgaagacactaactactcagagaagttaattaaactttctgaggtcgcatagtgtatcagtgaatagttagtgaatcagtaaatagatttgaatccaactctactgatgctcagttcactgtgtgcccccactgtggctcctttcatatttagggcactataaagagctctgtcaggttccaaaatctgtgtttcgtgacctagcacagtagcgccttaatgaatagttaatgaatgaatgggtcaggataaagcaaatccattatccatcagttcttgagagttcatgggaaatttccatcacatgatctccatggttttgccctgcctgctccttctcttaggaagttaacaattccacccatatctaaggcccagccctttaaagacagagagtggtggtggtttggttaggggtacagggaatctccatccccagacagacttgacacatcgtatgttcccagagtacaagagagtcaccaggaaaagcagagtactggctgtgactgcaattgtcaactcttgtttccccactgccaccttcagagtgtgtaaagcagaaatgcatgtgccttttcctaagacctagaggcaattttctcctgcctcagatgtgaaagagcacaagaaacatttaaccccacacaccacccgactgcctgcactaagtgaactgggccagagggtacatctttttttgtaaaattacatttctaggtacatcttccaaaaaagaagtttactctgattaacctggttcccagccaagagtgactcagggcatcttccagtgcaaaaagctagcctctcctgaaaactgctccaagactttcccttccgatctacaggttgcagctaatgtttaagtgtctgcagtataattagaagctgctaaactatcaaaccacagcttgctcggcctcccaactaaatcactgggttcaaacttactattgtgtcttcagagctaattgatgtgtttaaatggttcaggaagaaaagttctttggaccgtacttacaacatttctgtaaggttgtaattgtttcaaaataattttaaaaagttaaaatactcacctagttgttgactttttaaacattaaaatattttaaactttaaaatatacacctagccttagcagctatggtaaggacttgggttttgattggtaagagggaaagccgtggtgggaatttgagcgtagctggacgttatctcttaggctggtgtgttaagacttgactgtatgagagggaaaaccgaacagagagaccagttaggcagttcctacaaaaaaaccaagagagaggccaggcgcagtggctcacgcctgtaatcccagcactttgggaggccgaggcgggcggatcacgaggtcaggagatcgagaccatcctggctaacacggtgaaaccccgtttctactaaacaaaatacaaaaaattagccgggcgtggtggcgggcgcctgtagtcccagctactcgggaggctgaggcaggagaatggcgtgaacccgggaggctgaggttgcagtgagccaagatcgtacgactacactccagcctgggccacagagcgagactctgtctcaaaaacaaacaaacaaacaaacaaacaaacaaaaccgagagagagatgatggcagctcagaccacagtgcaaactttaaatttgaaatgaagtgattggactctagacacatgtttaaggtaaggtttacagtatttaccgagggagaggatgcaaaacatgaaagtaaaactgcagcaaagatgattccacaaaaaaaaaaaaattaaaaataacaacaaagcactttgctaattgattctaatcagaatgcatattttaaaaccagtagcttaaaagccatacctaccaataaaagtcaacaactagctgaatattttaacttttaaaaattattttgaaacaattacaacctcatagaaatgttgcaagtacagtccgaagaacttttcttcctgaacaatttcccaattagttgcctacctaatacccatcaccccctgcatattttagagtgcagctcctatgaacatggatagccctcctacaaaaccccaataaaaccatcaaaatcaagaaacggatatttctagattactactgtctaaatcccagacccaattccagtttcaccaattgttccaaaggtgttctttatagtaaaagagtgtaatatagcatcatgcattgctaaatggttgactttgacaccctttatcacgatgaatatcaactactattcaggtttgtatgggtttatatttagcctcaaatttttcctttttttcttcctgtacagtttatttatattcactgttttattcactctattgaggtagataatgtgggttaagaaattccttatagtgatggagaaagtcacattgaataaaataaaagaagtggcacttaactaatttttttgcagagctcatcatggttgttttattaaaactaaaagtaaagcttagaaataaatatgacttttaaaaggtaatatttattgcatttcttttaaagaaatgattaataatagcattttagaaataataatagcaaataatattaattgagcattttactctttataatgtatctaacttaattttcacacaacttagcagacattattattattttctctgttttgcagttgagatagctgaatgtctgtcatcatttccagttaaatatgtaaaaaggggatttgtagtgtcagcacaaatttctgagagatatatgagttgtgttgtggcattttctcacttcattgacgtcagaacacacagtgccatttgcttttgaaatgcagggcaggaaggcactcaatttattaaaaaagactcctgtgaattttctctgagttagattttgaatacattggcccttcctcaaacctcggcagtactggcttttccactgagagagttctgattgtccgtgtttcttcgtcttctgatagagcgcagaaggtaagggtaaaggacgagaaaatgtctttcttgcagggtggctcagaaatccataatgatacaaatcatgtgaggttcctcgcttttactttcttttcatccagggccatctccagcgtgccttgtgtatcgtccattgctggtttggattttctagagggtgaaagccgagatttagatactaatgtcaaaaggcctattggcaagaacttgtgaaaggaaaagagaggaagcaggattgcggtgaatggggcattagactgtgctttaggactgacagagtctctgccaggccaatggagagctctgcggtaaggacggtcccttagaatcgtcttgtgttaggcagagatggttaggaaaggtaggtgccactacctcgctcagttatgggcccccaaaatagcttgactttatctcaaaagctgaggagaatcctgctagggctaacagctgaggccattagcaaaccacactctcacagctgggcagcaaggcatttcttgaggaatctcagtggcacatttctgtgcctgacacagagtgatatattcatggaatatttcatggggaaatgagaactggaattagagtcaaataatatgagagtcagttttgatttttctgtttactagctatggcactttgggcattttacgccttattttcttcctcggtaaacagggaacataatgtatatcaaccataaagactggtggtaaggcaaaaataaggtattgcatacgcagatgttttggttagttttagaagtgctttgagattttattatgatggttttattattattattattattatcagcatcatcatcattattattgttattatgccctaatggcactcaatcattcattcattccttctttctttcattgagcaactcttaattgaacatctactatgtaccatgttccttcttagcaccgatctcagtactaaagattagtgaaataattggcatccctatttacaaggagcttgcatgccagtagtagggaaaatgtatacatatacacacatacaaacacacacatgtaaatttgtatatatgtgtacacatatatgtatgtgtgtatatttacatatatagtaaaataataaacatatactatatcaagtgatgataagtgcctgggaagaaacaaagcaagagaaaggaggaatgtgggtttcatgaccaaggcagaactcactgatagagtgatattttggtgagataggaagaaagtaaaagtgattcaagagacttactgcaggaggaaccattagacagagaggccagcagttgcaaaggccctgagtatgaatgtgcctagaatattcaaagagcagcaaggaataaaatgtggtttgagtgcttgagctaagggaatgtgaaaggagatggagtcagagaggcagtcaaggtgcagttcacatggggccttagcagctatggtaaggacttgagttttgtttgataagagggaaagtcatggtagaaatttgagcatagctggcattatctgataggctggtgtgttaagaattgattgtatgagagggaaaactgaacagagagaccagttacccagctcctataaaaagccaggagggatatgatggtagctcagaccagagtgcaaactttaaatttgaaatgaagcgattggattctggacacatgtttaaggtaagattaacagtatttaccaagagagaggatgcaaaacatgaaagtaaaagagcagcaaagatgattccacaaagccatcagcctgaacaacagagagaaagccactggcatatatggaaaaagccgaaatgtgtagcatgttgatgggccagtgggggtagcaactggggaaagatcagggtctgagttttggagaaaaaaaattgacatgttatgttcatcatcctagtggagatgttgaatagacagttgagtgaaagggttctgggggtccaattgaggacatcaatttgggagctgtcagcctagaaataacatttattgccaagagaatgcttttgttgagatgttgttgagattatcaagggagtgagtctgggttgaaaatagaagacacgtgagaactgagcttgggaactcaacatgtagctgcctgtagaatgcgagggtatcagggaaggctgctgaagaggagcctcttgtgaggtaggaaaagaaaaaagagaaagtagtctcctggagtccaggtgcatgagatgtttcaaggaagaggtcgtgatcaactgtgttaagagctgctgcctgatggggtaagataaggaccgaggatggcccatcagacatatcaagggaaagttattttgtgaacataacaagggctgttggggagaaatggaaggcagaggtggaaacctgattgaactgtgatttttagaaaagtagaggaaaaatttgggagttgtgtagaaaaattaccacagagtttttctggaaagaggcaggaatgaaatcatggtggaggagatatagaataaatagatcgtgctttgggggcatattgggaaatatgagagtattcttaggtattgatgtgtttgatccagtagaggcagatatcatgattcaggagagactgggcagttttagcagaggaagtactaaacaagcaaagggtgtgggatagaatacacagagaagggttggcatcaggagcaagggtagaacatctgtagaaacacatgctttgagcctgcagatgcgtggaggtaagtagctgcaatgggaaaatatgtggagaatctcctgaggtcttctattttctcagtaaaaattcccaatcggataatgaggtcttagaagaggaacttggggttaaagaagaagcgagaaatggtcagattaaaatctaccaggagttgtcaaatcctttcttgaaaggtcacaaagtaactgctctgattatagttcctttccaaatgatggctctgtctaataagaaagttttaacaagagaaacctgaattgtaacttgagtttcaagttccccactttctacctgtacaagatttggaaaatcatttcacttctctaggtttccatttacttgtcttttaggaattagacaaaatcagggcatgcacatttatttgagcatgagtctccttaaaacgttttatatcatgacccactaaacacacaaaatgaagtacacacctatgtatttgcaaacttgaagtttaaaaaacaatgcttacctttattttatatgtgcttacgatgctctctgatgttttctattctaggctaatagatttattctaatatattttattttgctgttgtttgtttgcttgtttgttttaagcctggctgatctgattaggaagaaggttcacaacccacaaataggacatgatctacaatttgaaaagcactcacagtttgaaaagtcacttccttaagtgcctcttattatttaattatgagattctgtgaactctcagggagaacataagggctaaaatgacctcagtcacagaaggcatattatgaacatgtgatcagaatcaagagctggaccatacactgattttgttgaaaaaaataaacaagctagttaccaagattttaagatggagtgattctacaatttggatttctagtgcctctgaaaaagtcagaactggcacggttggcctggtctctcactgagctttccggtttatttaccctccccacacctggcccacttcattcattttggtcaccagctctgcccctatagccgtagaagttaggaacccatgctgtagtttaagaacaataccaattttgaggcatctccttaaccaaattatgatacgtaaatgtttattgagcatttgaaaaaggcccaacattttactagatgttgtagagaaaatgaaaactttcagtgacttcattctgcaagattccagttcacttagaatattttaataagcatagacttctcacagatgaccagaaatcagacacccatgtgaaagtctaatgtcagaaaaagaaacctgtctgtaagtggggaggccctgcatcccacttttccagggacagagtcagtttgcactttattgttccagtgttacctggtttctgcaataacttatacagtcattgtaactaaggattaattaatctttttatttattttttgtttctttgagcaccaattcttaaaacagcatttgtggctttagtccctgtattatgcagttggccataggagcctccatcatgctcaccacctattgtctatttacagcctaactgaaaaaaaaatggggtcctaatttgattatttgaccagaatttttgtcttcacaacccatgagttcactttttctttcaagtgtgctgaaacaaaatctaccatctgcactgccaaatacttaagtaagatgtgttataacactatttaaaaagatattcttgacagcaggaaaaatatccagcctgtgacagactcaggctctcagggtcttctccttttaactcatagttctaccccattgttgctttcaaaggtaaataatctggtccctagaatgcagtgaagagaatcagtgcagaggcttgggttatgatatgaagtgatcagaattgatggttactgactggacagctactactcagaatgactgctggccatttattgattaatctgtccaagcaccatggcatatttcctcctctaattgctggcaagccaggaagttgtggcgaaaccaagtgttggccaaatatgaagctaccaggaggactgggggttagttgatgccatttgccactttagttggcatcacaagcaagcatggcagattagatgttatcttcaccaaaaacgagagtgctttcagtgtacaatttatccttatttttgatatcctgtattgagacacttactattcccttatctataatggcagatgttaagctggcgtgtgtgtgtttgtctgtgtgtgtgtgtgtctgtgtgcgtgtgtgttggtgtgttgttttgttttagacacatgattgaaataaatcgttattccctaaggtattagtataactgcctaaactgttcttttcttcaatgtcagaggtcacaaaagatgggacgtctaaatttagattcagcaatgccaaccccccactaagtggcaggaccctgccatccccataaccgaaagcaaaacaagcaagcaaactaagtctccaatcagaaatattatttaaaacaatctaagttgtatcccttataatgtggatcagtaccttgctggattttactagaatgggccaatgtgtagactgacagaggagacattaataacactgaaatatatgggtgttgccaaatgttgggcttaacatgacttcagtgggttaaggagccatcataaattcttggaaaagtgttttttaaagtagtcctaactgatagtattttggccaatagtggagtgattccatgaaaataagaacgtttccctaaaaatgaactgggaaaataaaattctgtttttgccctatgttaataactttattacattttactttaaagacctcaagtgagcaagagtagtggtttgagtggtggcccctcaaaatctatgttcatgtcctaaccaccagaacctgtacacgtgagcttattgggctcacaatagagtttttgcagaaataattaaggattttgaagtgagaacatcatagtttatatggatggactctaaatccaatgatgagtgtacctagaagagaaaatcaagtagaaatagttacagcagaagagacacagagaaaaggagaaggctatgtgtagagggaggcaagatggtgtagttatgcagcagtagctggggagctcctggagccaccagaagctggaagagtcaaggaagaacctcccttagagattctggagggagtgatgcccccaacaccttgattataaacttctagcttttagacctattggagaacacatctctgttgtcttcagtcacttagtttgtggtaattttttaaatggctgcaacagtaagaaatgaatatagcaagggcactggaaattattgttttagtacttcccccccatttgatccaaacaattaaattgctttgggcactgatcgccattattttccaaaataatttactataaaaagagaagttatttagtcaaatgaatgctgggttaggcaaaattgcactgcaaaatgaggatttgttttatcttaccacttttcttgatgggagtgagtgggggagatgatgacttatctacattatttctactaaaggagaacatagtggcataacgggaaaggaaaggacctcttggaacatttttcctaattaaaaataatggagaagactttgttaacaagtggagatgtattaacccagggacatgtgtctgctcttccaagtcgagaaggcagacttccaaatacttccagaataatcattcatccttgatagtggtttaaaataaaggagtccctagagagaagaggtatggacattcataaagttttgtttttcattctatccaagttatgatagaaagaagtggctgggagagtgtatacatgtttcagagtagccctcagccaaatagtgagtaaggagataaagacaaaatcagatccttccaacaaacctattgtgttcttgaaaaacctctttcattgatcagtaagtatcgacactaaaatatttcccagtaagattaatcaaaagacccaccatttgatttaagattttctagcttccacgaattctctcttttcagttaataaggaaattaatgtaaacattaacaagggagtgatttctacagcagggtaggtcagccatgatcatctcaagccacgctacattcagtaaaaatcttcaagggaagaagaatggcctggactaccctgcaagccaaggtctttctgccgattggtaggggaggacatttggtatctctggtgttcaccatgacgcttagaaacttagaaacaaacatacccatagacatgtgctttgcagacattttgacccaacaaccacgtttctaggactcatggcaatcatagtaatgcacgtagatttatctgtgaggatctcagtgatatttattaacagctaaaaaagtcaaacaatatccaaatatagaaattaatttaaaattgcccatggagatcacagaataacagtacttttacaagattacaatttttacaagattacaaaggtctattattgatataaccaaatgacagattacaaatcattgtttattgcattatcttattttgtaaaaaataaataaaaatgggttggtggaaaagtaattgcggttttcaccattacttttaattgcaaatctgcaatcacttttgcatcaacataatacatgtagagaaaatgaagaagaaagtaatataataggttattatctgtgattatcaatctggccaatttcagttgattgccattttcttctttttctccaatatatactgatgtgtatgtcattctgtgaggggtaacattctactttataaagacatatgaataaaacatataattgctaattcttgttgaaaaatccccaaatctcaactggaattttttttgtttaccatctaccttctagtatgttagaattaatggcctttaaggttaaatgttagaaaggcatatatttttctaacttcatatatttccttcctttctgccttccattctttcattctttcactctttctttcttgagttctaatgaagaggccttgggaaagaaaaacaaataaaacttacctgaataatcagagcataatgttaatgattacacaatacttactgattatataatacttaatatttttgaggccatagacctttacagaatttgctgaaaactgttgatcttctctccaaaaaatgtacttatgcaacatttcatatataatttttgggagaaggtggtaatggagccatgggtgaatttgttctttgtattcccaacaattttttataatgaatgaaagactccagtgataagtttccctgtttactgcatacttgggaagcctagatctctagctctcctctgtgaaatccaattaaactagtttgttaaagagatcagatctttatacttgagaacttccactgttttcttataaggatatttgttgaattagttttataaatgcagtatgaacacatactttgaatgccgtaagtggtaagcaaatacacacctgatatacatgtaatgagatgttcacaggtctcttagccactcacgtgcaagttcttactagagtgaaattaggaaaactgtttactcactggaacttgagtgagcttccctgctagagaaggaagaaaagaacttgcttattaccacaaagagaagatgacaaaagatggacagtaaagtgcgaagctagagaaataggaaaaggctatagattaggtgagatgatccctcctcataacccatccaatgtaaactggtgaaattactgaagttacaaaatgctaaactagaagggatgtttttttcccagtgcaaagtcttgaaggaactaaactttatctttagcctaccttgaggaagaaccaaggtagaggaaatggatgaagaggtgaaaacaagggttctgccaagaattttcagaagtttgtaaaattcgcaaaggccatggaatgaagttcagataaggtttaaccaaaaccctgaaggatattgagacacaactgatttctgggttgcatctttttgatacttaaattatacatgtttgaatcatttataatttagatatgctcttataaagaaaaaatatcttggctttaagaactctgttatagttacacgcactgtctaaaattaggcatattatagaattcaccacaacttgtgggctttctttggtgttgatgttttttgccagcagttgaaggtgaacaaagggctttgaagaggacaaaggaatctcccatccctgctaaaaaaatactgaaatgaggctccatgagtatcttcgtttctttttctaaataattgtctcgtatccagaggctgatgttggcataggttgtctaccttgagcacaagacttgtaatgcaggagaattactgagtgtcctgcggttcctgctgatggagggaaggcaccttccgcacaggtgaagctctggccacaggatcatcctcaaactgatagcctccgagtctgacttttccagctggagggagagaactgcttggtttctattgaaatcactatttgctcaacattattaatgatcagagaaacgcaaatcaaaatcataatgagataccctcttataccagtcagaagggctattattagaacatcaaaaaaacaacagatgctgtcgaggctgtaggaaaaaaaataaaaacacttatacactactggtgggaatgtaaattagttcagccaccgtggaaagcaattcgtagatttctcaaagaactcagatctaccattggatccagcagtctctttactgggtatataaacaaaggagtataaatcattctgttaaaaacacacatgcactcgtatgcccatcccagcactattcacaatagcagagacatggaatcaacctaggtacccatcaacggtggactggattaagaaaatgtggtacatatataccagggaatactacacagccataaaaaagaacaaaatcatgtgctttgtggcaacatagcttcagctggaggtcattgtcctaagcaaattaatgcaggaacagaaaaccaaatacttcatgctctcatttgtaagtgggagctaaacattgggtatacgtggctataaagatggcaacagtagacactgaggactacaagagggagaagggtaggaggggtgccagagttgtaaaactacctgtgtggcactatgctcagcaactggatgacaggattattgctacaccaaacctcagtgacattttgatcagtcataatacatgttacaaaggagccagtgggaagaaaatagaagatagaatataaaaatcaattatgagacacataggtattttttctgatattactttttaagttgcctttaaagcatacagttctataaattttaatacatgtatagatccatgtaaacatcaccagaatcagactacagagcagtttcatcaactcaaaagaaaaaaaaaaaacctttatgttattactttatcgtcagagtctcccccagctggtaaaccactgatctgttcaccatcactatagtcttgtccttttgagacttccatcatataaatggaagcatatagtatgaaactagcttttttgacttggcttaatacctttgagatttatcaaaattgtcatgtatattaataccttattttttattattgtcaaatagtattttattttaaagatacatcagttagtttattcattctcccagagaaggacatttgggctgttcccagtttttggatatcacaaatgcagctattaaaagcactcacgttgagaattttgtatgaacatagattttcattttttagagtaaatgccaaataatgggattgcttaccatggcttttgaagaaaaaaatatgcagtaggcgaagatatttttgaattgtctataattataaaattgtctctgcttttcctttagaaatgtattttaattgatttttattttgtattcaataagcaaagtgaaggattgtaaaagcaacataggctggaaaatttaggcacaaccacaaactactaaaaggccacacatctctgactatccaagattgtttggagtgaaaatttgccaagttcgttaatgcagggagactaaatagaaaggaagcaatggtaataattggtaaatagttcatatgcaagaaaaattaggcctgatattttcagcctggaggtagagtaggaactgacataaacccactgaggaaagctcctcgggtttctgtggtaaggaaacttcaggggatgaatggggaaaagggtcactatccttaatgatttcaggaagttaattgattttttttaagggtcagaaagggatacatcaatgacattgggtgaattatatgtttactgagggtctagttactgttcctaataattttcttacataaaatgaactcaaggttaattaagaaacataaactttcatgttttgccagagccctacaaactaataaattattatgagatatttttgttttctggcttgacattgaaccatgcagttcatctataagttaaacattatagcagaacctggcttttgtaataatattatttacaaacttaagcacattattttttttctacaatccaacctcagatgaccttttgttttgttttttttttgttttcagtgttctgagtgccaaaatattaatagatcttactaaagatatctaacagtatctttacatctaacaattagatatttaacaatatttaacaatgtatctgtggttttaagccacaaaacaatcaaaataaccctccatgtggtttgttttcttctgtcatcataaaacaaagagcttatgccaggcataggacattgacaggggaccacttccgtggaatgacttgaagaacaaatcaaagctcacatactcaaaaacatttttttaattaccttgccacttttaattttgaggacttttaggtattccctgaattaagacatgttcagttagcccctgctaaaatacacagaaacttatttgcacatcgtcttggaggccgtagaaacttgttattaagaagatgagctgtaaagtcatgagttcaatgaatgttgtatattattattatccttattattgtaccagccagcacctatctggtgacaaaaagcagagtgcaaaagtgttggggagaagaaacaatatttcatcaaactctctccaactgctgtttaaactcttttgaaagctgatgcattacaatggcagtccttagtaataattacatagatttcattacgtagactttattccatcaatggttactggatttatgtgttatctattttttttcaagaattattcttaatagtaatcacagcaaaaggtgatatacatttgctaccagaaattaatttttattatgaatcacctttttttctctaccctgtgaacattgtagagtttatctgaacatgactggcatctacacatgccttttagtgacacagatgtttttctggatcttgcactcaccctgaatgtttttttttagcctttatggaggggaattggctgaccatccttcagttgcactgatacatccagtgatatgaggtcagagtttcctgaaaaattaggtgcaagaaaagtaaggtcctagattgtgaaggaggcattcctggggcagaataaagctttttcccattggaactgagagaggaggctgctgacttaatgtattattccagtgggatatgcgtgtgccaaaacagtttgtgtatcagtgcagctcggaaaagcagtccatttcagttcctcagctttttcttcagcgtcagacagagcaccgaggctgagattacctctataaacaaggctcacacctcctggtgtttccgccatttatcacattttctttcctttttttcgttttttaaatttttgtaggtacatagtagacatatatacttatgaggtatgtgagacgtcttgatacaggcatgcactgtgaaataaacatatcacagagaatggggtatccatccctcaagcatttatcctttgagttacaaacaatccaattacactgtttattttaaaatgtacaattaagttattgattgtagtcactctgttttggtatcaagtagtaggtcttattcattctttctattttttttttgtacccattaaccatcttcacccaccctccactacccttcccagcctctggtaatcattctactctctgtattgatgagttcattgctttgatttttaggtcccacaaatatgtgagaacatgtgatgtttgtctgtctgtgccatttatcacattttcaatgtgtggttatcaagccactttcacaaatatgttgtttcattgttgccacaggcttgcaggtatgcctgatggatcttgtgttatagatggagaaactgaagctcaaagtggcaaaatagcccaacgtcacatggctaatatgaggtagacgctggatgtgaatccatattttccaactaagctccacttctcttttcactattccacatctgctggtgctgaggtagtaagaaaaggatgataatactggctgaagcagttgggcctagcaggaacaaaaacgtgttattaaatctggaaatgagcttgactgtaaagggggtaaactatagagacaaatattaaggtattaatacttgtctaaaataatgtacaaaaagaccttcccgaggatgttttcaagacttaaattcgcttatttgaagtctttaaaaattcccactaatatttttgggttttttgagaataaccagcctaacaagtgtgaggtgacagctcattgtagttttgatttgccttttcctggtgactagtgatgatgagagcctttgcacgtacctggtggccacagtgggtatgaagtttcggtaatacaggacaaatacgttctagagatctgctgtacaatatagtagctattcttagtaacacggtattatgcacttacaaatttgctaagaggataaatcagtcattaggtgttcctaccacaaaaacaaaaataaaaatgaaaaaacccaaaaaacacaaacggacacaaggaaacctttgggggtgatagacatgtttaccacctttattatggtgatggtataacaggtacatgcatatgtccaaactcatcagatggtacaaattaaatatgtgcagtgtttttggtatatcaattatgcctcaataaaatgaaaatgaaaaataatgaacattgaaaaacaaaaatgaaaaaacctcatctcctagtaattccactgtaagcattcatttagttccagttctacatcttgaaatggattgttttcctaacttctaatgttcactctgttaatgctcatacgtggtcttctgcctcacaccctcatgtatttcataatcttggaattaactgtgatgattttctaagctctctctacttctctcccttctagctctctgtatggaataggctgctgtgttttttgacttagctaacttcggcctgatcattaggatgccactgttctaatcctgtcctggcttcccctgtatctaagcagtggcttctcattctaagttccacagccctccttccatgtttctgtctcagccccaccagcactctgcccctcactttttcttctctcctctgagcacgtgagctgcatgattggagggatgaatctggtcatctctataccttcagctatcagcatagtacctgttactcagaaagcatgtaaatgctaaaggaatgaatgaaggaaggaaggaagaaatgattcattttttccaaaattggatcttggcctctgttactcagttaattcacactattcaacagtagttctacctactgctcttctaatccctttcttgcctagtttcttttctcctctgttctttcgtttccttctaatccccttccctttagctccctccctgtttgccttttctcttttttcttctagccttctgtggtgctttattgacaactgtttcttgtgcacttactatggcacaagatacaggcatgcactgcttggcatgtactgctatcttggcagagacaatgaagtgttgcaagaataaaataatgaataaatgcagacaattttcctgcattcagagcacctaacattcttgtgatagggaaagaaagacaacaaacaagtagtaaattagacagatttagaaattattggtgctgaaggacaaaaaaaaaaaaaatccctgataaacttacagaaaatatttggtactgctctaaacaaggtggtcagagaagacctctcgaagacatgggttgtgacttcggtaatgagaggaaacagtattgcctggcacaggtaagagcaagtgcaaaaagcttcaaggcaggagtgaacgtgagcattcaaggagcagacaggaaggaaatatgctgaggtgaagtttgagagctattcaagctagatcatgctagttccttgtaagccactggttcctgagtcacatggaagccagcagaaagattttgactggaaagttgtatgacctgcttactatatttaagaggtcacagtggctgctgtatgaagagtggagtattgaggaccaagattcctggaaacagagagaccaggaaggtggttctggacctagcccaggggaaatctgacagtggtctaggccaggatggtagccatggaggccattccagaagaagagcaaattatttaaaaagaaactcaggcccatggagctagactctctgcatgaactgtccctgagaatcagtatgacatctaggcaggccacatcacctctagctttttttttttttttttttcagacggagtcttgctctgtcacccaggctggagtgcagtggcgcgaactcggctcactgcaagctccgcctcctgggttcacgccattctcctgcctcagcctccagagtagctgggactacaggcggccaccatcacgcctggctaatttttttttttttttttttttttttttagtagagatggggtttcaccgtgttagccaggatggtctcgatctcctgacctcatgatctgcctgcctcggcctcccaaagtgctgggattacaggcgtgatccactgcgcccagcccacctctagcttttgcaggtcatcatggaccactcttttgggacttcacagctcatctgttgggtggctctcaggagttccagcagataccagatgcatccagtgttctccaagaatgctgctcaatcactaagggcattatctttctcagagtaatgcatttgcttttctactgatggtcccatagtggcaggtcttaatgttatccttgtgattactaacactgcaagttgtgagtatcagtgcttctcagctctaactgaagtagctacttcgaactaagcttactggttattgttgttttccccctattaaaattgtgtgatatttcacatcattgttttctcttatttcacaccacagcaatagaaattgaagccttaaaatttacttgtcatttgcaaatattcagaagaacatgtactctgactatgccagaattttcataagaagtataatttccaaatcatttttattttatatttttgaatttcaaaccattatgaaagttggctatgtcttcactccatatacaccaaaggtagggttatttgtaggccacataagtaaatattcttaaggcaatgtttctcaaaggctcaatttgatttgtgagaaattaatcggtattattgtcaaaaaaataaataaataaaccctcctattttctatcacttttaaatgcttggtcaaacaaaatcagttttctttagggtaggatttcttaaatctttcagcataaaaatgtgccatcaagctctttaaatggccaatggtgagcaggatatatcacatttctgaaagcaactataaattgacaacagaacctttttacacaaagcattttacacaaagagatttcctttaaaggtattttgatgttcaaatagcagtctggaaggccattctttggttcaaaagaaattatgtacttttttcctttcatatattttatgtatgtcaacactttagctaatgctattaggaaaacacagatcaacaaagaataaaagatccataaaatctgcatttttttaaaggttatcctaagcttataaatgagaaaactcagaagcattaggacagtgaattccttaagatgacatagttaggggatggatccagtcttctattttgtattctgtatttttaacttatatgtttatggctatcatatataaatagaaaacttactcttatctcagactttcttccttcacaaactttctttctttttccaaattgtcaatcctgatcatacaactatgaacaaccataatgacaaatatataagacatctgaatctagattgaaagagtgttgtaaaataaactgataaacctaagaagccaagactaaatgggagtaatggaaaaatacaacctttaggtccaaagagccgataattcacatggcttgcgcagtgttattggttagagggacgtagtgtcttcactgatcactcagtatgaatcatcagtgtaactaacatctgtgtgaaaagagctagtgttatcttgggacccatgaagagaaatataatctcccgagtgaaagaggcagcagcctctctctactatgtgctaatggttcttttcctggatgttgacaaaacattcagaaatgtgaacagctgttgcttccctttatcttcagggctcctctttcctcagttgctctgattttgtgactttcaagaacacaggatgctagctgactctgcattttctttctgaattacctatatccctcccttcctgaagggctgtgcctaagagggctgctcactatttatgccagcaggggctccctgtggatgttagagacaggcagcccttcccaatttcccccttttatcttgaattacatgaaaatggaattccaaatatgatagctattttttcccaaatcttggaaagatgttggtcccccagccttgtattttagtctgttgcttccttaacatttgaaaattccatgagaagaaaagaaaaactttaaaaggaagcaaataaatctaatggcagtatttcatggactcttaaggggagttagaaaatggtattttttgaatttctctaagtctgttaatactgggttgggagatgggtgttaggaatcacatataaatacaaaataaaccttttttgttcatttttcttctccttagcaaatcatcaggcatccaggctttttagttattactatcgacatggctccatggagggagagggtttcatggacgggggctgagttggcttggggtgagatgtctctgactgtgaatttttaacaaatgctgggttttcattatctgtcaaacctgctttttcatttttctttacatagatctattcattatcttcacactctccaattagtacctcattctcttcatgatctgccataaaatacaggttctttctgcaggatttgcttatttctccccaacattcctcctttcctagtgagatgtgctttctctttagtttttaatgtttgaaaaagctaatcaactccaaagtcttcattaaatctctttgagagactgactgggattcttccttggagctttatgttcctgtggcccaggactgcttaaaggtcacaagaggccaggagcggtggtaggagcctatagtcccagcgctttgagaggcaaagataggagaattgctttagcccaggagttccaggctgccgtgagacatgatcacgccactgcactccagcctgggtgacagagccagactctgtcttaatgcatacatacatacatacatacatgcacacacacacacggatgccctcttaccaacctgcacccttagtttactcccattgtgcatgagattacttcttccctgtctgctactctagatttgaaattccacaaaagcagccaatgtgtgagtgctgataaagaatgaatgaacctatgaatgagacttttacaccacgtaaacttgctcttcctctttactcccagatgagttgggggaacttctttctccaccctttcccaccggactgattgctttcagcaacctttggacctaatccctagagctaaggagaaacgcttgactgcaagcaaaaaaatgtgaacgttgcaagaacaaatttagtattcgaagcaaatgagaacataagattgtagagaggggatatgtaaggtgaggagagaagacaaaaaatcactgaaatacagctaaagttaagagtcagtgaagaagaggcacaaacaagatttgagaaagaagaagaaaaatgggtcataccccacaagccaagagaatggagttttaaatttttttccaactttattgaggaataattgacaaaaattctcttgatttaaggtatagaaagtgctgatttgatataaatatatattgtgaaatgattaccacaaccaaactaattaacacatccattctgttagttaccatttgtgcatgcacatgtgtgtgtggtgaaaacactttaaatctattctcagcaaatttcaagtatataatacagaattattaattacagtcactatgctgtacgttagatatctagaacatattcctcttttaaccaaaattttgtaccctttgactaacatctccctattccctacctcgcagctccttgcaaccagtttgttttatgttcaaaaaggaaaaaaaaaaaactatcaatgccatctgccacagagaagtcacgtaaggacagaaaaaactaatttatacgttagtcacagaaagaaagaagaaaggcagaagtggaaagagaaagagaggatgaggtgtagccgtaggctgagggtgctgtaatctcaaaagtaggcttttgtccaggaaaatgactcttagtattcctttctgggcctgtctattgtgctacatgctctttgacatgatttactactattcaatacactcaattcaacaagtacttattgcatctctacataaaccagcctgtgctttgatttttaggagtccttaaagataaatatttaacctgaaatcacttacagtcaagtagaagagataatatgcacatacgtttaactgcagtgtaatgcagaattggacacaaatcacaaaaacaagaacaaattgcctttgtgagctgataagtgggtaaggccactccttcatatcaataatgctgcctgcagggaacagaatccaatttagatgattcaggaaacgttaataaaggaactatttacagagctgtggataggttcaagggcgataacatggaatgaagttgatgagactagcaattaaagaaagctgttagcaaccttgggcttacaggggccaaaagaggaaatagtgtgactgaaacccagtaagggatagagacatggaaaagtgctgccccacaggagccataaccatgaagaaaagcagccactgccagaaaaaaatggcttagaacaacaagagttggagaaagagttacttccagctccttctcctcccaccctctgatgtcttactgctaggtcccattggtcaagccaaatgtgaagtcagctcatttgagaaggtagatagcccagtcaatgagacaatgcagcaccctgtgacacagatcagggcagagaaagataggagagagacctgaggataagcaaatagagatttccgttttcatactgttaataaagacataaccaagaccggataatttataaaggaaagaggttgaattcactcagttcagcatggctggggaagcctcaggaaacttacaatcatggcagaagcgaaagcaaacatgtctttcttcagatggcagcaggaaagaaaacaagaatgagaactgagtgaaggagaagccccttataaaagcatcagatctcgtgagaacttactatcatgagaatcccatgggggaaacggccctcatgattcaattacctcacaccaggtccctccacaacatgtgggaattatgggaactacaattcaagatgagatttgggtggggacacagccaaaccatattagaccccttcttggaggtatcaaaaaggagcaggtatgatacaagccttcgaacaaatataacataccatgttatggcattcccagaggtgtagacagactgagaaaaagcaaagaagtggaaactcaaagacagtaattcagattagctcaaatacatggtgtgcgtccagtaagtggtcttaagagagtgtagaagaaagcattagatgcccagttgggtggcttgtactgtagttggtgatttaatggtcttaacttgaaaagaaaagcatattgaaacaactaatctggcatcagaaaagacagcctggaggtggtagagactctattcagagaagccagttaggagcatattgcagcattcaagctaagcaactatgttggtctgaaaaggatgttggcaatggaaagaaataatgaaattatggtgttcaagcaaacagggcttaacgatggattacatatagaaggagatgtaaaaataagggctttaatttatgttcttccatggcacacagaaggaagtcagcagaaaatagaactgagggaagaagggatgaattcattttcagctacttgtgctgggaggtgcaggatttgggaatggagcacaggctgaagttgtacatttgggactcaactgcatagagatcatagttgcctaaaagagattagagttgccaaaaatagaaaacgataattgatttattagtggaaatttggcaaataacatcttagtaatgtgatcatataaagggatcagttcaagatatagaagagggatattgaagtaggagaagaaaggaagaaaatattgagccaatagaggccatcgaaagaggcattttcaaggtaaaatatttctaaaaagaatcaggacagagaaaggttgttggattgtgcaattatgtaaattactatttcagagactttgatggtgaaggagcaatgtgggtagagatctacagaccctatgcagggaggtgacatgggaaggaatgtggttttgtttctccgataaaggaaacctgagcatgttagctgggagaggggaaacaattctcttactgtcatattttctccctgttttcatgttaatgaaacatagtcttagttgcccttaataaactgtagtaacaatgttcaaagagtccacaggagggagacactactttctaaactgaccctatgagtagttacattgccacaatatctcaatgcttaaggtagaaagctgaagctggtttttgttgttgaattttttttaaaagaacgttggtcagatgtttattctggacatggtgattccttaaactattacagcttttttttcttagagacaatttattgcttgctgaacaggttttatttttcctttgtggacttcagccagtgatagaaacaaaatcttttccaatatctttttagtaattgtaccacctgaccatatagtaggtgctttaaaaataattgttgttgtttttctgaagtctttcatggtgaacttgtgcatttggatgattcggccaaattgggttttgtatttctatgcggaaagggagattttatttatggatgtaccacagctatttccagttcttcacgggctacactttcacatcataggttacactttaccatcctgtaattagtcagaatcacatgactggctttggctaataaaaagtaagtagaagagatgcatttcagagttggtacaccactttccacacgctcttattcattggtaaatgcttgttggcatcataaaaggatggtgacttattcatccctgatccctaaggaacataatctttctcagccaatctatttttgtcacgagacatgagtgataaatgcattttatttggataagtaatagtcaccagactttttctgtaaaaggcaggatattaaatattttcagctttgtaggcaacatgatctctattccaactactcaagtttgtcattttagctagggtagcacaaataatggtcatagacaaaaattaaattaatggacatgtctgtgttgcaagaatacttttcttataaaagcagacggcggtcagattcagcccatgagccataatgtactgacacctgttttaaacctctgaggtgttgaggttgttacagcagtataacctagactatactgcctaactactattacactttacaaaggaaatttgttagagtactgaatggatgcaatggcaattttgtactttgctatgaaaatatttgttaaaataggaccatgtgaaattgatttggttttggagctttatttaatctaactgaatcatatcaagaatcaaagaaataatcacataaaattgaattggaacagctatttttaaagcaggctgaacatttagaaattttcccaaaattgaacacagaaaaaaagaaaagaaattatttttgaaaggctatagtgatcaccacagaagtagtaccaagagaacacatataagcaagggaccatgggaagaagtttcctgacttcttatcacttaaaccctaattttaatagtaattgagttcaaattttaattatagaggtttaaaaagatgtgaaaggtaagcttctgtacactactgattttctattttttgagtttagtactgttgcataggtatgctcacttcatgaaaacgcatccagccatacatatgcctgatgacatgtccttttctgtgtttataattctacaatatatttttttttgagacaaagtcttgctctgtcacccaggctggaatgtagtggtgcaatctcggctcactgcaacctcctcctcccgagttcaagcaattctcctgcctcaacctcccaagtagctgggactacaggcgcccgccaccaagcctggctcaatttttgtattttaagtagagatgggatgtcaccgtgtttgccaggatgatctcgaggcagagacctcgtgatccacctgcttcggtctcccaaagtgctgggattactgacatgagccaccatgcctggcctaattctacaaatttttaatagaattatttcaaaaaccaaagtgaaggaaatcatttctgaagtgttcataacaaacgaacgatttagttttaagagtaatttgtaaagtgtgattgttatgtcagtaaactccagcatcctgtgatccagtcaggagttctctggacaatgtcatactattgggagtttgctcctgaacgctgttttctaaaaacatgcttcttttgggtaaaacgtcacaacttatggatatctgtttgaagataaaatgacccaacttctcccatgagtagtgagagccatctcagccaaatttattgcatccctcaaattttctgtcacaaaagcaaagggtatcttccttccctttagtctttatttcttatctcccttctgtcattcatgttgctgatttctttcttcctgtaaacagaaacctgagccaaggattccttatgggagctggagggtcttactcaccagaatcaaaatccctgacaaaccaatccctgcagctcaacaaaaagctagtgaattgacaagcacagaacaaagtctggaaggaaaaacatccatgcaattccctgtcctacctacaaacatacggaatccagatgaaatgcttcggaatggaaaagtgtcaggtacttgcagtgtagtaagaagttatgattaaaaagcaagaaaaatgttagtaatcttagaatcctgtatttattttttctctctgtgagagaagataaacatttaatatggatacgctgaattaattgttccatagctcatttggcctcttatttcttttcttttttttaatttccaagctggttttattagctacattcaataattaatattttcttggtcaggtgccattacagaggcgacttttctaaagtgataatttattttattatctttaatagaaacttcggcttaatatttgtattaatttattgtcacccttctataaagacatacccataactaggtaatttataaaggaaagaggtctatttgactcacagttctgcagggctggggacacctcaggaagcttacactcacagtagaaggggaagcaacatgtccttcttcacatgacagtagcaaggagaagtgcagagcaaaatgggggaaagccccttataaagccatcagatcttgtgagaactcactcactatcatgagaatagcatggaggtaactgcccccatgattcaattacctcccacctagtccttcccacaacatgtggggattatgggaactacaattcaagatgagaggtgggtggggacaccaccaaaccatataattctgctcctggcacctcccaaatgtcatgtcctcacatttcaaaacacaaacacaccttcccaacagttccccaaagtcttaactcattccagcattcgtccaaaagttcaagtccaaagcctaatctctgacaaggcaagttctttcatcccataagtctgtaaaaccaaaagcaagttagggccaggtgtctgtaatcccagcactttgggaggctgaggagggcagatcacctaaggtcatgagtacgagaccatcctggccaatatggtgaaaccccatctctactaaaaatataaaattagctgggtgtggtggcctgcacctgtaataccagctacttgggaggttgaggcaggagaatcacttgaacccacaaggtggaggttgcagtgagccaagattgcatcattgcactccagcctgggcaaaaacagcaaatctccatctcaaaaaaaaaaaaaaaaaaaagcaggttagttacctcctagatacaatgagggtacaggcattggttaaatacacccattccaaatgggagaaattgaccaaaacaaaggggctacaggccccattcaagttggaaatccaatagggcagtaattaaatcttaaagcttagaaataatctcctttaacttggtcatgctgatgcaagaggtgggctgtcatgaccttgggcagctctggccctgtggcttggcagggtacagtcccccccaaagttgctttcatgggctggtgttgagtgtctgtgacttttccaggcacacagtgcaagctgtcagtggatctaccattctgaggtctggaaaatggtgatcctcttctcagagttccactaggcagtgccccagtggggactgagtgtgggggctccaactctgcatttcccttctgcactgccctagcataagttctccctgagggctctgctcctgcaccaaacttctgcctgggcatcgaggtgtttccatacatcctatgaaatctaggtggaggtttccaaacctcaattgttgacttctgtgtacctgcaggctcaacgccacatgaaagctgccaaggcttgtggctttcaccctctgaagccatggcctgagctgtaccttggccccttttagccagaggtagagcagctgggatgcagggcaccatgaccctaggctgcacaaagcagcaaggccctgggcccaggccctgaaaccattttttcctcctaggcctcttggtctgtgatggagaagctgccaagaatgtctctgacatgccctagagacattctcctcattgccttggtgattaacatttggctccatgttacttctgcaaatttctggagcaggcttgaaattctccccagaaaatgggttttcttttctattgcattgtcaggctgcaaactttccaaattttttttgctctgcttgctcttgaacactttgccacttagaaatttcttctgccagatacctaaatcatctctctcaagttcaaagttccacaaatctctagggcagggggaaaatgctgccagtttctttgcgaaatcatagcaagaatcaccttcattaaagtcccaacaagttcctcatctccatgtgagaacacctcagcatggacttcattgtccatatcactgtcagcattttggtcaaagtcattcaacaggtctccaagaagtttcaaactttcccacatcttcctgtcttctgagccttccaagtctctaggaagttccaaactttccattttcctgtcttctttggagccctctaaactgttccaacctctgcctgtttcccatttccaaagttgcttccacaatcgggtacccttatagcagcaccccactctctgcagtactaatttactttgtccattctcatggtgctataaggacacatctgagactgggtaatttataaaggaaaaaggcttaattgactcacagttctgcagggctggggatgcctcaggaaacttacaatcatggtggaagaggaagcaaacacaaccttcttcacgtggcagcagcaaggagaagtgcagagtgaaggaagggaaaagccccttataaaaccaccagatctcatgagaactcattcactatcacgagaacagcatggaggtaactgaccccatgattcaattacctcccattggatgcctctcaagacaattggggattatgggaattgcaattcaagatgagatttgtgtggggacacagccaaatcatatcaatattttagtagcataaatgaatataattattacattttaaataaaagatgtattaatttcattttcaaattaagatttagaacataatatgtaccttcaataataaatggcattggattcattatatgctgtatgaatataacacaggagtttacataatatttttcaagatttgttctctcatgctaaagttttttgtaactttttttcatcaatataaatgccatgacaacagtaatgtcagaggttgtgacttttttttttttttttttttttagacagaattccgctctgtcacccaggctggagttcagtggcacaatcttggctcactgcaacttctgactcccaggttcaagcaattctctttcctcagcctcctgagtagctgagattacaggtgcctgcaattgcacctggctaatatgttattttattttattttattttttagtagagacaggatttcaccacattggccaggatggtctcgaactcctgacttcaggtgatccacctgccttgaccttccaaagtgctgggattacaggcatgagccacctcgcccgggcgagcatgtgacatttttaaaaagcacattctgaggtttcaaagtgtaataggaaaaacatgcactacaagtagagtccattataactgattttaaattccatctctgtccctcatttcctcttgaactgctttaatgaagaatccccagatcttagtggctcacaaccacaagcctttgtgaaatatgtcagcatgtgtggactgactgatgcactttggcatttcttttctttctgggactcaggctaaaggagtggctactctttaggacagccattactttggaatggggaaaagcaagagacagagccacacattggctcaaacacggtgtatgtcatctctgctcacattccattggccagagcaagtcagaggatagagccagacaatgggacagagatgtgaatgaactctgactataggaatccttcaaggcatacatcaatgaacagaaaaaacaggaaacgaagattggaaaaaatatagtatgcttgaatgatattgccaattggagggttactcagcagtgtaattagccttttgctgaaaatcatagtcagggaatggtgatagctgctaacctagccatccaacataacccaaaatgaagaaaactatttgagaatttataatcatgcaaagcctttttaaatacaataagcctggacaacatagtgagaccccatatccacaaaaagatttttttaaaattgtctgggcatggtggtacatgcctgttgtcccagctacttggaaggctgaggcaggaggaccacttgagcctggaaggttgaggctacagtgagctgtgattgtgcaactgcactccaacctgggtgacagagtgagaccctgtctccaaaactaaaaaaaaattaaaaataaaggctatctgtttgtgcacgtgaatatgctctagttggtgggaaacataaatgttaactttacgtgtgggtaatgtatagatgagctacttaattatgagcttatttgtagatctgttaaaaccaaatggaaaacacacctatttgtaaactggcaaataagcttttccacatatgaagaacagcttgtttcaggttttaaaatataataagattaacttttaaattgagttgagaaaacagcaagttacagataaattgagttactaaggaaagtgatttcacttttaaaaactgaattaaggacgttgaaattaatttatttttgaacagaacgtgctcaatgttaagttttgtttattaatttctctttggacaaactctttgaatgaaaacaaaatctattataaaactttgtttttcatattggcagccctgcatcaaatttttatctacaataaacatgaattatataccacttgcaggtagaagtcccatctgcacatcgattcacttcagccaatgacatgtgtgtgcatggactcttactgtagtatgcattaagtcccctaagccaattacttagtggagacatttaattcagtttaatctttaattatatgcttttgattaatggttaaaataaccgtaagttatagctgcaacattccatgttaattagtgggaaactttctagacaatttggaagactttcttatatctcttgctttagtttaaaaaatttgggaagtaggaaagagacaaataatcctctttgaagattgaattattaggaattattaagagaaggtattatctaagggtatagtggttagctacgtaggctctgaatcaaacagacctgccacaaaggtctcccaagctttttagatttgtgtttgaggaattttgtataatctttattagacttgggttcctctactaaaaaacaggataaccgtagggcttctctactagaactatgagcctaacagattcattaaagaatagctcctatgtaccatttaatagattgaatcattttcaaaaatgcttattactgacaaagaatcactaatatatacatatgagaaacttaaatacatattagaatacataactgaaaggatattattgaacacctgctgtatcctgagcactctgctagccactggggatatggacatatgtaaaaatagagatggtccctagcctaatgtaagaggcataaagagttataacgctacagtacattcttggtgagaatgtgaatagtataggatttttggaaaatagtatatagagagtcttttaaaaattaaaaaataggacaacccaacgatccagcaatcccatttctgggtgtatatccagaggaattgaaagcagtatgctgaagagttgtctccactcccatgttcatttaagtactattgataatagccaaggtatagaattaacctaattgtttatcaacagataagtagataaagaaaatgtggtatattacacaatggaatactatacagccttaaaaaagaagaaaattctatcatttgcgacaacatggataaacctagataatattgtgctaagtgaaatgagccagacccagaaagatgaatatcatatgatgtcatttatatgttgaagctgaaaaaagcagatctcaacaaaactcagagtagaaagtgttaacagaggctgcgggttgaggggaagtgggatggggaatctggagatgttgatcaaagagtactcagttagactaaaggaacacaatttagtgatctattgcactgcatgttgaccacagttaataataacatatagtagatttcaaaattgctaaagaattgatttctaatgttctcaccacaaaaaataaaggataagtcagtaaggtaaaggatatgttaattagcttcatttactctttctacaatgtatgcatatatcaaaacatcacattgtgccccataaatatatgcaattaatgtttgtcattttaagataaataaataggtatttttttgtaaaaaaaaaaagttttaatgctctataaggagcgcatgcaattgattatcacagcataatgatttaacatatttggatggtcctcaaagattataccataaaaacttgatgagatgatgagatgctgctggtctacattatgacttttgcccactgtaagagtgataggtggaaatgagtcactaagctagtggatgagtctaggtctatgttaaacatgtgctttaattttgttttactttgcaattttagctaagtgcagagtgattgctgctatagtagtaaataatgcaatgtattactctaatagtgataaaattcagtggtacatgcatctactcctatgtatgaagttccccttaaatgtagcagcttaaagcaacaataaacacttatttcatatactttgtttgagttaggaataattagcaggttagctaacttggggtatctcatgagattttactcaagatgccagctagagatgaagtaattggaaggcttgtctggcattggaggctctacttcctacatgatgcactcacatatcaagcaagttagctgtggttgcaggagggaggcctcagttccttgcaatgtgaaacttctcatagggaagcttgagtgtttttgcataatggctgctggcttcccccagaataagtgatcccaaagggctcagaacagaagctgcatggtctttaattatctaacctgataagtcatactccatcatttatgcaatatctcgtgattatacatgtaagccaaactcagtgtggtagaggaataaataattagtatggataacaggaggtgagaataatttggacccattttagaggctggcaaccatagtaaaaattttttaaacacaagaattacatgtatatgatgtattgggatgaactggaaaaatgtggaagtatacaaatgaggtttggtgaaaacaatcttttttatatattatataactttggatataattatataagtattaggacaaatatgaattggataaaactttcaaatacaatctctttggttatgattagtgagaaacttgaacttcccattgagaaggaacctatttttaagaactcatcttatgcttgaaagggttacgtgaaatatctgatcaagacttttttaatgatgatcttttcaaattcttgataaacatctttaacgagaaacttcactcatacgagtaggtaataaaataatgtaaatcattttataacaatttaaaacatataccaaattatgttcaaagattgtaacagctctttcttttcaatttattgtggaaatgtgaatggattaaaaatccaatccatgtttttcccgtcaggtgtttcaaaataataatgaagctctaatttacaaaatgcactgccttattggattagaggcccctacaagaagcttggatgactccaaaaaagcacatccgacaaatctctctaaaaacaccacagacaacaggcaggcaaatcaatatatgagacttagatttcaggctgctggctggacttgtgcatgtcaggaatccttgagtgtcattgccaggcacagcaccctctacaaattgcactttagctctacatcacaccctgtaagaagctcagtggtgcaccttatgcacaaagggaaggtctgtatgtggctgctggctcttgagacatatggccagatggcagttcttgtcttcgaacaagtcacgcgtcaaggtggagcagcagatactggatgctggtcatcattttcacagccattaaggaccatgggcctactcagtagttcctctcagggctaggctaccttctgtgaaagcccagagtctctgctcatagctggatgtggccatccggggactctggccaattaggcattggtttgctctacctctatccccagctacctgggattcatattttttgtcaaatctataactcattcatatcacatgaataacattttattttaagagtctgataaatcaattttaacctataatcctggcacctttaaagttctgaaagcctctcaaagttttcagtaatactgaattctatgaataaacttatgttcaatagtaccatatgttaatttaggtatttgcagatgtattttaaaacatacttcataagaacatttcatgcagtgggtttctaacttggctcatcatgaaactcctctgggcagaattgtatgattttagatattgatagttagccattgttagtaagcctcttgcaatagcaagaatcaaaattttaatttaaattcaaaaatccaggcttacttcagatacagaaaaatccagatgcaccgaaaatgacatcaagttattggctggcactctctctatatttctgctgcctctttttatagggagtcaaggctgactacctatttttacactatgtttagcatggagaggttgcctctttttcaatagcttcaacaaaaggctcagtgttgagtctcattgccctgtttctgaggaatgctcagactggccagaactgtgtcatatccctactcaggtaacgaaggggatatagccaaactcattcaaaccatatggctaagatagaggagaggtataatgcctcaaaagaaaaatgggatgctgtaatcaaaagggaaatggttacttaacaaccttcccccctcctggctctcctccaaatgcacgatgtttgttaatctgaatttcaaaggagtaggactttccatctatattttgaaagagtcccccagaaattgaaggaccgctggtctactttatatcatagccttatcatttttagatacataggaaaatggatagaaaactaattagaattcttctcttactgaaactcagttgatatactgagcttcatagtcatactaccaagatcactagcagaaagtgtgtgaaaaactgtctttatgtgaagggaactatcatctaagaaatgtagtgtcactcaatgggaacgcccacagagtaaattcttgttaatgtcatttcttggtaagttgatgttcttccttccatcagattgtaaagactgttcatctaattatttttccttttttactctggctgctgggaagcccaaagaaaaagttattgttttgccatagtaataatataagtctttgtggctaacaaatcctttttctcctttcttatgactattattcagtgtgtaattttgcagtagtagtataagccacactaaatcatactgggaggagaaatcagaaaattttaattaattttcataattgagaaatgaattcataaaaataaaatatcatcacatagagctgtgtgtataactgaaaggcaaaaagaacactgatttcattttacaatctttaagtatttctaatgaattaagttaaataaatcttgctgagcacctactatgtgttagaatctgaaggaaatatagggataaaaaaggtgactttccttcaaagggattgacaaataataacgataaataaagcatatgaaaataacttcaaacagtacagaatatctcaatgagtataaaaggatatgtttattagacaaaacaacaaaccttggtagacagcttcctagagctaatttggttattacttctggataggctgaatatattggttcaaggtatttctccttcggtctccagcttaaattagcattcttaaatgattagtgatggcgtggctaatgaagaaaaagctcaggatgaggcaggggccctactcctgatttttggctctgccatttaacaactgctgtaggtccttcagcaagttccgttggcccttccaccctctttctccatcaatcaaacggagatgatggccacacctaacctgtatcgtgatgataaggattaaatggaacggtttctataaaagagtggaagcatcaataagaatgtgtgttattcatatttttttggccttcaagatcttccctataactctcctgtagcagatattatatccccaaaaatagaaataatatctgttatctcactcattctcagagatttgggaaggcctattagcaaatatctctcaatatctggaatagctcagagtctctaagaacatattatcttacattcccttttctttctccattcccagacaccgcaccaatgcctggatgtagcctcatggcctaagatgggaagttctcagttgccaactcctgtctgagtttgctctgccctggaatatctggcttgtattttcctcttattataaattttcatttatttatgaaagagttttaaatgatctgatgccccacaaaatgttcaagttcatctgtagattgtttcttgaagaagaaaacactaaatatgtgacataaaatagtcagcagtagcttccagtttatcccaaattctgaaactgcacagaggtttgagagatttcagtactgggaaataggccatttacccattaactgactgttgacaccagggacatttggttcttggcccaactgtacctgcagaactagcaacgtaagaaatgttcaaaacgttccctctcattctgtctcatattgaaattaaggtaaattatactcttttctaaagcaaatgtcctaacatctaacaagcaagtaaaagatggtatagactccctacactgtttatttgaatgatgcctgtagataacaatgagaatgcgttttttttttagtgtattcctctattggtgtcctttggcctttttaacagggtcacctaaaatggatgaattttctcattgtgtcaatgcctgtctctgacctagaaggagttatagggctaattggctgtgcagcatttatgcagcatcctggtgcatcagtagaaattgtcaagaatggcctatttagtttgttgttgattcaagctcatcttttgtttaggacctggtccttaaggaaattatttggcattcaaatcaaacactcataactgatggaaacgtctgatgacaattcacatcatcctaggaggcctttacacttactacactgatttgctaaatgtgtttacatttaattaaagaaaactctcttcaaccaggagaaagttgctgagtgagaaactcaattgtttggaaatttgcatctcttccaacaaacaaaaagaaacaaaatttaaataccatcttcttaaaagaaaattggtttgcaaagaaagaagaaaacaacttgatgatgattttgtgtctctctcaaattcaagtttatatctacaattccaaatgaagtactagttgtttttacctcattttggggccagaagtggctttcagagcctgagtagactcacacaataatctcctctgtggttttattcttcctttcctcctcttctttctcctttctccttttttcttggaagaagcttagagccagtgaatgagactcgaattctgttcgtactgcacattaatagcacaaatttaaaacactccactcctgtcaaactattttttttaatctggaaaatggcaggtgataatgactatctcataaaatgtatgtgaggctcagatgaaataatgaatataaaaagatcttctccgaaaagttgcctctttatgaatagaactagtgacttatccttaaagaaataatttcaaaattatcaattcttgctgtcacggaggcctttctttatctcaagacaaatagatctgctttattcatttaagccagttcctaccagtctgtcctcagatatgaaacaactggtgcctaaacttcttctcatctttgccttgaatttagtaagttttcatatcacagtgataataagaatatgtgtatcactgtatcttcacatcaatacattttgaaaacatgtactgagtatttcttgggtgccaaatattgtactacttaatataattaactcctccaacaattataatacaagaactattcataaacccattttaaaaatgaagaaattgaagtttgtagtactgacccaaggtcgcacagctggtgagactgagttgcagtaagaataggattctaattagttttctatccattttcttatgtatctaaaaaatgataagtagatataaagtatgatataaagtagaccagtggttcttccatttctgggggactctttcaaaatatagatagaaagtcctactcctttgaaattcagatcaacaaacataatggatttggaggggagccaggagggaggaaggttgttaagggcccaggtcaatatgcagttttatttgtctgattctgtgcgcactgtctgccttcagttgatagaagtagctgtcacctttcagatgcgtgtctattggatagttatcacagaaagagaccttaactagggtccattagcctccaggggatccttgagatgggctttgggaatctgagaaacccctgaaattgagtgcaatacattgtagtggctgagtatgtttcacagattctcgaatcagactccaaaatgttaagacccaagaagatactctagagtacatttagcaactttgatctttatcaaaagcaaccttttccctaaacttggcattaataacaattgacttttcagctataccttcaaaatcagacctgttaatatattacagatataacaagaaaaagggagacttacagctaaggagcagggtgtgggccagtagatagaaaattactaaaaggaaacatcacagacaaggggagattctgggccgggccagtagctcgggacgggcatggtgccttacgcctgtaatcctagcagtttgggaggccaaggcaggcagattgcctgagctctggagttggaacccagcctgggcaacacggtgaaaccctgtgtctactaaaaatacaaaaaaaattagccaggcatggcagtgtgtgcctgtagtcccagctactcaggaggcaggggcacaagaattgcttgaacccgggaagcagaggttgcagtgaaccaacatcacactactgcactccagcctgggtgacggagcaagactccctctctctaaaaagaaaagtgggagggagagattctggctaaactgatctaataggattcttgctgaaggcaagtccaaggtgatcagacattgcctggggacagtgaaagataaacaaccgaatcagatattgagggtgataagacattgaagatgggagatcaaggctaaactgatttagcaggatttttgcttaagtagaataggttagagacaaacacagaaacctaaaaatcaggagctagttgagaagagtgttcagaggaggccgatgaggattttgtccaggagagacttgcagcatggggtggagagccagagtgtagaaaccatcctccaaggttcagtcccttttgtgggaaactgtctgggcaagatcatggagagcttgataccatggaactgccagaaaatgggaaaaaagcaaacaaatcttttttcccctgtagcattgaccagtcaggaaaagaattgcagaagcagagtcgggggaagagtagggacttccagttctctcaaagtgcatgagttgagaactagcttgagaaacagtgcagtggatccaggccaagacactagagtcagaatacttaggtttatatcctggttcccctcctggctaactctacaacatatgaaggttttgtcctctcacagccttggatctcttacctgacaaaaataatgggggacaggggacaaaaatcataaataatttgtgaaattgttatgtaaattaaatgagctgactcatatacacgtcagaatggtacctggcacatacattaatgttaccaataataacagcaatcaatattattaatgtagacataagtggaaactttatatgtagaagagctctctgtaaataaaagaaaataacctttattaccattagtgaattggtaaatctctaccctgatgctcttaatgccaccttttatttttaatagcatttttaagtttatatgctcatgttccaccaaaagccttaattttaaatgagcattttatgcctttggtggtatcttaccatcaggaggtgattgtggtggccatttttattctttgcatgcactttttatactcagtttaatgcagagaacagagccagagtaattatctcctatttttcatttacatagctatcactcaatgccagtggttttagcagtacaaaatctgttttatctgaaatggaatccatttaataacaccaagaacttatttgtataattgactaacaattgaaggcaaacctgggaacagaaagaggcagagttacctatactgagaaccatgtgtatgataatggaagtctctttttttcagtcttgaaggattaaaaagagattttaaaatgttaagtgaatttgtaatagaaacagtgggaaaggtatcattttatatttgagctcctacaaaagccttaggaaatagcaaatcagccatttgggtttaggtggttcatttttattctgtcctttgtcttgcaaatgaaggttcctagaagagagtgttcttctcaaataaaataagctttagaattgacctcagaaacaggttaaactgctgaatcagattaagcctgcctctgagctgtttcttgggctccattttctttccctgtcactagagtaccctgactcttggttttctagttggtacttggtaaaagtctgtttccctagagatcaaatggattgagtgcccaggagaatcctgtacatgagtgacgccagccaagtaaagaggataggaaggagtgaggatcctagttcactcaaggcagcatggtttatctgaaggaaacaatcttggctctcagctccacatccttgcctgatactttggtttttaaagggcatttgaaaacctggaaatcttttttcaattatgtaaaatcttcgcattttaaaaactgttctttacaatttcaaacatatttaaaagcagaaaatagtattcaatgaaacctcatatacctatgatggggctccggaaacactaccccagaatagccctcattgacatatttaatattttaaactgaaaatatttaagaaaaaggcagaagcaggaaggcctttctgaccttcccccatccttctcccctgaagaggtcatagaaaccaggaagatttttctgacctttccctggaggaccataagactcttattaagtaagaggtgccttcccatagaaaaggaacgtccttacctccaaagatgcagagacacagacaaagaagaatctgaacaaataggccttgctaagtttcccccagtttatttgtgtgtttgtttactgagacaggttctcactctgttacccagctggagtgcagtgtcactatcatagcttattgcagcctggaccatttggactcaagtggtcatcctacctcagccccttgagtaactaggactacaggtgtgcatcatcatatccagctaatttgttattttttgtagagacagggtctcagtatgttgtccaggctggtctcgaacttctggctttgagcaatcttctggcgtcttccttccaatacgccgggattacaggtatgagcaatggcacctgaccttcctgacaacccccagttttttaccattagaccacacctcttttgccctaccatatttctggatgacaatccattcttcatcaaccctaccataaaaaaaaaaaagttcagaaacagtaagaaaaagaaacttaaataaatgtccttataaaggcccctgtgacatgtcaaaattatattgcaaaaagcaaatgtgtatgctcttctcttgttaatctgtcattttttataaggaccttagccatgaggtaagggtgtaagaaaaaatatttttctccccatccctcattacccagcttcaaaacttgttaactcatggtttttcctgtctcactcctcccctctgccttgattattttgaagcaaactccagatatcatattattttatccataataatttcagtagatttctctaaatgtcggaggctctcttcatgaaaaaacaacaagcaaaacactgcattttttaattattaaatttttagtcaacgttcacatattcttaatgcttttataattttctttaagtacatatctatttctccctttatcctctctcttatatgagttcgtttgaattaagatccaaataaactagcgtggtggtgcgtgcctgtgagtgcctgcagtcccagcaactcaggaggctgaagcaggagaattgcttgagccaggagttcttccagtctaggctgagcaaaatagtgagaaccctatctcttacaatttttttttaatcctactaaaagcaattgcaattgtttgctatgtctttcaggtcttttatttttaatctattaatatgtcctatcttttctcatttatttctcttttctttggtaattaatttgttaaagaatctgcatcattttgcgtaaattttttcacaatttggattttgcttcttttggtgttaactgacatatctgcccttcccttgatttgcagtatataaaaacaattagatataaaggcttaattaattctgatagattttttggtgggggcaagaatatgtgtacagccgtcaatgcttttgtatacttctatcttgatgcatgtgggctgtggatgcctgtcttaaagtaatgctacctctactgatgatcattgtctgttattttactagggaataaaaaacaaaaccaaaacaaatatctctggacagcatcatcacaagcttatgactctaccctagactttcttgctttgagccagggagggagtaggcaaagtgtgactcagtgggattaaatcagcaaaattagtaatattttatttatttattcattttatttattttttaataattttttgagacagagttttactctgtcacccaggctaaagtgcagtggtgcaatgtcagctcactgcaacctcagcctccagagttcaagggattcttctgcctcagcctcaaagagtagctgggattacagaggtgcaccaccacgcccagctaatttttgtatttttagtaggctggtcttgaactcctggcctcaagtgatttgcccacctcagcttcccaaagtgctgggattacagatgtgagccaccacacctggccataattagcatattttgaaaacaataataactaagatttcaccgtatttactgtgttctgcctcaagtcatttgtcatttattgactatatatctgtctccttgattgtaaatttcttaagaatagagactgtatcaagtttaaccattgtatccccaacatctagaagcatcagctgagatgttgtagtgagaggtgaagccagctggacttctgggtcgggtggggacttggagaacttttctgtcttacaagaggattgtaaaatgcaccaatcagcactctgtagctaggattgtaaaacgcactgatcagtgctctgtggctagctaggggtttgtaaaatgtgccaatcagtgctctgtggctagttagaggtgtgtaaaatggaccaatcagcactctgtagaatggaccgatcagcactcagtaaactggaccaatcagtgctctgtaaaatggacccatcagcagggtgtgggcggggacaaataagggaataaagctgccctacaccccacccccccataagccagcagtggcaacctgcttgggtccccttccctgctgtggaagctttgttctttcacaataagtcttgctgctgctcactctttgggtccctgccacctttaagagctgtaacactcactgtgaaggtccgtggcttcattcttgaagtccgcgagaccaagaacccaccagaaggaaccaactgtggatgcagtgggatatcgatagatacttgatgggtagatgaatgaatgtgagagtgaatgagtaatttaatgagtaaatggattaatgcatgctatgacagatgctgtgctttcaatcttttggagtacacagataagtaaataacgcactagtcatctcttgctacataacaaattaatgcaaaaattagcagattaaaataatgaaaacatatcccagtttctatgggcaagaaattcaggagaagcttaactagctggttctggcttaaggtccatcaggtggcagttgagatgtctgctggggctgtagcgattttcaggcttgagtagagccagagaatacatttccaacattcctccttcatgtggctattggcagaaagccctctttccctgccagctgttctttgacaggtgaaccactgcataggaatgcttgagtgtccttacaacatggcttctcccattgtaagtgatgtaagagagagcaagaaggaggccagagtgcctttgataacttagtctcagaagtcatgcatgttactcctaccttactgtgttcattagaaatgagtcactaattccagcccacactcaatgggagggtaatcaggctacaccctttgaaaggagttctaaaggattttttgatatattttaaaacaccacaggtaataattaccacaaagtacaacaaagactacagtaaagaattgtccaaagtcatttagctgtaaatggaatgctactgtagaggaatacgcagtttattaagggctttgatctatctgggctaaaatcccagctagttctattgttagctgaatgcatggccttaggtaaattactttctttctttgggtcacatttttgacaactgaaaaagtgttaccaaaacaccaggaggtcggtctagggctccttgctcaccacacagaaaaccaattactgagacaatgagtattgccacagaagaaggtgttttacttgggtgaagtcactcaaagagataggagatcagtttgaaatccgtctttcccagctgactgaaattcggggtttatatagctagagaggtgatgtagctgcgtgcaggggaaacagaaattgaggaggggtgaggaagtcatcatgatggatgaggggtctgcctcttgtttgtatgctgtgatctagagagtttcagcagctccttttctgaggaaggaactcagacaaggcaagtgtaagttacaaattgtaagactacagagggttaatgtcttgtttatttaaaactgtcaatatcggttccgtggaacagttgggccagttttaaaagtagaggattaaacttgtgcataatggtagtaataataaaataaaaccacctttattaaatacatggtatagtgccaacattcgaagtacaatatgtgacgtattcattttaatcctcatgattgccactatagtattgttttagagacaaagaaactgagacctaaggagattaagtaacttgcccaatgtcacccactggtggcaacagaatctagactctggcaattgcaatttcatgttatagttcagttttaaacccttgctccttaacttgttgtttggggctggtagcatgagcatcaccttggagcctggagggaaaacagagtcttaggccgcactccaggcctcttgaagcagagtctgcattttaacatgagccccagctgcttcagaggcacttaaaacttgggagccattgctctaatgacacatgctattgctgtctctaagaagacttccagtcatagaataattctaaattctgtacatttaataaccatgtgaaagctatgcacataaaagacaagggaactttgggctcgttaatataacgaggttgttggtgtttccacacctcccttttcctgacaattttcaacaaaattaagaaccagtcagactttaaaaaggaaagttttagattgtgcttttaataattagactaataagcaactaagctgggccacaaagaggtttgggaaaatttgtcttctccacatgcagaagaaaacaagttttattgttaaaacccaaaaaatatcaacaggccatgagctgggcaagcgagtcaattttgctaaacagtattgaacggaataatgcagaaactggggtaaagtttatagtcttagatgctcagaagtaagtatgtaaaaagtaatgctgtggccatcatttttcattgatagatatattttcccgaatccgatgtcgataagttgtgctggtgattctccacctgctgtacattattatcacctgggaaggtcctaaactatactgacacctgggcctaaccccctagaaatcctgagttcatggtacgcagtgaagccccatcctcacaagcttttaaaaagttgcccatatggctctcatttacaactggagttgagaaccactgacctagagaattactgtgagctatggtttgtctttgtacttcttgatttctcagttaatgttaactgaatgagcatagtgaagataaaatgagacatataatcacctcttacctattgtcctggtagacttactggttaggtcctttagttccaagcacctaattacttgtaagccaaataaaagggaaagatgatttattgaaagaaagtatgttattccataaagttgaagaaagcactatccaataaaaatgtgaaccattgatctaattttaaatttctagtaaccatgataagaaaaaggataccaagaaacaggtgaaattttaattttaatagtacattttatttgaatatatccttatattactttaacatgtgttcagtataacaaatattaagaagtactgtatttacattctttttttcatatgaagtctttgaaattcggtgcatattttatttttaaacacaactaaactcagactagccaatttcatgtcagtttactttggaagtgattccagagatttggaataaagagtagaattacagagaagtgggaagagatgtgttatcacactgtccacacctgcaggtgtctggtgtttggccccatggaactttctaagtgtctgagaactatctacctagggatgaacacagaaaacttttatctatcaccctttgtgcaaaggtggccccatggccctaactgccccatactgtacttttgggctgctcattctaaggaccaagcaagtcccacgggggtcccttgcagaggcatcaaagaaggctgagcgtaggaagtgagtggggaagtggtgcagccccaaagcttggagctgttaacgtgcacctgagggaagctagtcagagcaaagaggaaatacttgctgctgcagcagtggctggaataggagtggaactgtgaggatctgagtggcacaagagatgtcctatatattaggcaatgccaattctctaggaagttaatagcgttgcttaaaaagtaagttttgtgggccaggcgccgtggctcacgcctgtaatcttagtactttgggagggcgaggcaggtggatcatttgaggttaggagttcgagaccagcctggccagcatggtgaaaccccatctctactaaaaatacaaaaattagccaggcgtcatggcgcatgcctgtaatcccagctacttggtaggatgaggcaggagaaacgcttgaacccgggaagcggaagttgcagtgagctgagactgtgccactgcactccagcctccctctccagaggaagactccatctcagaaaaaaatgaataagttttgtgaatttaaagtttgtgaaaatgtatagtttctgtattgcatgaattgtcacaatttttttgaagactttacttttgagagcaatgtagtttctcagaaaaacacacgtacagcctcccccactatcaacatctcccatcagagtcacacaatggatgaacctgtatcgatacatcattatcacccaaagtcaatactttacgttagggttcactcttggtgtcatacattctataggtttggacaaatgcatgatgtcgtgtccgctattatagtctcatacagagtattttcactgctataaaaatcccccatgctctgcctatccatccctctctctcccctaaatccaaacaaataaaatgtatttattgctcatgtctcccgacaaatatagattggctgagaaagattatgttccttagggatcagggatgaatgagtcgccatcattttgtgatgccaacaagcatttaccaatgaataagagtgcatggaaagtggtgtaacaactctgaaatgcatctcttctactttttattagccaaagccagtcatgtgattatgactaattgcaggacggtaaagagtaacctgtgatgtgaaagtgtagcctgtgaagaactggaaatagctgtggtacatccgtaaataaaatctccctttcaacatagaaataaaaaacccaatttgaccgaatcatccaaatgcacaatttcaccatgaaaggcttcagaaaaacaataacaactatttttagagcacctactatatggtcaggtggtacaattactaaaaagacaccggaaaagattttgtttctatcactggctgaagtccgcaaaggaaaaataaaacctgttcatcaagctacaggcacatgccaccacgcccagctaatttttgtactattagagacgggtttcaccatattggccaggatggtcttgatctcttgacctcgtgatttgcccgcctcagcatcccaaagtgctgggattacaggcatgagccactgcaccctgccaagatagatttttctctaaaaaatgtgcaaatctcccaataccctataggataatatgttaaaaggtaggttgaaaatgcatatgactaagcgaaagaagccaaactgaaaagcctgtatactgtatgattccaactatgtgacattctggaaaaggcaacactatggagacagtaaaaagatcaaggattgtttggagttaggggagagagagggatgaataggcagaacatggggggatttttatagcagtgaaaaggtaaatcataaccaaatgttcaatcaaatgcaaaatggcagaacctgctatttagagcagtgtttctcaattgttcatcaaacattgggcttcattgttcaaatgcagattcctggagtccaacccatacctactgacataatgtttgagaatctgggagtcttaattttatacaaggtacccacacaattagtatacttaataaagatatcacaattcgaatgaatgtaattgcaaaatctattgcagaagacctccttttatagggtgactacaacactataaatatcatcctggtaatctcgtgtatatttacaattttaatttatgattcatttatgcatttgcttatttatcaaatttttttagagttcctactatgcacaatcctctacttactgggcaattcattgtaaaataagatgcaatctcttgtctaagaatgctgagtccagttgacagaatgtagttataattgagcttgatgacagtcaagttacataatgtaaagcggtttctgagagccaagaggaagacatccctgactatgactgtagatagggtctcttaggaaggaagtaggccaaatcatttttaatataatacacacaaagaagttaggtcaccttaataaaccctgccagattatgttttctatacacattatttttaatgattcatgacaccttattatctttgagctattaaatatactttctctctcctccccagcaaatgatgccccttaaattgatcaaccctttatttcctttgtatgttcccagtgacattcaggcaacatatataaatgcagtaattgttcagctgactcaagtatgtgatcctgtatatgcagtagaacacttttgtcttaatggagcagaaacaattgatttgaattgattctataccctcccctcaccctgccctggggtgagaaaagatgtaacttgctcataactgtctactgagtacatggaagagaaggttatgtgaaggaactttaagttatactggactttgagggatcgaagtgctttcctcacctagaaaaggtcacttatgtggtaattgctagaagactgtgaagctgaacatctaaaaactgtggtgcataattctcacatctcagttctgcccaggactcacttgggaaaagaacatttctgatgaatgaactaaagaggtgaaccctacctagaatatcttagagcaaaccttgccttaaacaatattaagacaaagtagtttttaattgtatagtattcttgtctttgcttcttaatatggttagcaattaccatttattgatgaattattaatgatcttgtatataaattagaaatattcatgctccatttatgcatttgcctatttatctgacattttctgaatgtttactatgtataagacactgcttaggtactgagcaattcatataaaataagatttatggcatttgttgtttcagtagcacatagcactgcttgacacttggtgtgaaaatgttgcctaatgcgttactacactaagggctttttcatatagaaataaattacacacagtatgaactgcataaccaaccaaatatgatataaaagaagactataaaatagacatacaaaaatatatgcactctaggccggggacaggggttcacacctataatcccagcactttgggagctgagttgggagaattgcttgagcctaggagtttgagaccggcctgtacaacatggtgatacccagtctctacaaaaaatacaaaaattagctggatatggtggtgcgcatgtgtagtcccagctactcaggagctgaggtgggacgattgcttgagcctgggaagtagagattgcagtgagccgagattgtgccactgcaccccagctgagtgagagagtgagactctggctcagaaaaaaaaaaataataaaatatatatatatacacacacatgcacacacacacacacacaccagtggtcaatgatatctccatatagtgcctatgtatatcatctcagggagcttcagtctttctgcctctgtagcagccagtactgactatctcatagggtgcagaggccccctatgcatagcctacaatacttctagtaccccaaaaaaatattttcttttaaaatcagaaaaaaaactgacctttcaggttgaagaaaatgtttaagtatatatattaatatgtgcatccttatatttatactgttgtaaatgcattgtaaatgcaattgtaaaatgtaatttttaactttttttttggaagaaagagcccatgaaagcaaaagtgtcttgagcccttgagggttctcttatagccagggcagcagaaacaggggtcgtctttgtccctgttgcaggggtgaaggaaaacttcccctttgtcctatgaaggtttgctgaaaaatcaactgacaaaaggcagattaataggagaaaaagcatacaaaatttattaatgtacatggaggaggcaggcagtagtcagagtaattatccaataacccagtgtattatagaaggaagcttatataccctttttcacaggggagagtggagatggggagtgtagaaaattcttttaggggcagtaaatcatgagggagaatggatggacatgggaggtgggaggcagatatcatgagaaggcgaatggtggagtcgcacaggaacaaaagttgtctcattatgcagatagagtcctccatgtcatctcttggagttgccctcagaaaaataaatgaaaagtgtccgggcctggtgatgactaaccctagtctcttctctagttattgatctttcctagttatttgatgagaccccaagggaggagatctcaagacaattgcatttcttttggaaagaagctttgctggtcagataaaaagaattccagagagtccctcctgatgcttctggaaagaagatcagagagtcaggtagaggggaataggtcagaaagggaccttggttctgaggcttacttcttagggcctttcgattttcaaaggcactcagcatgcccaggtgccttgtgttggggcatcattttctgtgccccaacataaggggcactcaccgcgtgagtcttctaggactgcagtaacaaactgccacacactggcaggttacaacaatggaagtttatttccttacaggtctggaggttagaagtccaaattcaaggagtaaaccatgctggttccttctgagggagggtcagctttctgggatggccagaggcccttggtgttcctgggcttgcacctgtacctttgcagtcctgcctgtcatcacacagtgttctccctgtgtctctctaaagacccatcttaattacctctgtaaagaccctatttccaagtaaggtcacattcacaggtctaacttatcttggagtggggagacatcatgcaatttacaagagattgtttacataagttcatcaggagaggactaaacaaagtgtgatggcatggattctatcgctcttcagggcagagaatgcgtgatgctaatgaaagtcttcctaggtgggtgatggagaccaggcctgttctctccaggcaggctctgaaatcttatggaagaggcgcaaaccagggcagcaggcccactcccttacaggacaactcggttcaagtggctccggtaacttctctttttcttccagtctcctcagttttggggaaatcttacctccccccttgtttctttcaggcagcagtggtttctcttcaaatcctcctttcatcttatttacaacagacctatttaactcaaagccagcatctttagtaacagaaaaactcgtttcctctatctaggtcagggaaggcttaatgtctaaaccttctgcaagagggaggggtaatatatgccatcctgctatgcaatgaaggaaaggaaatcagaccaaacccagtcaaaccaaccacaccaaatgcaattgctgcgttcaagtgaagcaaatggatgacgtgcactttgacattagcaccatgccatagaggaaagaaaagttattttttccccaagatgaaaaatggtaaacatagtaggaggtggtgtttgaactgggccttgaagagcaaatagaaaatttctgggcacagagaggtaactgctggggcaggtgcatgaggagagccttccaggcaaaactgcagcaggcatggagatgccgagtgtgacgacacatgacttggtcacaaaatcgcagtctagtgtagctataggactagggtgtatgggacagcagaacaagagttgagcctagaaggggctgcttgttagatatcattttcccgtaactctaaacaagggcttactgaaaatcttctcctagaactgtctctgtcccagaaaactcacctggttaaattgatattataatgcagatttttcacaggtagaagtaggagcctattagttttctatgactgttgtaagaaattaccacaaccttagtggcttaaaacgatgtaaatgtattatctcactggaggttagaagttgaaatgggtctcatagtgctaaatcaacatgttggcagggcagtgttccaatctggacactctagaggagaatctgttttcttgcccttttcaagttttagagactgctccattccttagctcatgggcctctgtttgtcatcaaaaccagcaatggatggttcattcttcctcctttgcatcactcagacactctctcctgcctcacttttccacttaagggaatccatattatttcactgagtccagatggatcatctagaataatctctccatctcaaggtgagctaagtagcaatcttaactccacctatgactttagttctcccttgccatataatgaacaaactcatgggttctaggaattaggatgtggacatctctggggatgaagcattattctgtccgccaggaagaaataataaaatagaaacttcaggccaatgcatctctgccatgtgaagacgttaaggggtagtttgttttaggatttaatatacagcgtgagtaggtgactatagaaatcccattgtacagatctgggaacagatctgcagaagtgtcttcaaagtatgacatttcagcttccccagaattcttctcaatcatctctgtaaaggctgggacatcaaatccctgagtcatgcctgcagacgtgcaggttttttaagaacagaattattggtgcactcctctgccctatctttcttgtgtcttccctggtattttccgttgatagccttctgacacgtgtgtcttgctttacctacatcttactctaacattggcctcttgtgttcttttagaagcctcattacccaaagatctcattagaggggattagtaagtgaccacaattgagagaatggcactggcagcatctttattcaaaaggtaaattccactgtgcatggggagctaccatttagttacaagtagcaggagtgtctggcatcagaagtaatgcagcaatatatttatagcctttatagctcatgacacctaccctgcaaagccatacatggctaatagaatgcagctaggtgactacctgtgactatcatcccccaacacccctgacaatgactcaattgcagcttcttagagccaatcacctaatttatatcctaagcaagaggtgcagggaaaagaagtggattgtggcagtgtcatgccagtcatatttgagagtatgttgggacctgacataacccagtggttttggaaccatgactcatgcagccttactgtctaagacaaactgggttgcaccttaggcagcagctgaggttgttaactaccagagccacctacaagttgtccagcaccctgtgggcactaggaccagtagtaaggattctgcttaacagatctatgctgtttaaaagaaataccatcatatgaatagctttcttcatcacattcaagggagaatgaccaaatccttaataaaatgcctctttgaggtccccatcacttactcttgattataaatgctgcggggataagagaatttgccgtgttgaatattcaaggacttttctatccccgggaattttctctgctgtgtttgtaagaagaggattaaatttgcctttaataaagcactatggaatacttactatcatggcaccaacgtaaaagaaaaacatcttcctggcacacaagagaggggaaaaatgctcaattatgcaaatgcatgcccagaaattttacccatgtaagaataatatctgatgatgtcaactcaattcttctccagtcttaggttctctcttactcttcactctgctagtgtaaatacctaatgtaatgactcacaataaaacacagttgttgagccacttctccctgactttatcacaccagaaaatatggggttttagtgcagtaattctggactgaatttcaaagttacccaaattaacatatttgaccacagtgacctttccagcttgatttacttctgttccattaccaaatttctggcgctggccaatcaactcatcttctcctatctcttgagctttcaagcctcattgctttggctcatgccatcctcttgccctaaaatgccctccccattgtgttctgcctgtgtagctcacatagctttaaagggtcaccacaaattccacctcttattgaagttattcttgacccctatattcttgtggcaagtttttaatctgtgaaaatcacaacacttcacctccagtctttttccaggtacccacatcctgctttcaacctcttttgtgttgttagctgatgctagggaccacaaactgctggctcacagaataaacctatctcacagacgttttgaggcatcccatgcaggattgtaaaattagaatatcttaaaaatctaaacatctagacctttgaaagatgacaacagctaccaaaattgtgcttataattaatggtgcaacaattggctaaaactgagcagtagccatttctatatttaggaaatatgttcttcagtttgctaacgatcacattgtacattttgattacatccaacgagcttactcatttatgtcatttcattattgtttctctggggacgctgcaattaattacaaatttgcctttaccttttttgtttttcttttactgattgcttttgcctctcttctgctggctctccacatgtatactggaatgatcttaaagaaaacaagaaaggcaaaaaaccttgtaagaggtttttgtcacttcattggttaaaaccctctaaatatttttctttgaatttagagaaattacgtatttctatgctagcctccctcacctgagacttccctccctgttatgcgttgtgtttcaaccatcgttctttttctttttcttgatcatgccaagttttccactccttattcatttttttcttagacatttgttttccttctgaatcttcacatggatggttttttccatcatttaggtcttaggacttatttgaccaccccatataaaatcgccaggtacttagcctcaaaagaatttttttgtcccatcagcttaattacatacctaatgtaatgactgatagtaaatcttattttcttctactgcttatctaacatgattctacttaggtatttgactacctgtttttcctgtttcctttcaatagagtggaagctccaggatggcaggaacattgtctttttcaccagtttcccagtgcttagcctggtgcagagcaaccctaagtggacatttacaaagtcagcttactatttaataaatgtgtgcatctgcctgactcctggtttataatgtcatataatagacatttgtactttttctgcccaatgagtttgtaagcatcttgtaaataaatacctcgctttgcacatttaactaaacccattaaaagtacaaaacagttagctttttatagatgtatagtacagatctggcaatatctttattggatggttcaagagtggatttaaaaagccagaatgagggaatctgtgtgttagttttaaaactttcagataataataaccttggctcaaaaacaggaagtctgaactcacttctagctaagacagagtaccagatttatcctcttgcctaaaactaccattttaaaaaaataacagataaaatatatgaaacaatgattttcagtacactggatatcaggcagttaaggacataagttcctgagggatgggaaacagtgtgatccctatgattctgtgagtttactacataaataaatgcatgaaaagatgatcaacatgatctcagtcagtaggaaatgataattaaaaccaccctgcaatatcactacagacctattagaattgctaaaataaaaaagactgaccacaccaagtgtttacattgatacaaacaaattaagatgtgctaagaaaaatgtataataatacaatcactttagaaaacagcttgacagttccttagaagttagacatttaagaaaaactggaaccctgtgcactgctgttgggaatgtaaaatggtacagctgctgtggaaaacagtatgttggttcctataaaagtaaacatcaaattaccacatgattagggttgggcacggtggctcatgcctataatcccagtattttgggaggccaaggagggcggatcacctgaggtcaggagttcaagaccagcctggctaacatggtgaaaccctgtctcaactaaaaatacaaaaattagtttggtgtggttgcacacacttgtaatcgtagctacttgggaggctcaggcaggagaatcacttgaacctgggaggcagaggttgcagtaagctgggatcacgccattgcactctagcctgagtgacagtgagactctgcctcaaaaaaaaaaaaacaaaaaaaaaaaacaaacaaaaaaaacatgaataagcagttatacttctgggtacatatccaaaataattggcggcagggactcaagcgggtatttgtacaccagtgttgatggcagcaatattcacaatagtcaaaggatgaaaacaatacaaatgtcaattgatggatagacaaaatgtggtctatgcaatgaaatattcttctgtctaaaaaggaatgaaattctgagccatgctacaacacaaatgaaccttgaagtaccttgcaaagggtaataagccagctataaaaggacaaatattgtatgattccacttatatgtaatacctagagtggtcaaattcatagtgacagaaagttgaatgatggttgctggaggctggaggtagggagagaggaacgaggagttatttttaatgagcacagcatttcagtttgggaagatgaaaaagttatgtggatagatgctggtgatggttacgcaatcgtgctaacatgcttaataccactgaactatactcttacagtgattaaaattataaattttatgttgtgtatactttaccacaattaaaaagttatacatttatgtataatatctaagcattcattccacttctaggtttttatcctagagaaaagaaagtatacatctaaacaaaaacttgtacacaaatgttcatagcagttttacttgcagtagccaaatactggagacaatcaaaatatctaccaacaggtaaatgaataaacatatggtgatatgtccatagataaaatatacccagcaatgaaaaagaatggactatcaaggcaaacatcaactttgaggaatattaagataataatgctgaatgaaaaaaatacaaatgaaaaaggagtacactctatcatgacatttctatacaactttagaaaatgcagtctaatctgtagtgacagaaagcagttcgatggtggcttgtaggtttgtacgtgtgtgtcagaaggttgcaggaaatgatgacataagacatggtgggttgtgagtattccaaagagcccctagacacttttgggggtgggagatatgttcattatcttgattttggtgattttctcacagatacacacataaatcaaaactcactgaattgaatagtttaaatatgtgaagtttgttggatttcaattatacctgaatgaagagtttttaaaaatagtaaactgacacagtaccaatgcaacaatatctatatgtataggctggccttctgatccaaaagctgtttttatttatgaagggcacaatctgagacctggctcatattcacagtcatttgatcaaatggatcctggaaatcaccggctttaggagatagaatgcattcgtttggtgtccatgtatcttaatgaaaatgaatgataatgatttggaatttaatggattccttgcagtcgtattgaaatttaatagaaaattatatagtataacttgaaatcaatttaaattatctgaatgaataattaatatgtctgccataaaattgtctaacatctattatttaaaagcaaatgattcagaattaagtttactaaaactctggctctcttgaagtgtaatgttaaaacatcctcctctcttgctcctccttagacaaatcttggaatagatgaaagaataaagtatatgctctacttattgaaaaaatatgtttgtagcaagaaatactttgacatttttataaggcatattcataaacactatcacattattccttaggtagaaaaaaagtgtgaaataaataccgttctcctcattttacaaatgtaaagctttcaatatttgccaattataactcaggataaaatccagtcacttcatctcatgcatttctctccttgttttatactcagtatgtttgctgtcttttgctacaatcaaaatactaagtctcttcacacctaaaattcccttgaaatgctcttttgtgggcttaggatgcatttcccttgatttagttcagatgctgccttcatgtccccaccgtgaacttccttgaatcccattaaaacctggactccaaatactttttttaaattttttaaattttatttatttatttatttatttattttgagatggagtcttgctctgtcgcccaggctagagtgcagtggcctgatctcggctcactgcaagctccgcctcccgggttcatgccattctcctgccccagcctcccgagtagctgggactacaggcgcccgccaccacgcccagctaattttttgtatttttagtagagacagggatttcaccatgttagccagggccaaatactttttcatgatgttactccagatacattttttttattatacttgtcattgctactattgtacgttgattgtatgttcaggtgttaataacatattcatagatgattttatttgtgtaattcctgtgtcccatgtagaacgtatgctgtgatttgattttgttcacttttatccccactgtgtagcacaaggccaagcacaaacaggcatgtagtaaatatatatgaaaacaaatcccaccaagacaaagaacttagtgacttggccaagaaaaatcaactatgaatgctaacacagtcttctgacctgtgccctatcccttaacctacctgtcctctagcattgatcaggcattaagggaaatgacaatctatgcttttatgtccaacggaaggatttgtagattaatattacatttgaagtgcctaatatcctaaaacacgtcaaagacatctcacatagatgtcagtcactatggaagttaatttggtaagccagcttgtggaacaacatgctcttatactttaagtgatgattttgctatctaaaatgtatgtaggccttctgctggagaggaatgtagaatctatacttcttgcccaaatgcataactgattaagtagctgtgggaaaatgtggctttcagcccaaactgttcttatatgctctgacatttatcctgtgagttatttggttagatgtgagtagtataggtagacaactttctatttaactccaattccataaggttatgtgagcattaaaggaaataatagacaaaagcacttaggagtgtagaacctaatacgtgttcaaaaaatgttagttgttattattgttttcgtgcttaggagaaaatcagccagaagtgtacttggagacggatcctctcttcttcacatcaagcaaagataagttcccctaccattttttgagtcaaatttcccagggcgtttttttcagataggggctaatagatctttaggacctcaaattgctggaagatactatggcatgagtttgtcataggaagtgactagtaaaactatgcacacaatgataatacacaaataagaaaagtacattaatttttactcagaccatagattatgggagggaaggggatcctttgacaatcttctagttctcaaggaaattagaatctactatgtaacatattccaagataccaactgagtcaaagacaaacctaggattagaatttagacttctgacctcttactccaagagcctttctaatgtcctttaacttacccccttctatggtttattagttctcaaggattgccataacaaatcaacaaaaactgagtagaactgtatttcctgtaagttcttgaggctggaagtctgaaatcaaggcatcaatagagatgggtcctttggaggctctcagggagaatctgtttcatacctctccttggcttctggaggttgccacagtctttggtgttccttgatttgtaaatgcatcgctccaatttctgcttctgtcttcacgtcactttcacccttcagtgtgtctatatatctgtgtcttttctcttttaaggagagcagtgcttgagtttaaggtccaccttaatctagtataacctcatcataacggattatatctgcaaagacccaattttcaaataaggtcacaatccaaatggattccaggtggacatgaattcgggattatgctattcaactcacaatatatataaaattattttgacttattaaaatataatatgaagaacctaaaatcaagttttctctgttttgtgttgctatttagggataaacatgaaaagcaacaacatttataaaaacacgttcaaaatataactgtaaaacttcttctcatgctcaacatatatattctcaagttcattcttcttgaaacctacttccttccaaacctagccacttacaaaatgtttatgaaaggttttttccccctaaagctgcaaatgtcctttttatggtcaaactaatttctttttactttctcaagtctcttagtctcctttctctatgcctaaaaaacaataagcagaacaggatggctaaccatcccagtttgaacatgatgtcttgagtttagcattcaaaatcccgcatcctgggaaactccccaatcccaggaaaatggggacagttggtcaccctagcagagggtctcaggggaaagtgactcgagggtgtgaaagtgaagaagaggaccaagtagtattcatttgctaatttattatatttctgggattctttccttctggccttaggttacaggtacaatagaacattggttcaaatattgaagtgcaattgcctgcagttatgcctaagcaccaattacaggtcttatggtatgaatctttcatttaatggtcattatggatctgattatagatacctttcaaagctgaagagacatacaaagtatatagaaattggtcaagggtaggctaagggaaaaaatatcctctgggtaaaattatactaggttccttgaatgatctcattccatcattgatcttttgttcctaaattgctgtcattgcctgagtcactttaaacattttgaggaaaaacagcttttctgatctcatccccagaagtttaattggtctctggtgggggttaaaaaaaaaaaatctgtgttcatcagaagctaccccaggtgattctgataattaaccaactttgggaggaacagttttaaactactgtaatacctgggctacagatgaattatcaaaaagaaccacttctcccaaagcatttactagatgataactcccaccaatagaagtatggctacttgatttatagctaccttaagataaagcaatttcatacatatgtttgtgtatatgtacatacatacatacatatacgtacacacatacatgtgaacttcattattacttttttccagactctagtagtcatgtaatttgagaactataagtcctatcaaaaattatgatttttttctcagctttggcaagtatagactcaggaaccaagaacagatatttgtgataaagatcagtaagaagtcacatgagctgtgtatagttgccagaacccaaagcagttaaagggtgactggtgcaatccatgtcagctggacacagctggagtcatgtcaattccttgtccttccagactccactagctcaggagtgaaagtgttgcaatgttagttccaggacagggtggcagtgtggagaaggaagtctcagactttcagaaagggtcagaccctggaggaaggagaaggatcccgaggatgaaggcctggatgagtcaggcttgtacagagaacatggcttcgtgagatttgaccttttctaggttcttggggaggcctgtggatatggggtgggccaggtctggaagagcaggtggaggtatacatctttgcactggctacctctttgggactaagcagctgcacccccaagagcactgttggtttaccctgtggtaggaaagggagggctgcttgtcaaataatttgacaaaatattctctgtgaaatcagagatgtgcaccgcctgagacatctgagctcttgtctactgaaatggctgtggcaaaaatggaagcaaagaagccaaattagggtttcttcctgctcaattaggaaagagaatatttcaggtgatttagtcagtcagtactttagaatttttgctgagataaaatatggtcacgtgagagtagggaaagtataaaaggcccaggggaaaatagagaatagagaatgctatttcaatacagaaggagcaagactgaaattttaaaaagagtgagagaatactatttcaaggcctatacaaagagctgcacgtgaggggtggctatccgaaataaacaatttgaaggacatacttccttttagatgtaatttaaagagatatcagaccataataatgatctgccttccgttaagcctatagacaagtgaaaatgggaatgtatcaaagatttgggaacatttcagagacaagtcccagagttaccttctcagcccccatgtcttagaaatattcatgggcatgtttagcccagctaagacacaaatgtggcttatatgagaatgtatcaaagatttggggacatctcagagacaagtctcagagttaccttcccttctcagcccccatgtcttagaaataattatggacacttttagcacagccaagacacaaatgtggcttaaacttaaattggtattttatctttgctaacctttattgagcatatactatgtgccaggctctgttgctaaagttatgacatgcaccattttgtttattattgacaacaaatgatagtgtttttattactcccactttgccagtgagaatgagactgagactgagagagataaattaacttgtttaaggtcagggaactggagaaggacaaaccagagacataaatgtatatcttgaagactccaaaccaattgttcttacagcctacactatagaggttatggcattatgattcattaattgtataataaaaattctataaaggagagagaaaagagaggctgataaatgaatcatggccaataatttgaagtaggttgaagaaaagaggaaagaataagaaacatcctacagaataaggaaattaaaatataactcctatagctaatttaacttatgggagtgggcttaccttactggctttgtggggtgtggggatgtgcctcatatgtctctgtttgacgatggcatgaacagtaattttgaaaatggagaaagatatggagggtcatcatcttgagaatcacatctagataacaaagcttacatgggattatagaatctccaacacttacatctaattcattaaaaatatcatctaggggaggagaaatgatggggtatagtccaactataattcaatgaagagctactttaactgtgaaattgacattttatttcacgtgggtttttttcgttaaaattatatatgcttcagtttcactgattgaatagaaaaggtccccagtttaacatagaaattatataaaattttattttctttgctactgcatggcaattttgcagttttaaagcactggttttctaaaaattagcaaggtctttcttgctttatataacttgctatatataactattatagcagttagaaactcagtcacaacttttgaataagattcaggcaaatcgtgaactattaccctgtgtttcaagttgctccatctacaaaatgagtctggccaccctgtcccagcaatttacgcaaagaagagggcatgacataatgagtgattaatggatcagcggtctgccttgaatctctgatttctccatctgtgtcaagagatgtcttaggacattgaaatatttattaatgtttctaataatacttcatcaagtacttaggaatacctttggccttcggtgaatttttagaaatatttaaacagctgtatgaggtttttcagtgatttatatgtaggataccagctgacccaactgactggctgctaatgggctttccattagcttcatttagaaaaaagacttgtttgtcagtttgaaagaaatacacattatattaggccagtgcaaaagtaattgtggcttttgtcgttacttttaatacacttaatacattacaaagttaggaaagaatcaggatgctagattacacagggttagaacctagctgtatcacttactagcagtatacctttggacacagtacttaatctgcttgtgtctctgtttcctcatcttaaaaacaagaataatgacactgcatccagaattgttttaagaattgagtgaattcatgtaaagggcacataggaagtgctccacgaacattagttattacttttctcaccttaattggaactgaggtgcttttctacagagatataaaatatttttccacacctcttgaggaactgcaaagaactttaaatataccatgtctgactgaaggaaggaaccaacaagcatgtgatggatttgatagtgtgctgaatgcctgtaggaacaaggaaaatatatttggtacaaatattttaatttcctcaagaaatagaacctgttactgcagcaacagtcacacatctgactacaatgtgttcataaaataaaaggaaagagagagtagtcatagaaaccacaaaggggaaattatactctgagcagatttccaagtccctagttattaaataataaactgagatctcataaacatggaaatgtattctaaacataaagtactcaacttctataataatttaaatagtctaattgcttgccatattaaagaggtagtttttttcttctgatgaattataataaatagcatcatttcagtcaataaaaagggcattcaaatgaataaaagttttcttctcatgtttagagacccctctattgactaaagacaggttagtccattgcagtggaatcctagctccaacctcagcgacaaagctgatgcctagtacccttacaacatgattgaaggtattgttttgaaagtcttaaactctcttgaagcatattcaggaaagatctctgttcaaccaccttcttctacagctaaccaagaagggaggctccaaggtattcattaatacatagccttattgaccgggcttcttaagaatcaggattcttgctctaccctgaaaatacttggtatcctacaaactatctgcagacttgcttgattccgctttccctttctcttggtactgaactcaggcagattttatcaacagatgagagacagcaaaggcagagttcattgacttagcggctgcctatgaaaatcctcagctttaagtgtcagagctcacggataaggaagaaagagctaggaaaatactcactgggtaacaagaccttggatacactttccaaaagggtgctacctacgtgagtctattactgcaattactttcatcatgatgtgttctgcaatgtttatttagtgcctggagcctgccacacaatgatacatttgttacaagcatggttctaatgctgtgaacagtaaaaagaggttgatacaattatcattttattttactgatgaggaagctgaggcaggtgagacttagaggattttaataacgttttcaaggggcttgtaaacaactcataagttagtaaataaagcttccacccctttttttaaaaaattataatacccatgtacttaacctttatgccgataggtttctcagagtggggtcatcagagggcagcaacataatcgtctcctggaaactacatatgcaaattctcaggctccatcccagacctactgaatttgaaactcggggagtggaaccctatggttcaataagttcttcaggccatcctgatgcatggtcaagtttgaggaccactgctttatacctactacctcatgtttaaaaaataataataaagcaaaaacttttagtttgagactcagaaaatgatctcaaacaacctagctgagcttgctgtttcttacaagcctgtgattgtggagtttgcatggttcctttcaagaaagtataagttgtctagaaaaacttggagaagatccgacttctgaattcctgtcactatcctaaccatatagcaggcagatgatatggagaaaattggcttagtcttaaatgagaaagtgttttttaaaaaaatttttaatgttttgtgacaggtatcacggattaagaaattctatttatgtctttattcttctaatgaagtgcacagaggtaaaaagtaaccttccttatcctaagaatttgtgacagcttattccctttcaagggattagagcaatgcatatgctaataagcctgtagtggcaacattttgcttgtgaatatgacagtgtatcaaatgcatgttacatgtataatattggatatgccgtgataagaaaaatcagaggacccataatttccatctagggagtgtcaatcaatacaaagctaaaatgcagttcagggaaaatgtcattcttataatattctggcagagtaactgagaaaaaaaaaaatctctcagaatccctagattagtgagactctgttccaccagcgatggatttgatctattattgccgatcggtttttttgtagctatgtggctcttgtgaatgggtagaatgcttatttcccatttcaatgttttagaatgtttatgagtaggagcaagtatctaatttccttggcatttttaaaacaaaacgaaggcattttaaaaatgatgatttttgccgagttcagaactgtatcttttgtactcggcacctagcaattgcttggcaattatctgttggacaaatggccagtatttttctcattagttaggttataccataacccatagcccttgtgtagttctcactaggccagcataccctttgcagggccccattccaagactgccagtttatataacacatttactcgaagttcaaatttagtgaatcatcagattttagcttagaaatgttctagttccagcgtctctacaacatagctgaacattgataactcatcacctcttgtaacagaaacctcactgctacacagtggagtgcgtttcatgattagacccttgtctgtctctgtaaactctttttttttttggagatggagtctcgctctgtcgcccaggctggggtgcagtggcacgatctccactcactgtaacccctgcctcctgggttaaagcgattctcctgccttagccttccgagtagctgggactacaggtgcctgccaccatgcccagctaatttttttgtatttttagtagagacagggtttcactgtgttagccaggatggtctcgatctcctgacctggtgatctgtccacctcggcctcccaaagtgctaggattacaggcatgagccaccacacctggcctgtctctataaactcttaactgtattgcctactcctattgtctaggattccaagtatgaatctggtcctttgctacttataggtgtgtcttgggaccagcaggatgggccttgctggagagcatgttagaaatgtagatccttaggtgccactccaagttcctgactcagaatattcattttaaaaatgatgaggtcaggccaggtgcagtggctcatgcctgtaatcccagcgctttgggaggccaaggtcggtggatcatttgagctcaggagttcaagaccaccctgggcaaaacggtgaaacccagtatctacaaaaacaaacaaaatttcctaggtgtggtggtgtgcacctgtagtcccagctactcaagaggctgaggtgggaggatcagctgtacctgggaggttaaggctgcaagccatgatcgtgccactgcactccagcctgggtgacagagtgagaccctgtctcaaaaaaaaaaaaaaaaaaaaattatgtggtgattgcatgttaaaaattttcaaccacctttatcaagtccacataaaattaagcacaaataaagtgaacactttaataaaggtttatcttgattcttaggtgtatacatatcaccacaatcaagataacaagcatatcatcactgccaagtgtttcctcctgtctccctctaattctcctgactccttccaccttcccattcccaggcaaccactgatccattttctgctacaaattaatttgcattttctagttttaaaaataaatgaaattacataacatgtactttcaaaaaataattttggttctttgcttttgagagttacctctgcagatgcatgtattaatagttaatttctttttattaatagtattccattgtatgaacataccacaatttgtttattctttcagcgcttgctgaacatttgtattgtttgtatatttctactattacaagtgaagctgttataaatatttatgtccaggtcttcttatgaacatatgttttcatttcttttgtgcaaacaactagagtagaatactcaattgtgatactgtgaaatatagatttggtcttcctccctgtttcctggaatttaacacctaaaatcctcagaatctccagagtgattttttggaatgctaatgtgttgactgatgggtggcagcccctaggtagattgaggtgggggctgatcaccatggaaaaaaacaagacaggtggaattttaagccccttctgctcgcctctaaggaggggcaagggggcagaagtgttagttcattatcaatggccaatgacttaaccaatcttgcttacataatgaagcttccatgaaaaacacgaaaggactgcattcagagagctatcagatagctgagcacatggagtctcctgaagggtggtatgcctggaaagaacatggaagcttccctacctcccatacctcgccctatgcatctcttgatctgtatcctttgtaatatcttttataataaactagcaaatgaacccgtttccctgacttctgtgagctgctccagaaaattaatccaatccaaggagttgtagggggaggttgtgggagctctggtttatagccagtcaatcagaaacacaggtaaaagcataggaattgaattggaggaggggtgggagcaacaagcttgtgtccactgcagaattaatggcttgcttgctagtgggttgaaatccccacacacttcttggtgatcacagggcacagaagtatactttgttgattgatgtttaatgagagaatagaaaataagctttggttttattcctacgtcatcagaccagaccatataatactcttagctttataagaaactgcctgacctttgttccatacctcactcattctgtttgcttgttttccccccattctttctttttctctgtgttttcttgggtcatttctatagttatatcttcaaatgcaccaatattctcatctgcaatgtctaatacacttttaattttatctggagtatttttttctttggcattttagttttgctctctaaaagttatattttcatcttttaaacacttttttgtatctctccttaacatagaattttgtttctagctccttgatcacatggaatacagttctgttttaatatctatatttctcctggattcatttcaattgatttattttcctcccaaatattggtcattttttatgtctgataatttttgattgttgagcattatgaattttaccttgttgattactgaagatttttatatttttacaagtatttctgagctttattctaggatgtactcaagttacttaaagacagtttcatcctttttcatctttcttttaagatttgacaggcgatctagatcagtgttaaagagctaagttttgctccacttctgaggaaaacactgttttgagtactgtctccaatgctccatacattatgaggttttccacttcggctactgctaacgggaactagttccagctttgtgagacctgctgttgttctctcaaatactttcaagtgattctttcttggcttcaggcagttaccccacactcatgagctgagcagtggtcagccatatattgaagcggggggagggggcatcctaatgaaaatcttcagagttctctcttggacttctctttgtgtatggcattctgccctgtgaactcaagctgccttggtcttcctggactctcagctttgtctccccaatgcatgtagtcttctgggctccacctgcatttcctctttgtgtcacagcttagacaccctttccatgtagcaaactgggggcaaccataagactcatcccattcattcctgacttttagagttcactgtcctttattgcctgatatctaaagtcttgaaaaagttctctcggatatttttccagcttttaattgtttcatttgaaagtgtaactagtataatctggtgtttgttgctccatcttggccagaagcagaaatagtgcatattaaaatgttagaacagtgctctgccatggagcatctctcctgacctctctgaatcttttaacatcccacacataatgcacctgatgttctcttggcatgatccctatgcctttgtgcatcaatttttaaaaaatgaatgaatgcttaaccacatcccctcttcagtagttctgcagttggttttcagaattcaaatacaagccttgacttcctacccagcaccctgctccgcctcccagaggagtctcactgtgttgcccaggcaggtctcaaactccagggctcaagtgatcttcctgcctcagtctcctgagtagctgggaatacaggcatgtaccgcccccctggttcaagcttttgcattttgtatgttgattaattatcatctcattaactttagctcatcactcaaagcagtcaatacattttggaaaaatatcacatcaccttattttagaaattacttataagcagtcaccaattcatatcatcatccaagtcactgataaaaatattgatcagagtagtgcaggggacattcttctgtttatcttccagactggcatggatccatgaatcaatattttgcagagagtcatttaaccaaatcacacatgcacctactgtatgaccattcaatttgtatttgtatacacggataccttaagtctataccaaaagctttaatgatattgagaaatgctttgtgttttaaatgcttaaaaatatggattgaaggaaaatgctaatggaattgtttcctggtggtggaacgagaggtgatctttatattttattattgcttatcattgagataatttttacattggattatatttttaaaatatgagaaaataagtttaaatattgtgtctcagttttcaacacttcccaatctacttattagatggttctttcagaataatagaaaagaaagccgcagtgacgttttattagttacttcttgctaattccaaatgatcatattttcaatttaaaagacttacaacttagcccttaattagccatttcagaatcttttctacggctttttttctcctatggaaatgtggtgtagtgccgatttttcatctcttcatttagtattctttcttaagttgcactgactgaggctgggcaatttcagtagtaagttccaaatattctcagagtgaacttcacctggtaaagtttacccacactcacagagatcctaatttcttcccacttagtccctgaactttctttggtgtttattttatcctgctcaatttgcaggtcattttttaaattgctattttttgacagaaactttagaggtgaaattagttaaagcatttcatttctattctgttgacatgtactgttgaatgattggcacagagacctgtttctatttctgtttcttgcttttagtgtagaagattctgtgttaatgtgatgaagggtggtgtgcttttgagctgcagcctgaccttgctcatgactatgaaatgttacaaggttgaatttcataagttgacgtgttagggctgttagtatcagcggtaataaattgtacaaaatctccatggtataacattaaagtgtaggtagtctagtcagatgtttggcagacagccttccatttgaagttccctttatgttgtggtatgggcattttataagacctgttgctgaatcctctgcatttgcctgggcaacaagcaaagatagagtaagtaaaattgcaaggtctcactttgcatggaagaagatctagtatttctttctttaaggataagaagaggcaagagggagcaatgaccctaaagtatttttaactgtggtaataatgctgtgcactaaatgtccagaactcattgtattgtaaaactaaaactttgtgccctttgactaatatctcccaatttccttctccaaacctccgataagcaccattttactcttggcttctatgagctttactattttattttagacttggcatataagtgatattgtgaactatttgtctttctgtgtctggtttatttcacttaacataatgactctaggtttatccatgttgtcacagatagcaagatctccatttttaaggttgaataatattccattatttgtgtatgtcatattttcattattcatctgtcagtggacatttaggttgtttctatattttggttactatgaataatgctgcaatgcatacagaatcatagatattcctttgaatttcaggtttcattttctatggatatatacccagaagtggatttgctggatcacatgatagttctacatgccattttttttggagaaactttgctattttctaccataactgtaccaatttgcatttttatctacagtgtacaagggctcccttttctccatatctttgccagcacttaccttttgttgctaatagtcattctaataggtgtgaggtaatatatattggcttgggttgactttccctgataatcgatgatattgaataccttttcgtattctattgtccattgttatgctttttgtgggaaatgttcattcaggttctgtgtctattcagtaattagattatctgtgtgtttttgtttgtttgtttgctattgaatcgaatgagtgttttatagatttctaaacagggctcccaggtacgcttaaagtagcaagtgtgagtagttggcaaggttaaagagtctgctgagctggagctagacttgtgccaaagtcttacatatgatgtttatggcttctaaacaaaaataccatcatttcttcaacatggaaaaccacataaagttgttagcactttgcttgcaattgaatgttaatatagtgggacaatgaactcatctttttcagaacttccttttgtttcttatctttttgagaatttggcaacagccagttgtgttgtattttctggtttgtagttttgttacttccaggctatttacaggaggcattccccttcaagaggcatagacatttcatatgggtaactagctgtcctctctgagaggtttactctaagagttaagtgagtgagtgagactagaagcagtgagataactgaaaagaaggacaatggatgcatttttgagggtccagagggtcttttctgatggatagcgcttcagtttctggaaaagagaatgtcacatgaaagcctgcatcagtcattcccacaaagtattgcatttttgccatgaactatgttctaaataaattctggggagtcaaagctgaagatcaatagagaagttcttataaagaaagaaagcagagctgtacatgaataaagagtaaatgaaggataagaaaataaacactgaaaacaggaaggggatatttgttaaatacatttgagccattgaggcagatccaaggatgaaattaggaggtttcttatccaaaatctatagtcatagttgcaatagtatataccaagggccagaagaatttagtctatgagtcaaatctgccccactacctgttttttttttaataaagtttgttggaaaataattcattgttgtattttctatggctgcttttgctctacagtgacagaattgagctgttgtaatgcagactgtatggcctgaaagctgaaaatattttacaatcttagaatctggcttttttacagaaaaagtttgtcagtgcttgctatacacagtgaacatattactagactagaattgttgttacccaagtgcagtgtgaatggttagagctaccatgccactgggaaatatgtgtttgcttttaaaattgagcttagtggtttaatggagtcgtatagtccaaccaccatctctctcaccagtgggaaccaagagaaagagaggtgaagtgtcttgccccaggccacacagcaaattaatgacaaagtcaaaataaacttccaggcctctgtagttccagccagtactattttcagaagttgattaaaaatggataagtggtccctattgtctagtatttgacatgaattccttacagtccagggagctgctgcattgaggaatgttccagtgtcctggattctacgcaaagagttaaatctctagtagtaacaggaagacctcgatagaacattcactcattgtttaatgcaaatcctagcagagacttttgggtcagcattatcctaaagcttgagtaatctttcagagagtttggttattgattccaagaatggttttctctcaaaaacctctttattttgaaaattaccgtgagacctcaacttcacaattctactaatgtcattagatgcctggtgctttattataattcggtttagctgcactttcgtaatgttaggtattgacaatgtgaagattttgatgttaaataacttcctctgacatgaatatagttaataattcttagtctcagttcaacattgcgatggaatggaacaggtcaaattagcacattgagtttttagaatattacagttctctataaaagtttgatttcctatatttttaattatttctgacatacattggcaagcataggagataagcaaagtaacagattgtattcaaaattttctttctccttatccaagcataactgagtcatggcctttttataagttggagtaccaagctcagagttgggttaccatctgacattggggaattaaatatttagattttttattttttcttggttgttgcaattttgtctataatacaatgtacacaaacaatactttgttattaaaattagtgtttgtagtgttcacattaaataatagtaaattaaaatgtgtgctaaattgatgtttgtatttttgttttgctgaccaaagaaaatgtaggttgtcatgtttaaagaaaaaaaaaagatgcattactggggcctattaacttaattagaagtaacagatttatagctttagaaagacaagctttacttccccatttttctcataatttatttttaattgacaagaattatttatattgtacaacataaaggttttgatatgtatatatggacacatatatgcattgtggaatggttaaatcaagctaacaacatatgcattacctgacatacttactctttgtggtacgaacacttaaagtctgtcttggcaattttcaagattataataccttacctatagtcaccatgctgtacaatagatctcttgaacttattcttcctgtctaaaatttcatattttttgacgaacacttcctcacccccggtaaccaccattctgttctcttcttcaatcaattctgcttctattttcctgtgtttatgccatctctttcctttaagaatttgttccttggttaaaaataaagcatttctagaagttacataagtgaattgtcatagtgttatttatcatccagagattaaataaattatattcaatcaatattaaaatgttgaaacaaaacatctcactcatgtccattcactcctctcacgttagttcattaagcaaatgtttattgagagttcactatattcctatgctctcattgaaataaatgtagagccaaaccacatactataattgggctcatgtagcacgttgtactggtctattctcatgctgctgataaatacccaagactgcgcaatttagaaacaaaagaatttaatggattcacagttccacatggctgggaggcctcacaatcatggcagaagtcaaatgaggagcaaagtcacatcttacatggcaggcaagagagcttgtgcagggaaactctcttttataaaaccatcagatcttgtaagatttattcactaccatgagagcagtataatggagcctacccctatgaatcaattatttccacctggccctacccttgacacatggagattattagaattcaaggtgagatttgggtggggagacaaatccaaaccatatcacatgcagtatatataacaagggaggcagctattaacaaaacatttccacaaaaaataaaagtaaaattgtatcctgagaaaagcgttcgtgaggaaggaatcatggttctatggttctatgaaaaattattgcaaaagaagcccaacataggcatgggattcaggatcaatttatgttttcagaatgtatttgagctgagaactaacagattaagagaaaagagttagttagggatggatgggggagaagatggagattacccaaacaaagtaaactgccagtacaaagatcctgtcatggaggagtggagagcaaggcttactcaaggaactggaacctagtttattatcagaggaagctgacagacaaagcaaaaaccataccatattaaagagttttgtttctactccaggagcaatagacagtcattgtaaagttctaatcaggaaagtatcatggctatatttgagaacagaaaatatcactcctgttgctgggtagtaatgaatggaggggtaagaatggaaggatacaaggctatgaggaggtctgtggaaagtcacatgttcaatggaatatgtacaaattacaaatttgtacaagcacaaactacatgttccacacattcataactttgaaatttcccagtgatctcatgaacttttgtaaaatagaagacttgttttaatggagggggaagaaaataactaacataaaagtctgttctaaaacaaaagctttgcagacatccaactgttcagtgtcaacttcataaacaccctataagaatctcattttgcatgtgaagaaatcaggctttgcaaagcttgagtgactcaaagtcataagcttcgtagcctggaaacaaaatttaaatctgtgacagtttcacatctaaacacatgttatatccactatagtcaccccagacttggggttacttctcttaatgtaaacagtttaatgatgtaattggtcaagtagattgcatatttaataaaatctaaagtgctgaaaaataaatccatgcatttactttcaaaggtcacaatcctcagagccaaattaaaccataatctacacaaatgctgcaaaagcagggaagtggggagccacaaaagtttattccaattgacaatacaggtaattttataggaatgtttctgtattgaatgctgttgtttcatatggtcatcagtcaggatttggaaatgcacatattgacaagtacttgcaatgtcttgatgtaatagttaggttcaacctataaattattcctcctttccccacagtgtttgattcaaaaccaattagatgccagttgaatgaaatttgcagttgtcttgaaatcagaagtctacttgttttgtacttggttaaatatgcttacattgtgtaagctccacaggactgtgagtaacagtattagagctttagtttgctcactatttttaatttatattttaaaatatgtattatactatatttcatacattaattaaacactcacaaacatattttcttagagtttggggatcactgcttgaattaaaggtaaaaatctgagaaatatttgcaattgaggaaaccaggatttacaatataaggtgtgcagaatcaaatgcttcatcttgtagagaaaggtcccttaggaatggtgctttaattttacaaaaacgttcaaactcttttctcatttgatcctcaccacagcctgtgagaataattggttggttgaaaataatggttggcctgaggtggaggatgtctaatgactagaagaataaaaattcctgctcaactgggcaggacagcagagttcctaacaaactgtcagaaaaataaaaaaaagttgtgaaactgaatccaaatggcagtctatgagaaccatcacttctgtctttctgtttcttaggtagcatttctccagtctaaagagactctagctgtggaacatatgctatcaattgaatcttgaactgatttttctttttaactcaaattactgatgaaggaatccttaggaaaagttgacttgactataaagtgtccaaaggaattggtaaccaggatgttttcttcttttctcccacctccccatgcttgtaatttaaaagattggttttagggttttagagatctaaatgaagtcagcaacctaaaatgccttttaaagtgcaaaagatgtcttgtattctgcagtagttcctattgattttgaacagaacaatatttttaaaagaattccacatggatacagaaaatgggaagagaagctgacctggtagatcaacctgtaatctctacatcaatgggtgactttatttaatagtttagaaactaaataaagctaatctaattaattcttttagctgtaaaatatatttacattaattaatttttttttgtgccagaagataagatgatgcccttcttcacagaattggggagtcataatgtaataaaataacaaattatgttaggaaaaagtcatctcattggttcagaaattctcattttgcttatactttgttccaggagtttaattttaaagcttccaaatgacagagaagtaacacttgttgtttggactgaaaatgtatttatgaatcagtgattatctgtctttgagcttgatcattttcatttttaaagattccatgctggtaaaaactatttatcccttctgccctgttctctgcttcacagtagtatcagaaaaagttccatacagtagtttgttagttgaactccttgagaattgcccaaatctaagcatttaagaacaattaacttttaggcattgatttttttcttctgtttttgttagtttaattgaggtttaatttacatataaaatttatcaatttaagtgtgcaatcctcttgttttaaaaatctaatttaccacccaccaaaatcaagatagagaactcttccattgtcctccaattttatttgttttgtacctctttgaatttaatcatcccacctccatatacacacacagacaagtctgtgaccactagttactttctgttgttatagttttgccttctcaataaatggattcaaagagtatgtaatatttgtgtctgacttcttttattcagtttattgctcttgatatgtatgcatgttattgcaagtatcggtagtttttttttttttttttgcattgccaggtagtatttttttgtttgaatacatcacagtttggctgttccctagatgatgggcatttaggttctttcccattgagggttattaaggataaaactgttataaacacttatgaacaaggctttcagtagacatatgccttaaatttctcttgcataactgcctagtagtgtattgctgggttttattgtaagggtatgtttaacttcataagaaactgctcaactcttttccaaagtggctatattattttatatatttctaccagtgtattttagcatgccagttggtcagtattctcaatgacacttagtcttttgtttttcttgggttttttttttttaaaataattctagttggagtgtattgatatttcattgtcattttaatttgcatttttcttaggcttaatgttaaaaatcttttcatgcacttatttacatttatatatcttttttggtaaaatgtctattcaaatcctttttttttactttagttatcttattattgaataagagctctttatattaatatattccccatataaatcatttattggctaaatattttacaaaatattttctgccagggtgtagctgttattttcagtttttcaatgatgtatgaaaaagagcattttaaaaaatgttgaagaagtccaatttatccctgtttctgtcttttattcttttgtgtcctgtttaagaaatcattactagcttaatgttctcctattcttttctctagaaattttatagtcttaaatcttacattaatgtctataattcactttgtcaatttttatgtatgttgtacagtgagagctgaagttaattttttctatattgatattaagttgtttcagcatcatttgttaaaaatgttatccttgttttggttgattgccttcttttaaaatgaattgaccttgtatgaaggctttttttttctaccatctgtcttgttcctttgatctatatgtctgtttctacaagaatatcacattgtcttgattactacatctttaagttttgaagtcagctaatgtaagtccttcaattttatttttctttttcaaaattgttatggttattataggccctttactttcccatataaattttaaaatcagttttttaatttctatagaattctctctcaaattttgattgggattataataaatctgtaaatcatacaaactcttactgtgacaatattgaacatggtatatgggatttatttaattttatcaatattttgtaatttttgttctacagttttttcatatgtattcttcaagctacaactatcttatattttgctactactataagtattttcattttaattttcaatttttaaattactagcatatataagttcatttgatttttctatattgaacttatatcatttgctatgagtaaacatagttttttgtaggttccttaagactttcaaaatagattctctataaatgaagccattttaatcttatcttttatgatatatatgatatatgatatacatatatcataaaagataagattaaaatatatatcttttatgatatatatgacatctaatatatgatgatatatatgatatatgtatgatatatatgatatcttttatgatatatatatcataaaagataagattaaaatggctatatatgtatctttaatttttttgtgtgtgttcttgtctgagtgcactgggatgcaatgttaagtacaacgttaaactgaaataatgagagtagtcattcttgcattggtccctgtttaagtgggagagatttctgtctttcaccattaactgttattatttctcgcaagtccttattaggttgaagaaagtcacttctgttccttctatttttaatcataatggaatattaaatttttgtcaaaaacttttctgcatatatggaattgatcaagtatttttcttactggttttctctcatctctctctctctttctgtctgtctctctctttctctctctctacccatcgttctcctcttaacagcaaagctactgttttctgtcttcaaaatttgggtcaccttgggttccctgaaactcaaattctgactcttctttacaacaagatcaccaggctctccttaggtttctcccacttgtggtatgttctagaatctctccaggcagtggcagtgagctggggaattgcaaggctcatctaatttgttttcctggaaatatacgtatgttccagttttcccgttgcttaagatgagtgtgtaaatctggtctcttgctattggtttttgtatcaatctttttttgtgtgtccttttcctatttatttgtttttgcttagacctaatgcaaatctattgcctttggatgatgtcttaatttatttctagcgttctagttaatgtaccaaacaatctattgggattttcttccttcattttcttcttcttcttctctttttattatttattttaaagttggagagggttgctgctttaaatcagctatttttcaagactgttaataccaataactattcttaagtttccaaacaagctgggtgaagagaagttgctgcaacatccttcttcaaatctgttctttttcaaatcaattctttcataggtggagaaccgttttgttggagtcaggctaacgatttcctctcttatgaaaatcaagaatttaaacattttatatataaatattttatatatctgtgtgtgtgtgtgtgtgtgtgtgtgtgtatgtatatatatatatacatacacacacatttaagacagagtctcactctgtcacccaggctggagtgcagtggcatgatcttggctcactgcaacctccacctccctggatcaagcatttcttatgcctcagcctctcaagaagctgggattacaggcgtgcaccaccacatccagcaactttttgtatttctagtagagacaggatttcaccatgtttgctacgctgatccgaaactcctggcctcaaacaatctgcctgccttgtcctcccaaagtgctgagattacaggcatgagccagtgcactcagcctaaagacaaatattttaaatatatactgaatatatacacactcatggccctctcagtattgatcaggagaagtattaggcttttcctgtgtcaggtttgaatcaacctagttgtgctaactccacagggtttgtagaggatatggggacatgggaagtttccctatgactcagtagccagttaaatgcttacaaattcacagtttattgtgaggccttcacacaacaacaatcatgcaaatatattcaataacacaggcagtaataagatagagggagaaaaaaacacagcaagtagtttcagagaccagcacactgactgatgaaccagcagctctgattttcccttggaaggccagccagagtggaggtcctttcttttccccaacgcagggcttctggcagccacagtttctggaaaagaggacttagagttctcaatggcagagcttctacaggcatcgtggccatggtcagtttctttgcagtttttaatgcctgggagtatccatggccattatcctcaggtgccttttaggtttactttctcatcaggtttcagggtgcctggccacagccggggttggcttatcacctcagtccaccatgtatatgcttctcactccgaggtcaacaatttcactgtaagctgagttacctgtcataagtgactccattttgagacatttaggaccacaaaacattatatatcatctttgttaaataaagttccactttttggaataagtatacacagttgtgcaagtgagaagcagctcagaggtgaatcaggttttgtagctactacggaagataactactcatttctctgagatctatttaccatcctgatcattatgaggtctccaaaaaaaactgtatgtttgccacattacctatatttattataccatccaaatttggttaaactattgtacccattttcaaatagtggaataacagagagaaaaaccttgtgtatttcgtttttaatagtagtataatatttagtcacattattaacttgaatttgggttgtaatattaatattataacttagtgcttgattttgctgtagtcctcatagatatccttattaattttaaagattttaaaaatctcattttctttttcttatctgctttaattttctaaatcattctgcagtacaactaaacatactaacttggattttgtaggggaagtctgtatatgtatgtggtgtgaattaatgcaaatattggaagaaattaaattaggttcatttcaagagcatttggtatgaaaagctaggctaacaaagtaagtgttgcctgtgatagattcctagaaacttgttgaaattagtagattgtaatggttttcaattaacatatggcttgtttctgtgcaaataaaggttttcagagtgcttaagggaatgttggagaagttcatttaattacaatagttacgaatattacctctgatatctgtttacccctgtatttatacatatcttttgttttatagatcatccttttttcaactaacctattctaaattagtagatacaaagtaatgcaatggttatctctaggttgtaaaaatatgagacgtttcaattttcatcttcttatgttattttacttttttatacatctaataacgttttccctaaacaaataattttcatctgaatctcagataaaaacacgcaacagctgccttttcaacaaatcaaatgttttttcttcaaaattgaattgtggcaaatcattgcgtttaaaaaataaaaaaaatcagttcatacttctggaaaatgaaagatctagagtatatctactttagaatatcttaatgtttgagttagatgaactaagctctgaaacattttccaaatcttgttttccagctggagaaatggaggctcaatgttttaggatgggtgaggtagtttaatgcttgtgactaccttgggacttggcacctcttcatatatcaggatgatctctcgatctagtgcacactctatctctattgtttatttgcaaattacaaatctacgtaggcaaatgatctacttaggcaaatgaagcatatatagcaagaacatggattcatcaggtatctagacaggtcatattttgtataatatgtggttttcggttcttaggcattcagatagtctttgatcagttttttctctcttgacccagtaaaatttcctggagctatttttgacaatctgtaacttttatgtgtataaacacatgcagaattttatcttttataaattcagatgcctttttattgaaatccagaaacagactttcggcctatttgagatgattgaccatattacattttttttctaggctacctatagttctaggaaactagctccataaagttctataaaataaccacataattagatagaattccctctctaagtcaaccaaatatgaagtctcaaacaaatatttttaattcacatatttatgctctatgtattcaaaattgaaagtatttaacacaaatattgttctaaagtttttttaaccatgttaattggttaatatagaatatcacattgattatgtttaggtttggaagaattagctcaatttttttctacagagaggaacaaattacttatgcttctagatgttgatgtcaatatttgattgttggcaatattgtcattcatctggttagagtttatgttcattaatatattaatggtgtttattttatatatcattgtgttttatttatatttgttagaaatgcttgttcctcagtgccataaataaatagcacttgaacataaatttaatttcctcagcaagtccatttttactttctgcagaaagggtacactcgccagctgttttgcaagagtataccgaacaaaggagacagggtcatttataaactgatgtgtcatcttactgctgtgtctggtttccattccctggaatgggacttcacattctgtccttgtcctgattggctagcaacttagaactttctaaaagaggcaaaggcagaggagaacaaaggaaggaggaagtaacttgtagaatgctaagaaaggtaaaaacatcttcaaataaggaagaggaacaggctatgacctaatgcttgcttggactagtataagcatgccagggcaaatatttaggctaaactgtgggagctaagaacataaagtacaatgatttccttattaacgctagcagatatttaagaatgttagtacaggtctttgaatacattttgcttctaagagaagttactatttattcctaattagatggggaggaaagtctttgaagaggatcccctactttacattttacatatatatatatgtattacacatatatgtaacagtgtttcatcaatatattttttcagtaggacaaagtaaatctacacaggacagagaaattgatttactttttgaaagttcctaagcaaaaattatctatcaatgaaccacatctaaagagccactttttactacttgtttatacactgtctctccttcttctttccccctaccattgtttaagccacagatttttaaaactagaaaggtctttataaaagtttctattcaatactttcattatatgtaaaaacaaaagggtatctaaacacattaaaagattcactcatatttgttctttgatcattattagtctaaatcttccaaagaaaattgctagagatcttgaaaggtaacctaaatctttctaaaatcattttttatctcatttcctatgttctgcatgctttcatctcccccaaatttgtatgttattatcttaaccctatatagtacctaaaatacctaggtgatagtattaagaggtttgatttttggaaggtaattgagtcataagggtgagaccctcatgaatgggattagtgctcttataaaagtgaccctagagagttacctaaccccttctgccatgtgagaactcagcattaagatgtcttctaagaaccaaaacattggtcttctccagacacagaatctgctagttctttcatcttgagctcctcagcctccagaactatgagaaagatatttctgttgtttataagctacccagtttatgtattttgttatagcagcccagctggactgcagcacaattcttagaatggagtagagtatacatattccaggcgaagtccaaaggctattccctctgtgtatcctgtaatgatttgggctggagtacagagaagcagaggtttttggaagatagaccgatttttctttggggattccatccacttgccctttctttctgtccattagaactaatatctttaaataattggcaaggcccttgagttaatttttcaagtatctccttcagtgtatccagtcaaattaaatatggcagaaggagcccagatcctaccgatctttgcattcagtttgctgtggtttggtataaagctattggaaacggctttctaacaggatcttgaattcatagcctccaccaccacctccttgcatttgggtggggctatatgtctagttttcactgactgagtaggggcagaaatgttacaccattgtaggaacaagatggtgaaaaaaacatatgctgtctttaccattctctaccttcccttttcctctttattgactgcagtgcagggaaatcagtggctatggggataccaatctatacagtagaaggaaacactggggaagagagctgatcatgagtcaggaacatcattaatgaactattacaagaatgataaattaactattgttatgttaagccactcaagtttggtcatttatttaatatagctaccaacattatgctgactcaaatggctttttggattaatgatgtctaataaaaataaatgcatgtttctttaacgcctagaaatgtttccttgtgcctataaatgaagaaacagccttatttttgttgagaaaggtaggaaagaataaaatattatggggaaaggtaaagacagtgtctttgaagcatatgttgatgtttttgtgtcctatcattgtttatctctcaaacaattttcctacctcacatgagatgcatcttcctctttcacagtcatactgggtgactgatttatagaacacactgccgttgaatccataagccttttcccaagctatttctgtgaatgcaatttaatgcccttttaggtttatttgcaattcactctcatgttagtacaggcattttttgatgtgctttcataaaactattaagatttatatgtgggcagactcttgaagaccatactccttgtgttaagatttggggtatataagataaatctccataaggctgttcatacaattcagcataacatgggtgactttgttttatattggttgaattgttcttaggtagttgctgtgtaactgttggttataaatatggctggaatagtattactaacaatgacaatggtaatagccagcatattttttagactttactatgtgctggataatgttaaagttcataactcattttatcttcatagaaaacatatgaggtaggatatttacattgccctcatttacagatgagtaaaagagacacaggggagttaagaaacatacctaagcttccatggtagtaagctggtgttcaaacccggagttgactgtttgtagccattgtacctagcaattaagatctggaaattgtgataggaaagaatgaaacatttatatattaccctttctttttgggaacaactaggcatatacatgagataaatgtctcaacaaagaaaataatgaaagagcaaattaaggagaaatagtaacacttgacctgggtaccagataggataagcaaggactgacaggagagtaagaacagaagcttacatgtcgagtgctttgcatacacaacctcatgtaataacctgcaagaccatccagcaaaattggttctatcattgagttttaaagcaaggcagctaaagttcaaggaatttaagtaactttcttgtccaactaagagtagatataagtgctgggatttgaaccaggtctttaaaatacaaaatagcatattccctgcccctaacttcttatctaatcaacatgataaaaggaccttccaggagagagagtaatgtgggaatatgggagaggctttgcttgtgtttcaccaggagaaaatcagcttcctgtttggatacccactagacatttaaagttccccagtgaacccactggagacacaaagtaagcccactccgctagaaactgttaaaaaaatttcaagaaaagaaaaataaaagggaatacttacagaaattggcatggtaagcattaagcatcttggattgtttggaatacaaggatcataggagatgaaaggagagacgaatgggagtaaggagatgagtagtgaatggaacggataaagcattacactgaggattttgtatctgttcaaagaacatgaaggagacggtgtacaatcgtagtgtgtggaactgagttttgtaaaaggagcacccatctgcaactgaaggaagaaacaaggagccaagacaaaagggggagtttcattccaggaattaagaatcagaataaatatgaaaaatatagcacctaataaatgtgtatttagctataaaggaacaataaatacaaataaatataagaagtggtctctgcaatttaatacatttaatttctccaatcacccccagggagtttgccattttgaaaaactgtgactcacaaaatgggtcaacccaaggcataatttcacagtgataatgagcagtggaaaattccatgtaaaaagttgacttttagcatatttgtctaaccctctctttccacatctgtactctattaaattgttaattcatgcaaaaatggtgataacccatatcaacattagatggttgtcatcaacacacttaaaaatttgggcgattctggccaaatatagtgcacaagagattgaattttacaaagtatttatcttagctgtgcctgttcatagtagaatagctctgtcagaggagtagcttatccttggctggctatgttcctagaagaactgtaataaaactcctagttgaaggaaataataagttccaagggaccatcttattcccactggtgtttgagggagctttggtagaaaccagaaagtcatactgtaagaaaaccactgagcagcatttatttcctgtctttccttccccaagtagcacaagccaaaggttagctcagctgaatgtcatatttttaaacatgcccactgttgcctaatgttaaagatactccctgatgcatgggtatgggtcttgtgacacagccctctcccgcccaaactaatcagcctagaggataccacatcgccaatccaaagacaatcaagacacaagtaaggcttggtatacaaggcttcagtgaatcagagattatcttaattttatcagattcattcattttcactctgtgtagaatttgagctcacagactgctgttccctgatggtgactattgagttattggaccatgaagactaagcaggtgaagctggggttagagagaggataagctggacatgcagaaacaacacactagctacacctcagaggcggcagtttaattttttatttaattaactttcaattaatttcccagttcttgaaggatcctaattactttgtacaaagctcattttcttgcccaagaatttgatgaaaatctataagctctcagataattactttcttttacatgaaataatttggctaggtttataatcctcacacctgaaagtatcttggctaacacatacaccaactggaaaaagaaactaattggctcataggtgaaactcccagttgggagagacccaaggtcaccccctattccaatggagtgttgtattacttgcaaagtaacacaagaaaaaatattaacttgcccttttctccccatctgagtctgcatatttttcataagaacttatgtatgtaatgtccaacagaagctgtccatagtggttaaggcaacacaagctaatataataggcaaatctggaaatctctgcagcttaacacaatgaaaatttaattcgtgtagagcaaaaggtggtgggtatgcagcgtgggatcttctgatccacacagtcatttagggatctaagctgacagaggatttgctgtttttatttatttatttacttattttactttataatttattttattttattttatgtattcttttcataagttattgaggaacaggtggtatctggttacatgtgtaagttctttagtggtgatttgtgagattttggtgcacctatcacccatctatacactatactatatttatagtcttttatcgcttgccccttcccactcttccccccaagtccccaaagtccattgtattattcttatgcctttgtgtatgcatagcttagcccccacatatcagtgagaacatatgacatttggttttccattgctgagttatatcacttggaataatagtctccaatcgcatccaggtcgctgcaaatgctgttaaatcactctttttatggctgaatagtattccctcatgtatggatatatatacatatatatatatatatacacacatatacatatatatatacacatatatatatatacacacacacacacgcatccatcatgtatggatatatatatatatatatatatcacagtttctttatcctctcattgattgatgggcatttgcgttggttccaagattttgcaattgtgaattgtgctgctataaacatgtgtgtgcaagtatctttttcgaatagtgtcttcttttcctctgggtagatacccagtagtgggattgctggatcaaatggtaattatacttgtagttctttaaggaatctccacactgttttccatagtggctgtactagtttacattcccaccagcagtgcagaagtgttctgtgttcactgcatccatgccaacatctactgttttttgattatggccatttttgcaggagtaaagtggtattgcattgtggttttgatttacatttctttgatcattagtgatgttggacattttttcatatgttcattggccatttgtatatcttcttttgaaaactgtctgttcatgtccttagcccactttttgatgggattgtttgtttttttcttactgatttgtttgagttggttgtagattctggttattagtcctttgtcagatgtacagattgtgaagattttctccaactctgtgggttgtctatttagtttgctgactgttccttttgctgtgcaaaagctctttagtttagttaggcaccagctatttatctttgtttttattgcatttgcttttgggttcttggtcatgaagtccttgcctaagccaatgtctaaaatggttttttcaatgttatcttccagaatttttatagtttcagatcttaagtttaagtccttaatccagcttgaattgagttttgtataaggtgagagacaaggatccagtttcattctcctgcatgtagctagccaattatcccagcaccatttgttgaaaagggtatcctttccccactttatgtttttgtttgctttgtcaaagatcaattggctgtaaatatttgggtttatttctgggttctctattctcttccattggtctatgtgcctattttaatacaagtaccacactgttttggtgactatagccttatagtatagtttgaaatcacgtagtgtgattcctccagatttgttctttttgcttagtcttgctttggctatgtgggctcttttttggttccatatgaattttagaattgttttttctaattctgtgaagaatgatggtggtcttcagatggagattgcattgaatttgtagatcacttttggcaatatggtgattttcactttattgattctacccatctatgtatcagcactctctcagaccacagtggaatacaactggaaatcaactctaaaaggaaccttcataatcatgtaaatacatggaaattaaataacctgctgaatgagcactgggtcaaaaatgaaatcaagatggaaattaaaacattctttgaactgaatgacaataatgatacaacctatcaaaacctctgggatacagcaaaggcggtgccaagaggaaagttcatagccctaaacgtctacatcaaaaagtctgaaagagcacaaacagacaatctaaggtcacacctcaaggaactagagaaataagaacaaaccaaacccaaacccagcagaagaaaggaaataagatcagagcagaactaaatgaaatggaaaaaaacaaacaaaatttacaaaggataaatgaaacaaaaagctggttctttgaaaagataaaactgatagaccattagcaagattaaccaagaaaagaagagagaaaatccaactaacctcactaagaaatgaaacaggagatattacaactgacaccactgaaatacaaaagctcattcaaggctagtatgaacaactttatgcacataaactagaaaacctagaggagatggatgaattcctggaaaaatacaacactcttagcttaaatcgggaagaattagataccctgaacagaccaataacaagcagcaagattgaaatggcaatttaaaaattaccaacaacaaaaaaagtccaggaccagatggattcacagcagcattctaccagacattcaaagaattggtaccaatccttttgacactattccacaagatagagaaagaaggaactctccctaattcagctatgaagccagcatcatcctaataccaaaaaccaggaaaggacacaaccaaaaaagaaaactacagactgatatcctcagtgagcacagatgctaaaatccttaacaaaatactagctaactgaatccaaagcatatcaaaaagataatccaccatgatcaagtgggtttcataccagggatgcagggatgatttaacatacgcaagtcagtaaatatgacacgccacataaacagatttaaaaacaaaaatcatatgatcatctcaatagatgcagaaaaagcatttgacagaatctagcatcactttatgcttaaaactctcagcaaaatggcatacaaaggacatactttaatataataaaagccatctgtgacaaaccgacagccaacataatactgaatgggaaaagttaaaagcattccctctgagaactggaacaagacaaggatgcccactctcaccgctcctcttcaacatagtactggaagtcctagccatagcaatcagacaagagaaagaaataaagggtatccaaattggtaaaggggaagtcaaactgtcactgtttgctgatgatatgatctttaccttgtaaaccctacggactcctccagaaagctcctagaactgataaaagaattcagcaaagttcctggatacaagattaatgtacacaaatcagtagctcttctattacatcaacaacggccaagcagagaatcaaatcaagaactcaaccctttttacaatagctgcaaaaaataaaaataaaatacttaggtgtatacctaacaaaggagttgaaagacctctacaaggaaaactacaaagcactgctgaaagaaatcacagatgacataaacaaatggaaacacatcccatgctcatggatttgctgtttttaatgcatgactcccaggaatactctggttgttggcaggcagccgagagtcaaggggaggagagaactgggatactacaaacaaggctccatgggtcaagtctgggaagactgcaaaccaattgtgtctaaagactattggccagaatttagtcgtaagggtcatcctgacttgaataaggctggggaatatagtctagctatgtgcccatgaggaaggaaaaaaagttggagaacagctagccaatttgtaccataataccccaccttttagtattggattaccttaaaatatcctctctgttaacctgaaatatattgctgcacatataaatatattattcatgcattctctttcaattaaacgtaaagaactcaccttgcatcccagccgaatattcagaacaactattcagaacaactgccatcctgtaatgtagttattacaataaatgagaacattttagataattcttcgtgtataaagatattccatccatgatgctgaaacaagaagtctttaggtcaaaccatctgagactgggagattgcatggaaatgaaaaatagacttagatgtgttttaaaatacttagaagtgattactgatagaataaatgtaacatgtacacctttctaaatcaccagtggaacaactgagcaaaggaaaaatgatagctatataggactacagtctgttttagtacaatgcatacttctatgatgtgaattaactcacatgttatttataaatagggtaatgatgtcagcataatgtgggaatcacatcgatttaaacactgttttgctcaggtcaataaaggcctgcaccatcaagtaatagttacgcacaaagtacgctacacagctgatttcaacaaactgtttttctactgtctgcaatacccatgtatttcatgatcttctataagaaccggttttgattttaaactctatcttgagcatgctgtgtacaacattgtttactgtggttgatttccactggaaatgtaattttttggcttgtttgttaaactgagatagtatattaggattatttttgctagtaagttgcagagttgaatagggttttcatgttctgttctcaatcctagttttctcctgaaccctattacttttaatactgtttcagaatttgaaattcttagcaatgcatatatttcattccataaggtatgcctctcttttcagtttcaactgtgaaaaacccagtataagctgcctcaaaaaaacccctgatatatattaaattatataactagaaagcctagtggcttcattggcttcagcatagttttactcatgaattaaagacagtttttatgtaactatttctttacttttagttctgcttttctcaatggacttcagtttgaattgcaggctttccctatgaggtagataagtgggtaatatcagcctaaggcttgttctcattatatatacgatgatgatatacataattttatatatatatatatcatatattaatctggaatacattgcaagaaaaaagagcatagtcaaaaaggataattaaagaacccttaatattgaaactatttgcaagtttcaggcaggttaagagacagctatgaggggtaatgaaacactctgggatagtagaaggaagattgttcgcactgctaggctgaaggagtaagtggaacgacaggtcaccagaaccagtgagtagtgcagttgtgggagagggttaccaaactagagctgtggccttcagtagaaaatcacagctactgccaacctggagcccagaagggagagaaccaggagaacaaatactccgtcctttcttctttttctctgatcttaatattgcctcccatgggccaaacctaattgaaagtaagagaattgagttaaggcagtccatagaggttagcttcaacagagcaaggtgagaattaaggatggaggggaaaagggagaatatccaatgacatcaatgtatccacttgagtaaagagatagtttttcttccagtggcctcttatgatttttagagaaagtgttcattggcttggatcatatgtccatacacagtaggcagggaaattttgtgttctggttatataactctggttgtacagtgtggatttctgaatagtgtgattaacaacactgaccagcaacacatgggttggggaggagtagtcaaaatacttttatagatctgtgtagctgacaaagtgaagagcaacatggtatactctggtctggctttcagacacaaattttctcctagtggtgacttaacccagtagatttttaagtactttacactcatcccagtcaaatgattcactttccatagagttggaggaggaataaatactgagggtgaatccacctatttactatatagtattttcctttgagaaaataaaccaagtccccttctagggaagcagatggatgaggtggaggaagagaattcatcctcatcctttgacaaatgtttatatcctctaagtctaaccccaaatctggaaaaggatagctgctcagtaaatatttaatgaaatggataattatcagaataacagtttccaaagtgtatttcatttagaatatttaatgaaatgtataattatcagaataatagtttccaaagtgtattttatttagaatatttaatgaaatggataattatcagaataacagtttccaaagtgtattttgtttagaattttccaggtagctgaggaaaataaaaaaataacctgctctcaatgttgtagtctcataatccacattccatatgcttaacacttttcttctgattgaatgatttgcattaattacaaatgaatgctaaaaacaaaactttttcattcctaataaacttatttttatttaatcatttttgcttcagaaacgggtaatggcagttttcaaatactattctaatgtgagtgcattagacactattgttcacgtaggatttgttcctttgatttgatggaaatatccggatgacaattttttttaaagtcactacggggatataacggatgtcaaggtgattccttttcctgtcccttcccttttcccacaagaatttgtactgtgagagagttttgaatgtcttagtacagtcggttgctcatatgacatttttttctttatctttgtgacaatgcaagttgaaatgattgaggggtggaagaactgagaactgtagacagaactaatgcaaattttgcacatcaaatagaagctagaagcttattgatttaagaagcatttctaagagttctactctatcagctggctcatgggtggtcaactggttcaacttcactaaaaagagttctttttactttaatttgctttttaaaattgttatctaagacttttcaagagcacactggggtttttcatttcagatcctctggagagacacagtgtttattttccataaaagaagtgaacacagtgtgttcctttgaaaagctcagcctccctttctgaggtgaacaaaactcctttagtaggttccactagagtcaagctcatcaggggatggtggctttcttctgtttgattcttacctaacccaatttttctgtgaataggtggtattggtttttcagttgctttccactttggagtagactatttcagtcttagaaagggcatagaaagagttgatgggaatgaaataggcagcattttttggtcactcttagaataacttttgacttctctcaaaggaacatctgagcctgagggattcaactagttttattgggacaaaacttccaggctccatccctgcttttaaagaggaaaaatattccattctagccattccagaggtgaagaaatgctgtcttccactttctaaacattcttacccagcttccttcatgttttctcctcactgttggcatgctttaaaaacttgctgtctttgcattctcgggtgagccatatctaagagatagattaacagctactgtcccccaaactgaggatagaaagatgtgtcaccaaaggaaccataaaacaagaaaggatattttagtgaggctaatttgagtgaggctaaattattttcactaagtatgtaaaacatttattgatttggagtcacttcaaatttactttcttgacaatcactggattaaatattatttttggtatcaatcaatatttttaaaagatatatttataataagccattggtgaagttagtgttgaagtcctataaaaatagaccttgttttgtctatagtagcattaaacctataccagtattattgctgatttacaataatatctaatatttactccatttttcttaatctcagagaacggtctaccaaaaaaatttaaaaaaaagaaatgcttgagtaaaatgttaaattcagtttccttattaccatgacaatggcaaggaagcaaggaaatctgtcttccctttcatggatggattcacattatctcttagcatttctccccctggtagtcctggatcattccaggtgaccgtaatatgcccagttcatactgaggagggattttcactatgggcataacctgcagcatctcttgtaggtgaatatggtgtagttgtataatcccttcccctcacgatccattagttatcccaaactcttacagtggagctagaaaggacatctgtcatacatgaggttctgtgaaactctgagaccttaaatacttttggtaagtcattgtctgtttaaatagtttagtaagttattgtcagtatgctcatttatctgttgtatatgtcatatctaaagttctcactttggccaggtgttgtggctcatgcctgttatcccagcactttaggaggctgaggcaggaggattgcttgagcccaggagtttgagactagccttggcaacatagtgagaccctgtctctacaaaaagatagataataaaattaactgggtgtggtggtgcatacctgcagtcccagctattcagaggctgaggtgagaggatgacttgagagtgggagattgaggctgcagtgagccgttgaacacaccactgcactccacactgtgagacagactgagaccctgtctcaaaaaaataattaaaaaaaataagataaaggtctcacttcaaggtactgaagttgtgtaatatccctcaacattgcagaacattacagaacacagtaatgtgtttgcaaaaggatattgatagaaaggatattgatgtttgctgtaggattttaaaatacatttctttgtttgaggggctgctgtctttctgaatcatagcccccaggctaaagtcgtaatagattcagatcatgacattgagcactcctcaagctccatgctgtcttattgcttttgtggacaatctgtaaggatttatgggttgaaaagtggaaattagtggaccctatattaagtaacctttaaggaagttaacctagtgaaatgcgatgtattttcatgtgataccagggcttcagaaaatctttttattttttatgtttcatttttttcctgcaacaaatggtcaagtagtactaatttaattttaaaggcaaatattcaaaattaatttccaaggaggtagagatcctttcagattgatatggtgataaaatagttaaatgcatccaagatacaaaaaaagcataccttacttcttatatctcaaaataattcctctttgtgccacacctgttgccttgttaaaatggatgtgattagctaatggcactataacttgaaaataatggttcacatactccctgaaatccttcaagctggaagacactcacagtgtctgattaggcctcttgtttcaaggcagcactgtgccttagtattatattacaaacaagcagatggtctgctttatatttgaaggaaaaaaatatcagggaaggtactcgttccctgatagttgattttcagatcagatttcaagaattctttgattcctaagtgactattggagttagggtttattttagaaaaagaaacactgcatctgttgaacatagaaacacctgttgctgtcgatgagtactgctgatagtttatgctaaaaattctagttttgaattttattgggactttaacaggtatttatagagacctgactatgtttataatatggtacttctgattaacgtgaagaggttgcagtcagagtttctgaccctcatgtacaaagaactggagaaatagataaggtttatggtcttagagtagagctacctaagtaagcatcctgaggaaggtggaaacaaatgtcatggagattgatcatttcataaacattcccttattgctggatttttaaaatcacaaagatataaatgaggatattaattggggggagggtgaaacaaaaacatcactgaatataatttacttgcaaaacattgctggaaatcttttaagcaatgcacattatagtaagaggataagaaaagagatatgaacaagaataaaatattaatgtttttatattaataagagtagcaaaaacaaatatctaaatatttttcatgtgttctcaggagtttacatgtgttgtctcactcagtcctcaaaataacactgtggagttggtcctgtcattattccagttgtgtagccaaggaaaatgaggcttagatgttgcactagcggtgagtggtagagttcagattccaactcagtaaaccctgtaagcatcaacacagagttaagttcatttaggttgaaccataagatgtggcaagcttaccaacaggagacaggaatggaaacattctatgtgggctgtgctctgtgcaacactgctctcagaagacgtgtggtatagaagggcattacttaaagtgtggtccatgaatttcttctagtctgtgaattatttatgttactgttctgcgacattataaatacaaaatctaagaattagccctacaaaattcttacagcaatttgatagtatttttttctgttgaaactaataaccacaaaaaaagggactgtattttttatgttttacatttaatatttttagaattgtatttttactttgttctataataatcagtgacaggctggagaatttaaaacaagaacaaaaatctggtgttttccagcaaagagtttgagaaataccaatgtagaataaagaccatcctggttctattagttgcagatatgatttttggaatggttttaatatctacctagtaggatggcttccaagtttaaatgcagggacatattagctagcatctcccactgtgcttagcacatggtagatttttcaatcaaagccagctgaacttgtaaccatgagaataaaaaccaagagtaggttaatagcattttcactgcatctcacttcagtgatcattttagtctgaggaacagtactgaagtcaaaccttctcttctatcagggtctctttcggtcagtctgtctttgtaattcagttctagaataaagaggcaagttagatgaaaaaaggtgcaggtcaggggatttatgcaaaaaagaatttgctcagaaggtcctggagtctgtatggactcagatgaatcttctacagtagtttacagtgaaaactgatgctatagaatgttgattcaggcactcagagggttacaactgtcaaagtaaagaccttggtgctgaacacccaggggaggatttgaacaaatgggaagcagcatcagctgctgcctgaagcttgcagctgtgtgctgctttcagtttgctgtgtggctttgccaggctcttctctggaacctttcttccttctctataacttctgtacctcccaggcctcttcactgccttccttcaactccacgtggataagttccttttcaactcttttcactatccaaaacttcttgcttctcagatgtgtgtgtgtgtgtgtgtgtgtgtgtgtgtgtgtgtgtgtgtgtgtgtttggagatggagtctcactctgtcgcccaggctggagtggcatgatctcagcttactgcagcctccggctcctgggttcaagcgattcttgtgcctcaacctcctgagtagctgggattacaggtgcccgccaccatgcccagccaatttttgtatttttagtagagacagggtttcaccatgttggccaggctggtttcgaactcctgacctcaggtgatctgcccgcctcagcctgccaaagtgctgggattacaggcctgagccactgtgcctggctagatgtacatatatttgtcataggatattctagaaggaatctttcatagaatattctggttcaaatgccagcctattcagcaatcctctgtgccacaaaactgacttttaatttttttttttactatatccctccatgccaaattctgaaaccttaatgaaagttatctcatctaggtttttagaggggaaaaaaagaaaaaaacatttttactaaatgaacaaatactttgtaaaaatttactgtgttcctgccatgtgtgaggccctctgctgggcatggggagagtgcaaatatgggttatttcctcattcgatatttactgggaaggtcactgtaatatacattaagaataatcctagagcacatacaaatacacaatttaaacagactaatgtaaagttaaataaaaatagtagttccattgttttcttcctgcacctgatatggtttggctctgtgtctccacctgaatctcatcttgaattgtaatcccaattgtaattcccacatgttgagggaagggccttggtgggaggtgattggatcatgaggacagtttcccccatgctgttcttgtgaaagtgagttctcagaagatttaatgtgtttataagtggaagtttttcccctgctttcctgtctctcgcctgctgccatgtaagatgcacttgcttccccttcaccttccaccatgactgtcagtttcctaaggcctcctagctatgcagaactttgagtcaattaaacttctttcctttgtaaattacccagtcttgggtatccttatagcactgtgacagactaatgcagcaccccaatggagcgctgtaaacactccttaggcaagtatgttccactctaaagatcactgttcaaaggtgagatcatgaagctattaggtaaatatatcataaagaaaaaattgtgctatataataaaagaaactatcatcagagtgaacaggcaacttatagaatgggagaaaattattgcaatctatccatctgacaaagggctactatccagaatctacaaggaacttaaatttacaagaaaaagcaaccccatcaaaaagtgggcgaaggatatgaatagaaacttctcaaaagaagatatttatgcagccaacaaacatatgaaaaaatgctcatcatcactggtcattagagaaatgcaaatcaaaaccacggtgagataccatctcatgccagttagaattgggatgattaaaaagtcaggaaacaacaggtgctggagagtctgtggagaaataggaaagcttttacactgtgggtgggagtgtaaattagttcatccattgtggaagacagtgtggcaattcctgaaagatctagaaccagaaataccatttgacccagcaatcccattactgggtgtatacccaaaggattataaatcattctactgtaaggacacatacacacgtatgtttattgcagcactgttcacaatagcaaaggcttggaaccagcccaaatgctcatcaatgatagactggattaagaaaatgtggcacatatataccatggaatactatgcagccataaaaaaggatgagttcatgtgctttgcaggacgtggatgaagctggaaaccatcattctcagcaaactaatgcaggaacagaaaaccaaacccctcatgttctcactcataagtgggagttgaacaatgagaacatgttgatacagggaggggaatatcacacactggggcctgtcggggggtggggggctaggggagggatagcattaagagaaatacctagtgtagatgatgggtcgatgggtgcaccaaaccaccatggcacgtgtatacctatgtaacaaacctgcacgttctgcacatgtaccccagaacttaaagtataataataaaaaataaagattttataaataaaaaaagaaaattgtgttataaaagttgtagatgaaatgataggaagtgacaaatgggagctattatttttaactaatggattttaaacatttgttccataccactttatatatggctctggggatttaaaacaaattaatatgacaatacagtgctatgatttaaagcagaggttggcaaatttttctgaaaagaaccagataataaatatagtaggctttgctggccacactgtttctgtcataatcaactcaactctgccctcaggtagcgtgaacaaataacagcacaggcattgggtaaatgaatgggcctgactgtgtttcagtgctgcctgcaggccatagcttgctgaaccctgatgaaaagagaaggctttgcaattaaagctggtgatgaattctggtattgatatcagttctgttgtcagccatgtatcaggtatacaaactctcctaggcttgatttcctcagtgacagcctagataggccaagtgcactttgtggtctacacatcatcatcacccagaaacttgttagaaatgcagaaccacaggccctgcctaaggcctattgattcaagaatctgcattctaacaagccccttggggtatttgcgtatcatagttggagaagcacggggacagatgctgctgctgctgctgatgatgatgttgttagtacatcaatgtatagggttactgaattgtgtggttaattgagatgctgccctcaaagcacttatgtactagaactagaataatcactccatcatgtttttgctcacccatgcctgtattaggatttgtcagaaaactcagaattaagtggaatctaggaagattttatattaaattaaaaccaaaccaagtcacatttaattaaaattaaagccaaaccatatgggatgatgaataggatttattcatggagtgacaggagctacagcatactagggtcattgcaaattgtttaacttgtaaggtgtagccatattctgaataatgaatgacttagtaaaggaattttgtgaagtcaagtggggaggaaatgtaggcttctctcctattggcattttctgagtccttttggaactctgagtttgttttttttttttcatttctttgctgtggtaagtagagtaaatagatgatattagaatgaggtagggactatcttcgaagtgagaaaggtataagaaatacaatatcgtttttgagaaaattttgttttaaagacctaagccacaaaaacatattcttggttaatcagaaatttaagaaaacatgaatgctgcattcttttaatatttgttatataacgtgtaatattagtagtaaagtgaattatgttctctacgttcatttatccttctgttttatgttaaagcaatggcccagacccccagattttggttgttaaccataattagaatacctcttttttctaaaaggctggcattgtgtaaagaattttacagtgtaaggtcactgcttagcaagagtaaaggaacacagtctaacagagtcatttcatcttctgtatctattttgtcagctcttaaatgagaataatgctggttcttctacagatattgtgaggacagacaataaaggtcactgtgctctttagaagaatgatacttcagaagtccaagataggattaaaaccgaaatatcttatttcaaccttttaagtaggtaggaatgactgttagaataaaaaatggagaactgtacaaatgattggtacgtttgaaacatttctttttttttatttaaaaataattcaaattgactctggagtactttgaatcagagatgggtaactaaacaccatgcctagtaggcagacagtagttgaatagaagtatcaaggaaaggactggagtgggcagaataatgtaactgctatagagaactggataagggtgagtttacctgtgatggtgggatatttagcagggttgattgaataggaattttgagatatatgttgaatagaggccctggatcataatttctagaaaagtaattttagttatgttatttaatggttttgataactgcacacatgtggtgtcttgtgtgaatcccaggtggtcatgcctacaacagaaccttgtataattcctgacatggagcaagtgctcaataagtgtttgttcatttgtttttctagctggaaattctgatgccagagtttgcttaatgaatggcattgatgtgaaacaaagagttaatggttttccttaatacagtcacctcaattctttctgctcagtacagccaaccttttaaaaagaatttctctgcaacttccttatgcttccccattagcatcttttttatagtgtctttatttctctccttcccactcactccacaaacctctccgaactgtctttcccccagaaaactaatccaaaaatatgtggtcatcaattactgcagggtttttaagtttcagggactttttccaaagtctcaatcttattactaagcacttctaagactgttacatacttttcatgaaacatatttcctatggactctatattcctagagtttccctttcacatttggtccagtctcctcgctgtgtactcttcgctttggtgatgtgattcatagtcatgaaattattgaccggctttcctaccacaaatccaaaatgtggaccttcaagtgaggttttcattctgagcttcaaagtgataggaaaaaggatttacttggcatattttcttatatgtttcatagtcagcggatatgaaagaagtccaaactaaattcccaaatctagcacaatgccctttcttatatactgtattcttctaggactgttctattctaagcttcacctcatcacacaagtagacatatatgtatatatgtgtgtatgcatatatataaacacgcacatgtgtgtatatttgtatatatatatacaaactacgtatttatgtatacatacataaattaaaaagacaatacaattgccatacttatatgacatacatatatggcaattgtattgtctttttcctctggcagattataaataaggactttttaaaaaaatcattcttgcgtgtcctatacttagataaggcctgatatatcattgatgctcaaaatatttagcaaatgaattaatctagttcaattcattcattcattgtataatggagtaagaaacagcataggcttcagctacacagtcataaagacttcaggtggttttctatgcatctccttatacctgtgtttaaataacgaagatataagttactttgtgtagcttctccccccttgttgtctcccctcgttgtctccataccatttataaaaatagttatggtacagagtccttgtaggatataagtacaggcataccttgttttattatgcctcacgttattgcatttttcagatactgttttttataaattgaaggtctctggcaatcctgtgtcaagcaagtccatttcctaacaccattttcaaaataacacgtgctcacttcatgtctctatgtcacactttggtaattctcacaatatttaaaattttctcattttttatacctgttaggattatctgtgatcagtgatctttgatgttactattgcaattattgtggggcaccacaaacagtctccgtgtaagacaataaacttaatcagtcttgtgtgtgttctgactattccattgactggttctgcttgcacttctccctgtccttggcccttcctattttctgagacagcaataatgaagagagaccagttaataaccccacaatggcctctaattattcaagtgaaaggaataatcacacatctctcactttaaatcaacagctagaaatgattaagcttagtgaggaaggcatgtcaaaagctgagataggccaaaatctaggtctcttgtactaaacagtctagttatgaatgcaaaggaaaagttattgaaggaaattataactactactgcagtgaacacacaaatgataaataagtgaaactgctttattgctgaaatggaaaatgtttgagtggtgtggatagaaaatccaaccagccacaacactcccttaagccaaagcctaattcagaaaaagttcctaattgtcttcaattctgcaaaggctgaaagaagtgagagagctaccgaaggaaagtttggagctagcaggagttggttcctaaagtttaagaaaaagatcttaaaaatgcattgccatcacataaaaatgcaaggtgaggcagcaagtgctgatatagaagcagcagcaatttatccagaaaacctaagataataaaggaagatgacgacactaaacaacatattttcaatgcagataaaacaggctcctgttggaagaagatttcatctgggacttttgtaggtatagagaaatcaatgcctgacttcaaagcttcaaaagacaggttgactctcttgttaggagctaatacagctgctgactttaagttgaagacaatgctcatttaccattttgaaaatcttggggtccttaagaattatgattaatctactctgtctgtgctctagaaataaaacaacaaaacctggatgacagcacagttgtttacggcattttaagtccactattgagagctactactcggtaaaaaaaaagattactttcaagacattatcgctgacaatgcacttgttacccaaaagctctcatgaggatgtacaaggaaattcatgttttcatggctgctaacacaacatccattgtgcagcctatggaccaaggagtaattttgactttccagtgttattatttaagacttatttaagaagtacatttcataaagctatagctgccatagatagtgcttccttcaatggatctaggcaaggtaaatagaaaaccccctggaaataaatttataattctagatgccattaagaacattcatacttcatgagaggaagtcaaaattcaacatgaacaggagtttggaagaaattgattccaaccctcatggatgactttgaggggttcaagacaccaatggaaaaagtgaactgcagatgtggtggaaattgcaagagaactagaattaaaagtggagcctgaagatgtggctaatcttctttgctgcaatctcataataaacttgaatgaacgaggaattgcttcttatggatgagcaaagaaagtgacttcttgagatggaatctactcctggtaaagatgctacgaacattgttgaaatgacaacaaacgatttagaatagtgcataaagttagttaacaaaacagtagcaggctttgagaggattgactccacttttgaaagaaattctactgaggataaaatgctattaaacagcattgcatgctacagagaaatcttttgtgaaaggaagacttcactgttgccttagtttaggaaaccagcactaccaccccaaccttcagcaaccaccaccctgattagtcagcagccaacaacatcgaggcaagatcctccaccagcaaaaagattacagcttgctgaaggctcagatgattgttagcattatttagcaataaagtatttttaagttaagggatgcatattttttatgtatagtactattgcacacttaatatactacaatacagtgtgaacacaattttcctgtgcactgggaaaccaaaaaaacctcatgtgactcgctttactgtggtggtctggagccaattctacaatatctcctaggcatgcttacaatgccatatagtaattatctaagagttcctgataaagaaacacagtaggtgctcttgctaattcatcactctttctgtaggcctgcattcatttatgttttcactgattcatccaatagtgtataaacagctactttgtgtgagatcctgttccaggtgctgagaatctagtgatgatcaaactgggccaagtctctgttcttgtgatattttcataggaggacacaagcaagaaataaatagcacatacatttactaaattttagacgtattctctgtgagtgctacgacgaaaatcaaaggcctttctgatgaggtgtcacttgagcatgctgaggtaatgcatccttccaaaatgtggaggctgagtgttacgaggtagaaacaccagcaacctgagtggcaatgaggtgggaatgtgtttgaatgctcacgaagcatccttcagtgtagctggggaaaaatgagaaattttagagaggtaaaagctgaagtagattttgtaaggtcatgtagatgattatatagaattcagtttcttctctgggtaagatgggaaccgtaggggcagggggcagggatctgagcagaggagtaacaaagtttaacttcgatttaaagcaaatcatttgggctactctctggaaaacagactccaagggagcgagggctgaaaaggagaagtcagaaggacatatatgaaatagtagaggcaacaggcaatggtgacttagtacaggatggcatttctcaagcatggttcctggggcagctacagcaacatcacatgggctctatcctagaccttctgaatcagagactgtagaggtaggtagggcccaggaatctgtgttgcaacaagcctcccagaaagttctgatgctgatcaaagtttaagaatcatgctttgggtcatcagtagcttggaagggaataagaagtagtcatattagggatatatgttgaaattagagctcatgggattgaccagtggttatgtgtgaggtatgtatgagaaaagggataacactgaggtctttgaactaagaaactggtggaatccagttgctgtgtgctgagagaagatcctgggaggagctgctgaaatgggagtcaggttagttctaggtgtagttattgtgatgtgtctattagtcactcaagtagagccgttgggcaggtgattagatattcaagtctggagtcactctttaataaatcagttttagttgttgtacgtagacttatatattgttattcaggatttctttattcgggaaatgaaattagaagaggacctgtagagattaaagaactatttaggacagcatttaaaaaattagctcaagaagaaaagtgaattgttaattttttcccaagactaattccttcaacttgtcatatgctgtggatcacctaatagaatctcttaaatgactaagtgtattttaatgagcccagaaattaaaaatcattccattattaccttgaaagacaaaggtgtcatgagcatttcatatcctcaggtagtattccatatctgatttaatagcttgctgaggggctgggttgctttagaagtccattgagtggcattttaatggcagtggtaccaaggatcctaatagtctgtgaaatctgtttcacattagacctttttggaattggctcagcctaatttgcacctattaatttaattttgaacagcctaggctgaaagttatattggctgctgatacataacttcatcttttataaaaatccagatacctgagttatatatcatgttatctatttccccattgtttgaaatataatacatctttctatttaaagaatcaaaatgttctttatttttcaaataacaatatgcctgaatttataatgggataagtagttttattcgacttggtatagaattaagaatgtaagtaatgacattattctctacctaattattaacaattgtagttgtatagctctgtcttgaattatagttttggtatgtttcgatgatctagagcttccatattggcaaactaagaaggaagagttggaaactagaataactttagagataattactcttagtatcttcaaaagcgagcaaagatctgttcagttcaattaactttttactcaaaagttaagaaggagttgagtggttggcatggtaggtaactatcaagttaaacatacttggagggcttcagtggctcttttaagccttttgctggtgaaatgtgtagctagaaaaatatgcacaccctttcagctggatgtggaacctacccccatcctcttggaatattgatcttattcagttgttggaaaatattatgggctgttcaaacccaatagaaatgtcaacatattttaaagatgaaaatttgtgaatagctctaaaaacaattggtgatgtatagttaataaaataaaatgtgatagaaataataatggcaaattttgagtactaatgacttggctttgggttgataaggacagtaaaagttctttcctggtttaaaatttgcaaaaattatttttttttgaagaaagattcagtgatactaatatgtctaatgattgctaagcacaaccacagacactagcagtcattaggcacattagcatcactggattgattctagttacgttcactggagctatattgagtctatagaatcactgtcttacattttgaagttgcttgcgttttgaatttatctagcatgaccatgtcaaataaccctttatcagaataaattaatatgcatgagggtatatgtgtgtataaatctgtatccacttataaatatatatcttaaaataaaaaagatcctatagaaatacaagttagtattcctttaaacacactttttttgttgttaaaccacaggtcagtcaagcttagttaaatttgagtattcaagagttttgttatattaaagtagtaagtgagaacattgggtttctagaaggcaaaagtgaagaatgtatgaaaaagaaaaaatatttccaaagatatctttcacaaacttagtgatagttgcttaacaccctggtgacttctgtgcaacttgatgtttgccagcctctagagctccacatcaacgtatcctgctcagtgctttgttcatctttttttcccaagaggagctctgaaagcttccagcgagttggaagagcagaaagcagcaagactttagcatgtgttcatgaaataaagaaaataaagagctagtctcatttttgtcctttcttgttacagttgcttaagaaaaagataacagataaaaaagaggagagatccaggctcaaaatctcaggactggaaactttgcttcacttagaggtcactctctggctgttggctatagtcaaatggagaagccaatgctgttgtttctgtgtctaattccaatttcattttgtgtagctgtcattctcatatttccttccagcagtaaataaggacatggaacagacacatttcctggataaggctatgagtgccaaataaaagaagacattacaggaggccacaataaaaataaacagaagaaagtgaaaaactctcactttttttaggggtaatgtttcaaaaacaacctccaaatgattgataagcatgtgctttcttcttatgattaagaaatttatttagtggttaagatatttggttattattcttggattgctagattaaggaatgttcctggaatattaaactttgtggaacacgtcactcccctcctgaaaataaatgtttatcttaattacattatagtacttaaagtttttggatgcaactaatgattatatctaatttgtgccaagttctctgctaagttattgtatattttctattctagaatatgctcttttttttttttttaccccaaccgaaaaattacttgtaggtctcatgaccttttttcaggtgatagctagggaaaagacaagtttatttgcagctgaaagaaaataactttcaggaccgagggacttgagaggcagctgaaggaaaagaaagacatagacttttaaatatctttattccctgataaaattgttccccagaactaacattttaagctttattataagtcaatactctgtgttctaaagccttcagtacagagatgaaagagaggaagtaaatgagtacatgttctgagagctgaaagctctctagggcaggtgttttatagttgtggtacgaggactctgtagcaaaagggtttataaaattaattcctttatctgtaacataccaatgataccttgctacctatctcaaaggtagtgagaattaagtcattatatagatgtgtaatgactttattagtgttgttatgaaaacaccagcattgccatctttgtctaatacttagaagagagacaacgtagtttagagggcaaaccaatggaataaacaaataagtttagcagccagacaggcctgggttttctactgcttataactgtgaatcactgggcaaagtagccaacatttctgaacctcacttttcctatccataaaatgagaatgaccatccttagttaacagttataccatgaaaattactgtgaagtatttagcaatgaacctgcggatgatccataggagttgttaactaatgcctattccagccgtctaagcttcagtaccttttctccattcctgggacatgggattgaactgtcccacagaggacactcctgctggaagagaaagtcagtccttcctttcctcatggttgccagaatcagggaagtaaacgtgaaactgattgtaaaaaggggcaatgaactcaaatatgccttgaaggaggaactaagagaatcttccaatcaaaacatctgtaagcaagaatctaaaatagtttatgaagtgaagaatttgggttgtaagtggaatttttaaatgagaaaaatagtgtattgactctagatgggatattatctaaattttttttttcttttaaaatggctacatttgcagtgccagggatgagagataggggccagagatcatctaaatgcgtggcctcaggaaacacttggttacaacctctccactttaaaaacaaacatggatcgttgaatgaatccttttgttcattctttctacctctaaaattatctgaagccacaaggacattggaggttcactgatttcttattcatcgaagcaccagtggtgcgagttggaacggcaggggtaagaggcttgtgtgacagtgccctccacctcttgacccaaagatttaaggattcacaactactatgtggaggaacgcataaagcatgacacaggaatttgtaagaagaatttagttagaacttttctaaatagtctaaactgactactctggcaaagaggacatcctgtgagggtatacatacagctgtcctcttaaaaacagagctctcttcagttcccaatttgttattgctcaagctgagaagagaaaagcccagtttcttccaaccaaaagcaaatgtcgattaccaaacagcaacaacaaaaggtctggacacttcccattacttttgttttaatctctctgttttctaatcatttttgttaaaagtatctcttttggaaaattccaactttattgggtagagtttattttatttcaaagagcttgcactgagtgccttacagaattcagtagtaccagggatagcataaaatctatagaagagaaaataggataaagaaatgttatacataaaatatcaagtcataaaatcaatgagaaaggtataaaagtagaaagttaataatattatgtaattttcttgcatcagctatagttccatataatagagttgttttgtatatccagtttcttttaaggctgtttgtgtttcttccataattctccaaacatactgtaaagggatattgtttctcatttaattgtgttcattcagccaagatgctgactatgagctgcgggagaagcagaaggattgtatatatttcatctgctgctcttcaagcagaaatgtggtggaacatgcataggaaaattaaaattgaaggcagtaagtgactaagcaccatgacagttaacataagcatggaattatatagacattcaggaaaaacagtaacatgtgaattgtcttaaaaatgttgttcaagagtttgtaaactaagctacaatctttgacaaccttacatttttagttgtcaaagagaaagataccaagaaggcaggagcttgtagttagggaataactacatttcaagagatgttgtgagatagccctgactagagtaatgcgagaggatcacattaaatgattaaattattattattattgttattttgagatggagtctccctctgtcacccaggttggagtacagtggcatgatctcggctcactgcaacctctactccccgggttcaagtgattctcctgcctcagcctctcaggtagctgggattacaggtgcgcaccaccatgtctggctaatttttgtatttctggcagagacgtggtttcaccatgttggccaggccagtcttgaactcctgacctcaggtgatccaccagcctcagcctcctacagtactgggattacaggcatgagccaccgtgcccagccttaaattaatattgaattaaaaatagatggattaaaagaagggtaaaacattttaaaaaggaataagcatgtggtaagtagaatttgagaacagtgatgtgaaaatgaggatttgggtatttgtttgtgacaatgggaagccaccaagaaagattagtgtgaaaaatatgaactgaggaagcacctttctggagatagagacctattaggtggctgtaagtgtgtgatcttgtcttgaataagtgacactgagaatgagatagtgggatgaatggatgaaagaaggaagagtttcttgcacatagcattctttcaaatgcaagaatattcccacacagtgatgccactggaggcctccaacccccttcccaaattgaaggcttcaaccagctaacactgagccctgataactgcctaattcattgttattacctgaattattcttaaaatgtcaatagacaaaacttctgattagtgtggccatagagagttgatagtattcctggccaaagaaaaagaattagattctatgagcatatatacagaaaactctgtttctgccattggttatatttaaggaactcaaactagaaaccaatgatagataagatagagaagagagagcagaaactcgaaaatttagaaagggatcctctatcatacatgggttgttaactcaaggtcagccatgagtctttgaagtgcttaagaaaatgaatttagcttcttaataaaatatcttaaactattagggaattctattgcagagctttttaaaaacagccatttaagaaaattacataaaaagaaagaaatagaatagagaagacatgctgtgatgaacattaaaaatttgtttccaaataattaacatattaaatgtatctgtcatgatttatttgtcccaacaaactgatatcctatactttctactttggaaaattatttcaaatttgcattttgtacaagttgagtgatataaattctttagctctgcagaagaatagaggtattttataggttaataggtgtcgaaaggattgatttgtaggcctggcagtgaagtaccaaaaaaaaaaaaagaaaaaagaaaaattatatgctagagcaacccatgaacttgctaaatgttgataactaaaggccttcttctgggacttaaatatcctctaggtttctccagtgacttaaagtgatgccacagcaggtagcagaactataagacatcatttctaccatttgatataagatgtttattgtttccatcaaacacaacacataaaataccttgtaaatggctgcaaagcacattatgaagtgcctcctggtgtgtttatgctagtccattttgaacatttccctttgctacaggcatcaagaaatgacctttttggcagtgtctactcccttttggattttcactcccttccagagtcccattatctcattaaatcatttatgtgcaggaggagagatgctgtagtgaatagcaaaatcccatgatttgtttttgatatgctctaccttttcaacaaatatatttggagtaaagtctatataaataacttaattaaagccagacattgaatgtcaggaatgagcgtttttgacagtatggtgcggactgagttttaaaactcaggataattttagaaaccctgaattatacagtagctaccttatgctacatggtactttatgtgaagtttttgccttaacacaatgtaggacagttctttcctgagtgacattgcaatgatcacactgtaaggaatcacatggtataactttgctgcttgcaaccttaattttctcatttgaaaaatggaaggatgtattcagtttttattttatttatttattatttatttattttaatattttgagatggaatctcactctgtcacccaggctggagtgaagtggcgtgatctcagctttctgcaacctccactttcagggttcaagccattctccctcctcaacctccggagaagctgggactacaggcattcaccatttttaaagtttcttttaatccgtgaagtaaagaaattaatgatgtgtcagaacagaatctagttagaagcccctgaattaactttttccatgcctgattagctatcttcatgacagaacttctaaatagagatagttccttatttgatcataaatctgacacatttcttattttatccattatgttaagagcaaacattttagttaccacttcttggtttaatccaggatcctgtacttggtactttaatgagtctcgggcaattgacaatcattttgtacctcagtttgcttttctacaaaatggtttattggaaggtttaaataagctaatcaatgttaaatagtcaaatgcttactgacagtgagtattcagagttaggtcttattgtttgttctttatgttgatgttttcagctgtaaaaatgttctttgaattggggggggggcaatttagattaaaagtcacttgagatcctgaagcagtagagggctccggtatgctcaagtcagaagacctgctgctatttttgagaagggggaggtcatatttatcagaatctcactgagatatttggggttggccagaaggtggaccctctcccactgtctgccaatattagacttcagagaaattactgactgggcaccttggctcatgcctgtaatcccagcactttgggaagccaaggcagaaggattgcttgaggccaagagttaaggccagcctggacaacatagtgacaccccatttctacatgtaatacaaaatttagccaggtgtggtggtgtgcacctgtagtcccagctgcttgggagactgaggtaggaggattccttgagcccagaaagttaaggctgcagtgagccatgattgggtaacagaacaagaccctgtctcaattaaaacaccaacaccaacaacagcgacaacaacaataaaaaggaaattaccaaatcattaaactctgatttaggaaagatgcagagacctttgccattcactctcttccacttggagacttcagggaattaaaatatgtactttaaattttccagtgaggcaactaaggcccagtttgattaattgacttttcaaagtcatactgactgactgtgatggaggaggcaagtattactggcttcatgacgtgtacttgtgtgtgtgtgtctgtgtgtgtgtgctggaggaaaagaggaaattcttatactattccataaaagtagttagtggccggccagccatggtggctcatacctgcaatccaagcactttgggaggccgaagcgggtggatcacgaggtcaggagttcgagaccagcctgtccaatatggtgaaaccccgtctctaataaaatacaaaaattagctgggcatggtgacgcatgcctgtaatcccacctactcggggggctgagggagaagaattgcttgaacccaggaggcagaggttgcagtaacactagatcacaccactgcactccagcctgggcgatagagcaagactctgtctcaaaaaaaaaaaaaaaaaaaaaaaaaaaaaaaaaaaaaaggtagttagtggcctttgctcttttacatttaagacattggaaggaagcagaaagttctgttaaacttcaattgaatacttaagctcccctattgaatacttactatgtagtggaagcttttatagatgttgtcaccaaggttttctcacttaaagtagtatgtttcgagactaacaaccagagaacaaatgcaggagttagaaaactctatttatgggattaaattgcatatgtatttttcttgctataaactaattagacagtttaggtagccatctttccatcttgctattggactctttaattactctcttttactgatttaacaactatttattgagcatctagtgggcaccattctaggtactagaaatacagcagagaataatgtaaatatgtcctttgttctcaaagagtttatatttcagtgaaagagacagacaataaacagataactgatttaatgtcaggtagtgggaatgtttctgaagctaagcgaagcaagctggaaaaaaacccacaattttataaaaataaagaatgagtataagagattatcttgtttaattttgtacatccaaccgacataattggccataataaatgagttcatgcattccaggattttgtcagattatggcacaatatcatttcacatgggaattgactgttggcctttagaagaatgaggccggaacaaggaataacagcaagttttccaggccattcttgttagtttgcacccagaaagctaagaataacttgatcaaaaccagaaaagtaagtaacagcaaaactgggcttgagatacgttacctactgccaggtttatactcttttccctgtactagttgcactcccattgggcaatacttttgcctaaaattcacttatcacatgaaaacatattatatagctttcataggcaatagaactatgatgacaggctacagagtttgtattttggctttgctaccccttagttctgtaacttggggaaaagtaattaaatttgctgagcctccatttcctaatttgcaaaatgggaataataaaatgtgttcaataattttagaaattaaataagttaatgcatgtaaatcacttagcatatagcctagtataaagtaaatgttaaaaaaattacatctttatttaatcaaggacacttcactaatacattacagtatttagcccatagaagacattcattaatacttgatgaaaaatatataaaaatgctacttgaactgagggctgatagactttttttttttttaacctggggagtcttgtggcccatccctgttgcattaatttcttatccctctcctacaatatgttcttaggttgctataatagaatctcttggtctctggtgttgatttacagcaatgcccaacctagtaaatgtaagaaagagacttggtgaaagtaaaaggacttttcactttcaacatacttcaggaaattaactaatcttccctaaacctctgaaaagaaggtaaatagctttaattatctgacagatggggaaatggaagcaatgagtctccagttccactcttttgctcagattactaagtggcttgactacatctgtaaactcattaacttgatacttcctactttctttttcaagcatccctctttggaatgactcagtgagcaattcatcacttaattaatgccctttctttaaggaatgattgggtttggcaagtcatgttgcttttccttccgttgccttgaatgtttattctgtacaataaaaacccattgacattgagattacatattccggaggacctggagctttggaatattaggaccacattctttcccaatgatttcttaaaaaataagtcaatgttttctattatatcagggatagacattttcatattctataactattgttttttgggtaaaatattgtatgttatcttcatggaatacagagatgacataaaatataaagcatcatagagagtgggatcagtattttgttctaaaaaaattatgacttctgtgcccatgtagccatatttttttctagtctgctggttaaatttcttcaccaactcttattttgaatctctaagatgttcagtttctcaagaaaaagtagcagccttgttgaaaatgtgaattactagtcaaagaagcctatgagaaaaatagtgcacacaccttacacacatacatatataaaatatatgtcatatatattttaggtatacattgtgtgtatagatacacatattcacacagtttactgcttttattgtttgaaactaaaaatattgaatatacaatgtttacagttatgtgaatcaattgttttatgtatatatttcaagtatcttctctatgaagttctatcatgccagtgaaaatattctgctctcccctatcctaaagctaactcaagccagtttgctccttaaagccttaccctgtacaaactccactaatgtgacaccagctgggtgtatggcagtacacctagtgatgctaaccacctggagtgagtgcagaccccacaaggtaaggactcagtcttctacaagactgtctttaattcaatagccatactttgagggtccccaggacacctgtacttctgatagattggctataagttttgaggttcttataatcccaccaggtttgacaatcctctgcaatgattccagaactcaagaaagtgctatccttataattttagtataaaggatttgcttagggtgaagtctaagagggatcacagagcttccatgccctctccccccactgtgatgatgcatcaccctccagtgcatcaatgtgttcaccaagcaggaacttcattgagcttcggtgtccagagtttttatgggggttttaatacataggcacgactggtgaaatcattggccacatgagtcaactcaacttacagcccttgtcccctctgaggaggtcagaatggctcaaaattccaatgctctattcacggttgttctttctgttgaccaatcccatatgaaagctgtttaagggcctatcagaagttacttcattaagataacaaagacactcctatcaatcaggaaattccagtggtttttgaagctctatggtaagaaccaaggacaaagaccagatatattctttattatgctatagatactcttcattaaaatcattacatagttgtgaaatggaaacaaaaacaagtgaacattaatagtagaaacgtgaaacatcagtctctcaccttttcttccaactgaattgtagctgattaataataaacacaaaatgcctaaatatgaaacagttgaggatacaatccgagtctggggcacaatttagtttcccacacttttctgttgacattgaagtcacccatgcatgctggtcaacactgagttgatcacttactcaggagcaggtaaagcagatggagagtggtagactgacctcacccagatggggagccctgtccctgtcactacttaaattgataatctaggtgaatattgtgcctacacataggcatgtgtaagaggatatgagacaaccagaaaatggctagtgctgtgtttttcaatgcaataactatccactcaggaacaaaaaatatgagccaatggatactagtttcttgtaacaattaactgaattgattattaaaaagtaggtgtattgattataaaccttggcctgaaagaagtattatatggagatccataatagttcctgaaacattttatcctgtggggtggaatctaaatgtgtctactctatgaaaacttgaagatggcattgaacttttccactaacaaaagaataatataaaatataagagaattagaatttccaaaatgagtgttggaataaagaatctttaatttttgactaaatgtgactaataaatagaattctctctactgtctgcatttttccatcactcgtacaagtttggtctatatactctcgacactgctaaaaacttcgctgtgaggtcaccagaacttccagattggcaaattcaatagttttgtctcacatatcaaaattcttgactcctttgcctcatttgacattcgaagccatgcttttctaattggaacttttcctcttttaattattaaccaacagtgtttacatttgccatacctttgacttgcagaaagctataggaatccactgaatctcgttgaggagatgagtgtctaagaaagtccaatatactatgtattctcagctattatatcctgatgacacacactaaaatgacaaagggacaaaagtaaaataaatcctgaaacatatggattttgtgttttcaaagcagctgttaatttctaaaaattgaaactgattacccagaatggtttttaaattccttacagtggtcccttatttccctagtaacagctgtttctgtcttctgatcattcaactttgtgtgttatgaatgttgaaatgatcggccaggaaatataatgtatagcattttgaataacttgataaatgaattaaccatttgaaatccaatacacagttatttgttgggtccttgcatgttaaagtatttacagtaaaacctagatctaggaatccagaaatatgggttagggtaacttgataacataattaattcacctacaattatatgacacaattccatggataaactagtgactcatagggtcactttggagttatcaaacaaatgaagataatgctattaagaaatgtccaacaacagcaaactatagaatcagatatgagatttttttcctcatctgtggattaacttcatatatcacttgtcccacatatttatgcattctacccaacagtaatgaagacattatttaaaaaaataaaacttcaaggtgaaaatatttgtccttaatattttattttactcttcagtaggactataattatagctctagcagagaaagctgttaagaaatatttttcggtgccatttataaaaaacatcgatgatggataataaccatatgagggactccatttgtttctactgcaaggtggtgtcacaatctgttctggttcattagaatgtcaggttatgcgtctgatgcattttccatttaaggatgagatgagacttggtgtgcatctgtattagataaataattctttctttctcccattgagaaataatatatatgcacaagcatactttagtggctatcaaatatgctctctgatgcctgtgggtttttctttatttcagtacttatgaagttttagcattatctttttaattatccttaaccactgttaataagttccttaaagccaagacctatatcttatttgtgcttgagcttgtttcaggcataatgttctttaactgttatgattgaatcaatgattgaatgaatgcacaagaaatgaaggaaaacattaggcccaaagaagttcgcaggtttaattgcatatatatatatacgtattattatattgcatataataatacatgtattatacatgtatatatgaatacatgtattatacatgtatatatgaatacatgtattatacatgtatatatgtacacatgtattatacatgtatatatgtacacatgtattatacatgtatatatgtacacatgtatacatatatacatatataatatatacattatatacatacataatacatattatgcatgtatatacgtatacattatacatatgtacatgtacatacaaatacatatacacatatatgtatatgtacacgcattatacatgtacacatatatgtatatgtacacgcattatacatgtacacatatatgtatatgtacacgcattatacatgtgcacatatatgtatatgtacacgcattatacatgtgcacatatatgtatatgtacacgcattatacatgtgcacatatatgtatatgtacacgcattatacatgtgcacatatatgtatatgtacacgcattatacatgtgcacatacatgtatatgtacacgcattatacatgtgcacatacatgtatatgtacacgcattatacatgtgcacatacatgtatatgtacacgcattatacatgtgcacatacatgtatatgtacacgcattatacatgtgcacatatatgtatatgtacacgcattatacatatatacatagattatacatatataatattaatatattatatatattatgatatacattatgtatatatacatatattatacatatataattgcatatgtacatatataattgcacatgtacatatatgtaatatacatatatatgcatatgtatattacatataatatatatgtaatttactttccccacagaagatcgtaggcactgactcacctcttaaatcttcgaagtagatttgaaagtgcaatagaaaaatggcacagaaacaaagaacctaacttttataacatgttgacttcatgaacttttatgtttcttgtgcacttctcgtttgttttaaatgactgttgaaatgtaggctttatgaaacaacatggtgtttcatgggctgtgtacttggtaatgtaggattgtctctctgggatttcagtttaggcacttcctgaaactgtgttaattggcacccctgcagttttaaagagcttgatgcagctccccaagaggctaacttattttttcctcctcagaaagaaaatggtacaaagagaagatgctgctattagaaaaacaaaaattggatagtttttcataggcaaaaataccagcctaaatcataggctaaaatccctgcacagtttaatgttaatgagtgtactgtggaataccacaaaaacatggggcttgaatttttatgagctttaaaatttcagttctgtcatttatttggaaatgcgacttttcttaactgaagaaaaatttacatacagtgaaatgctcagattttaagagaggaattttaagagttttggtaaatgtatacacccatataatcattactcctatcaggatatagaattatttccatctacacaaaaaacctttcctgtgtttcccttctgatcacccctttctcctaaaaaggcaaatcgtgttctgacactgtgatagatttggtttgcctagtcttgcaatctcttgtatctggatttttttgcttaacatgtttttgagattcatctatattgttgtgtgcattagcagtttgtttcctccgttgctgagtcacattccaccttattaatatactaaagattttttatccattctccagttgatggaacatttgtgtggttgacagtttttgtttattgtgaataaagccattgtgaatatccctgtacaagtctttttgtagagatatgttttcatttttctgggaaaattcttagaagtgaaattgctgggtcatagggtagcttttatgtttaactttattaaaaactcccaaactgttattcaaaatagttgtaccatttttttattcccgcagacaatccgtgagagttccaattgcaccacagactctctaacttttgatattgccagtattttttaaagtttagccttttcaatgggtggatatttatatctcatttgggtgtgtatttgtatcacattttggttataacttgcatttctgtgtttgaagacttgattgtcgtatatcaatatattgctaccagctttcttatgcttgttgtttgtgtggtgtatcttttcccacttttttactgtgtttttatatttaaagtgcatatcctgtaaacaggatataattttgcatttattttgtactcagttcatttgaacatctagtagatttacatgtaatataatcacggttaggtctgccattttcttattagtatatttattctatttgacttttaaaaattctactttcctccttttatcccttcttttggatcatttaaatatttattcaactgttttcatggcctttgactaaattgttttcatagtttttgctttatatatctacagagagagctttatatatacatgtaaatatctaattaattaaaatatataaatatataaaactttatatataaatatatatttatatctgctttatatataaaggtatatgtatatatacacattttagtgttgcttccaaagatgacaattggcatccttaatttatcacagttcattcataaatggcattgtactacttcacttaaaatgtaagagaattgcaaaattataaattcatttaatttattcctgtcctttgtgatattgttgtcactattttacatttatgtatattatacatcccataatataatgtaaaatttttttctttcaaaatttagttatattttacagcaactaagaaaaaagaagtttatttacccacttatttaccatttccatttctgttcagtcctcatgctgccttcagcctaaaaaagtggttttagcatttcttgcatgcagttctgctgccaaccttctcagcttttattatttgtctgatgatattttattttcagtgttgttgttgtttgtgtgtttattttgccttcgtatgtattttttcccctagatgtgggattttggttaataattcattaacaacattgttctattgtatgctggctgccatcgcttctgaagagaagtcagtgtatctgcaaatcattgttcattggtatacacagtgctgtttttctctggctgcttccaaggttttctctttgtctttggttttcgggagtttggctatgatgtgccctcatacctatggtatgatgtgcctaagtgtggttttcttcgtatttatcctgcttagagtttgttgagctccctggatgtacaagtcgaggtattgtcctcgaattggagaacatttatctagtttttctccacattttttctacaccattctgtttcttctccttccgaaacttcaattacacacatactcgactgttttagattgtcccacgggtcactaaggctctgctcagtcatccttctctcttctggtcttctttgacattgaataaagtctatttatctgcttttcagttcaatggccctttctttggctatctacaatgttctgttaagccattccagtacatttgtttatattggttttgttttgttttcagttctagaatttttgttccattctttttttcttttatatagttttatctgctgatattctccatctctttgcttatttgaccatcttttcctttaaggcttcaatatatttataatacctgctctacacatttttcttgctaatgcaacaactgggtaatttagaagcccgtttccactgattttctttccctcttgataatgtaactgtttttatcttatatgtctcatattttattatgttaaaaactaagagtaatatgctgtaagggttccagattctattatctttcttttaagaatattgctttttgtcctagtatgctagtaaaaatcctggctgattagcttagaattgtggaaactttgtttcatgcattttttctgtcttttagtctgagagtgagaccttagtatttgtttctgaagtctggtccaaaagtggctaccaagcctctctaatttggtaggagtcagattctaaattctgcctctttgatagtgggcagaagctgaaatctctgctcagctttttcaaacttcgagctgttgctttctgctggaatcactggagttccccccacacaaatttaggttaggaatcagccaggatttgagattgccaaaataaaattgttttgggccaatgtttccattgcacttacatgttgcatcattctgttctgattgctgtaggcttttaattacaacattgggtcttatgtttgtctaacagcttcttatattttcctatctctacttccataattaattatatactaacatttgattgcatgacctctttacagtgttactgtgtactaatgcttagtcttattttgttttctctctttttctctttctctctctccctttctttctttctttctttctttctttctttctttctttctttctttctttctttctttctttctttctctctctctctgtctctctctccctctctctctctctctttctttctttctttcccatttctgagaagtgaccatcattgtatttaggtctgtaaatccagaacccaccagttaagaatgtttgtagacaatgttgttaatcattcattcattgcaccattgtgaatttgtccccaccaaatttatatgttgaagccctaaaccccaatgtgaagacatttggagatggtacctttgggagataattaggtctaaatgaggtcatgagggtagtcgtcttatgatgggattagtgcccttataagaaggtatgtgagaaaatttctctctctctctttctctttctcttttcatgtgaggacacactaagtatttattgggaaaagaggacacaccaaaaagtgcctttttttttcttttcttttctgttctgctctcttttatgtgaggaaagaccaaaaaggttgacctctgcacaccaagcagaggccttaacagaacatgaccatgttggcaccaggatctcagtctttcagtttctagactgtgaaaatataaatttttgatttttaagccaccaattttaaggtattttgtcttagactgaagtgactaagacactccacttccataatctggttgcttatgaatattttctctttataaattattactcttatcagttaggatccattatcagcgctacagaaataactctcaaatcttggtgacttcacatcataagatggtacaatttatctctagcaaaagtaattgccagttttttttgttaaacatttttgatgtttgttttgtgttatgcctggaactcatcaaacatctcatattgttagctgttaccatcattatcatttttatcagtcatcaagcccggtgaaaacattaattaattcttctgacaatcctaggagataagagctggtatgttatccctgttttacagagaaaacttctcaggctcacaaaatgaagcaacttttacaatgatacatagataaaaattggcatatctaagattcaaagtcatgtctctctggtctggcatccagaatgttaatcaatataatacaatataatacaaaatatatagattaatatacacatggcattaattatgtttcaaacactgttgtaaaatttaacatattctcatttagtaatacatggttgaatagttccctgagcatgaaggcattatcttattctcctttactagtaggtacaaaagattcccagtaaatatttacatgtttcattttaggcctatatctgaaatattcagatttcaaatcctaatatattcttgacttcattcctaatgttctttgtcataatgtggtaatgaattttttttttaaacttaatgtgtagaaagtgaagacttttcctgttttaagatggtcaaaaaatgttgacccagaacaatccagcaaatgtgttccagaggttggttatccaaaatgaatgaaaaataactcatattctttgtctacaaccatctatccagggatccagctgcaaagttgcaagacatcagaagctttgcctattgttaagtacaatggtagcaagttctttaagtctctcctatagaagtttttgtttaagcagtgttagatcttcatgaattttggcattttttcctgcataccttagtagactaagttgatcagacatctacggtgctggggaacaatagcttcactcttaaatctttctaagactaatattgtataaactattccctttcttacttatttaagaattgttgtgggatgttggaaattttaatgattcttatttattgtttttgttagttaccatattcactttcccttaattttctttctttcttttgagttctttcaggtattttgtgggatgggtggaattattaatatatagttatgtccaaaaatgaaaattcagtggaaaagataaatttaaattattttctatatatggtatttgagatttttaagatgaaagagttgggttattattgaatgtacacaataatatgcaaattattttctatgtagaaaaataatttaaattttgaataatttaaactttctttcaaatgtccccatttggaatttatattggtatttattgatactttttcttcacaattcaaattaaatagtatcatataatctcacctggagaagtattaacttctcaaaaactgttgggggtacatagactttatttaaccattcaacttaattcagtccattttcttctttgtttatttattcacttaactaatgtttacaaagtggcaagcttttaaattgctaatagtgccaaataatatctaaaagaaaaatattagatattttctttaaaacagaaatttctgagaaaattaaattagaagcaaaatttgaaaaggtcaggaacaacttcaataaagcaattcatttttcttttttttttattatactttaagttctagggtacatgtgcacaacatgcatatagtatgcagcctttttttttcttattttctgggatcattctgcttccttatagacccaattcatgttccagtcccccctatattgtaatcacatgctgggtttttaaacatcttggattgctatcttgggcagccaaaaaggaaaaaaaaatcaaatgtgaatgataatttttaagaaaacagcttcaaatgaatgggatgcctatgcacttccaagaatggggcagcaatcaacaaatgaataatggccacagctgagctctaacaaacacgggatgatccagctgaagcaaaggctacaattggactaatttggcactaggtccattttagtcctggcattaggaccacattttatttctgctagtgacctagttccacctgcatttgtcactactgctttcagttgctggacaaactatttgtgagataaacttggaacagtgatctggactaaggcaaatgcatattgcgttttctatttacaatggctatgaggagacagattgtctgacaggtaaggaagccctgcccagttttgcctgcccaagataacatctagcaaatgagaagaataaatcatgccattcactacacaaatgtattgagtgcatagtgctgtgccagttggtatgctagcaatataatgatgaccaaatcaaaacattgtaagatactgacttagaaaaaagatacctttttaaactcacacaaaacctagggggctatgacacctgagggacaggatagcctgacttgagactgacaggctaggaaagactcaaaacatgtaacatttattttctttcatccagcaaactgttactgagcactcatcaggatagagatactcggccaagccttgggaaaacagtggagagcaaaacagacacgcacggtttctgttcacctccggagtatacagtctagtttctttttccagttagataggtgtctgatgcctagtaggagcctaataaatgtttgctgagtggatatttatgtaatacgttctacagtaaagtctagactggttttctcaagtggtcctgtcccataaatctattatatggatgaacattctttaagtgggaatcttcttaagaatcacaaagttgacaattaccatgtacttttctatgagtaatataacaaagatgtgtaccagataggacattagccccagtagaatctaaccctggaaaaacacaaagtaaaatagtgctgatcacaactaaatattacaaaacagatgctgggataaaagttccagtagagcaagtggttttgaggatctatatttcaagaagagatacctgtaaaattagttgccggtaaagtttagttcataatgtacttgattaaaaatagattggcaggaggtgtttttcaagaagttaactgttatttaaagagctttagagaagaaagggtagtcatttttaccatgctacataaaggtcaggtaagatggaaactaaagaaaggaaaattagatttgttaattagaagttacttggccttttagtatcctggtttaagaggtaggacattgccaaagagccaatttcagagaactggaaaaaaagacgagaaaagagacaggcagatgtttgagcattcataaaatgtttgagagtaaaagcaagatggggagagagagcagcagtttgagtgtaagcagaaaagggaaatatgtgagcctttacagagtagtactaactgtaattcactgtaccaagcaatggggttgtttgcctacattatgccatttttagtgaaaatggtgtctgtgctatgattggagatcatttaccttcataagtaagtgctgcacgatagagtattcaagtattcaacaaaccatagagccttctacattatatatttcagagtcaaaatgaacatcggcatccatgtgagggaactgtgttaggttctgtctgattgcaggaagaagttatatggttgcgtggccttaggcaagacagatgatgaaagagtctgggcacatgtatggacaggctttgtgaagaattggaatggtaccgatttgttattgaacacaggtccactaccatggctctgaagaaccagtgatcttgtatttccttaaaagcaggtgcttgcttcaactgtgactttacagtaccttggactcaaccatttttttttttttttgctgcttttctctttgattcttgccctcttgagttttctgctgctctgtcatcgtacactcttttctctgtgtctcacgttcaagaccacacaagagaaagaatggttcagtcagtccccattcattatggaccatctcatttgacatcttacaccacaccagattagaggccactggttgctgacagctacttcgggcaagtaagtagcctcctgggtcaacccatgaaaggcaaaataataaatcacataacatacaaaaagaccacttatgtgaaagaaacaaccaggggtggtttttgcagaagaaggttgcagtcatagaggcgcttggtttcaatgcagataaagtttccaattttctcctgtgtgataagattcaacataccagcaggatttataagcagatatgtctcagagttagcatgcaattggaggtttcaaaatttattttttcccagagtaatgttaagtttttatttattttttcttaatttagaaaattctttcgggatggagtaagtaatgaaaatctgagtaaatagaatcctcagggaagtgtccatggccgagtgctgagcataaaagaggctgatatgaaatgagaagaaagatacactccttcttttccctcattccttttgttttagttgaggtacagtttagttcattttttggttgatcattatgtctaattggaaccagaactcagatgaaaggttgaattcaaggaagagggtactgtgaatttgatcatcaagaaaaactacaaagataaataagtataaaaagagtcagaagccaaaagattagtctttgttttaattcttacaggttattttaatgtttctataagactatagcttttaccaaactctgcgtcaactctgacaaatgttttgtgctcctccctccaccctaccaatccattgtccacggtatgggtttagttaattctcaccatttttaccctttgctattttgtgctaagacatgtgatacctgcaggaaaagtaatcattgccagtagacttactgtccaggaatgggtaaatgatagcaccaaatggtacagcttaattaggagattctctagcattttcctccattgttccggtccagcatggaagaagctggactccttttcatttcgtccgctatagtgagttctatgtactaaaaataaaagatgatatcaaatgaatcaattcacttgccagtaaaagaacatttccatctgtatatttctttttttaaaattatgtgcaggtaataccaatttagagaacagcaataccattgcaagtaattattacaatttctccattatatccattgttgtggatagtatgttcatgattctgccataaatccaatcttctcatctagagttgatttttgtttttatatgtttgaatcttgtatttttaaattaaatatgtttagcttcccttaaattagatgaacacaaatcaaagccaaaccattttaacctacaaatgtacttcagtacatttctaactataaatgacaatttaaaaaatatacataacatgaaattttgcctcaaaatacaatttcattatttattttaaaaactgaagatgtaaaacttcaatctacctactatggaaaatcatttaatagccaagtgatttactataccacctaaaccttcaagaggttttaatttctgtgaaaacttcttaaagcctttaatgccagatgtccaacccaatcacattatataaacattgattatgtacctttccttataggaaactataatgtaaaatataatactgattcaggccaggcacggtggctcatgccagtaatcccagcactttgggaggccaaggtgggtgtatcacttcaggtcaggagtttaagaccagcctggccaacatggtgaaaccccatttctactaaaaataaaaaaactagctaggtgtgatggctagtaatcccagctactcgggaggctgagacaggagaatcgcttgaacctgggaggtggagattgcagtgagccaagattgtgccactatactccaacctgggcaagagagcgatactctgtcacacacacacacacacacacgcacacaattatatatatataattttttgctagaggtgccttcccagtctaagtcctttggcattcatttccattcataaaactttaatggattacctactaatttccagatgctaggttgaaaggctcatggataaagcatagagaaatatttgatgagtggtctgggaggggagaagaatgtgtaaattagcaacatcaaggtttgacaagatctgcagtggaggtgtgtataccaagcagatgaacacagatgaggaacattcaacacagcatgtatgcagggagtcctggaaagattgtttcagaagatgatgtctgagatacaagttgaagtacaggttgtgagccaggggaagacagaatgggtggaggggaaggagagatggcatagaacaagggaaagagctgtgtttcaagtcattaaaacaacttggacagagacacagaatggagaaattgactgatgtggggtcaataacaggtgtcagagtttaaaccctgaagcaggaagtgatgagagataggctgcaggggttgatcatagcccctcacggaaggtgctggtatgtccatactcaggtgcagagcctgccacgaggatggattcctaaattaggatgttaagcaggatgacacatggcctcacatgcatttgaattggttactttaggatatacatggtgaaaaaatgaattgaaagtaggcatggctagaggccagcattgttcttaatggtatattgcagaggtccagataaggatttgtgagggcctggtactaggagtatgttacatgtaagaggaccaagtcaagaagcatttaggaagtaaaatcagtaagtcttagtatttgattcaaattataaagaggcaggagaatggaagaaagcatcaggaacccatttctagcatgagtcgttaagagatggtcttgcctccaactgactgtttctgaggagcagaggttcagctgaaagaataacttgagctgtgactcaatctatgattaaaacataggataattggatagactcattatttgattattgccgtttgttttcaactgcattttcttcacattttatttttaactattaattgaattctatagtatgcatgcagtaaagtacatgtatcacagcttagctacctggttgtcttcattttgggaaaaaatcatttctatgtaaacttaagatttgtacatagcctcatttctttttctccaaagtgaacatacctatgtaaccaacatctgaatcaagaagaagaacatattaccagcacccccccaccctcagagagtcccgtttcagggccttttaaaattaagcctgagattgactatctatgaaaactgtattccttagctgcccattattttggcaaaaggcaataattgatgaagttggaatttaagttggcagaagtgtaaaaggcaggagatttttcagagctgttaacactgcatgtggcaaagatcacctctcaaagaaagcaggggttatgcagtgaattcatgaattcctagcagaagggacctggttagctatttttatgagagagggtatgtttttccttaataattagtctattgagttttcatattttatgatttttttttttttgagacagagtctcactctgtcacccaggctggagtgcagtggcacgatctcagctcactacaacctctacctcccaggttcaagcgattctcctgcctcagcctcctgagtagctgggactacaggcatgtgctaccatgcttctttaattttttgtatttttagtagagatggggtttcaccatgttagccaggatggtctcgatctcctgaccttgtgatctgcctgcttcggcctcccaaagtgctgggattacaggcatgagccactgcacctggccttatgattcttaaaatgcatttgcttcacatttttatatctctgactttgagaattatcttgcaatggatgctgatcagcctggtgtgccatcagcctggtgtgtggcagcccccactcggttgtttttgtcctcacttggcttgtgctccatcatggccatgactgtcatcacttcaattaagccatgtgcatgactagtggtaaatgtattgatgccatgtgccaagctgtgctaccagcttcaggagaaattttcctatccctcagaatagaagaaaggaatttcaaggtcatgagtgactggtatgactgattcagcaggtgtattggccacacatcaaacaataggactaccacttcctgttaactttgaacagaagctccttccctttcagcagcctgtgactccatagagaaagaaacaaaactgagttggttcaggttagacagcactagcatcaaacttttcaaaatgagcttagatgaaaactctgtaggaaaagtaatgaaacatagactgatgattccaagggaaaaaaagtgattgagaagagctgggtcctgatgaacttttagtaataccattactgcttttttttaacactataaaacacacttaaaaatcattgtgtacttgaaatgtttctttcaaaatacgtgaaaaaaattaaaaaatatgtacgaaacaattctaagtggtaagaatgcattgtcatagtttaattatagtgactttattttatttttattaatactttgttttagagcaggtatagattcacagaaaaattgagcagaaagtacagagaattctcatatttcccctgcttcaacaaatacacagcctcgttccttatctacatcctgcacctcagtggtacatttgttccaatgtattattttatctagaaataatatttcaacatattgcccaggctggtctccaactccaaggctcaattaattctcttgcctgagcatcccaaagtgctgggattacaggcatgactcttgatgaacttacaatgacacatcaccatcacccagagttcataagtttattttagggttcactcttggtgttgcccattctatggctttggacaaatttatatttgcagtgttttttatttttgtattttgtcattgttgttcttcatggcatattaaataatggtgcatcttattagtagatggtataagatgtgatgaaatatggtatctgtctccactcccaactcatgagccatcaccagaattctggtgcaaaccctcaacggtatggttttctatggccgaagtgaaaatagcaattgtcatttgagtatttagtttgcgtctggtatactgacaagtgatttacttgtattatttttagtggtaacatctctataaattatctcattttgtagattaagtaagttttcaaagatgacacgggacttcaatgacagagttagattttgaacagatatttatctgatttcaattgccctaaatacagctactatgcatattgcctctcagataatagatactgaaatttttaaaatcagctgtgtcatggcaagtaaagatgtgtgacttaatggagataaagcttaacattttggggaaaacgtgtaagttcaatgacttttataatccttggtttactctagtgcagatatgaacaatagcacatacttactagaagtggaacttgctgtcaggctacttaacattgtaatggtttaatgagcaatgaggttattacacaaatgcaacccattctgaagatgctcagtcccttcacataccttacttcaaaacctactttgttaaaaataataatcattataaaatacagtcaactttctactaaatctattctccaattatttaactctggtttatacattcacatctggtgaccccctgataaactgaggggctttgttctaaaacaacagaatacattttttaatacataaaatttactaaggattaaacatgcacatctggaaaatgcagtctcctctttcctctaatacagccacaaaaaggatcaataaagctaattaatctgctgctttgaaataaacgcacaggtccaattgagaaaacttttttcctctgcgtacctggttctgttgaaatcaccacagaacttgtgtttcttggcactatccaaacgctgcacttttggaaagcctggagtacatagctaattagaataaattgggagtataacatagcaggtctggggtaaaagtcagaaacaggtttggaccaagtttttccagtttctaatgaccagtttcgtggtgttttcctttcatcgctgatctcaggaacaattggagatcatcactgctgcccaccccatgttttgccctctcctggtggcagcatggcatgctatcaccccttgctcctctgcaaatggccctcatgagaaggagctcggatgaggtagtgaaaggcactatttgacaaaaacttgctgtgtgccaatcactgaatgaagatgattttcatgtgtcatttttgctattctgtgattcagtcttttcacttcaatccatagatatgtattctaagtcacagagaaactatgccacttatctaaggtcagatggctaaatacttgggtaagagatgacttaaatctaatgattttagattccagagcacatgatctgaaccataatgctatattttaataagtacaaactttaggacaatgttggttctccatctgcttaaagtcactctgcttctgtgtgcaattttcttagcttctctttgctagtgataacagacttgctgaagttgtcccaggaagatgcaaaataacatatgtcaagcacctgaaaaaatcctaggtgctctgagcgtgctaatttctttctcaaatcccccttttcctgtgttgctgtgagtgccagtatctccttgctgctcctgccaatgagatagatatatagatagatgctataggaatattgacaagagcctttttctcaagttaaggtctataaaaggctggtggatgataactccatctctgctttctaaatcaagggaagggctaatctattataaatgttactcttccctggagacttctatgggaagtcattcaggacaggtagctgtaatggtgtcactcagatcatctaattaaatgacgcctgccctcactaatcatggagagggcctagaagggaaggcgacacattattccagattaattcctgattattctgtacaaatagaaggtttagtaagagagagcctgaatcaataagcatatatgtgtcagagggttgaaatgaatctttcatcctcctggaacagtctaggtttcacaaatcaacaacctggcagtactgcatttgggtacaaaacaaggatcagaaaattaccttttatagacattgcctttcagatgtctcattactgccactctcaaaccttagattcttccagagggctcttatgcaaagaccctggcaataaaactgcaaactttacagggaagatgctctaaattgggaggtttgttttcctggattcattatcagcatatttcaggggtgcatacctgttgtgttggacggaaatactcagactgtaccaacagagtctggtgatggtggcaaaaataatttcttcctttgagagttggtagttattaggcttagtgaccacagaaacaattgtctaatgccatttctctccaggcattactggttttaccataagttgaaaatcgtgaattataacaactgaggtgcagctatatggatccaagttcattatttccaagcaccattgtagacacttctatttgcatattgaatatataaaaccatctgtcattatgcccacagatgaggaaactgaggcccagagaaatctggctgatcagtgggaaagtcacacattttcatccaagtgttttgcctctggggcttcagtccctcaccacagtcacatactgtctgtctctacttatgcccttatttaaaaagtgtactgttattatatttgtaaaagaaaaaacccatatgattactttactgttataagaaggcaacaggttctgtaccaagcaaaataaattactggagtggtaccatgaaaaaataattctcccatagttatcgtactatgaagattttgctcaaaatctaaaccttccctttttagatgttgctctattttatttcttcctttaaaaaattttgaggtttattttgttgcaaaataacttcatccacacagcttaatactcatattttttagtgtgttttgagaaagggatcaggcattaaatgagttctctctcagtgttcaagtttcaattgctatagattgaggaaatgaatcctttgctctacttggcaatatttgaccacttaatgtataaaattagagcttaaaatcaagttagggaataaaattttgactcaggcaatttgattttgtgctttaaaggtgaaagtgtatgaaagtattaggagtagattgggaagtgttggggttaagcactgacttcatcacacgccaagtaaaggggttagctccaggaatacacagagaaataaactccagtcctcaaagagtggaggagatgggaaaccccgcagtggcagccttgtaaagaaaagagccaggccgtttaatctggtgctgtgttgtgtcctggcactaagattcccaccacctcatgagtcagatgttgaagaaaaaaagtccaattcaagatacccaatctttttcctttccctttcttttctgaagaatctgaaaagagcaaataatacaggtcttgcctaagtaggcccttggcctccacaacattctaaaccaagactttcacctttgttctttcccttggaacccatagactaacccacgtgtatctctgaaactgtggatcacttaagcgatcatcttttccttgtagaacgtgctccagttggaaggggacattggattcctgcatcaagtggtctaagctatcccctgactctggggccctcctgggtatcagaagacttgcacttgagtccaatgcctaccatcagttatcctcatgctctcccagtcagttattcagttatctcagagtgcaaagacggaagaacacgacagttcagataaaaagcctcatttaaaatctggaatgctacccttatgggccatgtgaagttgagcaaatccttagtcaatcgaggcctccgtgtcatcattgtaagatgtggcagtagtaactgtttacacatttgtggtaaagattaaatgatgtttctcaaaattccaggctcatagaagttcctcagcaatgaatgcttcccttgttttcttcataaaatgagaatcccagtttcttgccatctgaagaactataggaccattttggtttatcttttatcaagttctgggggtgggggccttgtagaaaattatttatggagtacaaaaaactccttaactattactgtgagttacaaaaatagaaggacaatttctgtcaaagggaaagatagttttcctatgcataattatttataaaaacccaaaagaaggctgggtatggtggcttatgccagaaatcccagtactttgggagggcaaggtgggaggatcacttgagcccaggagctagagaccagcctgggtatcatagtgagaccctgtctctacaaaaaataaaaaataaaaattagctgggcatggttgtatgcatctgtagtcccagttactccggaggctgaggtaggaagatccttttgcctgggaggtcgagtctatagtgagctgtggtcataccaccatcctccagcttgggcaacagcatgagacccagtctcaaaatatgtaagtataaatggaaaaaatgaataaaaaataagaaacttcaccattatctaaaatcctttttagagaaagaataaaatttaatctagtatgtcctttgaactttcctctaaaaaaaagttacagaaaacaatagtttgctgttgatatagcataaagtagcattatatgtggttaatttgaaaattggaggctcgatctttccaatttctgctaaaaaaaaagaagagccaaagaaagtaattaaaaactgatctgattcctcctttctagtagtgagataaaaatcaccccttttcacatggttttgatgttatcttggaagacaatgagccagtgcctctggaaacttcctacagaatgtttttgtctttttagatctgaaaatactgagaatcaaaacactgaatgaggttttattttgtttcgttttttccaatcacaagaacatcgatatcctcaccttccaaaatctttccacatttacactgtgtcctacttaggtggttacacttacattttggaagtgtgacatttataaagcatatcttgacttgccttaaaataataattaatctctattttctctcttttaattaactaggagcattctaatttcttgggtttaaagcgtagcaacaaatttcctacagaattctcattttaaaaatcagttaaattttcagttcttttctgtcctttatacattttacccctttttagaaactatgagtgtgcgtgtttgtgaccaatcagattattctggcattccaatagtctgtatgcttttgcttccacattttattaaacgttcctcagtattgttttcccatatgatacattcacatttttatgagatgggtttttgtctgtaatttctttttacctccctgggccctttcaaaactgattccttgaaaaaaaattgcatgatgattttactgaacatgctctactggaaattgtatacgtgctgggtatcaatgatctattcttgctaggtcattgcagttcatgatgccttcttgagatttcacacacatgactagattcgtagtccatatactttgtaaactctacaaagtgcttgtgataacatcagcagaacaaacataaaacaattacactctcaaatacattactcgacacttttcatcactatttgaagtttgagctataaagtgagtactttcaatgaatcatttgaaatgtgctctaacattcataatctaggactggatatttccttgtagtaactcacgttaggccaaatcctgtatattaaaggattaacctaattgtttctgtgagctcttcctctgttccagttagaattggaaattaggcatctatacacaaacactgttgattattttatagatgaatttgcattaggtttattcaacgtagaacaaaatcaggtcaatatcttagaagatgacttcagctcatattttaaaattatgggcgcttctgatttacatagctcatttcctcccattgtaatatgtgtttgcgtggtatttgtcttgctttgatttaatatggcttttccttgtaaggttttctagagatggcaatctttcattaatgtagcagatgatgacttttttctttcctcacagtcctacaaataaatcctaggagattgagagataaaataaacaagcacaaaaagtctcagaatattaagaaaactgaagacatttgagacatttgtcttcaggaggaaaattagaaaaaggaggtaatcctgagtattacaaaaagctggtttacacagtgactgaaatattcatgtaccagaaagcctaaaacaaaagtaaaaacctattagtcaagaacgggaaaagagagatgtataggagactaaagtttgtcacatctaaaatctgtctcccaaatccacactagatgtaattgtgaaactctaccttaatttacataatatttttagggagtgagaagctggaaaaatttggggtacccactctctatcataagtactgccaatatcaattttaatgttttctaaaggattgattgaacaataaacttgttatagaaatgataatccccttaggtagctacaaaaacattttgtatcaggcatttatactttcttgtgaacacagtgagatccatgtaataatcagctccatgagcaaattatacaagattatacccaaattttactgcatatagttatatatattgccaaaaatatattctacattaaatatgcaatcatttaaaataacaaatgtggatcaaaggccatttgccatttgtgaaaccaacaacaatcacaaatgcttaaattacttggatagaaaatgtttgacccgtaacagttttaaaaatctcataactttctgcctctctggagacagttttacacatagaccataacaagtttactttataattttctggagaatagtttttatttgttagaagggttggaattatgaaattcaagttaaagggaatcctaagttgtcaccaagctctgtcacagcttacacatgtccccactagcatcctacacttacctgtatcgcatcacttacaacactttattattgtggggtttttttcttctaacttctttctccaaatccagtcaataatctccttatccatcatggtgcctctggccctagcaggattcttgacatatatagatttcaataattgtttgttgaactatagatgaaagagtattatcatgagaactttctgtgactgccaggaacactcatttaaagttggtccaacaactcaatgtatcctcctacggcagattccattaaaaagaagtgactaattgacctttagtcccatattcactgatagaaagaagaaccatttgacttttgctgtggttttagattctctgagatgttttttgagccatcctcccatccatctattcatccatccatccatccatccatccatccatccatccatccatccatcccctctattcattgtaaggcgttgtgtttatggtactttacatgccacatgaatttgttaatgaatgtataaatacattattgaagttattatgagttatctatgcttcattgaaacctatgccccattctaatgtattcaagaaccaaattccaccgtagattcttacaaccaaagcttcaacattatccccctttcctcctaatttagattcttttctatctccctcttggtctaattgaaagattaactcattctcaaagaagaactgaacatatattacacatctatagatgtaaagccactgggggttactatactgcaaatatcaatgaggaagcagagatgggttttatggataaagctgaaaacaatgccaatacatagtgactgctgtggtttgaatgtggtccccaaatccatgtgttggaaacttaatccccaacgcaacatattgcaaggtggggcctcaaaagaggtgattaggccatgagagcagagctctcgtgaatgggtgaaagtcattatggaaggagtgggctagttatcatgagaccatattacaaaagagagttcacccctcatgctctctctgtctcacatgctcactttcaccttccatccttttgccaagggttgccgtgaccaaatgctggcactgtgctctgttactttccagcctccaaaactaaggaccaaataaaatctcttttctttataaattacccagtctgtggtgttctgttatagcagcagaaaatagactaagacagtgaccaaacctaagcttgataagcagttgttcacctgtagttgtggctgtgcctggctggaaaggtggctggtagcagcctatttgcagacatcttggcaggcatcctgatgtatttactgcattttgccccaaacctatatttatttgtcatgatgaaagaggtaaaaagccctaagaatgaatgtattacatatattttgaagattaaataatgattgaaaatgtaatgagaactgtatgtaataaatttataggttgtcaaaaaaagatttttttaagaaaccctaattctgaaagataaaatgactactaaaacaaatattaaaaattaattaaaatatttttatctgtgttttaatatgattagctcttcaaatggtatgaactaattgtataaaactgtagcttttaccaggttgactttcttttgcaaaaaatggtggtaaaatgctctgaaaaatttggctgacttacctacacagtaattacctaactttattctactttgataatacttgttagcaaaagatatttcagtgctaacattttaaattgttgaaaataggaaaagaacattttctgcatctagcacatattatttaacaaacatctgttggggtagatacctcccatcagacacaaataacttttcaaaaagaatagttcccttttatgtctaagaaaaagcaaatggtgaaagcaactaataagctcttaacaggcactttattgtggggaggggaatccatttaaccttgaatatcagggtgggaacaacctgcagctataaaacaagcattcctgagaatttttgaaaaggtctccttttccctgttgagacacatatgaaaattatgcacccttacttacagtgaaattggtaaattagaatcactataatcagaaacatttcatctttgaacatgtcagtggtaaatgcacgattcatgcaaataatgtatccatcttctgctcctttcatttcttcctttctccattacaattcacttctatttattttcacagtaatgtgtgttgagaatgtttaaatgcattctgcagttctttaagctgccttgatgagggtgaccaatgatggggaggtcagagtaccagaatggtggcttgcaattggccacccatcctgactggcttctgtgcactctttttaagaaagtggggccaggcatggtggctcacgcctataatcccagcactttgggaggccgaggtgagtggatcacctgaggtcaggagttcaaaaccaacctggccaatgtggtgaaaccccgtctctactaaaaatacaaaaattagatgggtgtggtggctcgcgcttgtaatcccagctatttgggaggttgaggcaggagaatcgcttgaacccaggaggcggaggttgcagtgaactgagattgccccactgtactccagcctgggcaagagtgaagctctgtctcagaaaaaagaaaaaaaaaaagtgggatgcattgttcaggaatgcactacatcagagattaccttcctcactcactccctgcttactccaatgggggcttctcaaacatttctgtcatcagccttggaggtcaacgcttcctggatttgcctatgcttctaaaagaacaatataaatatgcttgtgtgaaattctcactttgcctcattgataaaatctttcttgacctgcagatcaatttggtctgctgcttctccgctcctgagtttggggtctccattgtgttcagttgtattttgaatatacaacaatataattctgcccctttcaaaataaattttgtcctttgcctaattatattcccttgccagcctgcctttatcttgatctagtgcctttttctagtctagaaattttatgtctctttcttccctttcttcacattccttaccttgcttagactttggtgtgatccagaatcatctttgatggaactgtaactggtatgtttatttttatgtttgtttttttcctaaggatacagtcaaagcaaaagacattaaatcagaaattctatattctgaccaataatggtactccctgattctgaaaatactttagttgaagaaacattccagtttcaggaaagttcaaatgtggagcatagcatgcttagatttaaacatattgatagagcgggtccttttatctcacagagtagagctactaaaaatacaaaaattagacaggcatggtggctcacgcttgtaatcccagattctcaggaagttgaggcaggagaatcgcttcaacccgggaggcggaggttgcagtgaactgagatcgcaccattgcgctccaacctggagtgatatccagagtgatatagaaaatatcacttaggtggtggggatgattgaaaaccagatttggaacctggcaaacccagaatataaagtttcctaataattgataaaagattcattattttgccaggatagacacaaaatttagctttttaagaaatttcttagattagaacaatgatacttttttcttattaacagagaggtgattcagtcatttattaatagacctacttctatccagggctttttccccatcacaatgagaactttttgtaaagggaaagaaaatggacccaagaaagggatatcatgaaatataatgtcttgtattcatatttcatatcttatatttcatgatttaaaacattaatgaaatatagccatgttccagtcccacatactcatctaatgttgccttttgcatctgaaatattactatgctagtctaagattaatagtttcttttctttttgaggcagagtctcactctgtcgcccaggctggagtgcagtggcgcgggtctcagctcactgcaacctccgccacctgggttcaagtgattctcctgcctcagtctcctgagtagctgggactacaggcacccaccaccatgcccacctaagttttgtatttttagtagatatggggtttcgccttgttggccaggctggtctcaaactcctgacctcaagtgttccgcctctcttggcctcctaagtgctgggattacaggcgtgagccaccatgcccggcctaatagttttttattagctgcacagggaggctaatcccagtcactcaatagactgaggcaggaggatcacctaagcctaagagatggaggccagtttgggaaacatagcaagaagagtctcaaaaacaaaacttagaacattttccttatttctggtttcatcccactcccctcatatgtctttcatagagtatgcataagatcaagattgcttgtttggggaaaaaataatctgagatttaaaaaaatccctttgcataacaaatttttagagcttgccatccagatgactaaagataaggttatgatgtcttcttaattcattctgagttaatccgttctcacaacaagctgcacatttatttattttctaccttttgaacacttacatttatttatctctgggtaccctgttgggctacattccatattgtgacgtgacagcttttcatcagctttagaagggatattttgcaaaatgactgtttcacatcactctatacccatattagagacttgttggcagtaaaaatatttacagtgagagggctgtcttttttgttcacattttctgatgtagttgctgtcatctttgcaactgcttttcttctcagggcagtgaaccagctaactacaccatctcctgagtgtctattttgagggtgagaggcttgctttgcttctgttgatagaaatgggatttatccgtgaaaattgacaactgaattgtcaccttcccctcaggtggtttcctaattataatttgttctctgccgtgtcaggaaacagaagaatagaaaatcagaatcttttttacttgctgcaaagcaaacaggatcaggacagcctgggagccagggaaaatcacactggaaatagctcaaagttcctggtgggttgtaaagatgggctatttgggaaggttattcaggtggttcaaactgcctagggccttaagtgaacttgaataataataggccagtgatttctatcccaaaataggctgctgctctggtactttgttaaaatttgaaattacttttctgaaaatgccatctattaccataactctgcacagaaacactgacttgtaagtagatcaacagaggtcaaatgtgtggcactcaggcatagagcagtacattgaaaatcccccctaatgtgttaattgccgtgctccagaaagcatgcttcaataaaccctagtcacatatgacatatgaaaccccgaaggtttgtcaacttccatgggagtatgaaccggtggttgaatgactgataatgcttggaaatgcctaggcattttgcttctcattttgttgtttgatgtatgagcttttactatttcctgggctatgtggggtgagggaaaggactgagttagctactaccactcatattatggggaattttaagtgttctttttaacaaaaagttaaatatctcaagataaatgtgttgttgtcgtgagaaaccatttaggttgccccctcctctctgcttctccttccttttctttagtctcttttccttctacctctttcactttgttaatctcttcatggcccatcatatatctctatctccctggctcactgctgtgatgtttctccattctttctcatagccaatgatctaaatttgttaagaaatcatttggacactatgtccctgagatattgagaacaaggtgcacacaaatctattttaaaaagttgagtaaatttcaattatttaaatgttctactttatggaaattatgcaaaggtggccagtggccagaatcatgagctcttgactagtagctgaaaacatccccaaactggaatgatgcctttcttaaaaacagctcattctactaaaaagtaatgtcagttgtaaaaaattatctgacactcttcttccagaaaggtggaaggatatatgtggagagacagtcttccattcacagttctagacagcaaccacatttactccatattgacagcgtcacacctttctctcccctaaacacctagagaagagagattacttctctttgatttctaacatcttccgcaagatgattccaatgaagtgttcaggaaacagactgggcagagaaaagatcggatgagttaatggggatagattccccaccactacaaagaaaataattgatagcatctaaccctaataacctgaatgacagtatcttatataaatttgagttaataattcagcatccacttttctgtttagcaatatctgctaaattcaaagcagctgctttctactccctgttagtattctttagcaaagcttctagttaggataatccttaggatatataaacattttggttttattttttctcttaatactaactgggaaggtgcattttaaaagttatacataacatatataatatttttgtagttagtaatgtgtggagtataattgtaaattttatgtatatgctacacacccataaatgagacatgtacaaatgcattggtttcaaatctaaaagaaactggtttgggatattttgcctttttttgtttgttttacttccaatactgttagcctaaccccaatgatcgattttcaaatttggaaaattttaagagacttatctgtgagatgtgaagtcaaagctttttaatatgcttaatgacttgcttttggtaatagattaagatcagaatgaaaagtagaccttttctgtggcataatagtgccagcctggggaaatagaattatttcgagtaggaaacacacactataattttagagagataaaggtaaaagatggccagtaaaagactagaagagttcaaaattaaatatatatgtattatagattactcataatatatataatacttataataatatttatgtgggtccctttactttaaaaaactggtggatataaagtattgatcttccagagtccatttaaaatttgattcctacacttgtttttcagagtgtagccattcattgtaaaaaataaaatgcatctcatcattttgcttgatattttagctgggaagttatatttttattcttcctattcattttctatgcatgaatataaacatgactcaagtttgactgctgaaaaccagacacctaatacccttaattcattgcctcacgatgaaaggtctgatcatgatgacatctagaatctcatgggttcttatttgagattatgttttacagctctaggtacttttctgcccttagtaacagaaaaattttaaaaatcagacttccttgtttttttttttttttttgagatggagtcttgctgtgtcacctaggctggagtgcagtggcgcgatctgtgttcactgcaacctccgcctcccaggttcagcgattctcttgcctcagcctctcaagtagctgggattacaggtacccaccaccacgcccagctaattttttcatattttagtacagatggggttttgccatgttggccaggatggtcttgaactcctgattttaggtgatccacccaccttcgcttcccaaagtgctaggattgcaggcgtaagccaccacacctgacccagacttcttaattgcccaaactggagcaggttaagggagctatctttccaatccatggagaaacattatggcagaaaagagcacaggaacctcaataaactatcataaagttgcttttaagctgaagttgggagaaaatgttgctttctgaaagattcttaaacttgctcatgttaaaattcaagagagtctttggtaggagaaagttgaacgtgtttagtgcacattcacggatgttcatagcagagttggtatgttataaagacagtactgttaggagtgcaccaatttagtagctgggatgctttcatggaaacagaagcactatttggggtcattgtaggtgaccctaatggaattgtatttttgacatcatttgctacctgtgatcaacaaacaattgatatcctactagagaattattgcctacttactttgtcttctttgccttctacacaaatacttcaaaaattgatttagccacacataaatgatcagccgttatccgtttacaagttctctagcctaaagctgcacatgatcaacacttatccgtccatgattgtggcagataatgtccattccttctatattccttagtctttcttagtcgaagaactaagcttgattcgaggtgacaatatactggctaaaaaattacatttttaaaaaatcagttcttgcaactacgtgtgattcatgagaatattttggacaatggtatataggtgcaagtgttgtatgccaagctgggaaggtaacatggaaagacttcacccaacaaaaacaactgcccatttgtctttttccatatcccctttcttactgcttgagagatgagttcatgagtgctggagcttcagcagacatctgaaactatgaacaacactgagaatggaattgacattctaggacagcgctgcagaagtagcctgggtccttggtgactgaaacttccataccagctctgaattctttacctgtcaacttactatgtgagaaagacaaaaacatattttcaagcaattgttatttttattttctatttttgcaagcaaaccggtaaataattggtattgcttaatcatcaaaatgagtctttaaaattttgaaatcacatatacagagggactaaacactttagcagagcagtatagatttttggaaacatcactacacgacctagtcaagagatgtgattcgaattgtttctcattaactctatggccatgtggcttttggtaaataacttttcctctctgagcattgttttcttccataaaagtagagatctgactcggttagcactaacattccatctttgacctgttgagataccttgtcctgactaaaacgtcccttataaccttgagtctaaaggctatgatcaggaagagaacacaattcccaagtccagtcgagatttacctttaataagaattcatggcttatgggatgggcctggtggctcacacctgtaatgccagcactttgggagaccgaggtgggcgaatcacgaagttaggagtttgagaccagtctggccaacatagtgaaaccctgtctctactaaaaatacagaaaattagccaggtgtggtggcaggcacctgtaatcccaggtacttgagaggctgaggcaggagagtcatgtaaacccgggaggtggaggttgcagggagccgagatcgcaccattgcactacaaccccagtgacagtgcgagattcttgtctcaaaaaaaaaaagaaaagaaaaaaaaaaaggattaatggcccatggagaggattagtagctctatctcaaaatcttccctgaagcaaacttgttaaaatacagctagtggtgttggcactgatgaccttctctctctctccctcaatctccccaggaagcagtcaacctaaaatgcaattacatgcaaaaaagtttcagtcatggtaattggaagatgatatggtggcaggtgatgtgatagcaaaagtcagtttctggatgtaggaaggaatattgaaaatgttagattctagaacaaatcaatatttccaacagtgtgcaatgaagggaacctaccaggctactccagcctgaaaataccttggaaattttacaggaggtatttcttcactcactcacacacacacacacacacacgcacacacgtgcgcaaggaattatatcaggatttattagtcctgaataaacttcactagcattgtgaatttaacgctaagactttcccttccaaaagctttattatttattttcccttttctattctcatatattcatccaggagctaggaaggactgacaaaaaaaataggcaaatgctcagctttgcttcttccaccaagatctgtgatctgtaggcagaagtgattcttattaccaaagtgagtaaagttcttactccctctaacagcagggagtgacctgcttcaaatgtcaaatggaaccatgaaaaccttttgtcacagggccctcgttaaacaatcaatgacacttcgtctacttgaatccttggggagtgatgccggtatcctcatggaagggccccttagatattctgttagaggtatttgggtctcagtagctgttgaggtgtctgtgcatctcttatctatccttctaagagtgcagtaacatatgttataaatatcctgtatattttattttattttttatttttgagttagagtctcactctgttgccaggttggagttcagtggcacgatctcggctcactgaaacctctgcctctcatgttgaagtgattctcctgcctcggcctcctgagtagcggggactacaggtgcacgccaccatgcccagttaatttttgtatttttagtagagatggggtttcaccatgttggccaggatggactcgatctcttgacctcgtgatccacccgtctcggcctcccaacatgctgggatgctgggattacaggcgtgagccaccgcacccaggctattctgtgtattttattagtccagaaaagtaattattgtaataggagaagaaacaaagtaaatttagacggggatcaattttgtttattttatcaccttgccacatcattttctccagctgtaaatcaggtgggacaatggactctaccctcaagctaggaaagtgtctctcatttcttcaaaggacacctacttcattactttttgaatttgcttttaccatttctcttcattgggaaaggctttcatttgctcttttgctaaaggaaatctgcctcctctctcccaattagcttaaacaacacctcttgctcatacgtttcctaaacttccagttttaaagagttgttctttcttcagtgaccttttagtgttttatgtagactggtgcccccccaacaatatggttactgagaaacaataaccatataaaattaaaatacacattctggggggaagggattatgggtcaaatatgctttgtacaagctacatattatattccttacttggtatgtaacaaaacataaatacgctcatggagttatgtattcattatttaaataattcctgggtacccacaagcatacgtagagctggcctacctcattaattactatatctgcagtgcctcaaatatacaaattttaaaaagaaaaaaagtcatatgctactgatggggtattgtattatctgaattaaatggtaaggaattatttaccatgcagaaatcgtataaatctttttttggtagtaggaaacgctaaatgctcattttcttagactatgaggcatatcaaaggttgaaaaaagaaagaaagcatagcttacctccttttataagaataaaagaactaaataaaaattttttgtcaagtaagcctctttcaggaaatcaaaggatcaacacagatttaatttcaccttctgaaacatctacatctgtggtcttttacaatgagaatgtgcccaaggcttgcttgacgctgaaagtggcttcggaatcattaagtgaagatttcaccatgttccatagcatttctgttaagtgcactttattgttcactaacttgttgaaaactggaattgccatacagcataccatgtagtttacttgactattcaataaaccataacactccattttcaacccttctgaataatcgattttttttttactagaacatacttatacaagtggtgatggttctcaaaaaatcatgtggatttaatttcattctgtcctggaaaagtatcttttcactttaagaagttcctggctgtgtccatgtaacggactcagcactgcagctgtgttgtcattgtgcattctactgagacacgagatgattgaaggtggctaggaaacacaaggagctctgataatggggaaagtttggcaagtagaaagcaaaatgtgaaaagcagagagagaatatgaaatgttaaaaatagctttttcttttattttcattttgtgactacagagtgatggttgagattccccttttgcacagacagacctccggcccagtagtccccaactgtgacaatgttcctccacccccaataccacgcacacatgaggtgataatttgcattgctgggagaactatttggttttgacaactggggaatatgctactggcatctaggccagggtactgccacagagcctacattgccctggatggctcctgtggcccccacaacaaagcattacctagcccaaatgtcaacatcaccaagtttgagaaatcctgctctacagagatttgacatttatattgctagcaaaatacctcaaaagtcaacctttagtgtttggtaagccaaacttctatgtatgagatgctggctcttgaggcctggaagaagtctaggatcatatttaatcaatataaaaaggattaataaaaatcttactctgtttagtttttgtctcctaatatatggttgtctatagggattaatcctaggttactgaccggcaagagttcatagacaattaagattaggaaggaggcggagaggtcataaaaattatatttctcctttgcttttctctgttactctaggtaagtgtatgctgatggtttctgggataccacgttgggatggaaaggccttcattgtattatgtcattgaatgctgtgggaatatggaaaaaagtatttctctaatctacagatgatctcagaaagcctcgttacatactacacacacacacatgcaacccctcccatacttataactaagatgtctatttaagcaaatagcaccagacaaaatagcaatgtatattagcatggaatgtgcaactttcattttgtaggtatttcatcttaaccctgtgatgtgtcttgggatcgtaagattagcgtcatttttctgggtagagaaacagtcctgaggagtttgtctagcttgatgagaactgcatgttactgctatttttgcagctattaaccataagacaaaatttgcagcttcttccttattttccatgttccataaaaaaatgggatgagacaagttctaagtgatagtctatctctattcctgagcctaatattttcaaaatatgaggtgtgtaagataactaggtttccccactgtcgcctggcaaaatcatcatcatcgtcatcatcatcatcatcatcatcatcatcagtaaccatagacttatatggtttcctctcagatattttattttaaaaaaagttcctttcatctagaaattctgaccacaccttgatattgcaattccttgttcatattggtctggatcaggccatattacttctcttgaagctaaaaggatcctgtgttctgattggtcaacttggaccagcatctggattctgaagtacagccatgtctccctaaaccgcaggaattcagggatgagaaaaggtggttcctcaggcaaatctgggaactgtaaccaagagaaaggtacacatatgctagatgggcacaaacagtgagtatgacaataatatttccacctataacaggttgttgcaaaaatacatgagattatatgtacatataaaataccacatataacaatacccactacatataaagatttagtaaagcaataagcattattttaaacatatgctataacaaatataacttgcgatccacacacaaaactacttggatttcaagaaaatggttacaaaccactcacagaatgctgaaggtgtttggtgttatgtaattagagagatgaaaagtgaaggaaaaaagagttgcaataattgatgataacttccatcatgagtaatttaaagttgtgtataactccagattttaagctaattcaagattattagttatctctcagtagtttggaataaattaataaaaattaaattacccccaaattagaattcctgcccaaccatcctatgtgagcagagatgatatctagaaaggagataagtataaatcaaagggagtgatgtttcaaagaataagcccgaaatggttcttcaatgattttcccttttgggtgatccatatcaataaagcttaataagaactaagagtgaaattactactaactgtgaacttaataatgccccactgggagttcattaatatctcaacaggtacactgaagcattatcttaattgcacatgatactttcaaaaattcgccttttacaagttttgtggaaactaccctctagaactagcattagtgaattttgttttgcctttctgtattgcagttttgtactgcccacatatgcaaatcccccaggaacaaatgaaccacattcgccttccaaaaagtaagatactcctcaggtgactgtccttgctacaggcaatgtgtttataatacaaagcagaatacaataaagagaggaagaatataatataaaaaaatatactgagaaagaatgtaatatagagaaaaaaatataatatacagaggaataatacaaaaagggaggaagttaacatgcatggaaacaatttcagaactttcattgtgttctgaataaataaaataatttcctttatgtaaatatttagaaatttatttttatgagaactaagcttgcagtggagcagtggtggaaatttggatttttaaacatttctattaatgttttctagaagacatctgtacttgagtcttcagtgacaattattgacagtaagatgatgcctaagggagtatgtttccaagcctaggagatccttctgcctagtagcagtttactatgtaataattatgggataaaattaaacttgactcaatcttgtcaacatttagaaagtgaaagtgcgtcatacatgcataatatttctttttttattagaaatgacatataattattttctctggatttaatatattatttttattcattttttttttctattttaacttggcagtagtaatgttaacatcaagtaaaatgaggacccaagaccataaacactgtatttgctatgtgggcctggcagcctggttcctgaggggagaggagttaaggaaaaggcagggcagaaactgcctctttaaaatgacaaatcctagttatgtctggcaaagtttgaatcctgaggcatcatagtttatgttgcctaggttgtcaggaactaaggcctaagaaaaaaaaacaaaaacagagtgagcagcttcctaaatgacttccttggtctctttacctttgatcttccatccaaatgatagctttctttctcctacattccccaaaaaagtatgccgaggaaaagaaaaggtgagaaaaagtatttgccctggagcctaaagcagcccatcagagacctacccaggacaagaaaaactcccaaatactgtgagtgtctctggccacaccaactttgtggatgaggagcaggtcaaagaaatctgttctcttagcttattccattttatccatttcctggcatgcccatttcttcaatgaatactgatccgttcctatgctgttcccaatagagtggtatccaatggggaaacaatgatgagcaaggtctttttcttccataagggtaaatactctcaaggaatggggagaagaataaacagataatgatacagataattgtttaattagaactgtggcacttgttaccaaagaaaactaccatgttccagaagaacccatcaattgaccttcctctaaattcactgtgctttctggggcaaacattgtagaggttagggcagagccttgagcaccttttagtgattaatgtgtgctgtttattggatataacttaacttttgatcattctttcagtcaaccaaaataattcaaccaccacaatacattttattgatgagatatgaatatttatgtctcaaaggtatatataggttgtatatgatatgttatttatgtgtccattttaactattcttgaaattgttttttcccctagcattgtttctcctagagttacaggaattcttagaaccataaatttgcataaatattttaaaggtaaaattagaaaccgagaattgggcactttttttctatcttgaaagtaagatctgaatttgggaaaaattacatctgatgacttgaaagagtatgatttttattgctgtttttattccctgtttgcttgtttatttttaacaatggccaggaaagttgacttcaacataaaatttatatgataattttgaggcatgagaattgctctcaaaccttgattacttgaaatgagttttctgtcttgtcatcagtgtcacctgactagtgccttgagagaaataattggagagattgagaagatttgagttgagaaaaaaacttgggggagagagatgctttcacagctagttggagacccacatagagaagtggaattagtttggcatctaactgtgaaaggcagaaaaagcagagaggattatggacatgcaggtggtggtggcccaatatttggagtggtgcaattcaggaccagaaaaacccacataatgtcttctcttcattggaacgtcattaagaaggagtgtgaatgccatatagactcctggagaaataaatacatgccattttagctaataagtcaaattactgtcagttcattcaaactgagaaataacatagtaacttgaagacaacacatcagagcagactgagcttctttaagaaatgtaaatgtaaatattttatacattaatagtgaatttcgtaagacatccaagtgcatgagataatatctatgtagtggtagaagtaaaaatattcctgtgtttctatagatataattttatataaaaatgcataaaagtgataatgacatgccagtaaatattttttgttcttaaaacactggctattcacttggctatctactcaaaaacaaaaaacaaaatcaaagtcctagcccataacagataatatatattaagtagatcctagatgcattaaaatgtttaaagatcagttatgcaaatatataatcataaactgtaggtgacaatatgcccaatcaacaagacgttagaccctttttatcactgagagctaagaagctatagatgtggtagatcttctatagataaagtagatcagaagaaaatgtttttgtatatcaaagataccatgaataatactaatagttacatattcctctttcacattaaaataaatacataatcactttataggcatactggtagacatgaaaagaaggttctttgtactttatttaagcaaagaagagtgagaagttaaaatattaaataaataatggatttggtagtatgaatatattgtcgtgttcattaatgtgttacagcatgtgggaaaaaaacagacacatttgcaaatgactaaagattgaaaaatactggcataaagtttagttttttttcacaatttctttaaatcagcaaaaggaaaattaatttagatatacattacattattagtaaactgtaaatatatgttaccatatatctatatggtaagccttcatttataaaagcaatggagacatttattaaattcagtgaaagaaatcacaggaagtgcagaatagattcctaagatgtgttctgttgtttgtacacatttagacttagctgctcattaagacccaaaaagatattaaaggcatacaatgacaagtgtaggcacattatagataattaactactactgttaagtttgaccaaaatttcacctttactatatttttttagtttttctatattactatatatagtatatatcctactttataatatatagtacattatataatattatataatgtactatattatactctataatataatatactatatattatactatatagatactatatgaacctcttaaaggattaaaggctataggtatttgattttcttaattggtaaagagagaaagaaagaacaccacagagatttggacgttttgtcatattttctttttacggtactgaacacctcaaagatgctggaaatagttggttctacaatgatattagaatgatcacaacatctagcataacacagcaacacacagcattcagaatttgtaaattaatctgaagcatcaatataaaaatgaaaaacttagttttaattactgcttaaagttatttagttagagaagcaaaaaggtctgtagcattctaaaaagtactgatttaaaaaatgcctaggggaaattttgattttgtagaggagacaccttggatgtttggaaatgtattgcacatatgagagcgtgaattcatgcatagatcttttctctgaaagaatggaataccttataataaattatcttcaaggaaataaatacattttcttctccaaacaggattctagatcaatgtatagtttagagtgatatgtcgatacagctgattataaagatactttcataggtgatgagtcagcagaggtttagaaaagaaaaactccttgatattggccttggcaatgatttttttgaacatcacactgaaagctcaggctacaaaagcaaaaataaataaatgaggcttcatcaaactaaaaagtttctgtatagcaaagaaaacaatcaatgatgtaaagagacacctaaatacaagaaaatatttggaaaccagtatctgataaggagataatatccaaaatatacaaagaattcacacaaatcaaaatcaggaaaacaactcaattaaaaaatggggaaaagatctgaatatacatttcttcaaaggagacctacaaatggccaacaggtacatggaaaggtgcacaacagcaaggaaatgcaaatcaagaccacaatgtgatattgccccacatctgttatggtggctataatcaaaaagacaaaatataagaagcattggtgaggatgtgtagagaaggtcccccttgaataggtgataaaaggttttggatgtctcatctttctcatgagagagagtgagaagttataagactaaaggtaggtagtatgtcagaaaaaacatgaagtggttgagtattccaagtaaggggagagaaaggcttaaccaggatcacacaatgcaggaggaaaaacatgttataaaggaagggaaaaaaatgaattgtaagccattctaaccagaatgatgttttcttaaaggggaattgtagcacagggcttacgagtaaaggatttagagatgtgcttaaagtgaattccagatttgccacttacttatacgtaaccttcaaagtggttcttgatctctctgtgtcataggttctttatttgtaaaaacagaaattgtgttaatgtgctgttgtgaggattaaaataaaataatgtattacagctcttagcatgatgtttcacacatgggaagacactaaattataatttataatattatcattattttgttattgttcatagaatagctttacctggatatcctgaggaagtacggttctgtgtctcaagtaaaaataagagcatcctatatcaatagcaaatataaagaaaatgctttcaagaaatgtggtggtagatggtgacacagagactgtgtaagggtccccacggtatttttgaagcaagtcataaacttatatagagagggagactttgggccatatgatctaggagttccctttcaattctaaaagtgtccttctaaatctaaagaaatgtcctacaagttctagctaagactttatattgacaaaataaaaatttaaagataagcttcttaatttaactatatatttgtttcaagataagaaattagaatgatactagttggtttttaattgctcactgttcagaaataacaaaagggaaaggaatttttcctattatcactcttgtttttctggaaactctagctgaagtaattagaaaactaactgaatcattataacttgcttacatggaaatcccaagaaaataaactaaaagctattacaactaaaaagaattataacaagggtagaagacaaaaagaaaatctacagaaattaatagattcctatatggcagcaataaagagataacaaaatgaatattttgtctcatacataatgcaatgaaaataattatttagaaacaaagttaaggaatgtgcaaggtttacatggagacaattataagattttaggaagagcaagaatgaacaaccaaatagataaaagtagataatttcccatgcgggaagataaaatgttgtaaatatttaaattctacccaaatttatttatagctatactatgattctcattaaaatcttaatggaattttattgttaacctaaaaataattatcctaaggctaataaggaaaattaaaaacgtgattatccatgatcatgtttaaaaggacagctatgaagagggagtatgctacaactaagatagcctcaaaatactctaagctcataacagctaaaatagtaaaacactggcccaagacttgaaaaaaaaaatcaaatagtagaagatacaccctgaagacctaaggatgtttaagaatttaatatagaacaaaagatgttcttttctgtcattaaagaattattaattaataaatggtgctaaatcaagtagttaaccatttggaaggaaaaaagtatagattactgttcttttgtatttaaaagtccaaagtaatttccatgtagggaaagatttaaatgtaaacctcaaatatttttgttactttgaggtagagcgacttaaacattattgtgaggaaatactcatgagtatgtataaaggcttgcattagctctgaggattttgttttgacttataatgacagtgaaaacttgaaaaggtttaaatatttaacaatgaatgttaggcttaggttaggtcaaatattcatacagcagaatattatgcaaccagaaagaaagagagaaaagaagggaggatggaaggaagggaaggggagactaagacccatattttaataataaataatatttataagctcatagcaataattaataactatatatgtgtagtagtctgctttcacactgctataaagaactgcttgagactgggtaacttataaaggaaagagctataattgactcacagttcagcatggctggggaggcctcaggaaacttacaatcatggtggaaggcgaaggggaagcagggcaccttcttcacaaggcggcaggaagaagtgacaagcaaaggaggaagagcgccttataaaatcatcaggtcttgtgagaactcaatcactatcacaagaagagggtgagggaaactgctctcatgatccaattgcctccacttggtctctggagatgtggaaattacggggattatgtagattatagttcttgatgcaatttgggtggggatacaaagcctaaccatatcagtatctgtgcataaccaaatatacacacaaaggcaataagaaggtacaacaaaatgttgacagggatcaaggtattaaaattaacctgttttcttgtgtttgtttctctacatttttataaatagcatatgttgttaattttcattaaaacgcatacacttattttaaataggttatagatgtttttaaatcctatttgaaactcattaacaaaaccattcctgtgcaatagccaaatttttatgaggagaaaagaataataagatgacaatatggtcctgtgatacagattaaaaatattttagttttctaagttcaagaaaaaaggcctaagaagagatggaatctctctttttatatagctgcagtgttatcacactaaattgcctttatcaaaagatcaagtctccatttccaaagaagactggcaagagagaaaaggtccaatagcagcaagagaaagtatatctagatatttgagtgaaaatggaagttaattgctaaagatgcctaattatcatttgatcagttgtaggtaccagtagtagcacgcaaaataataactatgtaggctttaacattaacttgaaagcaagtaactaaacatgaagcataatagccaggacaataagcaacatcatttttcacaggttacataaattcttccagtccttcacctctattgctacaagggatatccttataaagccgtatttttatctcagaataaaatcctttttgtctttcattccttattcttgcatcattatattcatagtgtcaaaataagtaccattggatagagggtatacacatgatcctaaagagaaatatgggtcttaagccaggagatattccttatttacaccggaagggatagaccacagatagtaaccattttcaaagggtgcacagtaatgaggaaagaaatctgtttcctcaggattttcattactaaaatatggggcatggtgtagaaaatgcattgcattggggcacttcacaattctgatgttttacagtagctacataaatgcaaattcaaggagagggctggatgtatctttattagcaccctttcaaaggtacagagggattttggcaggaaaggcatctgcgcaacagcatgaagcttttacatttccacaagttgaaattgatggaaatgcattgacatgtttggcttctttccttttcatttcttgtgagggaaagcctctctctctttctccctcttttcctccctcttctatttttctgtccaaagcctttattcagttgatatttttgttacctaaaacttataatctccaaactacaatcgacacgtaggtaactcattctataaagatatttgtatgggctttactgaggcgcttatataaggtgtttgaacagcagtctgagagtgaccagtaaaataacttttagtggctatgtagtcagtgatgtgaacagaagtcagcctggattccattaatctactggccttcctttttaatgcttatttaaaaaatattttagtaataattcagcaaagcatcgtacttgtgagtgtttatagctttgtgacctgaggcaaggtaatattcttccaagcctcaattttctcccttgtaaaacaagttaataatactataatatagtctaatgtaatattgtacagtccggttcagagtatttgctgacaattagataaggcaatgcatataaaacttttagaacatgactggtacaaaataaagagttggataaacagtacatattactttgaaagcagtaatgaaaggaatatgtaaaaacattttattgccataggacagtgtggagaatgttcgtgatgacgtgcagcagaggacttgaaagtcaaatgtggggaatcgataactttagtaaggaaaaacataccattctttattttcgatgattattactcccatgtattaagcactcctctgttccaggcatcgtgcaaagcaatgcacattcattttccctgtttctcagaacttgatcttagtgatgtaaccaactcattcaagtgaaatagcttcatcaaattaaacactagcaaacagaaatgccagactctgatcctacatcttgtcaataccaaatcctattttacttgcattaaacctcactataattgacaagttgctcaggtagaaggacccatcaggagacatgcaggctttctcacactggctttgaattaagtcaggggcagaaagcctgccctccaatggtcatagagcagaagtgcatcgtggacaggctgcatggaaaatggtgggtcgtctgatttcagggccacaggacttaactctaatgctgacctagaaatgttggtggagaaatgatttttacggaggcgataactagccttaaactatggcaaatgggtatactttaggcaaactacaaaggaaggaaataaatgggttaatagtgagtagagttttcagggctcgaggaatcaacttgagcgtggctttaccatatttgagctacactggacttttgggcttggtctgagaaaagatcaactggcctttggacacccgagaaaccttttgtgataaagcagggataagacctgggagagtttgtaagcagaattttgtcagagttgatcattcttacgtgaaaattaattgtatcactcattttctattgcttgatagaatcaagacaaagaagggaacaaatgttacggtgctttgaagaggtaactagcataggagttctgaagttagggactaagccagatttctcatctgtgattacttcagggctggccttaggctacctgaaatcccaggcagacatttttttgcagctctttccatgtatataatttaatttagcaaagtagatgtgttaggactactcacatagcccaatttccaatgatgctaagaaataaatactacagcagatgagggagataatgtgattttttttcaaggggcctgtggagtcctaagatgatccttataggcaaaagttctagagctcttcaggacatttggtgaatgccatgtggggtagaggtcagagggttccctgaagggaaaagatagaaatcagaggcccttgtggcctccactcagacagtactgccagctctctcccagaatccaaaagagaatttggaaaattttgaggaaagcctgtcaatgtgcaaagaccactagagtaaatgccaagggggtggggaatttctcttccctggggcaaagggtattacagagctactttaaaatgttcttgtgaagaataaattagataatgcttgtgacttacttagctatttccttggagactatccacaatcaatcgatgttagatggctaatgatatccacccagtattcacaagctgtgctaactaaaccaatctttatatacactccagccaggttgttgtatttttatttctattggtttataagtagtaaagcatgattcaccatgtttggtagaatggtcataaatctttttcttctaaacaaccatgaccctgaccttggaattcccatgctaacctccttcccttattcctaagacaaggaaataaaaaggcaagacgctgaagtcaatacttttgtgctgcgaagaagtagatggttgcatttaggtggtctaaaattacatggtggtgtttggcaaaacatgtatctcctttgcagctcaaaccctgtattttaagtaaactgtcataagtataaatgagtctcttacatcctgacggtgcactctcacgtggtgctttcttgtctttgcagatcccccagattagttatgcatcaacggcacccgagctaagtgatgaccggcgctatgacttcttctctcgcgtggtgccacccgattccttccaagcccaggccatggtagacattgtaaaggccctaggctggaattatgtgtctaccctcgcatcggaaggaagttatggagagaaaggtgtggagtccttcacgcagatttccaaagaggcaggtaggatgagattgctctgatcaagctggctctcttcaaacgtctgtggcttgtagagttctcttcaaacttcattaaataaacactacagactcttacattcccagagtcctgtgaagtacacctgtgatgtcttcatctgtatgactttgttgtttttggagagatttttgaagttgtgaaactgagatcccttgagtactaatagaataaatgaagaaaaaaaaatatgtactaaagttaatatcttacttctgcctaatgggtaataggatagattctagcctgtgtatgaaaacgtgggaaaatgtggctggatgtacctccccatgaagactcttcctctctgcctctctccaaaatggagagaataatttagaattacgtgaatgcaatcactgtgccaactttgatttgaagaatacctggaattcctctgaatgacttggccaaaacaaaattaaataaattatccaggcagtagaatgtatttagacaaacagtctttcaaacttgagattattttgagagagttctcttcagcagcccttggagaggattctcttacgtttgtttatttagctcagattggaagtaatgggttcaaatgtttggccagctgtcttccagtgggcagattttgaaaaatgagacaaaattcttacacttagaaattctgacaataagtattcaggtttccccatatggatgtattggatatggtaaatacataccaatatgcatgcttagatattcccacactcttcttatgttgaaatgggtgctcagtgttgtttgtaagcatttcatgcaatttaaagtgttatttaccagaacagtttactgaccataaaagcaaacaaacaagcaaagcaatagaaagagagctccatgttatgaggaaagatgtcataaattgtgaagatacagctttgagtatttgacggtcagactacagatatactcagaaataaagcgcttccggatacggatgatgctagaagagagaaactaggacttgtttataaatctcatgtttttaattcactgcatcattagctgtaatttcaaaacttcacaggagatctgtgaagatctgtgagattcttattctcttccttctgacttaacaaagctgactaaatagcttctaatcattgtcaagtctcgctctaaccactatttctgggttaaaatgcaacactcggaaaaacttcctttgttttgttggcttggtcttaaacttctagtgtcttctcccacagcgcctatcacaggttagtataatttcctatttgtttgtttttctatctaatcttcatgactataggagaccatgtctgtctcattttctactatggccccaggtgctacattcctaaaggaaaaatttaggctacaattcagttagaaactttctgattaggaaagaaatcttaactctggccttgtggcaggctgtgatttataggactcattaactattgacttcataaatccccaaagaggtatctaatcatttttgatgactatgtttttctttctttctttgtttttctgaatcctgccttgatcaaactaaggctggaggctgacttagaaacatatcaaaaatttcaggatagaattgaatagataaaataagatgaaaagaacatatgggtaaaatagtaagataaagcttagagacaaagggcagatgccagtttgcactatatcattgttaaaagtgagcctcaaatttaacactgaactttaaactggatgaagcaaaggaagaacactgcccattctgttacaggatttacagtgttcatgaggtcaaaatcatgttgattattctgtaaagtgcagctttccttgccttgggatcaagataaatgtttgctctgggtctttataaaaaactatattctatagacaggtcaatggtgactttcacatggttgtttattcctggtgtcatttgatggaaacttaaaacattaatatctgagtttgctattatatataatgactcttcaaaaaggagatgctcttataatatgatctgaactccccagctcatatttttagccaatcctacattgaaaagccccagctaaaaaataaggattccgtcagtggcagccattttggatgaaatctttccatcctagagcctttccccttgaggacgggagtagctaaaaagccagctggtgctgcagaaatgcaaggaaacagtgaatgtttaggtgatgtcttgaaaattaatacctcttcaaggtattaataataagtagtatggtatttggcatgtatttataataagtatttaataagtattcttcttttatacatattatagtatttggcatgtatttataataagtatttaataagtatccttcttttatacatattatggtatctggtacgtatttataacaaaatgcattggaactatatcacatgtgcaagtgatttagttgcatgaacttatgtgattagcaaacaccccttcttttcaattagaagaaaggaagaaagaaagattattagcttaaatggtgtggagtaagtctactcagttttggtatggcctagagaaaacatgaaattcattcagtgagttttatttctgtgggcctctcataaggcgcgcatcttgctgctgcaaaggtgattctggtatttaaagacacacatcccatgacctctaaaaagaatccatctccttcctctgatgttcaattgaagaaataatcatatattctcattccaaaacaataagaaaataaaagaaaaatttatctattggaatttctgggcatatacatggttagggaattctccaaggtaattttatgtgttcacttttttctttacctgcaggctcgaaaaagtcaccctcacaaaagatacaaacccaatgtgtatgggtaggtgaggcgatatggcacaaaaataaataagcacactggttatgctgtcagaaagacctggatttgaatgatggactccatcactctcttattttaacaattttgacacatgctttaacttttcaagcctaaacttcctcatagaaagaatgaaattaatgatttctgcttcaccagattggtagaatgtataagatggtgcatggggaagcatttaatacccaacaatatctgattacattgaatcacaatggctccctataaataagtagagttactgtttgagtctgaaaactttgaaaataacttgagtaatagatgttatctgccttgagttgtaactagagggttattttttaagctgtttctattcttattaacatgctgtcatgatgtaagatggatatgaagaaaaggaagtgagctatttgcattgtcctatgtatgtagaatatgtgtatgtgtatacatatatgtgtgtgtgtgtgtgtgagagagagagagagcaagaaagagagaggggggtgcatagactcaatggcattgtttcagtgtactgctggcaggttggaaggatttacttccattgtttctgaacagtttgactttgaaggttgtgattcttttcctctataaatggcctcacccttttaaaatgctttagcttcaaaatttactttagacttaaatcctgaggcagaggctacttataaaccagagcctaaagcatctccaccatgctcaccgtcacagtgcaccgataagcgcctcttcattatttactgatagaacgaaccaagacaatgatgtcagagaaaataagccatcctttaacagaggccatgtaattgtttaaaacatggaagtctaagcacattttcactaaactgtcaaagacaacctcaatacttattctttcaagtagagtccggcagatttaaatatgtgtggatacttttccttgttgaactttcaaagagaactgtaacatgattttctcagacgatgaggttttgtaaaacagttatatttgcataaattgccctgtttatttgaatgaatgcacatgcaatagcaacaaaggcaatttatttcttaatattgcagggaaggaaagaaaatccactctctatgtgctttaaaattcaggtcagcaaaaatgacctaaattagacatttaaaactcctttatcaaagtgagggtcaaggtaaatgtttatgatagcatgtggcactaataaattccagatccttttaaccaaatctgattcaagcactataagactaaggactacatatatgactcttacagtccatcagactatttccaggaaaatctcatgaatactgcttgacaatatagcacaaatagtaacaactgttactgctatgctaccatcatacatgtcgacttctcaaaacctaaaagatctatccatttgatattttacagtgatcacttaacatagttgtatttcaattgttcttataaagtaattattattattcagataaactctagaatttatttttaattaatactttatcatagcctagcatatttttttcctaaaatacttagaggaagatttgattaactgttattaactgttattcagccttcagttttttagacctcaagctctactaaaaatacaaaaattaacctggcatggtggcatgcacctgtaatcccagctactggcgaggctgaggcgggagaactgcttgaacccaggaggcggaggttgcagtgagccgagattgcaccactgcactttagcctgggagacagagcaagactctgtctcaaaacaaacaacaaacaaacaaacaaacatacaaacaaaaaccagagctagatggattttcctactatgggatttcagagcactgtgtgcctctctccttcacagatacaatgttctatcttgtggtgtgcattgcccattgttagtctttgccaatttactttaagctccataagggcaaggacattttcctgtgtttctattatctaagataattcctagtacatagaaagcagtcaatcattatttcttaacagaaggaagaattgtgtttttcccctttgccctttaggaaaaaaggaagcatgtagagaaacaccttacgatatgtaattttgctagaaggccataaaatactacatcctagatctgcttgctgtggtttagtacagttgctttcactctgaatttacaccattatttcctctcaccattcctatataaaactgatagcagtatggtgcaaccaggctgtaattcctaataccaccatctatattgaattctgttttttttttctttctgtctatgtcatggtgattatggaaaactctgacacattttaaaactaggtagattattttcctaatgaggtgtttggtggttccagcttaaatatagatactaaacatttgagaactcaattttaagacacaaaatcacaaaattcttataatgtcatttatctttaggtacatttaaaactaaactgtaagttcctcaagaaagacttgcatttcatttgttttgggatcctcagtgattagcacaacatttcagcttttaactcatgcttcatttgttagcacctcttgagtatgtccccttcccccatcattacagtgacctctgagacccacttaattcaccttgatttatagttatcattatccattcttccagaataatccctccaatatagtatccattcagctttttagataatctttctaaaacataaataaagtcatttcagtatctgtttctggtttcctcttccacagaggatcaagtaaaagatgtttagcgtgaaacataaggtccttcatgacttgacatctgctttaatctccagtctcattcccatatttatcctttttcatatttaccttgagcccccatacatatactctttaccccacttattcaaccttctgtggatttgcggatattctttgcctttgcagaggctctgctttctgtctggactaccagctaacttcaatttattttttcaaaacatgacaccttggagaaagctctctcttactcagtcttcctcttttggaattcatggtcctcttttggattgtgatgtatacattcatctttttaacatcacaatattcttacatctatttccattgataaattaatagaggatcactaattgtgtaagttctgatgaaagaaaaagcttttgcatcgctgtagagctaaaacagtcagatattcatgttcctagcctgccttgaagctagggtacagtcattaattcagtcttggctaatcagacatacctatcaggaatgaaacaagatctagggacacaaaaaaggctggggcgatggaaaacccattttgttgacagtaacagcagtagcagtaaaaaccacttgtcacagatagatgtggtatccagcatcagctgggtgcagtagaacaatctccagcttccctctttcagaagaaactgcagcattgcccagtaagcttggtactgtggatttttttttttttttttttttggctttgattctgaccaccgagcctcctttgtttctgcttattttctgattttgtttccctggccttcagagggattctgtttattatccctcataacttaaattatttttctgcttaacctagacagaattgacttctgttgtttgccttcaaccttcatgaatataaccagggttgtctctttatgagttccacagcaccctatttaaactctatcatggactttgttgtatttcattgtaatcatctgcctagttatcctctctcactagagagtaaaattctcgaggctagacagtatgctacatttgactttcaacactcgatacccagagcagtgcccaacacagactaggtttaataaatgcatgttgaatttaaaaataatgtgttaatgatacaagtggttatgtctttgaggttgtagtgggtacagtaaagcagttgaaagtttttctaatttgaattttctgaagtgatcattgatctgctataattaactttataggagggaaaaaagggacaagaaatctggtgatatgacttgtacttatgcaatatgtatctgaatggtaggtactatttcagagtaccttctttatagcaggtactatttcagggtaataatgataaataataattctagtagaaacaacaataggacaaaaaaaaacccctctgttttcaaagagtagaattacatatttagagtaatgaacacagcctggttagggcatactacaaggaaagattctgaaagaaggtagatcttaactaaatcccaaaggtaagtagatgttaaccagacaaagctgacctaaagtggtttgtggatgacatactaggaagagagaagcatgttaaaagtccaaaataaaattgcttgatagcgtttaaatacttgaatgttgcaagagaaatactattgctttgaaaacttgtgtgaatcttgaattaatgtgatggaaaattgtcttccaagcaatgtggtagccattccaaaaaactttctggcttttaaaccaagaacatcgggttctggccctaatgcctccaataactcactgggaactaccatattgtttctctgggttggaaagtcatcacatattaatggagaaaactagtctttcttgggtcagacaaatctcagatgtttatcttcctaattacaaaggatgggtttctcccaggctatggattgtcatttttgccatgggactagaaatagatagtgacaaggtatttttgctggatgagaaaatagtgaaaaatcatgtctcagcgattcctcctcatctcttctgcctgccatcattgcacttgataaatttgagagggtatgaaaagatctgaaggtgaagtgaactctttctttacttgcctatgtagaaatgactgccataggatgcatgtgctaaggagaaaaaggtgatgggattctggcagagaggttaaagatgcagtgtaaggaaacatagctcatctttacatagaggggtagagactcaaatatggagaattttattgagccatggaatttcttggttaattggctgagggggaagagcactattgttctatgatagtttacattgggaagtagccacacttttgtaataatatcattataatcaataaactttaggggcaaaatgtttagtcttccctttttaaggaagatgcattcagccttcaaggtgaagctttctcttcctagtcttcacaaaaatgttcagagattcctacttctgtatctcatcggttttgatagatgtcagcaagagagataaatttcagtaggaaaattttatatgtatattggaaagatattgattagtgtatagaactggaggaaagtacccagaaaaagtttcaaggatagccagatctagagtagctaaaaatttcagagtagtaaaacttacttaaatgcttagtgtcattactgaagtctggcatatccaatacgtcctccactcatatcatggtgctcaaatttcggtatctcatcagagaaagtgaactagtgactcatggcacttgcctatgtttggcttttgggaaaataggacaccttgatttcgaatctctccaaggccataaacaatagggaagatatatttcccaatgtaattttagtgttgtaaccaaaagttgggtagtcacagtgtaaaaaaatgctacctttttggttgcccttaccaaaggctccccactgttccacccccacccctggaatacacaagtaaaaaggagtaggctttaactgtgcccacacacaagaaatgtagtattcattaaaacagaggcatgaaagtgggcatcggaattagtcaaatggagagttctgaaaaacaagtagatactccaatccaagaaacattaaattaataaatggttgcttgcaaaatatctatttattggacttcaactgcttcctaaattgttttgtattttgaacaacctgatatgtgtaaatgcagcctctttgagacctgcacaaagggatctgttttcctttaatttggcaaacgaattcctgctgttaaatctctcaagagattatagaaaattctacaaagctccacattaattgcagtagcactctcagtcaagctgaaggggagcagatgataaacatatccggcagtaatagtagccgtcccaaacacactgcattgactgactttcaaataatagtttgaccttgcgtagctccaagtttgtctatttccaattattcatattgcttgttactcttttgcctagatgacttaaaagcaagcacttaaaccacattgtccataatcactggacagtattattccattgcattaatattttacatttggcattagttgtcaaacaagctcctgtttaaataggcaatcctcaagtatcattacactctaaaagcaatgatattagggtgtacctttgaggaactagtgtgtaggttgtgagaagacagaagagcagacagaaggtgctcataggagactaagtattagtcatgaaacaaaaagatcatgagagtagagtctcgatcacaggatgctaagtatggggggaaagccatggggcaaagtacagtcaggagaggatggtcctagtaatcaactgctttatgtgttttctttatattgcactattttctggaatattcccttaatgttattgaacaaaaagtttccatttcctcatgcaatgtgggtaaagtttagatggagcttattttctccgaacaaattcgcttagccttagatgactgcacttagatagagtaatggctttgggtggcaaccggatcagtaacgtaagacacttctattgagctgattctcactttgaccggcttttgactgataattattatttgctccttggcttgtgttcacttccttcacagggagaacgcatccccatatctgttatatgaaaacataaaaacttgtttacagttgactgtgtacaaaaaacaacttcagccttgaagtcagtctcctaagtgtaaactgcatggattagttcacagttaaataatgaagacctgcccttttgtatcatgaccttgtcttatgctgcggaagggaggaactggtactatgcatcacaacaacaaaatttttagttattttgaaagttctttttaatcaacgtgaatttttttcattgttgttttcacttgtttatttagtcttcattggatattcaaatcactttttcaaaacatttttgagaattaacctctcccctaaaagtgcaagtgagatagaccaacgtgggatacttaagcagaaaaaaaaaaaatcagaattctttgaaagattattaggcaatgcaaaaaatactgaggaagatgtaaggaatcaagaagcttggactggatgggaaaagaggctactctagtgacacaagcagcagaagatgacagactgtgtcttcagggtaccaccagaaggatgagtcagctccaactccatggaggccttcaattctgggctccaaactcagcatcaagtaagaaagcaccccattgtctgcagttgatcatgtggtcatccattggctataggtatgtggggtagttgactgacgattccataagatggttattgtagatatttcaggataaacatagaatcttgatacccaaagagtaaatagcaagggagaaatgataaacacacaggatgaaatgtgataaaatagattttcttctctgttcttgtagtgcacatttggaaaaaaagaaaaaaattaatagtgatataaatttttctagttaaagtagttctgttgaaattttgaaatttgaaatgaagggatttttttttccttcttcttttttctttttcctctaactagatcctcaaaagaaaccatcacaacttaaaatacacgtagaggactgttcaagctactagctttctaaaaagatacaaaatgtaattttccaagatttacatctgtgatatggttaagagttttttacaggataagaatggcttttgcttctttgtgctggacagtttgtataaacaaatgctatttcatttttttttttttttaacaatccccaaattcctccaagcaccctgtggatttttgataatggcagtaggcaaacattccttgaaatgtagaagcggcagaagacaggccttgttcctgcattcttccctgcacacacatggatttaataaggtggccgaacaatctgtgctgaagcccaggagagccaggactccttaagaaggaaaatgacaggggctcatcgcacgctgggataaggatgagaatctcctggtagtgcttgccatgcagtctaataaaagctcttttcaaaaactgtgtgggagagcattgcagaaagaaaagcttttagcaaaactagctttatagagtctactgtttgttgttcagttgggaaaatgcaaactgtaggaagaggacttatttaacacacatcttcattttttctgagatatgaataggtaagagaatgcaaaggatagaattgaaatgcaaacgtaggtaagggttactattctgtcataaaacaaacttccacaagtaggctaacacagagaaagaagattgaagacctctgctttaaatctcttccccactctctcagcttctgtttggccatttagttattttcctttgtcttttatttttcctggacaagccagtccctgcccaacaaactttgcatctctataggcttttactcaagcggtgtcctctgcttagaacatcccctctgaagctcagttgcctggtaaaccctccccttagtgacgcttctccagtatgtccccgtctccccaccctactccatgtagtgttcctgccattaatacatatatccatggccacacatttaattttgtcactgttgtaatatgaaagattatgcactccttcagagtagctacagatattaaaaatagggaagatgaactaaacattatcgggcatctctcccagtccaggtgctgatcagagcttataatacagtcccatggaaatattaaatactaaataaacatttgttgatgtagtaaaattctggcatctccagtccataaatctacttgcctttttaatttaaattttattataaatctcacctctctagagagtcttttagcctacgctgtgttatattagagacaaactgctatagtaacctggtagagaaacatgtatttcctaattccttaaaggtagtttagctacaagtttatgacagattataaatgtatataatgttaatgctaggtttcagattgcaatagtagtgattttcttgttgtcagttctgttgagcttgttaaagcaagacctaatgtaattatgttttaaaattgaagcttacactaattctgcccatatattaaagggtttcttttatgtatccaatacatgaagtagatttttatagattagttatgtgtgtgtgagaaagattaagattaaaatagagagatgagacataatttgaaccaaaacattaaagaaatgttgattttaatgaattgggagatgaaaaatgagtattttccccctaaattttaaagatctgttaacgtgaaatacaataaaacacgaagattcaggtgaaatatgtattctaaagggcaagaatattacctggctcaagatcaatttgctttatttagcttttgcagcatgcaaggactaagttcatcagatagggaacaagggtgagactaacttctttattcttattttcccccagagtgaaagagatgagcctgggagggagatcaagcttcattctatgttttatggagaaagacagagattgctagcaggaggtggatagatgttcaatacctgttattcctgcttcccaccttccccctctttcattcttcattccattttcatcatctctccaaacatcaatcgaacacctgaatatgactatttcctaatggttggtaagcaaaattggaagccagatatacctaggtttaaatactagctctactcacattagaaatgtgtgggtcgccctgtcctcttgaatagtgatgcctatctgtctgtgtcaggacgtagtaaggaagcccatgtctagtctggtacctttaaaccaggacgtctcctacttttcaaaatgactcaaaagttgagctagccttattttaaaaactaaaagttcaaaatcagtggtgacatgaggacttatttatttaaagtgcttaagctttggttttagagtttctaagagatctagtggaatttgctattatgaaaagcattacccatgctattatgaaaagcatgaaaagattaagaaatctggctaaaggtcaggtgcccagcttcgaggaaaagttgggcttttagggatcaggaagcattaaaggcacacaaactttacattttgggagtcattttgttgagtaggtgaagtgagggatttggtcttgatatttggctgccccatctctatgtgggagctcaaagttaaaaacccactgtaggtaaatgagaaggacagctcttgaacctgggccagtctatattccttctgtgaagtactaacagccaggctatgtagcctgggtgggagcccagataatgtgagctggtaaaggttattggaaaagtgccaagaaataccaagcttttggtttgtaaccactataaaaagtttatgaacatgtcagaggaatggatgagtgatttgtgaggtcttaactagataccccagtttcgtccttgttttggctccttttcagaatgccaggagagtgcatgcagggattccatctgatcaccctcagtgctctctctctggtcctgctggatagatttaggtttcctttcttttttaagggcctcagtttgctatttcctttggtggctaccaccactgactcccttgatatcttctactcccttgccttcaccttgcttaagactgagaaaggagttagattttgtcactagctcttctttttcctcactgtgtaccccaccaaacaagattagttcaagttaaaaagaacctattggaggtaaactgggagagcaagtactggatctgggatggtccctttcccatttaattaggtccctggttatatgttcccatagcaccccatacttcctctttcagaataatcatttcccttgtaatgctcagcatccgtatcctgtttgattgcaaacttgctaaaggtaggtattgtttgtcttggacttcgctgccagtccttagaacagtgcctgggacacagtgtgttctcaaatatttgttgctggaataaatgaatgaactaaatcagtcttttagggatttattgttaaccaccatgggaaaattaaataaatgcaggggaggaaaacattctaaaattagaagactactttctactctcaggttctgtcttcccctgagctaagaaccagacagccttaggctggtaactcctataaggtggtcctcctctcatgctgaccccatctttactgtacagttcacttttcacgatctgaaggcaccaccaagatagatccaggagtgacaactccagtgtaggtgtccacggttcccttaatctctaccctgctccaagtataaacaaattggggccatttccttagatattggggttttctcaagaaatcctttccctttgtggcatgggtcaaatcgctagtagttaaaaaggtgttaactcttacgtgaaataacactttttctttgtaatgacctgaaaaaaaaaaaaaaaagagaaatgtgtgggtcacttactctaatctagtttccatttttgtgtttatactacaggaataaaaccagttccttccttagaaggcttttttgagaaacaagtaagatacctaatgcatgcaaatgctcagcatggtacccatcatagattaaatctataaacattagctactgtgatgattattataatggttactattacactaattatgtgaatatattagtaacaatattactagtccttccttgctcattacttctattatttattcaacaaatatctgttcagtgcctactggtgtcaagcactattctagatcctaggggtgaacaaaatagaccttgcctgtgaatttaggtgagatgaacgggagtaaacaaataaccatatagcgttaggcaaatatctgtgcccaataaaaacgatgtccttttatttgtgttgcttacattatattggcagatccagatggcttagaaacagggcgaatggagctgagatggcaacaagcatttgatgatattgccaacgtaatgccaatagagcttgctaattacttggctgcagaggttgaaggagatgtatatatttaggttgtgaacaactaattggatggtgatggttgttacgagcagatttaaagaatggggtagggatcgagagccctattttagacttgtgaggcttgaaatgcctacagtatatccaagtgaagcagttgaacaggtagttagatgtataaatctagagttaagaggggaagtccacaatagagacctaaatttgagatctgtgacaaaaatgctgtgagatgggaagcgattacttcagtggagaagatgcctgggaactgaaccaacaagagtttttcaaactctaaaattggtgatctagtaagatgaactaaggcatgcctgaagacgtagaaagaaaacaaggagttaaagtgtcccagagaccaagtaaaaaagtgtttaaagaagcaatgaagatgaaatgaaggtccagtgaggcctgagaactaattattgagctttgcaacatggagatgatcaatggctttgaaagataattttaggtgaaatgttaaggccaaaaacctcaatagagtaggcttaagaaagaatgggaggtgagaaattggtaatagtgaatagacaatttaataggagaatatgctaataaagataagagaaatagaactgtcaggtgtgaggggcttaaaaaggcaatttgaggatgtttgttttctgcatctacttgcaatctcccattactcccatttttcattttttttttttttttttttttttttttttttttttttttttttttttgagatggagtctcattctgttgcccaggctggagtgcagtggtgtgatctcagttcgctgcaacctccacctcctgggttcaagcgattctcctacctcagcctacttagtagctgagattacgggagtgcaccacagtaccaggctaatttttgtatttttagtagagacatgatttcaccatgttggccaggctggtcttgaactcctgacctctggtggtcctcccaccttggcctctcaaagtgctgggattacaggtgtgagccaccatgcccagcctactcttctagttttttctactcctttcgtgcctattctgcatcttcctcctcctccagtcttctgttgctctggactatatcagactaagaatacaaacatgaaaagactcaggcctgtctcacacagagctgttgtctagagccagaccatgtgaatggtataacagcatattgtgctttagaaaacacagaaatatcagaagaggtagctagacagggccccccaaatggcatccagggtgtttgtctcagtgaattctgaggagtgctagcttcctgataccaattcaatggaaaagggaaagaatcttgctcagtgaatgtaaccagaagcgctttctcttgaagaaaacatgtgcaccacccaagaaagagaaaaatttttattaattcattcatcaagtactttgtgagtgcctactctgtcctcattgcagctaggggttttgagtaatcaatagtgagtagtttgtatcctcatggagcttatactaacaggcaaagacaataaataagtaagtgaataaagcagcttaaggggagacagtagaagtgctgtgtgttggatgttattttagacagggtggttgggaacacctctttgaggaggggatatttaaataaagagatgaattaaatgaggaactgaactatgtgaagaactgggagaaattattccagatagaaggaaaagcaatgttccaagaccttgatgtaagcgtgtcttgttactttcaaagaaagtatctcattatgtggaatgatttagttgaagtcatgcttatgccccattctttaaaaagtttcttggatccctttttaaaatgtgttttgaatatttgaaagaaaatgctaattcctgaggtactaatttaacctcatttccagtgttcaagtcatcttgacatcatccctatcagagaacttttgtaaagcccctgtgataaacatgcaagggaccatctcacagattcttccatccatggtttctatgtttatcaaaaattaaaaccatagccacatgcagtggctcacacctgtaatcccagcactttgggaggctgaggtgggcagaacacttgaggccaggagttcaagaccagcctggccaacatggtgaaaccccatccctactaaaaatacaaaaattagccaggtgtgatggcatgagcctgtagtcccagctacttgggaggctgaggcaggagaatcacttgaacccaggaggcagaggttgcagtgagccaagatcacgccactgcactccagcctggacgacagagcgaggctccctctcaaaaaaattaaaaaacataaaaatcacaacctagagtcaaacttagcctatgtctagctctggacacttgcattggtgaaggaacaaagaatgctaagacttctcaaagtttcacttcttcagagttgtcactcataccttgaaccatctgtcccacatgacatccccactatgtctctaacttcaccattaacttggagtcacattgacttcttcctttcaagtccagtgagttgctggattatctttcttcttttcactggtgctgccataaaaatcagacaatattttctggttgtaagtaacagaaaccaactaatctaaatataaagtaatgaactggaaataaaaagagtgaaatagctgaaaagaatcagatagctgctgaaagatttagtaagttggccacttcctgctgaccttgcatttgggatgaataaattcaagcatttcttcagttcttgtaatgatagactcaaaggcagagtctaggagagaagatctggttaggtccaccagatcccttgcccatctctgggttgagactagtgtaatatatgaagaagctgagaacagaaactaaaaaggagtcttcaggggttcatatgtcttccacagtggaaaaatcagcatctgtgtttactgcccagaagcactgtacatttcaccatgaagagagaagaatgctatgagatgtggaatgaatccagaaagccacacgtaactgatacccattttagacttttattattcctcatttgagatattgtgggagcattttccaagtttgtctgttttcactcttcctaacttcctcaccatccgcaactctgtttctggttaaccaccccatggcgcatcccagtaactgcatttcttgtgtagacaccttcaattatcccagaattaaagtatacagtacaggacaatcacaagctagatttgctcatacaaggccagcctctggccccctggtgggctgtgtatgatacagggagaaaaaaattgaagaaaaattaaactatcagagtaatatagaatcaagtgttttatcacctggtgtctattcactttactgtctgaaaatatattttatgtgtatttttagttgggtcaggtttggtttaaatgtttggttcaaatttctatatggttttctgctttctgtcagaaaagaagaaaaatttccactaacagaatgtaacattggtattgccatatatattgaataattccaatagggtacacttagctaattcgatatctatacagctaatcaaaatactaggacttaaatacttactatcatgacatttgggaaaaaatgttagctaggacaagtctcttcaggagattttatttgaaaacatttaccttttaaccatatattgctgttgcacttttttaaagctctatttacatgtttataatttcagttgtactatctgggtttcatcatttgcattctaataacaatacttgtattatttatttggcattgacaatccattattttttctcaataaattagttcagcaattgtaaattaaattttgcttttcaagtagctttaaattctcaagtacttcgaaatatgttatttctttaatgttaaagagaaaaacttgactttcatcaatatgaatgtcatcttttctttatcttactattacttataatatgttctcctgaaagttcattgatttggctaagggttatggtgtcagtttcagaattaaagaaactgggacagagagatatgtataattttataactaatagtctctcctctttgtacggagagcaaagtacttgagccggtatttaaattatgaactttctttaggaaaatgagctatttccaggtttaaataaagttttttttgaatttctaatagtggcgtctatgaattcttttctctgatcttatacctgtaacattgtgatatttttcagaacagaaacattatataccaaatttagccaataggctaaacaggcattttggataatagctgttaacctttttccatgataggattgtttccctctgtcccaataagctgatgaatgaatcatccacttgttaaaaggagatactctttctgagatatcaaactcacgtgaaccctcccttacccttccccagccactgtctccaccccaactgggagattattttggtgtcatatagactgaacttcattccaagacagcctgaagtgtcagtgacagacctgggactctagcccagaaatgtggatgctcagtctctgttgtaaccactaggccatgtacaccaaatccctgcattgtctaagccaattccagggcagctgcttattaacgaacagatgccgcttgatggcactgacatccatcagagaaaatgattctgcttgaatcagtccctgggcagagcagaagtcaccactgtagcctcgtcccaggattcctgcttacttctttattaataataaattcccatgttgccttagcatttatctggctttaggaaatgaataaaatttgactatttgtgtttaaatacaatgtcttgtaaatcatgacaacctttgtattttagtatatttcagttattatgaaataaggtaagctttgcccagctgaatgaaatggaaactcattatatctcaaatgaggtgataaaagatagaatagtattttaataacgtagacaacatggctttttgtattttaatattcactgttctattggtaatggagccttaacaaagtgattttgtttccaatcaatcaaatatttcctcatcagcactctaagcaaaaatactgtggcagcttctcttgtttttattatcgccaaaataagaagcaccatctctaataagtgtcatttgcattaggccatgctgtcagcattcaatttggaagcttgctagtttcttacggagcctgtgacacagggccctcatcagtatgttgtgatgatagcctcacttttcctagctctgctttagattgacagtcaacctgggtttccacacatccctgcatgtgccattgcagagggccattttatagttaggctagagtcctttggttgccaaataagagattaattcttcctagcttaagggaaacattgaatttattaaaagggtgttggcctgtgtcagtgttcaaggcagactagaacaagtaagcctcggaaaatgcaaaatcaaaatacatcagatcctttagcaatgggtccttcggaatcttctttctaggttccagtcattaaaatggctcaactccaatgactccaaaagtcagtttgtctctttaaaaaaaagaatgcaggccgggcacgggggctcacgcctgtaatcccagctctttgggaggccgaggcgggcggatcacgaggtcaggagattgagaccatcctggctaacacagtgaaaccccgtctcaactaaatatacaaaagattagctaggcgtggtggcaggcacctgtagtccctgctactcgggaggctgaagcaggagaatggcgtgaacccgggaggtggagcttgcagtgagccaagatcacgccactgcactctagtctagcctgggcgactgagcgagactctgtctcaaaaaaaaaaaaaaaaaaaaaaaaaaaaaaaaaaaaattccaaatttctgagaaaatctgtcccaattaaagtctgagactcactctttcatgagctcatagtggcagttctcagagaatgggatatctgtgtgctaagcagtcaacccaagagcttcctctcacattccacccctttagtttctcagcatttataagcattgccttttcgtagaaaacacttagcacagtgcctggtactttgcaaatgtgcaattatgtttcaactattgtttcagtgattgtaaatataattcccattgttgaggttcttcatgccttctatggactgaattctttcccctccaatttcatatggaaattcttgccccagtgtggtggtatttgaaggtgaggcatttggaagttgattaggtttagatgaggtcatgaaggtcgggacttcctgatgacatgaatggcctgataacaagaaacaggagagatctctctctctttccaccatgcaaggtacaccaagaaggtgtgacctgcaaaccgggaaaagagcaggacactgaatctgccagcactttgatcttagactctccagcttccagaactatgagaaataaatgtttgttgtttaagcccttcaatgtatgacattttgttatagcagcccaagcaaagacgaccccattcaaatatattcctgttaatataatctaaatataccatacaacactaacaatttagctgccatttacaatggaagggaatgcgtagttatacccagagactgcattcagcattcagaagtgtcattgagtaactaccaagactagtcctaaggtaatggccaacttctctatgaaaggatttcatcttgtcttgatattcaccatatagaggataaatctccaatttaatcacctctacattactcatatcaaataaaggaagaaaagaatgagaacagaccagaaaaggtatctgcattcttatatgtgcataaatatgtacacatactatttttgtctaaatgtatgtatgcatttagaaactttataaactgttcataaaccgtaaagtcaaacttgtatttagcctccctcacctgacccaatctatgtgtcctttgctgttccagtggcttcaatatttttgcctggaattgctttcattcaaatcttcctagactgaaatcatcttgtccggggtcatcaaatgcataggggtgcatttttttttgaatttttcatctctgaagatggaaacaaaagaatatcaaaagtttgcccctaatttcattctataccacagtgtatccattttgtagaaataccatttgtccctttgttaataaaggttactctctccagtcaacactacggctcttgcaatttgcccagctaatcctgtagtgctaagaggagctggtgtggccaggtgacactctaatcttcaattcagaggtgccatcatgggactcacataaattttaaatgtcaagaccacctaaaaacacagaagggatgtgggatagtgggaaacactgtgaaaattatatcattgaattaaatgtgtaattttatctgaaatgggataaaagggtagcacatagcgatgaaggcagctagaatcccaggtaaaacgataagttagcttcatcttacatatgctccttggggagagagcttctttgttttcatccccttatgacacgaacatggtagacaaggttttggggcaatggtttgcttattttgataaacaggagacattattattttgataaataggagataaatagagacgtacttttgccaataattaagcaattgtaccagcctgagctgagcattgaagatctacccaagatataatagttcccataagaagctcaggagtcttgtagggagacaaacatttttaacacctgttaaaatattaaaaatagaggtatatataggacaatggttctgaaactttaatctgcatcagaatcacctaaagaacttgctgaaatacagacccctgggcctcatccgtagagtttgtgattcagttagtttgaggcagagcctaataatttgcttttctaactcattcctgggtgttgctgagactcatgttctggggaccacactttgagagccactggcatagcaacctgtgaagtcacgacagaagcatgttctctccatctggaggagaactgggggagtaaatcgattgttagggctcttaattacaaaaagcagctcttagccatttaagtagaatgggagtacattaagtgggtattgggtggttcatgggcaaatcgtggaggccagttttccagaaacaatgccccaagccatgtacaagtggcctgatgactaaagggccaccaagacttgagtaaggcgtacttagcacagtttcagagctgccaggaacataactctgctgcagttctgattgtgccaatattgatgccacttcttaggatgactatcttccctgaatgccagattgtttttccccactcttgggtttgatctggagccttctacttcaagtggtttaattttgaagcaaattgtcatatggtgaaatttggtgggtggattcctatctcctatcacataaattagatgtgaaggaagctggggaggtgatactaaaaggcttaacatatcctcacacatagagagattattcaaaagggactgtgcatgcaggagatgtgtccattgcaggagattttacacaaatttggatgcttccattcagaagaaaagggtaagggtagtctgtcagattaggagaagatatgggaaaaagattgagttacaaaggaaatacttgatgaaacctacatgattctgtatgacctggcttcgctacaagatctccttccaggctcatcttgccattcatttcctcctggtccttcaactccagatgtacaggccacctttcaaagcatgatacatgcagacacatgtcttgtgtacatgctgctcatcacatctggagctcttatcctcctttttttctaggttaattctcagctcagttttcacctcctcctccagaccttcccttacctacctcactgctatcacaaagtgctctagactgcaaggcttagaaacagaaatttatggactcacattcctgaagtctggaagtctgagatcaagatgtctgcagaattgattccttctgaggaccaagacaggaggatctgctccaggcctctctccttagcttgtagatggacttcttctccctgtgtttcttcacttatcttccctctgcttgtctgtgtttgtgtccaaatgtccccctttttataaggatatcatgcattccagattagggcccagcctaataatcttatgttaacttaattctgttaattttggagagattacctctccaaagaggctatctctaaataagatcacattctgagatattgggggttaagacttcaatgtgtctttatttgggagtcataattcaactcacagctatagattttatggcaccacacacttccactttcagaatatactacagctataactttactcttatttgtgcagtgatgtctatctgcataaataaatatgggtggatatctacctcctccattaaatcactctctaagatggcaaggtcagcatcttagaggtgccagtgtatgtgtattaaacaaacaaaaggtaaaccgtcctacacacctgcctaagttgtttggtctttgtcacgtgggccatgagacatagaggcgtgacttgatgagaacttcgatttagaaaatgagaacaccacctcctccctaaacatcagcaccaagtaaatgccaagtgcatcacatgctgttgggtgagggttgtgtgcagtctagaaagcttcacagtttaaagcattctctctacagcttcccctaggaaaataatacatcagcagtgaaatgaaaacagcatgcagtttcccagtgcatttattctctggctgcagaagtaggtttagaacataatctcgctagaaatatgtgtgtccgtcagcgcttatgtgggaaagggacttccatgctggcatttgaaattgtcagtgtgttccatttccatgtatattgttttagcacgggattttcaaaataatacagtgtcagtaagatatgagctgttaaacacccaaaggatttgccaaaagactatatgagatgccctctggggttttatatgataatttttttttaagtaacaaaaatgagagctaaatctgggaggcagggaattagcaaagtgatgtggtagacacttaaaattgttaaataaaccacattcctctaggttttaaatgtttgcaacagttcttccaaaggtaaggaagtgaacaggatgatttcctagccatgtatctatgacactgtggccttaactctgacaatagcaatcccaatcattgcccattttcaagagctggactcatctatttctttttgctagaagcttcccaaacagtgctcacatcttttagagctcaccaaccccaggacatccgtgaaagaccatatgtagtcttcccccccgccccccccacatatatctatatataaatattacatatttgtcccaaaaatggcatcattgcacatggtgtcaatggctataaacttaacttctgatgttgaatttccgaaaagaacaatttttgagtatttgttggcaagataaaagatctttggagttctacttgaaaactgatacttcctttgaaggattacatccagtggtcccatgaaactgaactttttaaaaatgatgaatgagataagtagtgaactatggatgtttaatagacatatattgagtctctaatggatacagatactatgctctatgtcagccccactgtcaagaatattgtttaccagaggaggatacacatatacatatctatgctattataataataataacagatacacataatttattatatgtatgtgtatgtgtatatatagatatacacctatatattactatatatgtgtatttaacctcagaagagtcttatagggtaagtactattaatttctccatcatccagaaaaggacgccgaggtacagggacttgtccaaggtcaccaagctgggaagtaacagagccagtatttaaacactggcaggtaagttgacttcataattcttgttttagtcacaatgcccctctaaggcatgactaaactccttaagaatgaagttaactacattcaaattcatcaccaagttctctcgtctttactacttacaatcctgaatttcaccacttctctccatttctgctgccactcccctggtccagaccaatgtaatgtctcacagggacatcagaaaaaacttaccaactgctctccccacccctctccggctccaccccatccctcttttggtggccctaacagtcttataaaatgcatttcatatgttacatgtttctaaagttgtccagtggtttgtcatttatcactggatgaggaacaatatcctgaatatttctgcaagcttctaagtaacttggccctgcttggatcaacattgcttcttagaaggcccttttccacattgcctattttgggtaccacacatactgttctttgctgttcctcaaatacatgctgatgttctagactcatggttcaaacacatcctattccttctgcctaaaatactctcctaggcgtccccagccccaccccacattcatttactcagttaactcctggacctcagagcttggctcagatttcactacttcatagaagcctaacctcctcccccagaatgagatagtttcctctttaatagcttattttaacagcttatacttttctgtgtggtctttatccctaattgccattaagacattttttattttgcttttgattatctctatcctctaaattgcaagctcattagagtaggaattttatttccttttgtttcccacataaaatcgtgcatggtcaaattgctgaatttctgttgaatgcccacagtaagagagatatttcttttgaggcagaaagtgaggccacattgagaaggtggtatttaatctctattttgaagggtggctagtttctaaataagactaggggtgggagtatggatgatgtctttccaggtagcagaaatcacttaaaaaacttagtgatggaaaaacacaatgtttgtagctggtgaagagtgtggattcatttgaatacagattagaagatcgtgagtatcagaagataattttgaataattatgctcagataaaactggagagcctagagtgatacttttattctgtaaagaaaaagaaaccactaaaaacatattaaagataagagtgacatcatagtgatttagaattatttgacagagacacatttaaaatagaatttttttagaatcatcatgctaggtttcaatcccagctctcatctttaattgctgtttgtccttgtacattttatttaagcactgtattatctagggcagtcctttttatgacaaacacatcctgaagtttcagtggctgactacaataaaagtttatttctagttgttgtccaatatgggatgccttggtcagtagtccttggtctttattccctgtatcttgttctacaatcaccctaaaacttcagagtccactgagtttggctggcaaataggagaggagatagggaagtgctatctgcttcacaaaaactccaatttcatcttctatgggtgaaaactagtcatgtggctttgcctagaggcaaagggtactgataaaattcttggctgggtagctgccttccagggcaactttactcaatggaaagagaagtttgaatttttggtaggtagtcagccaattttgtgacatactctaagctttaatttatttttcagtaaaatgagaatgacaatagcagctaatatatagactgattatgatgaataatggtgtaatacattaaatgtcccagcacaaagtcaagaacataagaggtccctccttcggattaaggagcgagatcaggcccaaactccattgagggcaatagaaaaggagatgaatggagaaaaaccaagaaaagtatgtgttttacttggttctaaattgatgttttcagttttgcttttggaacatgtatttaaactcttgaagacttgaatggaaatgataactttcctacattctgctagagacagctctctgcaatgcagccagcagctgctcgtagcagtcctgttctgtgcaaataccatagtctccatccatcaactgagcaccatcaagttttcaaagcttgccttgattttataatatttaataattttacattctgagttatttattcatgttttaagattggctgactccattgtcatgtctccatgaaacaaagactttgtttagaatgtggaagagattattgtgtcacttcttcatttggtgcctaaagcagagtatagagcatgtatgaaaactatttaatgatgagtaacaacttgaatcaacttgaaaatttgctttttgttttgtcttttttgagacaaagtgtcactctattgcccaggctagagtgcagtggtgtgatctcggctcactgcaacctctgcctccagagttcaagcgattcttctgcctcagcctcctgagtagctgggactacaggcaggtgccatcactcctagctaatttttgtgtttttagtagagacatggtttcaccatgttggccaggctgatcttgaactcctgacctcaagtgatctgcccgccttggcctcccaaagtgctgggattacaggtgtgagccgctgcacccatccaaaattttgcattttattaataagcatcatcaaaagtaaaacaaaaattctgctagaggagtcagtacaaacccaccaaaagctgaagtgatatctccattgttgattaatctttatctatctgtgtgtaggtgggtatgtaaatgttaaagagctcataccacctgcatcgttacatacaatagtttcatgtgatttctaattttgactactttatccagttcaaaataatactgtgtgatatagaaccttaaagagagctacgtttacatttgtagaataggccaaggaaacatgttcatgcctataaggcagaggtgggaggatcacttgagtcctggatttcaggaccagcctgggcaacataaggagacctcatctctataaaaagtaaaaaaaaaaaaaaaaaaaaaaaaaaaaaaaaatagctgggtgtggtggtgcatgcctgtggtctcagctactctagaggcaaaggtgggaggattgattgagcctgccaggaggtcggtgctgcagtgacctgtggtgatagtgccacttcactccagtctgggtgacagagcaagaccctgtcttgaaaaaaacaaagagcaaataaatcccaagatgtggcactttatattatgattttgcaaactcatcctttcgtctttattcattcagtgcagaaaatatacgcaattgacctgctacatttatctgcaaaaactgagtaatctactcctcttttaaagagttggcatatattaagtaatttttaatattgcctagaaaggtaagctaagtagttgaattttacccttccaggcacccatactggaaactttgtagtggctttttcattcatgtctcttccttgtctcttagaactcttgttggccaaggctttgagttaattacaccttggttacattccattcttccatcctcttagtttctatcttgactgaggtccacacctcaactattattatagccagaaaactcatccatcttctattttatacctgtgacttcaggaatcagctttattcatgtcatgcaaagtcctaggagtcaccattacctgtaaaagaatataagttaaccttcatgtgaagcggaattaaagaaccacaagatacaagtagtacaatcagtgccattcagtacaaactaagttccagccagagtaagcttgtcagtcttttcacatagactccaaatttttctgaatccttatctttgctcattttgttcccattctctatcacttctacagaattctgatcctaactctgcctttttttttaaaccaaagtattgaggaagtgatttaaactctggagcctctgtcttctaattattaaaataggctccaaaatgcatagcctttaaggctcttagaggttgaaatatcaaagtgaaaataacatctttttgctccatgcaatcaaggcacatcttctgtttgtctagaatgacaggcaccactttatacttattttatgcactggtattatttctactacctaacatgagctctttgaggaatcagtaattatgttgaagtcatcttgtatctcttctgctgctgcgcttaatgacgaaagagcagtatctgattcatccaggtaaccagttgatatcttgtagttattagctataataaacttaagaagagaagaaggaataaaggagggaaggaaggagggaggaagggagggagggagggagggaggaaaggaaggaaggcgggcgacagagtgacatggaggagacaggagagttagatggggtgggagaaaagaaggaaatagaaagaagggaatgaaatgcagggagggagggaggaaggacctaatttttattttgtttttaaatatcgagaatcatgatatataatgtgtttttaatgctacaactgattaaacctctttcttaatgtatgtgcttaggacgaagagcaacactttcttatcattacctataacttactattacttaattaagacctcaagtctgattaaatcctatcacaaatgaaaatgcttttataataaatttttaaaatttcaatagtaatgttcactgcttttctgaaataactcctctaatattttgttcaaaatacccagtcctatgttagatgtttagaaaacttgctttcttgcttatttttcttcttgcttttgctcagatttgttgattaattgacttttgtatcagcagatgactctttaatgaatttaatgtattggttaagcacatctattggccaaggtgaaagcaagacttcttaaagaatcatttctctgtgttttattaaagccaaagtcatatcatggcttcagaaagtctggacaaaacatctaagaatatgtatgcattaattaaattactctgaaagtaacatctccaatatattagacataacatatgagataaaaattgacttagaagcttttttttaggtctttttcattgccttgtttctgccactctcttcctgacttatttttcattatttgttttacattgtgtaatcagattttggttttttttttccactttgtattataaatgacccaatgagcttgccctactattaaacacttggcatccatgtagatccctatcaatgctgtgtgattagcagagctcactgcttagctccttgcacacctcagctcacctctaatttctgtcttctaagctgtttggtttgtataggtttatacgctgaatgtgatggctagattcaagagtcgacccataaagcagaaattgaacatcatcaaaattaatcttgaaaactgtaggaaaggcaaaattgcagatgggtgtccctctcaactggcctaacacagttgggttttctccccaatgttgaagtagatatacttattcagtagtgataaaccagataagtatgttgggtttgtatgtcaagtatgtcatatgaaaaaaaaaatgttaggctgcgcaccatggctcatgcctgtaatcccagcactttgggaggccgaggtgggtggatcacttgaggtcaggagtttgagaccagtctggccaacatggtgaaaccccatctctactaaaaatacaaaaatacaaaaaaatacaaaaaaaaaatacaagctgggtgtggtggcatgcacctgtaatcctagttactcgggaggctgaggcagaagaattgcttgagcctgggaggtggaagttgcagtgagcggagattgtgccactgcactctagcctgagtgacagagccagactctatttaaaaaaataaaaaaatgttatcttggtactctagaaacaaacatagtacactgcaaacttcactttgtgcagagatctttgatatctaaaatctctggaggtattgtcaggtccttgtctccttgactccctaactcccaactgcaccgacacaaaacaccatggggcatgagcaagtggaagcatctaaaatatttaattgtccccctcccaatcatttctgtttgtttccaaaaataaacctctaatatatgcaagtgactctactactgcacatctgtaaaggagaacaacagccgggatttctctctggatagtcacagcttgctttggtgttgatttttttcaatgttttctcatttagattatagacatcaaccactggtttgcttttctactctatattttagattcaaaatagtcactgcagcagaaggagccgcatatgcgtaccttaaaaaaggtggttgattttatccacctactggcttatactggagagacttgtttgaactaacaggagtcggttgacctctcctgccctacagacaccttgtaacttgcctcctacttgattcattcagcttgttgatgtgggagttgtaatatatatagcattgagtaagaagtgcaatgcttgtcttaaactttgtacatgccactaagtcatatttaagggagagcaatctggccaggaattaagtgcatttgatataggaataattgaaaaatagtataggggaaacactcaatttaccttggcttttaaaattttacacaaaagtgaaagtttgagaaatctcccagacttctttcccttcccagagatttacttccattagcgtatcagtgaccttaagaagtccagagttagaaacgctttaaactggttaacagggaatttcaaaatttaattgaccttagaatctaccaccttccaattttctttcaaccttcttttattagcatctgactttcacagaacattgtttgaaaagtgatgatatagaaacagtgcaaataacatcaatcaatttaaaacaaattatcacagaaattagttggtacaacttgctaagtgataagccacactagaatctggtggccaccacttgcttttcgaactgttgacaaatcatcctcttgttaatttgtgctaaaattttggccaggattgatattaatagctactgtgttgctgtctgcaaagaatatggtagaatcactgtgcattgcattcttaggtgcaggaggctcatacttcttacatctctcacttttcataagagcctaacacacccaaacagcaatctgtggacccgcagtattagactggctgcttaagagtacagactagggtggtgctcagaatgacctacattttaatatcccccggcaactgcagcagtcaccttcaatgggtataatttgttcatatcacagtgtctaatttgaagagctgggttcaaatctagtgtgttttgacctcaaaattcatactgtttttcaaatagaccccaagttaaggaagaatttaccagatacctctttttagcgaagaagtactttagcaggtaattgacaaacttacatctttcctctctcttaagtccctaaatcttgtctctatgccgattataaagacctctgtaaattaaatgcagcaaagaaatgttccatctgaccagtaatttgctgctaacacctaccattgtattccttttgttcctactttttatttctagtgagctcttctatcatagtttgcaacccttgagttttcaaattttaagccagtcctttttatccttaattcacacaccgatttacctccctttctagaaagtcattttactttggaattgggtaaaacatcccatgctcatttttgcaataatgagtttcattccactaaatcttggcgacttttgagattatttccctctctgctacaggttcagtgtccactcattaaccatatttttatcatagatatagagacggagaagatttcaaatgctttttccggttcttcccaatcttctgttatatgttacaattaagctcttaaaccattacccttctcttctttccatacccaatggccttcataatgaggggacatatggcatcccatcacttataatgccatatcttccatactattttttaggtttctattaaaggcctttcaattagatttgtctcccttcaatgcagattcattcttaccagtctgtaagggttctcttttcctctctgtagtctactattttggaatcttccctagggtttaaaaatccaggcaccatctcttgacactaacttgttggtcagttgttagtattccatattctcatttttttttaaggcattaaaaatagcaaagaaggcaaatctctgtattttacaagctgtgacatttattaaagaagaagtatcctttcctccagctttcaaaataatattttagaaacactattgaataatgatttaaaatatttatttatttatttatttttgaggcagagtcttgctctgtcacccaggctggagtgcggtggtgtgatcttggctcactgcagccctgacctcccgggctcaagtcatcctcttgtctcagcctccccagtagctggaactacaggcatgcaccagcacacccagttatttttattttttattttttgtggagatgaggtgactatgttggccaggctggtctcaaacttttgagctcaagcgatcctccctccttggcctcctgaattgctgggattacaggtgtgagccacctctctcagctaaaataaggtgaagtcacatagaacttaaaaaagaagtagaattttagtttaatgcctaaaagtataattaaatctaattaacaatggccttggtacaatatcagtctgttactttctttttcaagttcaaggctaaagaatagtacaaaccaaaaacagtgtggtcttgttcctcttataactgttttcttttttgactccttttctctacttatttcattgtcctttttcttacctaccttcaacattcaagttcagagaattatgcagcttattaaaaaaagcttccctcagaatttactgataatgcaaaaaaaactattaaaataaaagagtatcctaatgtcttttaaccttgagatagccttaagcatttcactcattaatatgccagtattcaagcattttgtaatatcagctgctctgtaattagctattttgaatagtttgcaaatttttctccctctgatatcttatggatatttttaaaacattattgcttcaaaaaaaatctttgggagacgattgtattttgttctccttagtttctttttttaactttcctttctctcaataataaaggaggaaagtcaaaaaaataaaagatgaagttacaacacagtaaatctagcagtttatgtttctacgcttagctcttgttaaacatcaggttcagaaaccaactccatcaaagtggctttgtgtgttttatttcttctcccaagtcttcaagtaggaaagattcaattaatcgtaaccagaatttcttctgaagaaaaacctttcctaatctcaccaatagtaagaagccatgtctagggtaaacaaattctccttgaagttgattggaaatctttctttgatgatttcttccattactgaagtccacaagggaaatagactatctcatgaattcatatacaattttatcttgaagattttcttgtgaccttgtgtgctaggttttaggcgtaacgtgaaagtgtttttttttttttttttttcaatgaaaaagacagtggactggaacttttagtagtttttgagcagactatactcataatgcaactcatcacagcatggtgagtacagatagaatagcatagtgggggtggcttttaaacacgctgggcatcaaaatgaattatgaacatttcataaagtatatcgttgccctcgtcttgtttcaagacattgtggttctctatttccaggttgtgcctaagtaggcatatttttcaaagtttcacgtatatatcaaatgacaaaggataaatttgcatatcatgggcattaactttaaagactaggaagttaagaaagaacccacaattgtgtcctattacattatctagctgtgtacaggggagcaaaataactcatgcctttagcatttggtcacttatatttaataaggatagaaaaaataatgaagctgggcgtggtggctcacgcctgtaatcccggcactttgggaggctgaggcgggtggattgcctgagatcagaagttcaagaccagccgggctaatgtggtgaaaccccgtccctactaaaaatacaaaaactagcagggcgtggtggtgcatgcctgtagtcccagctactcgggaggctgaggcaggagacttgcttgaacccgggaggtggaggttgcagtgagccaagatcacgccactgcactccagcctgggtgacagcaagactccatctcaaaaataataataataacaaataaataaaatgaaaaaaataatgatgcatgaagagctcttttcatgagtctggcataaagaaagtgcttagtaaatattcacttatatttgtactgttggtttcattgtggttgctgttggagctattaacaaagcagacgatcataaatactattccagatacatgcacacacacacagtattgtaaaactcaaagaaataaaataaatcagtatgaaaacattgaagaaatcttcagagaagaagagagatttaatttggaacatgagggtgcattaggagttgaacagatagaaaaatgatactttgaagacaaagtatagatggtcatcctgagtgccatgttcataaatatagccctgatggaagatgccacttaaaaaaggtgaaatgaaatgtatgttttggaattctttagtcttatgacaaggaggaggatgattaaagagaaaaagagagtgtgaataggcaggagaaagagagagagaatgagaagactagagagagctattttattaggtacataatatactatgtagcatacttttatagcagaaaatgcagcttatatgaaaaataagctattcccttctccgaaaaagtaaaaatttgtgagtttagtttccatttattctttcctagacattgcccctactgtgatctgttttttaaatatagctccttgccttagatgtattaatcaaatttattatcaatttttaaagtagtactagttttatatttctaaataaaaataaatatgttaaaattgttccatatatatgagacaaatatatacaaaaatattttgataaaatatattaattgttccactgcttaatgataaatactattaacattgtggtatatagctctattcagatataattcttttctgttctctatccctcaacttgtatcctttcctctattttgtaaactgctttctctctccatgaatgtgtcatggtactttccatgcatataattagaaatatattatcatttttaaggaccagatgatattctgtcacatgaactcttaatatatttaagcagtctgctcataatgaatatttatatattcaaatgtgttttatttttatgaacaatgttgtggcggatactccttacattactcatttgacatccctttgctgacttgatttcactattgttgatatatttccatttcactctcgtgtttataatgattgttgttctatgctcacctaattgccagtaatagtaataatgatcagaagaaaaagaaaatattaatattattagtggcaaattttattattttctgtgtattagccaccatgctgagtatttttacacattatgtaactatcttaaaagtgatataagttaggtggcattatcagcattttataggtaagaaaacagaggtttggaaagtcaaaatggcttgctccaagtaatatatttagtaagtgcaaaagccagtatttaaaccctgatttctgcaaatgcgaccaccatggccttaattactaggccatgttatatgagggcaaaaaaagcagcttatacttgtgacccccgacattcacctcttccaaaatagacctcaacaccttcacagggagtttggaagacctggttgtgtgctccagtgccactgccaacgagagttgagaagtgatggggtttttttggctttggttgtattatttattatctattattatgtccagaagttcttgtgctcctattggctgattacaaacctcaaagaagagctcaagacaatctatacccaagtctaaataaccattttggccaggttttctcaattttcagatggaccccactatgtagctctatctatatggacctattaattagatttatgaggccattttgctgccaaccaatgatggtgagcctattagaaagtagtgatgttcaatattagatgttgtctaggcacccttctcttccattcttgaagtagttcttaagaagtggtacccagagcatcaccatcacctgagatcctgtaagtgatgcagatgcttgggcctcccatcctgtgcactaactcagaaactctgggaaggggatccagcagtctgtttcaacaaactgttgaggagattctggtacaggtcaacatgggagaactaatacctgatgctttgcatagctaattgggaactcttgcccttcaaagtctccaaatcatgcccaggtttaaatatctgtggttacatccatatactttacccagaaattgagcaaattttgtttgtaagctcattttattcctgctttctctaagccatcttcaggtggaaattatatggcctccagcttaactaaaattgcatgtcaagatctacaattttcataccaaaatgtcagcttcaccatgggcatgtctggctgcttagcatagatatgtcttccgtcatcagcagacaaagcctactctcccagcactctacagtgagctgactgtgtaaacactagctacttagcacctgcttcttatgtccattgccattaaagagaagcagtgcaatgaactaagtaatcacccatatttcaagttgcgtgtattttttcttttggttgtaaccctgtatcaacataaattaataaaatttgagtgcttagcacatgggcatagttcttctttcttctccccttaagatgttaaaatacagacctatactttaaagttatttgttcatacagtggattaaaaaatgttacaaataaacattttatgtttcctgtacaagaacttgcaataaattctgtttaaagtttactgctgggaataaaaaatttgtttgtactgattaccctggctttaatcctgattgttcattaaaacgaataaggccagggcataattatttgtaaaaataaatatctcaccagataattcaactgtgctggttaactgattccctgtttttatcagacaataatgtctgtctgtctgtctatctaatctatctatcttgcatgattttgtgttatcatgtagctctaaaacacatttaatgtgtcattgtcataaccgtctttagcttgtctttctggtgtaattatagtctcccttgtaatatattacttttccatttttatttttatcttaatgatcccagtgttaattagtcttctattgttagtaatttcaaagttctcttggggctagtacaattacaaataaggttttatttttgtctattaactccaagtgtctaagacaatacgtttcatatacatatgtcaaagttaataattggagtctggtgtggtggcatatgcctgtagtctcagctgtttgggaggctgaggcaggaggatcactggagcctaggcagaggactccagaggttgcagtgagctctttgatcactccagtgtgaatagccactacactccagtctgggcaacatagtgagaccccatctcttaaaaaaattaacaattgatttgatctgagttttcagatcttcatcaattaaatgcttttctgaaatatgcccatgctactgcaggaagtgagaacacacacacacacacacacacacaaaatcttgtccttttctctagctcgcaacaagatgtgcctttgaaacaaaataaaaaatgtcatgagacacaatattccctattgcttcccattccatgctcagatttctataagtagcacatgtaaccttatattatcatcgcttgtttgtctctctcaccctccataagtttagcaaggctaggatatatttattgtagttgtgatgtaggacaggtgagccccaaagtagggcttagcctttgagggttctttgaggctttgcccaggaaagaattcaagggcaagtcagtggtagaatagaagaaaacatctttattgaagcaacagtgttacaggtctgatggcgttgcagctccgtgattgctcctgcagagcagggctaccccatagacagaaagtagcagctcagggcaattgcagtcatatttaaacccacttttaattacatgcagattaaggagcagtttatgcagaaatttctagggaaggattagtaattttggggtcattgggtcattgacatggaaaagggcagtaactccgaagtgttgtcatggcaatggtaaactgacatggcacactggtgggtgtgtcttatggtaatcttcttccttcccagccctgttttagctagtcttcaatgtggttcggtgtccaagccctaccttcagagtgagtcccacctcctacctcagttgtctcaatgcctagtactgtagctgggagttgatgtccaaggatatcattaaaagccaaataatgtgatttaaaaattcctttcgggagctcaaaagaaaggcaaacctagaaggattcgagttccctggtgagtttaatagaggaggaatgatgtggggtgggtattggctattatacttagcattatacttgggcaggaggacagagaagggctatgacgtgagaaagggacctgtcggaagtgaggaatgaagagatgcttttatttcagagaatcactggcagcaagagggaagatcagcattatcagcctgcagaagagccaaaactccaggcagagaactttatagcttataaaatagaaattatagacccaaagaactttataggtaggtatgttatataatataatctgtaattaaaactttagtctgacaataagattctaggtgttggcaaactataatctgcatggcatatccagctcatatcttgtttttctatggtgctccagtgaaaatatttttaaagcattttaaagaaagtaatttgaaaagtaaagtaaaatacccatcagaggcctcaaaacctaaaatatttactatctagaaatttacaaaaaatgttgcctgatccctgcaggtgaaagatgtaaggaataatgagaaaagatattggaataaaggatctacttgagtgtataagggttggggagacagtggtgacacatagatctctcagtttcaacagtgtagcagaggagtttatttctcattcctgtactattcaaggcatctgttttctattggtggacagctttctcccatgtggcaattttgagattcagcctcctttcctcctgtggccctgatattctgtagtgactcatgatcattgcatccaagcagtgaagggagagacagagtaaaagacacacctgcttcttaacacctacggttttaaagaaatgcacaaatattgtattaagtttctattgtcaatagctggatggatgtgtgtggactcatctaggaacaaagagcctaggagctgtactttctgagtgagtggtctccgacctgttgcagccttactgtatggccaccagctctacgcaagccattgctgccagagtgagaggtagttgtggcaattaactcagccgggagctgattgcttcccatagcagtgacaggagaagccatatatttatatattgagatacaaatgtatgtatatatgtggacatgtatgcatgtatctcaatatatcctgtatatgcatacatatatgcatatgtatatacacacatatacacatatatcacgcacacacacacgcacgtgagaaagcaataaatcaagagaattagtggactgagaacctgggtacaattcctgggtctcctatcttccagttgtggcactgaacaaagtattatcctttccaatgaatgtgcttttatttttctcatctatcaaatgaagacgatctggctttgggtttataatgaagattaatgctgtaaatattttaggtcattgcctggcatatagcaaatgctcaataaaaactgtcaactacagctgctgttatcactattactgttgttatgctcttaaaatattctgagagatatttatggggcttagcaacagctgattatagatagaaagaagagagacccaaagtaaggtgacctcaaccttttgtcttacatgatgggataatagacccagggaagataggaggagctggtttgcaggataaatttaaaatatgtacctataagcaaggagaaacagtaataaaaataattcttgacacctatatttttttcagagacttggcaatttaatggtaacaaatcatcttgcaaacataaagcatcatagagatgtcacattgcaacatgaggaatagttattcttccagccctatattagaatgactaaacgttgcctcttttgctgagactattgcattatttacacacacagacctacacacatatatataaaagcaatgtagacacacacacacaaacagacccacacagagaagcatacatacatacatacatattccacacacaactttcatgataagcaaattgttcttttctgcaaggtagttgaacaattataaagttctcctatctgtgttgattctgtcttgtgtcctaagccaggagccatggtgaaggtggtgattatgcgctagtcaagtaacacatccattgacactatctgcaaatatcctctctctgtgctttcttactggtcttatttagtatgcgcagtttcagaagcatggtgatcagagtaaggcaggcatttggcattcattttatattagtaagcctagttattccttaaccaccttaaacttatctgttagttattctcagcgtacagtgtttcttctggtaatgtgcccaaacggatgttgtcttagtcaaaaataagactcagaagcagatttcaaaacagatgtgtgttggttttagactcatgggcttcctgggcctatttttaaagctaagggagattctaaagtcctctgtttgcctgaatttggaggcaagattagacaaatcttgatcttttcttctttctttagctttattctgtcaagttgttcaactcctactaacgaggtgctttgcttttgccaattcttttgatttctgacttggaacaaggttctaggggccatcattttgcaagcacattactgttttgggactgtccttcctacaagcagtttaatatatatatattttttcttaaaatcatggtgtccttaagcagagagcacccagtgtgtttgaagcctcaattaactcacaccattgagttgagttgttagacagggagaacagcaggtgcccctcttggcactctctagccagagacaaggcaggcatcagataaaagctgtcccaggtatgagaaatccattttccagcatctaaaaccatttcccacagtactactaaccaccaaccctttggcctccaccttacataaatatatatatatgattcttggtttatttcttcaccaaacatttattgactacttactatatgctaatttttcaatataacaggggacaataatatcaatataagcttttaaaaattttatttagattgcccattgcttttgagtccacaggattctataatattagccatggcaatgagaggataatcgaaattgaagatgttaatattcaagctgcagtcagtgcttcctccatgagtctctgccttttacctcatccttcactcctttgtaataactgtgaatacgtccttctcttctacttcatgttgaaacccattatgcatcttatttaattttgtgacaattcctttataccgagacaaccaaaactcccctttatatccaatggctgctcaataactatttgttaatgaattaagacatcaccgttagtagaaatcccacccctgggtgtttatgctaaacaaatgaaggcttatgttaatacaaaattctatgcacatatttattgcagtgttttttataatagtaaaaactggaaataacccatgtttttcaatggataaatgaacaaacaaacttggaatactgctggcaataaacaggaacacaatattggtaaaagctacaacttggataaatcacaaatgcgttatgctaaatgaaacaagccagtctcaaaaggttacatactagatgaatccatttctatgacattcttgaaacgacaaggcatgatggaaaatagatcagatgtggccagaagttactgatcaagggtaaagtggactttaatggacaagggagtttttctggatgaggagttgtgctgattgtggtagtgattctacaaatctttatgtgtgctaaaattcatacaactatacatgcacaaataaacgttactatatatttaaaaataaattttataaaacctatctctggtgaactcctatacccctattaatatttcttaccaggtacatccgaattttacatcagtattcttaaactttactgatcaccagatatacccaggcctcttgtgaacagtacagattctcagaactctctactgagaatgttcatttcatagactggctgaagtttaagaatgtaaattgtaatgcgagctaaggctggatgatgtgggggatagagaaagtttgagaaactgctctgggtccgtggtttcagacttcagtgtgagccagaatcagttgagaagacctggtaaggcttgggatgggatccagaaattggcattattaccaaggacccgaagaacatctaatttaggtggtacaaggaatagattttgagaaatgccactctggctcatcaaataaagagcagagtcagtttgttctttgtgtccacccagtaattctgcatgtcctggattggcctcctctccaattctccaagatatgtattttatccctgaaccaacttcctcaaattttctactgcactcccccagaagttggttgacctcgactctgtcacttaggaaaatgcatttttagatgttctttccttcaacttgctgttcttatactttaaaaaatatggcattgccttgagttttgttcttttcttccagcttctgaggaagaagttgtgcctaagtggccattgacgctcttctctctccttccttcagttccgatttgtccctctatcttggctccttccaagcagcctgtaatgtgttcaagctacctccatcttatgctatcaactctcctttaacttagaatattcttttatttctcaccttttctgcttttcttcacagccagattcctcaagcaggtaatctttgatgacattttgtactgagtgcctatttttcacttttcaatccaatgtaatgaggcctgtgcctctaaccctgcaatgagatgtcactggtgaatcctgccaataacctcttgggtactaatcccctggatctatccgaattttctgatcatttcttctaaacttccatttccaaccttacattcctccccttcaatgcctgcattctccacgggtttatctttggccttcatttctttttactttttttgttcgtttgttttggtggggtaatctctttcatgtccatgacttgaactactacctttagactcataattcctataccagtacctctggttagggtcataggcctcaaataagatcatagatgctcagtagatgtttctttaagggataaatgggttggtgcacggataggtagatagctgaatgaatgagtggcagtgaactagaaaaacaccacagcaaaaggaaatagattgttgatctctgattgtgtggattaatttataggtagagacatccatatagttgcttattggatttcattaattttttcaccttctaccaagcacttaggagtaatcagaatactcagttgtgtttagcttagaaattccaggatgcaacataaaaccttgttggccattagacctctgtgggaggcctaagaatttcatggacctctcactccctctgtttcttgtgagaatctgatttccattgtgcaagttcaaaacaataaagctcagaattaatgggataataaatagtaatcattaatgcatgaacatcacatcctttaaaacatctatgatgtctaagatgtttcatgatatactcattcatggtcatttctgtatttctctttcctctctctctctctctccccctccctttttctgtctttcactcacatacacataggacagatattagggtgatttattaagttaaaaacagtattttcagaaggactttaaaatataagctcaagctacaacatatagaaatttttttcacacaaataaacaaccagagaacagactgacaactggaagaaaccttgtagcaccagacgtcagtgagatgacatccattagtgtggataccacctccagacctagagctgacaacagatatcttgattacttcaagattaaaaattataatccactggctctaaaagtactgactacagtgcctaatacataatacacaataaatttcagttcttttctcattacttttcaaagagacatgctctctttacacatcctctagtaagccaaatattttatctccattaattagaaaaaaaatattgtataaaatgcattttctctgatgtaaatcacctttcctcctccagtttgtggtttccggtttactcacataaacactcaccaaactttcccagagatctgtacacagagtcaatcctttcttttgctgatccaagacaaggtctctattatctccaagtccctaatttctcctcattgaaatagagatctgtggcatgatctcatgggaatgttgtgatagccaaatgaggtgaagcatacagtgtgttaacacagtgtttgacatacaggggtcattactaaaacattaaatgatactatgattgttgttgttattgtttcaaatatcctattcctcctacagtttaagtcctcggagttttggaatattttaaatccttgtctcccccttattagtcatgtctcagatctaatgttaataattagagaggcctttctcacggtctcatctaaagtggacccttcacgccttcctctcacagcaaccagcataacgtgggaagtaagaagcagagacagtgcagttaggatgccttaaggcaatcctggctctacctgctttcagccaagttacttaacctcttgatgactcaatgtcttaatctattaaacagaggtaatgttagtacctgtcttacagcgttgttgtaagggtaaaatgagttaatatgggtaaaatacttagcagagtttctggcacaaaatatatagtaagcatttgttcttttcttgattacagtcacagcacttactgctttacgaaattgtcttgctcagggattctatgatagtctatcttacctcaacagactaatggaagaggacctgagggaagagggaaggattcatccttcttggttccttattcgctgctatatcccagaggccagaacaaggcttgatgtttattaagttattgttaaataagtgcctgatgtatgcaatcagtcatccggtccctaatacctggcctagtacattatgcataataggttaccaaaatatacatgatgatgataaaaccccaatattgttcatgctatttttaaacaaaagtcttgcaggcattgcatagtgagaaaattgagcacttataattgctctctgaattgtgtaaatttcttgagaaggattctgacttccctccatgcttcagtaagccagcaagactgcctctgtctcacttgatttagtttggtggcttcttgtggatgggagccatgaaaacaaattgcaatagaaccccttatcaggcaccccaattcaaagaaaggttgacacagatttatttcagaaaagggaaaggaaaagaaatgaatgattttcttaacttcagaatctggactgaatttttcttgtcattcaactctactcttcatgcaagttctaaagtaagagaaatttgggattttggactatatgtagttggtatgctgggagccatggaattaaattggcttcaaaagtgttttattttagtgatttctccagtataatctttaaagcaggagtctgtagaacttttgagattgaaaatgaataaataatgggaggaaaagaaaagatatagaatgtatagcagagaatattaaagagatagactttggggaggctgtgaatccggtagtccattttagaagtccatactgagatacaaaggtttaaaaaatataagaactaaatacataataattaatatttgctaaaggcagttacctacagtggcttcccattttaaccttgggaaaaataaaatgtataaactttctaaggtctgttgtgttagtcagggttctccagagaacagaaccgataggatgtgtggatataaagataaatatacaggtatacttgtatatctatgactatctcttatctagctagttagttaactatctacctacctatgtacctacctaattacccacctacagagaaaaagatatttattttaatgaattggctcatgcactgtggagactaacaagttcaaacctgctgagtgggtcagccaattatagatccaggaaaaggctatgttgcagttcaaatctggaaggctgtcttctagccgaattcccttttgctccagagaagagttttttgtgctattcaggtctttaactgattaggtaagccacacccacattgtggaggacaatttgctctactcaaagtccacccatttaaatgttaatctcatctaaaggcaccctcataaaaacatctagagtaatatttggccactcatctggacaccatggctcagccaacttgacacatacagtgaactatgccactgcatagttcactgtagagtctggcccctgcctaactctcagcttcatcttggaccacttacctgcttcaaagacagggaccgtctttccagtcctagcaaacacaaatttctgtttcctgcttttggacctttaaagatgttgttccctctgcccgaaatggcctttcacctactgctggcctggaaagtttcttctcatccttcaatctcagcttagatggcgtttctttagtgaagatgttcctgacttccagtcttatcaggcccccttagcatttttgcatcaaatacccttatttctctcattatacttgtcaaaattatatggcttggcatatttataatttcaaatttgtcttctgtctttattagtttaatatcctcattatcttttaatttggattctccatgaattcagggacctgagtcactgtgttcactttatgtcagtacacatgaaagttacccagtgaatactgaatacataaacaaataaacaaatgaagctcatgatcattgaaaacattctttttaatcaggggcaatttgaaacactttaatagatggttttctaccaaaggtagacttttcttgaattaaaggaggtcttagagcttgaccaggcacttcttacaaatgtacattcttagccacaatgtcccataagattcagcagattaggaagtaggacaagatgattttgctttgtattaataacaaatgctctggtgacattgatgcttttggttaaccaacaaatagctggaaaccacttatattagcccaaacttgtgcttaagaccgaattcccaactccaatgatattggcactgggtgctcatcgtctgctgatgttgtttatgccactttgacactcaccagttacatccaataaagatgcaaataacattcttttcaatatttaaagacatcttttatcctcactattctttcatgttcaaaataattccaattctctcaatgttacttctttcagacctttatccttctctgctgcctttaggtctttaatagatggtttccccaaagctgtgatcactggattcaagcaatactctttatcctgacatgttcctaatgctaaaagattgttaattgttcaagataatgtagtccattcatatagacctctgttcaattgtttttctactccctctagcttacttttttctagtcagtttgtgttttagagagctcaattagatttctcctaagtgagttaacatcccaaggaaaaaatactttttacgacaagtttttttttttttctagtttaaccaggaacaacttcaagtttctggtgttagagaatatcttataggccagttagtggtgtatatagttactgtcatgcttaacaattcataattaaaagtccagtcaactcatgtcagcaagaaaaacaaaaaaacaaaacatagtaccttgggagaagaccaatttcttcattccagggccccagtaaagttgaatgaaaatatggtggaagttaaagattaagtgggacccagttgggtactctggtgggagagtaatttaagatttgaagatagattggtatcagattgtggaggctgtgcatttaggttttgttttggaagtagtggagagccaagagctgatgatgagttttaatcgttttaatcaaaactgctgtagaatcagcttttaaagaagattaatgaagttaaggaataaaggataaaatgttaaaaaaaaaaaaaagagagagatggaaaacaggcacactagctaaagggagatataattggtctggctatatatgcaacagcacagatgaatcttccagacatcatggtgtgcaaaagaagccgtacacaaaggagtaatattctgatttcatttatgtgaaattgaaaagttggaaaatctaatttatagtgatagaattcagtgtgattacttttggagagaattaatgactgggaggcttctagggtactgataaccttctatatcctgattcaggatgtaaaaactcatctagctctacaattgagacatgcacagatgctccttgacttataatggggttatgtcctgataaacccattgtaagtctgaaaatatcttaagtcaaaatacatttactaaaccttacctactggacaccatacattagcctagcctatcttaaacatgctcagaacacttacattagcctatgttgggcaaaattatggaacacaaagcctattgtataataaggtgttgaatagcttataatttattaaataatgtacacaaagtgaaaaaccgaattgttatatgggtacttggagtacagtttttacagactgcataaggctttcacaccatcataaagtcaaaaattataagttgagccatcataagttggggactgcctgtacatttagagtgttacgtttaactcaaaaagtttactcctcaaaagggtggtgaggttgaacagaggcaatgaaatcagaaagacagaaaaaatgatttccatgatgtatctttaaaagttttttaatgggattcataaacaaggtatggccatttctgttattaaagtggactgtatctgcaaggttcattgttgtaagtagtcttcaaaagctactgctatcaatttctcccttcctgtcagtgggaagtgtccattgatccgctccttaaatttaggctgaccttagacttgctttgattcatagaaggttgtggaaataacactaatatttccaggtctagccattaagaggcctggtagcctctgctttctctcttgggaatctgttcaccatgccataaagaaccttgagatggatgccaaatgctgagacatgacatggatgaagagagatctggatgaccagatatatgagtgaggccttcatgggccttccagctcagttgctagtggaaggcaacagagtgagtgctgagggctgatgccacatgaagcagaagaaccacttagccaatctttccctgaatccctgacccacaaaaaaattccgtaaggttgtttatttaaactactaagctctggagtatcatgctatgcagcaatcaatcactgcagcagttgtcttctagaacagtggctttttatggaggatgaacagattttactcactcccaccagcccagggtctttgttaatgtctggagacattttaaattgtcactactgtagaggcttccactggcatctagttgggagaggccagggatattagtaaacgtcctacaatgtccccctcaaataatttctggcctaaaatattaatagtcccaaggttgaggaaccctgacatagagccatgatttataacttaggtggtacccaataatttttctctaaagccatatttcctaaactttactgatcatattagtcacctgggattcatgtcatatatatggaatcttaacatcatgccagaccttctgtcttggtccattttgtgttgctataatgaaatacttgaggctgagtaatttataaaaaggaaagaggtttatttagcctccattctacaggctgggaagttcaagtgcatagtgctgcacctggttggttcctggtgagggcacatgctgggtcataacatggtaaaatggcgaagtgaatgggcatatgccaggggatcacatggtgagggaggtggcagagaaactgaggaagccacattctttttaacgacatgctcttggaaaatcaagaaatcactcaccctggcaggagggcattaatatattcttgagggattttcccccataatacaaacacctcccactaggccctacctcctaacactgccacattggggatcaaatttcagcatgacttttgatgggaacaaaccacattcaaatcatagcacctttaaagaaatcagaatatccagggaagggggttgggaagttatgtttttactttcatgaaagtttcaaaaactctgccctacccaggatttctcagattttaatgtgcctagaaataatgtgggcatcttgataaagtgtagaatgtgattcacttagattggggtgaagcccaagtttctgatttctaacaagctcccagatgacgccaaagcattgctccttggatcattcttggctcttgagcagtagttgtcaagctttagcatgcatcagtatcacgtgaaaggaacagactgctgcactcacccccagaattggattctgtgggtctgaggtggagcatgagaattcctatttccaataagttccccagtgataatgacgctactagttcagaggccacactttgtggatcactgccttagattattattttgtacacctaaatgcacatagaaatgcatctcaagtgactgcaacaattgcagtttctcaaacctgtcactcctcctcaccgtatttcttcctttagtaacctagtagattttattttaataaattgcctcacctggggtggttcttatatcagtggcccaggactgcattttaggaaacactgtcttgggggaaacatttcagaatttttttttttttttttttttttgagacacagtctcactctgtcgcccaggctggagtgcagtggcacgatctcggctcactgcaaactctgcctcctgggttcatgccattctcctgcctcagcctcccgagtggctgggactacagacacccaccaccacgcccggctaattttttgtatttttagtagagacagcgtttcaccatgttagccaggatggtctcgatcttctgacctcgtgatctgcccgcctcggcctcccaaacattttagaatattgagtttcagggaggaaactgtgtcgtttagaaaaaacacatttaattttttcatgagtttgatttgcttctaatggtcatcttgaattattttcaaatatcatataacatgaaaatagtggaagatagttttatgcttatcaaaggtgtttatatactagatgtgtatatactagaatcagaagtactacttttaaaagtgctgttttcttcctgggtcagtcactcagttctttttgagtttgtgttattacatcctctatagaggccacaagttgaagtctgttgccaatttagacaaaacgctgatagtaatggccattgctatactgtcttgaaggtttgctatgtaccaggtattatgtaaatattttcccaattcaatctcctgtaatacactaagtaatcccttcagaagcagctactattatcctcaacacatagatgaggaaattaaggcatactaagtttaagacacttaaccaagaccacatagctagttaatatcacagccagaattttcaccctgtctgatttgataaacagttgatccttggaaataggatgtgggcatctgtatttaattaggctctatgaaactaattcttagttaaaacaatagttcaaatggagtgccctctttatataatgaataaagggaatgtttcggaacaagatttaatgtattgccttgacaggatgtggccatgactgaccgtttttgctatctgtttagtattaattacattaccagcatttttttttcaaccttacaggaactttaatgcatcatttttatccttctattaggatctggtgctcttgatgctgctatctattctccagtagcatttttggctagccaaaaaagtctatagtcatcttgtctcaaattaaaggctattttcagggttatctggttttcttttccatgatatatgtagaagataagtgttttccctattacctattatcttctctcattaaatactacatttaggtaaagtttcaagcagcctgtttattgccattcctcaatttcatattcccgattcaaagcacaaaatcttttgttttttgtatgtttgtttgtttgtttgttttgagacagagtctcactctgttgcccaggctggagtgcagtggtgcaatctcggcttactgcaacctctgcctcctgggttcaagtgattctcctgcctcagcctcccaagtggctgggattacaggctcctgccaccatacccagctaatttttgtaattttagtagaggtggggtttcaccatgttagctgggctggtcttgaactcctgacctcaagtgatctgcccacctcaacctcccaaaatgctgggattacagacatgagccacagcagctggccagcacaaaatctttaaaaacaaatagcgttcatgcaaaaatgtgctgacctaaagaatttcattctttattttgaactttattgaagatataatcattaactcaaacatgtcctagatcttcggagccaaaatctccagggaaggggtttagaaaactgtctttttatctttatgaaactttgagcctctacatttacctctactttcacaatctggactttgagctacaattgtctaaaagcccaccagcatttttcaaaatgattcttactgaagtcttctttcaaaatgtattctttcattgacacataacattttctattattaatggtgtacatatgagtgtgtgttagatgcatagaatgtgttccaaccaagtcagggtagaggaggtatccatcacctttcgtcatttctatgtgttggtatcatttcaagtcccctcttctagttactttgaaatacacaaaatatcattgctaagtatcatcacccactctgttatcaaaccttggaacttatttcttctatctgactctatgtttgtacccatgaaccaacctctcttcatgtctccttccatctacacacccttcctagcctttggtatctatcattctattctctacgtccatgagatcaagtgtagctctcacatatgcgtgagaatatgtagcatttgtctttctgtatctggctcatttcacttaacataatgacctacagtttcatccatgttgctacaaatgacatgtatgcattattttttatggctgaatagtattccatatcgtgtacgtgtgtttgtgtgtgtatatatagatatagatatatatctcatattttctttatctttcacccattgatgggctcttaggttgattccatatcttggctattgtgaataatgctgctctaaacatgtgagtgtgggcatcatttttatatacagctttcttttttctttgcataaatatgcagtagttggattgctggatcgtatgttagttctatttatagttttttgagaaatctgcatactgttttccatagtggttgcactaacttatattcccacgaaatgtgtgtatgtgtgttttgcctagactttaataagattatgaaacttctgaatatattgaacatcttatgctatataaaacattttgttctcagatacacagaaaataaatattcctttgtgtttatattcttatcgctacaaatttagatatttgatgttagattgattccaggctaaccaggaaagattctctagagaagatgaaaatttaactatgttaagagtacagaaatagtcagttatatgggaacaggttttttaacatctagaggaagatgtgatagctgagatataatatttatgattggaaacatttcaaatatcattttctataaatattagaaaagtaaattcagactcaagcaatataggcatagtattgcttcagttaaaagaaaaagttcaggtgtggaccgaggtcagatctgttttgacaaggactctggccctgtccacctgggtcacccactcgaacatgtggcagcctaattgtcagacagaaagacaatggttgtgggaaatctaggcctcgtgtcagtatttaaagttcagaggaggagagatgatctctttcagtggttctctcttaggaactgagattatctcttccagacattctctcttaggagcaagagcatctctttttcatgcccagagcaaaaatctactgagttttgtcagctaatattgggttacccatcaattatttaaccagtctttttggtcaagaaaatgtcatgaaatctattggcttagccttgcattcctgagtccattgtggacaaagggaaaatgattccgttagcttagtcagctctggaggttaggctggttctccctgaagcacacagctaccttgtggggaaggatgcatacatacatggaaacatagcagaaatgagtgctaggtgggcaaataaccactgcagaaataggaagacctgggtaaagtgttagaagtgttctctgcagtaccatcacattctgacttccccattgggactgccagacagaccattgctttttaacagaagtgggaaaataccggatccagtactgcattaatttgtagagcaattttttgcctccttgcatgtgtgattactcacattaaaaatagctttgtaagagaaaaacgatgtgaaatttatgttttaggtcaatatgttggggatttctgagctgtttttcatttgtaaataagtaactcaatgaaaactcaaaaggcttggctccagatatgtaaataattaataactagcttgctttatgggtgacttatttgaatattatctctaaaaataactacagaaggacggtagcagtgtggaagaatgactgtgctgtacattgggattgaagcatgagcatatgaagactagggttttaggcttcagacaatgtcagttttcctttgtcctttcataatttaagacagttgtttccaaacatcacatgcagtctgtagaagttaacagcaatgttcatatgaactgggtaaattggtcttggctttcagaaacttattgaaaataataactgcaaaaggctgaagatctggtcgtgggtggtgcattggatttaatgtcacgttgtctagtgcaatttgtaactgtgaattaataatttgggaaagatctttaggtgggaccatgaaattgtttatttcaactcagtcaaccgagtaacatagacttctgatggtgccagggaacagagtctgccttcaagggctggccttaattcagaagcacataattcattcagaaccatacaccaagtgtgattattaggctgtgccatttttgtttaatactcttatataatgtttccttttgatattgctttccaataataagaatcactgatttcaatgtttctctgagatggcaagtctctatttgaggatgaatttaacatttgaaaatacaacaaagctgttcagtacagtgtctgggtaattatgtggtatggtgattcaccacggggaagcagggaaggtaacacccagacgtgaatgcagaaaataacactcattttacgtgtggctgataaactggccataaaggggatttcaaaagagaaatgtgtattgataatatgctaatcgtaaccacatggagggaagacccctttgaaccatctaagtgttaagtttatttaaacaacctggctcaaattagaaattaatagaattgagctatgtgtctttaagtcattcttaaaatttccctcaagtacctcagtgtgttagacataattctctttattcatgacattgtatcaatactctggtcgtaactcaaatatacactaaagtctgatattcaggtgaggagcctctgtcatgccattactgttgtgttgtggtaagcggggatgaaaatgcatttggttctatgttccttagtctttttgctttcattttctctttctctttttcactgcctgcttctggctacttccctgcttattagatcgctcattagaaggcagatagggaaatcagaaggtaatgaaatttaaatctgctaattctgcaacttgttagcagttcctattaaatgttcagtgggagaaggagctattacgactaactaaaatgaagctgagggataatctatggaatttatttaactgttgctaattcattaataattgataattaggcaaaccaatttattgcacaactaaatgatgtcagatgttccttttttggagatactgatggttaaaaaaatttctggaaaggaaatcaagtattgtaagtttaataaacctcagatttaataaagaaaggtccatgacctcacaaagccaacctcctttattccctgggacatttgacagtgctaacaatggctacattgtatcatcttggaccaggaaaaaaataaccctgttgtttctgaggtacaagacaggagagcctatatttatatctgctaaatatttgcaaggaaagcaaaaggagagatggcacctgagaaaagttagaggtgttggtagcattcagggcccagcttattatcatgtgactataattggtcttaagaacaaggtgatgtaaaggaaatgtgaagccacttcagccttcccttattattcgacgggttctaatggatgctttcttctgaagagctggctttacaatagactcagaacccccaggtgttgggggatgcttatgtggatggagtgtcagagaagtttttgttgaaaatatggacaagatatatatatgtaaaatgaagtcggagttatggctaaagatgatttgcatacagacagtttggatggaaataagtaacaataaagaaagctagcatgagaaattaaatgtaatctgaaagagaaatagaagaaaacagaaggaaaacaatgttcgctgggaagcatgcaaaagatgaaggaatgcattcactactgcccaagtgagcttctgtaatgctaactttctcacagccttccgccattagagacatggggacagtggctcttcaccttgactgagagttggcaatgcccgaggagtttggaaatatactcgtgcctgcatctcattcctggagattctgagttgatggagacagggcagggcttctgcatcaggagcttgcaaagtggcccggatgcctctcaaaaatgactgagcttgccaagtgtttctgtgaaatatgcaaatttcatttaatgccatcttccctcactgtgtcttagtttccttttcatctacaggctgactcttcctattcttcccatcaccttatccccttcacatacactgtcttaacctcaacagaaacccgaatagcatgatataataccctaacacccagtcttcatctaacatgtagctcctctctcagatacaaggggagagagaagcaaagggctagaagcaaattcctaatactagtgtcttcataaaccgagatttcaatatcaagtgaaggattctctctcctgggcttcagcttaggacactaattgtgtaggatgtgagactctggaataagaaacagtagaacaatagtagatatatcagatttttaaaacactactagcacaactttcagaattattttactttctttccaaatcatactggttttgctacatctgttcaaaagcaaaatgaaaatggcacattttatctttcatatgcctctgtaattataaccgtgaaagtggaatatatttattcaaacttgtttctttttaaatgaaatgtcggaggcacaaaggagaaatactattaaatagatcatttagagattccaggccttctatatttagtacagctgccttaagattgaatgtggcaagataaattgagaaggtgcttagaaaaagacattagtactttttacagcagcatattcagccattattattcttcagaatcagagaggataaacatttcagccacccattcgatacctctccaaaagtctcattcatttgttcattcattcattcactcatttattttttcagataattttttcagtggcaataatactaaaagagagtgaagaatagatatggacctggccttcactgacctcaatgtcttccttagcaatgactggccataaggagacagaaaggtgagttcagtgcagtgggcttggggctagatggtctggagctacagttctcagtttggtaatgttgctgttctccttgctggtgcgtgaccttagtcaagttatttcgcttctctcagccttggttttctcatctgcgggatacagatttattttaaaaaatctatattgagccccttctgtgtatcaggttctgtgctgggtggttgagatacaaaagcaagcaagatggaagggaggtttgctcagagggcctatatatacccagcaccaagtataataaacactagctgatatcgtagtattatcacgggactctgttgggtcctgtgggggttcagaccatcatgggtgcttactgatacatctgattgtagttccataaaacacattctttcatttaaccaaatcgtggtattactccatactgctctgcaatttgccttttctagcaagtgtctgagtgtaagagcaaaggtggtgaacacctaatatgatcctggatagaattttcccaagagggtataatagataagcaatcacgtgatttcagagttcagcaagagcatagttgaatgtaccttccacaagttcagtaatactgtctgtgcagatgctccttgacttacgatgggattatgtcctgataaaaccatcataagttgaaaatatcatgaatgaaaatgcatacacctaacttactgaatctcacagccttgcctagtctacttaacacatgttagtacacttacattagcctacagttgagcaaagttatctgttttactcaaagcctattgtaaaataaagtattgaagatctcatataatttattgaatgctgtactgaaagtacaaatcagagtggttttagggtgactcaaactatagtttctcctgaatatgtaacactttcacatcatcataaatttgtcacatcctaggtcaaaccactgtaacttgaatactgtttgaactgtttattgctgtatttccaagaaagaccaatgcctggaaaacccctaggaacttgagatatatttgagtgaagaaatgaatgaagtggaggatccaagttggatagataaatgaataaggacataagagaaggagacccacagagagagaaaattgagaagttaaacatccagagacaatgtgctctgagtgatggaggtcattgccagaagatcaggcatttgattgaaagctttaaaagaagatgcagttcagaaaatgttaagagccaggtagagactgcactatggcaggcatagagaatgtggaatgtacgagaaacacgtgtggaactaaaaagctgtctgttgacgaggtagctcaaaggcatatggaagtcattgcaggaggaagggcttaaaactgaagagaaggcatacaaaccagatgcaaagtgttcaacgaaggtagagcagaccagattagccaagagccataagaaaggatgagagatgaggtgggtagaagtagagaaggccttaaagggtaatttttaatttattttgtttttttacatgaggataaaggatcaacggtctcggcaggagagaggcctgtctcacctctcaagtacaaggggagagggaagtaaagacaagaagtgaaaagacccaagccgtaaaacatttaagcaagattgtctggcagcatgtactaactcattaccattcttgcagagaggatcttttaggcatgttaataaaatgtttctgttcagtctatctaggagactcatcttcatcagctgttcacagttcaatcccataaaatatctctttgtgctcaactattgccacattcttcatggtaatgggcagtggcttggatgctgagttaagaaatcttagctaagaaacttcccacacaacatttgttgcacaaagctggcaaaagtattatcagcttaaacaaatggaggatttactcagttcccatctattagctacatggcttcacagccattagaaacataccctaagaagctttcctaccgctatcttataaagccttagtcttccattcagcatgctgatgaggcttgtaatatctttgaaagatttgttatccttaaagaaaacacttaatattagttcaaaaaaatctgataaactgtagggagaagagggatgtgaaagtgtaaggccaggtgttacagaaggtatgtgtttttaagaatcaagtgaagaaaagaaatgccaaaagcaccacagatggaattttaatggaaatttttttttgtaatttaagatcctgcacccttcaaaaataaaagaaatgttcaagaaatatataaaacaaaatatctgactgtgtcagcatctaagctgatattcaggataatgttcgccaagaaagcctctgtgactaccctaccctttcctcacacgctctgggcatgtgataggaaagacaaaaagatacagcgataaagacaattatgaacatgctgtgtattgtttttttttttttttgaggaattataatgttctgttttgtgccttgtaaattttaaactgatgttactctggtggaaggctggcatgatgaataattcataaaatggggactacccaatattagaaatgaaaatcacttattaaatgaagaagtctctatccctggtggtgctaagtcataggaagtaatattatccaccagtttcattcccaggtgaaaaggcaactccataaataaataaccaaccaactaggtttttattattttgtttattactgacgtgttcagacctcttgacagtatgatatttggcatatctttaaaaagtagacttttcttcttcacctttgactaaagtaccccacctttgattaaaatatatgtatgatttgaacaagtcttgtaaatgccaaatgcaaaaagatgaattctgcataaactctaatagaattttgcaaactacagtgtgcatccaaaatacctgagctgcttgttaaatttgtagaaactcctcttggacttcaaatcagatttcttacaggtaagacaccaaaatgtgtacctttaatagcaccctctgggattctgatgcaggtggaaagagagccagacaatgataaacatcggatttgttgatggatcatctagggttcctgagtgggagtgttgtagcctgaaaccctacctggtaaagccttgctctggtttttaccaggtaaaataaagtcaacccattaccttttgagaatcagcagataagatctattttgggggttgaattttatataaacctattaaaaagggccaaatagttcccagctttcaaaattagctttctgttctcccaaccaaaaaaaaaaaaaaaatcacactgaagggaaaaaattctttgttgcggatgtcaacaggaatagctacaaaaggcaagtaccagaagaaattcattttgcactttagggttcacatcggacttaatgacacaaataattaatgaggaatgtaagggagccagctctttttcctgacccctctgctgcagctgacagtaccaatctcagccaccttcattaaaactttttcacttttgacttccccgacttggtgttcttcagtcaccctagctccgtggccgtttttgtctggcacctttttttttttctccaattaactgatgcagttccctcaggcgtagctctttcttcaaatagcatcaactagcataggcctgaacatcccttaccaaaccacctcctcagcctttacttcactgacaccaaaattctacacaatttccagttgaagtaccacattcatatgtcaaaaatagtattaatcccccttctaaatgaggcatagtttttcaagctttttggcttctgtcattcctttgggtcttttttttttttcctttttctttttggactgagctttagatccaggcctagtatttcatttctgcctaatggtaaggaaatggaaatatctacctggttttcctaattcttctctcactctcatttatttctttttctccattcattcattcattcattcattcaatatccattcattcatccatcaattcatctatccaataaatagatattaagtccagtgataattaaaacaaaacaaaatagcaagagtccagtctgtgggaaactttgaagagacattagtgaaataatcacaaaaaatatatagttgcgaactcatatgaggactgagaaagaaatgcccaggatattgcagaattaataactggaaaacctggtctctcgggaatacaggaagagaagaaggaaggtaattttgtacaatgtagcttccagctgaaagaaaactttatctggctaaagctgagtggagcaagaaaataacattataaagttttatttatgtttttattcattcatccattcatccactacccaatcaccaaatatttgagtggttactttgtgcctggtgctgtactaaaagtgagattttattgttcaacaattcaacaaatatttatcacatcctcatcacctgtcaggcattgagaagacactgcatgctgagtttccactgctcatgtatgcctgtgtgccctagtaaagcccagtgaatagtggctggagtggagggaggtgttaatagcattattgtagctgcaactgttactgcatgttgttttggtcttgtaaaacttggttcgaaatgcacaactatttggaggccctttcagatttttaccatcctgattctgttctatttttatgcgtttacctcccccatgctctcactgagctctgagttaaatactatttctttcaatccctgctcaaggcaacagagactgtactttagataccaacttaaccagtcaaaaacaaaattcttagacaattcttttccagaggtctaagaaagaaggtattgttttatcatcttgatatgaaaattggatttgaacagtattatccaaatccttctcttcaagattgatgataatcatgcctttctttctttcaaatatctaaggagtataccactcatttatctcataataagattattgagtagcaaatcatacaacttaagaggtagtaaggcccttggagatcacccgcttcaatctcttaatgttacagactgaatgaaaatgaagctcagggatgttaattgacttgatcatagttacgcaaatacatcataggcattcatatacgatgtctgaagttaggttctctggaaaacagcctatgagacacagatgtatatacaggaggtttactggggagaactctggaaaacatttgtgagggaatggcgggaacaggaggatagaggaagacgatgaacttctacgcagtcacaacacaggcctcagttgagcccatagtggattctgggttgggttcatctccagagctgccctgccttgaggcacttggacaagtcactagaaatggactgcccctggagacggagcatggctttggacaggggcaattctaggagaaaaaccagctgccagtactcccagcagctgggagagttagggccttggtgctgaaggggatctgggcagctcactgcagcatctaccctaatagatgaggatagtttcataaaaagtatgtcccagtaaagaacagcaaagggctttatatttgacttcttgctaagtatctcattactggatattttttaaattctcttattctaaacaaaaagtactacttgaaaaagatacgtttgcctgaaaaattttatttaatgttagttttggatgctcacagagctcatctgaactaatcagccaaaaaaaaaaaaaaagacaacacagtgatgattcttggggataagaactcataaatgaagcatcttatattgccgttttggaaggtcacctacgatgcaatataatgaatgtagaagtcatgaatatgcatctgcaggaaagtgagaaaacaacatttctagaaagagcctgttaattggattaacaaaaacctagtttctcaaattcttaattcaacaaatgtttattgagcctctcatgtgttccaaacaatgttctaagtgttcgagcttcagaagcaaacaagacaaagcccctaaggcttgaccccttagagttcatcctattggttttcttcacatctttagcatcttattgtggatttctggataacggagctatgttctacttttctttatatctctaatgctttgcttcatgcctggcatataaatgtttgttgaatgaaaaatgtaataaactcttttacacatgtagacaagtacttgagctacagccatcacacctctaaatatttaattgctgaacaaatgtttgttttatctccagccagatttcagagatgtcataaatcttcctgaggcagactataagggaaggaaaatgctggcaggtttgaaaaatacgttcagagaaaaagaatacaattgggtagtgactggaataaataatcttgggtttgttttttttgttgttggcctcattatctgagcatggttattcagacacctagagatttttcctaagaaggttacagagtttgtaacattggattctttatatattccaggatttttccaagattagtatttagaaagacctaaaaacctcattcacaaataatgacatgtctttatttaaacctctttcaaagtgagaaatatatcttatttctgtttgatgaaatcatatacttgttatgtatttgaaaaagcgacctctacaacactgggtgaatgagatgacaaggtggtgacatatttagttgtgcataagcatcacatagggagtttgctataacatgtatttccctaaacgttatcccctgaaactctgatttagaaaatatggggcaagacctagtaatgtatcatttccgatcattacaaattggttaatatgttggaacgaatagatatttaggagttaaaagataaatttctgttctgatgctgcccttacttcatgacttgagtaaatcccatagcttatctgtgactctgtttccccacttgtttgaagtgatattaaaaataaatttcttggaggctgggcacggtggatcacgcctgtaatcccagcacttttggaggcggaggagggtgcatcacgaggtcagaagatctagaccaccctggctaacacagtgaaaccccgtctctactaaaaatacaaaaaaattagccaggcgtggtggtgggcgcctgtagtcccagctactcgggaggctgaggcagaagaatggcgtgaacccggggggcggagcttgcagtgagctgagatcgcgccactgcactccagcctgggcgacagagcgagactctgtctcaaaaaaataaataaataaataaataaataaatttcttttctactctgaaaagttgtaatatgtatataaaaagtgaatatgcataaaaatgtcttatgggtcttaaaggctagacaaatgtagttgtgaatgaaatttttaagaactaaacattacatttgctctcttagtcactatcttcaacacaacgtcttagaaaattggacaaaactcaactttcccgccaactgaatacttggcatctcctgagggattcccatccagtcgtctctctttggaaaaccttcctggcaaagataccccaagtcagaggacaggaataagaactgtaaaatattcactatttaaaaaacaatatatagtctcatgtttatgtaaaagtttcaatttttctaatcttttaaaaataataaagtgaatttattttccagctctgattctatttttatttccaaaagcttttgaaaatgcctcagaaagttatctctgtctgctatttctgtcacttcagtaggaatatgcctaattgaacaggtgactttatgcctgtatttttggaatttagaagctgcagaaagcaaaatatgtaaatgtctcgtgtctttgctacatcaccatcatcattagcatcatgttggtataattatataaacaatgagaggactctactgataattgactaaaggcaagtatatgtacctatatgtatttgtgtttctgtatctgtgataggctttaaggggagattttaaaacatattttataattctcatttcctcaaaataaagtagtacatccccaaactgataactgaatattttaatggtgatttgacatcagctgaagatatgagattttatataacccataacaatttgagattgctttagagatttatgcaaaactggaaaataacacatcttttgtggtcacatctttcaatatgtaggttactagtactgccaccctcactctccctaaaaattccccaaataaactgttctctattattgcatacatttcttatattagcaaatgtttctgttactcaaactgacagtatttcatatacttctgaagcctgtttaaggtttgtttttgtttgtttgttttgctctccctgttgatgttgctttcattagaaacatagtgaaccaaatgattgtttaatggatggtgttggatatacattaaattctgctatgtcaacatgtttgagtgtatttgtgtaaatgcagacatccatctttaatgtgatggtattcaggcattcctgtaaccagctaaagggaagtttttgtagtaatttaagtcatcacatcatttagtttttttcatcccaacgaaatcgttttcctcctttaggtgagctggcataccttgaaggtagtttgcctgcttaccttttgctgaaattgaaagaaggggaaaataagcaaaaaagacaaaatgccttttttaataaaaaaggagctaatttgaaagaggagtgagggattaggatgcccagattcagagaggaagtgataagaccttacggaattacaaatgggccaccagtgagtctgctgatgtgattcaggcaaattatagttttgccccaagtggcacattcactaaagtgtgtactgactgacctaattcccactcaactggcaaagtacggagttgttatagtttccctatggcatgctgatgtcttcttcaactttattacctacaactgattttccattctggttcagagtctcactacggacttttaaaacagaaatggttatccaaacctgaagtctaaaggaaaaaaaattaccaaggctcttataccttctatttcacttagaatgcatttcaataataatttttaaaatagtgaaaataataattacctaaaattcttttttcatgttttattgtgttttcctcatctgtccacacacccatgtgctaattgcaaaagtagtaaaaatgcattataaaatctttccaatttctgtcagaaggtatttataagctagaatataaatattttataatataaaatattatatttactaattataatataaaattattttaaaacattttaaaattcttacactgaaagataaccattgttcatattgacatagggatatggatatagatatagatgtatagatgtgtgtatatgtgtgtgtatatattatgtttaaaaataaaatctacattttataattttgtgattttcttttattatttgtaacaccgtggttatcctcccatatccttattagtcaagatgttgatttctcttaatattatgactttagtatatgatagtgttacatatgttgtatggctctatcaaaatatatttagccaacctttgctgttaaataacaaggttatcttttattatgactctgtagtgactgggatatgactaacagtgtagcaatcaatcttatggttaaaccaaaaatcccagatgatttctttagcttcaattgttagaagttccattgttgattaaaaactatgcatgtgtaaatatttcgtacatatttgaaagttactataaaaagcttctactaacttactgactaaatggtgtacatcacatctgtttaccattctcaatatttttcagaactgaaaacctgtttggcaataaagggcgttgccttaatttatagtacctttatttctagtaaaattaaaaatgttttatacatttattttcaatttgtgttttccttttgtgaattgcatgtgcccatgttttatttttatttctaattttttaaataaaaataactttgcctgtctgatatgtaaataatacatgtttattgtggggtgggaatagatgacatataaaagcttaaaaggaaaggtaaaatttacctgtaatttcccataataaggtaattgcataaatatttcaatttctacccattctttagtgtaaagcgataaatcattttaatgcatttttctgattaattgggaaggttgatgttttccgatgtttattagctacttgactgtgcccttcctttaattttctattcataatctctacatttctatttcattgtcttttcatatcaatttattagctttattttaatattatagatattgatttgtcatgtgcattacaaatatatatattttctttgtaacatacattttacttattatttttaacatttttctttcaatagcttttggggtacaagtagtttgtgattacatggctaaatttaaatatgcatttttcaaaactacccatcatttattgataatatattggttatttttgccactgaatgaaattaatggtgcttattttattgattgtatggtgttttgccactagtggtatgaattatgttttattttgatcattaaacatatgtataaggtcacacaggttttttcccatttagtcgttaactcctctgaagttcattgttgcatacagtgtgaggagatgctttgtttttttcccgactgctaaatttcctaccttagttaaaaggtctttctaaatctagatttttcatataatgttctatattttttctttgatttctgttgtctttggttcacacgtctaaccattcatttactgaacgctacacctgggagatctgttcccatcagaacagacagagctcatataacggctgcatctggaataaatgtgtttagttagtcacctattaatggttatgttatttttgtatcttgacttttcatacacattactacagtgaatagccttgtatatgtataaataagtctgtgaagtgaaaatgttgagtgtactctttgtttaaaagacattgccttcactgttggagtgggagtttacaggtaagtaatgggaggcaccttcatgatctatgtggttatggattggaattagggacattaatatgagctcaagttcagtttaatatatatgcaggtagttacatatagaaatatttataggtacttttgtgtgcatgggttagtgttcgcatattttcttgctgttagtgtcagcctagcaggcctaaagcaggtatacatcagtagcagcaagcacacctggcatgcaggtcttggtatctaataccattatccaatgagtggaactccttgaagagctccttgaagaaatggctgatcttatgattgaggcaggaaatattcaagatgattctggagtatcttgtggtgctagaaagttaaaaagtgcttaataaaaacccatgatggtaaaagtatgtcaaagggatgcaggaccaactaaaggttcttaatgtccaaagcagaactgatctaaacaaaaaaataaataaagtagtattggactataattcaaagtataacatggatatccataagtccctggctgatataaataaatgacttaataaataaaggaaagctaggcaaatctcttatacagaagaatttcaaatactttatatagatactcttctctcacaaagttacagcatcatttctcaattccttaattgtgggctacacatggtgacttcttttcaaagaagactgcctggaaaaggtggatgaagtaactttacagtggagaaacctgacaaacactatctcagtgaggtgaatgaggttaatatccatatgataagttatgttgatgctacattcccttgacacgttgtaatgagcatagcactttattctgtgtctattctcctcaaaatgccagaccagacaaatcaggagaaatacatcagacaaatcctaattgagggacgttctccaaaatacctggccagtactcctcaaagctaccaaaggcatagaaaacaaggaaagttggaaaaactgtcatagccaagaggagcctaaggagacaagatcactaactgtaacattttcacctggatggaaattggattaggaaaagggcattaggtaaaaaaaagaaataccaataaagtatgaatttagttaatgatacgtcaacattggttgattaattgtgacaagtgctgcatattaattaatgttagatgttaatagtaggggagactgggtggtgtgatgtgcctgtaattgtcttcacaatttttctgtaatctgaaaccttctaaaatatagtttatttttaaaaagagaattttgcagcttggtacggtggctcacacttgtaatcccagcattttccatctcagcctcattgcatgagctcaggagtttggcaccagcctgagcaacatggtgaaaccctgtctctaccaaaactacaaaaactttgcagggaatggtggcacacacctgtgttcccagctactcaggaggttgaggtgggagaaggatggctggagcccaggacacggaggttgcaatgagccgagatcacaccactgcactacagcctgggcgacagagtaagactgtctaaaaagcaaaacaaaacaaaagaaaagaaaacaaacaaacaaaaaaacacaaaaaccaaagaaacttttctacatcaccctccattgaggttatgtgcatctttactctcatctgcagtgtaaaaaatgttttctttaccaaatgtttgttaaacatttggttttttgctactctgataggttaaaagaagatttttagtgtaatttttattcttattttcttgctatgactagagttgagcagctgttcagatatttttaagaagtatttgtgtgattttctttcaactctcaaacctgattgtttgctatttttccattgggttgtttttcttccatttataggagccatgcagcacatagttttctactttatttatattctgactttgttgtttcttgatatgtaaaaatatttgctttttatttagttgacttagtcaatctcttctaagggttctgcattttatattgtaggggtgttccaccatgattttattttttaatctaatattgtatagtttcttttttatacttcttttcatttattgtctctactgatatattaattttaaatctagctatttccttctgttttatgtttccttccatttttcttttctttgtatcttttgctatgtagtttgttttagtttctcttttgtcttgaggtacttggagatgacacattgtattttttaatttcttgtattttttttttttttttttttgtgatggagtcttactctgtcgccaagcctgaagtgcagtggtgcaatcttggctcactgcaacctctgcctcccaggttcaagcaattctcctggctcagcctcccaagtagctgggattataggcacccgctaccacacctggctaatctttttgtatttttagtagagacggggtttcaccatgttgaccgggctggtttcgaactcctgacctcaagtgatctgcccatctcagcctcccaaagtgctaggattacaggcgcgagcccccgcacccagccaataattatctttaagtcttaaaaaaaaccagccctcttccttgaaagtatatttgtgaatcatcatcaacaaaatgacaatatgtctgaatgccttttttgtcaggtatggtgggctgaattctcaagatgtcaccccaagattccatccactgatcattgaatcaaacactacctagattaaggtagtgctgtgaagatattttgcaggtcagagagatttgaagggtgaaaaggacctgactcccaacccccaccgcgaactgactttgagattggatagagggttccatgtaccaaggaatgctggttgctccagaggttaaggatatcccccagctgacattagcaaggaaatggagcctcagtcccacaaccacagagaactgaagtcagccaatggcctgaatgagtttagaagtaaattcattttcagagccttcagaaaggaactccgccctgctgacaccttgatttcagccttgtgcaatccctcagcagagaaactagctgagcctgacagccttctgacctacagaactgtgaaatagtaaatgtttggttttttaagcttctaaatttgtgatggtttgtggcagcaagaaattaatttaaaaggcaatgaaattagctcaatctcagtttcccttatacacaatcctagatttgttggtttattcttgagatttgcattacatttcaagtgtttgtttggaataattgtgtctttaaattatttcttttttagtgccagtcttttcagcaattccagtttgttttcctatcactggactgtgtaagaatatttatctcttgccatcaacataaatgacagcatatctggatagtgagttttgaaattatacattttctttctcatattttgattcatgttactaaactaatgttggagggaaaatatatttttcccttcaacaatcatagtttcatatttagatacttgttcttgaaatgtatatgttgactaacttatatataggtgcttttttttccctgttaaccttgccaattatttagtaagatctttgcatcagcattcagaaaatttccttatattagactttaaatatttggtttcctttcattctgttctttggggattgcaaattatctggttttgttttgtcttattatacatcctataatttcataaatttgattgtattttttttgtctttttccccctgaatgctgaaacaggttttaagccttcatctcttactactacaatattattttttcttcagtttctgaggctacttttagttctgcaatgtcatcagtagattttgtcttctagttcatttctcattttatacctgtatttaattttatggaaatcaccaggcataatttctctaatatttttttttctttgcctaaagagttctttatcaaaaaaagctcctctttcctctcctgaattatatgttctcatctttccttttttatagaaatgttttatattttattttgggtatttcctatatactcatctgtacatgtgagagtctacccttggcctgatcttgtctacaaacatgacaataaaaacctcctatgcttatatcattctcacagggacactcttaaaattatcttaaaatctcaaatcttaatctggagagccgaataatagaaataggtatgggcagtctagagattttctagatggaaaactgtggggcagaatctgtagttgcaggctgctatgcagaggaacttgatctctttatggtttcttagcgttggtgaagctgttctatcactcacttttcttgtccacttagtctctgtttctgaatatacagcatagctatgtatggaatctttcttgttgctcttatctgttgactaagggattatccaaaatacctattggaagtctctctggtgtctttcttgccattaatcatcctagagaagctatatccaacttggtattagtccattcttacactcttataaagaaatacatgacatctggctatttaaaaagaaaaaaggtttatttgactcacagttctgcaggctgtacaggaagcatggcagcatctgctcacttctggggaagcctgaggaaacgtacaatcatggcggaagggaagggggagcgcatatattacatgaccagagtcagaaaaggagagaggaggcgaggtgctatacacttttaaacaactagaactcatgagaatttgctcattatcaaaaggatagtatcaaagggggatggtgctaacccatttatgagaaaccgcccccaggattcaatcacctcccacaggccccacttccaacattggggattacagttgaacatgagatttgggtggggacacaggtccaaacgatattactgttgttctagaatagaacacaattccacagtcatggcccttgtagatgccactgctaactgccgacccatgttttaggtcctatttaagaaatgtaagagaaatgaggagcttagtggatggtgttcactgagaaaattgtattctttcaaattaatcctccaaaccactactcatagcaaaatatcttaaactttggggataatcatggcatgtgctttcatttcaagaaattatggagaaccgttctgtctctttatagtcttttgatcatgttggtaaagactgacagaattgtggatgtgtcatgtgtagtgggaggggtgcaaggtcataccaaaagttgaatgcgtgcacctaagtcactacccaccacccactaccatatgaagcatttcatgaatcccatgaccaagagttttgcttatgctgcatgtacccttgtgttgtgccttgtgtattctcatatttttgatagtaagaattgttaatattttttctttagtttttacagctctagttttatagctatttaatataatatttagtctgtgcagcataatatactaaactacctccttgctgactccattttgattgtttactctctttgatgttacaaaggatattgaaatatatgtcttacttttaatatctcctgacttttaaaaattcatatctattcctagaaggagtaggattaatgcattataaattatggatgtatccttcactcatacctttcaaattgcttttttaaagactgataccaatttacaatattttagcaatatgtgactatatcattttcacctcaaactcagcagcattgggttataatatataacttattatatatacaatttcttattttatctgtaatttcttaaaatatagatattatttatatatgtatagtaaatgtaaatataaatatagttatatctgtaatttcttgatatattaaagaaattataattataataaatgtaaatataaataatttctttggcattttaagaaaccatatagctataataagaaattatatatgatatataaatatatttatatatacaatattaaagaaattaatatatactttctaaattaacctataatttttaaaatattttaaatgaattaaattaattgtaaatgggcatctccaagttgccaaggtgattatttttatcaggtgttatgagtttgcttgtacattaagtagaagtacaatagttttaataaattaatacgtatattttgtctctcaattacaagttagtaatgtcccctaaactatttcagggaagattctgaatctttgaaattcaaatgctagtgtgcaaatggtacctggaatatcacctcatttaataatccacttataatgacttttgatctggatttttatgagaataacaaaaccagttgtgaacagttaaatatttttatatcatatcctcagatcatcatgattttctgtgaaataaagaacattagtccctttctttggtaagggagtattcacaattctgtctttatataaaataattttcacttattttagttaattaatatttactatatgcctactctctgataggtgctgagtctcatcaagtatgtagcagaatatgaattttagagcaggtctattcatcttctattgctgtgtaacaaatcactgcacatttagcaacttaaaacaacacatattgattatctgacagttataggtcagaattcaaggcaaaactgcaagtttgctgtcatggtgtcagcctggctgggatctcatctgagatttgactgaggaagaattcactttcaggctccttcaggttgctggcaaaatttatttccttgtggctgtgtgactaagggctctggctttttaccgcatgttgactggaggttttgtaggtcctagaggccccgacagttccctatcgtgttgtcttcccactgatttttgcttcttaaagccagcagaagcgtctcgaactccagtcaaagacagagttctgtataaaataacacaatcataggagtgacatcacattaactttgccacattctattggttagaagcaagtcacatgatctacctgcacaacaggaagagattatactatggtgggacttacagggccaccttaggtgtgtccaccatagaagataaggagaaaagtctgaatttcctttttgaaattgaataaatcaaacttccttccctattctttctcatgtttagttgctttccccatttatctactttgttattttgaatgtactcatgctgtgttacactccatagtcggctcctggggaatttgcataaaaataaaactctattttaagggtctttattatttcgttacaaacattgtttcagaattgaaccacacaaagcctaagaatggcattgctctgatttgctcccataaataaatgtcacttaccattaagcattttcaaagggcatttccaaggacattctgattttgctaagatttactggaggttaaaaattaactagagattagaagaaaagagaattcaactggaatacctggttgtaatttttatttaaattattttaatattaattaaggtacctctcttgcattattcagcctgttaaactgtagaagtcttacttgaatgtaatatagtaaccatttttctatagtagatagaatttctttttggattaccattgaccatttgtgttttcatcatttatatgaatcaatggcaaattgcaagaagttcatagtttaggcatttataaaataaaggacaatctattctagaataatttggcatctgtatacaatatgtttattagaggtctagcagaaagtggaataactgttgccttgggaatgtctaccctaccccactgtgtttaacatttttattccagtttattcaccatattgtaccgcagaaggtagccacaatgagctcagagagacctcctattgtatcgcatgcctacttttttcagtacatctttgcacaaatacttgaccatttcctttttattcatctgcaaaatggaaataaaaacactgcctacctcatgtggctgttattactgttaaaatgaaatggtaaacataaagtgcttatcatcataaaaaccacataagaagaagtcaacaaatggaaggtttcttttcaaaaaaatttacagctattcttttaaagcataaaggggcagcattatctccacatgttggttatctctagaaccaaactgtgagaggattttcactgggtattatattgaataagacttctctggctgcaagtgataggaatataacataaaaaagagagaggaaggcaacataatggcttagattattgtaattccaggagtagtccctaggttagggatagttggatccctgggcccaagcacttgtcagaattaggtctcttccattgtcatatgtctactttaatggttttcattcaggtactcttctctcagaatataaccagaaagttatttcttttcaattagttctaataagatgtctgtgattagctctaatattatcaatgtatgtcttatacccattgctgagtccataaatctggtgagtgaagtttcctgctaggattgccccaccttcagacctgtgggtaaggtgaccccaaatttgaggcacatgaactgagaacagataagggaaagtgctgatgtcatagggactgggcaaagctaggcattgcatcaataaatgaaagagcacattttcagtacagatatgtttaaggtaaacggccgtttattttttagttatagttcattggtaggaagaaatagatatcgattctctcatagcattaatgaaaatcaaatttattggaagaataaaggattggaaacaaaatccgataaaacaggtggagaaacaggattcaggaatttcagaacacaacatcttcagaaatccaagaagacgctcttgggtcctggcttaaggaacctttgagaatctgttccagatcttgtattgtttgaatgaaaaaccacaatctagagaaagagtgaatgattatcctttcttgagtcatgtttatatcccgtgtatacggataaagagaattctggggttatctctgtgacagtcctactaacaataaaagtctctttcacaagagactctactatgagatttggtagagatttatgagatttggaatcaagtgttgtgggttttaatcatagttctactaccagaggtgggatattgggcacattacttaacatttccctttatttgcttttccattgtagataaaattggttcctatattttagatatctcatatgggaaagtataatagctttgataatgatgtgatgaagatgtggtcaaccaccagtggattgggtgaagcattaatagttttattaaataacttgagaaatgttgacatagaaatgaacgtgtgtttttacacaaaatgaaaatatcaagctttttctttcaaaacctcatattatcacaaagtggaaagaatcatacagtgaaatcagttgacttcagtgcttatttctaatgtccattgtgatcaactatatgtcaaattagaaggggttacttaatcttcttaatgttagctatttaattgaggggtggggtggaggtagttatcggagtaactttacaattaacatttccagtgttaacattcatgacaataaaacagaagaaacaaaaacaaaatacttactctgtagaaatattcttatcattagataactttttgagcatttaccatttaacaagcaccaaattatttccacatgttaattaatttaattctcataatgaccctatgaggctcttttattatttccttattatagctgaggaagatgaggcagatagagttaagtaacaggtccaacgccttacctagaagtagcagaaggggacctcaaacccaagaacccaagcgctttatgagtattacgttaaattacctctcatctgtatatgaagatactagtgatttttccattatttgtttagaaggctcaacaggagtttgcaaacactgagccagtttaactattctgcaagaataacggaagggtaaatggatttccctgggaaatactctctggagaagaaaacagtggtaggagagacagaaaacaaatgagctgttttccttccccaaccccgctctccatagacacacacatatatatatatatatatatatatatatatatatttttttttttttttggttgacaggtgttgagtgctttcatatgttttctgactttatgggtcagcaatcttccatcttcttttttttttttttttttgagacggagtcttgctctgttgcccaggatggagtgcagcggggcgatctcagctcactgcaagctccgcctcccgggttcacgccattctcctgcctcagcctcccgagtagctgggactacaggcgcccaccaccacgcctggctaattttttgcgtttttagtagagacggggtttcaccgtgttagccaggatggtctcgatctcctgaccttgtgatccacccacctcggcctcccaaaatgctgggattgccggcatgagccaccgcgcctggcctcttccatcttccagttgaactcttatatcagaaagaaattacctcctcaaacagattcaattaatagtgaaataaacacatttatgtttacaacaattttagaatcaaaacagacaaaattgtatacctaacacttggaaggagttaaaaactctaatatagtaggcatcatggatatgcttattgttttgtaggaatgtgaatatcaagagcaagcaaggtcacatactgctaggttttcatctcatctgtcaaggtgtcatctgtcaatagcagattgctattgagtagtaagtgccttgaattctcatcatctgattaggaatacgcccataactgtttcttagtgttcagctctgagtgaaggttcatttttttaaggaaagagacatttagtataactttaattcttctcttgcaaatgtctaagattccttcaacgtcaaagagaaaagtgtaaaaattaagtagaaactagggcatagattagaaggtgggtatgggtcagcggcttaatgcagctttcaaagagactttgtttgtataagaatgagttttcttgtgaggagcgtttgtgaattggccatgatctggaaagactttaaaatctgatgtgttaggacatttttgcaaacagcattaagtgtgcctcagggaagaaataatggagcgaaccagggttgtgaaggtacgagtaattctgggaagcagctattgcataaaacccttttagtatattcatgaatcttggcaggttgagtgggaagataatgttataggtcattaccatctcaattggaccaccagaaacagcattcatactcacccatccagccacttcttcacaggagcactgaaaaaccacctgcccaatagggttacatttggagctataattgcatgtgtgtgtttgtgttatggggaaggaattgggtggtagggaattagctagagaaagagaagagggctctgtctggcaaactgcagaaaaaaagtttaggtgtcacccgtcttggaaggctctgggagtgagctatggacactgaattaggcatttgacatgtgagattgtgattcctggacttcaatcagttttcccgttgtacatagaacccaaccaaagaacatgtaccctacaaagatgatttgaataaactcagtacccaatcaaaaagtgtctttgatagtgaggtgttggcatttaaatatgtttctttgaaatttaatcaaattggccatctccaacagatgaacatatggcattctaaaatatttttatctgaaatcattatttttaaaatttggagcatatatatatacatatataatgtccagaaacacaatctatattggtcaagtctcaaagctaaccaacaaatgcatctctgctagaatgttcttgaactatgttttgacagctgtgtgaaggaaaaccacttgaacagtaaacaattatcaaaacagctggcatttactggcttatgatgtctgaggcattgatctaaggactttccatgcagtgatttagttaattctcacaacatctctatgagatagataagattgcccataaatgtacagatgaggaaaccaaggcatttagtgtttaggtgattgtccagtctctaaattgggaagaggcagagctgggtttaaaacttaagcagtccagctgtaaaggtgtccccttactgccctccagctgatcagtatttcatttcaacatttatccagacccaatttatattgggcactatgctaggtgctggagatacaaaagaatcccatttcagcccatgggaagctgctgagggagagagatgtgaacagataactatagcagtgtgctgaaccgaagtacacagatcattgagaagaacattgaaataagtgatgaattcctggtggagaagcaggaaatagaagatttcctggatgcagttatatctgagatgacttttgatgcattagtagcagttttgacaaatgatgggaagaaatattccaagtgagagaaatagcacacatgtatgctaggggcctgacacagctctgtcctatgtatatgggtgaactctcttccaacatttttttgctcactcagatcttgtaaaaaaaaaaaaagttgaattcactctgttggttctatgttgaatcaaaatatagattaacttttgacaaaacataggtcaatgcttcaaagtgggaatgagactgttgtcatgggagttgagataccataaagagctggaaagaccctaagcatttatgttccattttgcccatcaaaggctcccttgtggatcagatcgagttagaaaaatctagatggaagtgggaggaaatgggctgaagtatcagatgataggatgagaaatgtgaaagagggaaaactgtttcttaagatcagtttgtatgataaggatgcaagtcaatcaacataattttgaacttctgagagacagaagaggactcttgcagtttgtaatgagaggctttttcacattttgggacattatcatgtgtcaagcactgtgtctggtgctttacaagctttgatttaacttattgattcaatagcctgattgcaatagttacttttattagcaatatcttgcagatgaagtttacacagctagtaagtagcagagctaagattctaactcagatctgatgcactcaatttagggttgcttaagatgagcttgcaggtctactaacatagtcttcttaggatttcttccaggtgacttctttcttcgaatctttagatgttaatgaaatgtagacttatgggtacttatgggtaccctgaagggaacacttagttaataaagagctcgtctgaacacagactttttaatatttgcatgaccatatgaagagtggtattaaaatagttctttgtgttgaatacatttaaagctattaccaagttttgatttggaccattatatcaaaggatatttttcttaacttcaaaaactgattatatgttcttgaaatagagaatagaatatatatgtcctagtttagaattctgggcaactttgtaattgaagttacagaattacattttgaacagaggaagcccaatttatgtaatctgcttattgcagctttccaagataagatttgtcagaaggctaaaaagacttcttgatcactggtaagtttctctaaatgggcattttgattaattatgatcatttcgctgattaaatatcagtgactaatcctctaatagagtgggaaataaccaccactatagttggttgaaaataaagggataagaatgcagagattggtttgaatcatgtaaagttatgattatggtatcagattgtaccagctattgtaactttgaggtttcttaaagccttgaagcttatttaatctgaggagatataataaaagtctgtaacagctattttgaaagactatatgggtttttttgtaattgtaccaactatgagtaacatagaaatagtcatttattcaatacctgctctgtgcaagaccccttgtttgagtgaagaaaagtgtcagatgactagaactgctctatttagtttgcacggagtgtgacttttgaacaggtaaaaatttttcttttacaaaatgactccgaactgcaaataaataaacccaatttttggatccccatggaatgtctaggctggaaaagaggactgatccttcccctccccaacttttgctttaagacctctaatctaaagcactatttcagagtggcaacctaggcttttcttgaatacatcccataatgagtaacttattatatcctaaagcggttcaaggcatttttaaatagtttggaacattaaaaacttccttcctataactgctactcattggtcctaattgtattgccctaggctttaatgtttttaatatagctttagatgaataaaatataaatctttataataaccaaaaaaggaatgctcaaggaattgtaataggatttaagagaacaaaattatgtttcatatttacctagaaacaatgttttaataaaatgcttaaaaaataaggtgacttttggaattaaaaaccaaatttgaccttttaatgtagtttctgaggttcattggaaaacatgtacctgtctctttggtgttaattattagactcaactaggtaaaggaagatagtgattaattcacatatgtggattctcattgcattgtttggatttccatttatttctactaactagcactgtgactctgtcaagttacttccctctcctgggcctctgattccctaaccagtaataaagtatctgcctcatagaattgtgtgattgtaataagataatgtttatgaagttcttagtcctggatctggtccataaaataccttcaataaaatctccattcaacaaatatttattgatagcacatgtatcatctgtcttacataagaagtggttctagagatcatactgcatgattaaacgttttgagaaaataaaagagttgcattttttcagatatttttctggcaacacccaaaggaaattgtttctttatgtttcgagagagtgatcattagtttaaaaaaagacttaattgcaaaacactgttatggagagataatttgttaatgtcatggtcaagatatggaaaagattcctgatattttccagaatatactctccattagagattatgttttgctttacttatttaatattcttgaaaggtgccagatcaaaaagtccttcattaaactcattaaagtttttcctttgacccattttacaacaggcttctgcaaaataatgttcatccatcgttttcttgcctgtactgaaacttaactctttataatatttatgtttgtcatccctctgtagatcccttttgatacctaattattatctaagcatctccctcattagaataaaaaaagtaaactagcaatcttgaagttagaaaccaagttttagagctttccacattaaacctatgttaccttactagttactaccatcaactagacggtaaagtgcaggatctgcgagtgccttccttcctttgtatttccatgtggatgtcctgagtgtttgtacagagcctttcatgcattgtgcctctgcaattttctgctcctataaatagcatttttcagctcttggtatgtatgccaagtcattccttgtatttggtacagcattttccataccatgggtgagtacagaatctttcacttcttaagcatctcggaaaagatctgtttctcctagtaacttggccaccaccaataaggaattttctgtggtacatgataagcacccctaggttccccattatgcccacgtattgattgggccttgtctccaaactttaaggagctatgatagagcagagttactccaacacctcctgacgatttgatctaagccaccaaggaaattctttacggagagtggcagcacattcctcatccatcatacatttatatcttgcctctctatttaacacattgcagaaaaaatgcaaatgcattcaactcacaacggaaatacatcttatttttgagctgcctacatggataatattcatcatttctaaacaagatgtgaggaatataacatacatataattttttctttatccagaattaagtctatttttcacttgtgagagaaataaaacaagctttgaaaaaaatgtttggctaaatgatagtacatacagtagatcaatacagcaaaggtactgtcttagtttgtgcctgctgctataagaaaataccttagactgggtaatttacaaacaacaggcatttatttctcacagttctggaggctgggaggtccaggatcaaggtccttgcagacactgcatctggtgggagttgctatctgcttccaagatggtgccttcttgctgcatcctcatgtggtagaaggggtgaggggactaactggctccctcctcaagtccttttataaggtcactaataccatttataaagcagagacctcatgacgtgatcatctcccaaaaaccccatctattaatactattgcattgagggttaagtttcaacatgaatattagagagaaacatacattcaaaccatagtaggcagtaacatttgcctggtgcctaaggtgtgccaaacaatattctaaatcttttcagtgctttgtcttactttatgtttaccacaaacccgaaaaagatgttactattttctcctattttttagaaaagggaagtagtagattggttatggtcctaattttacatggcttcctatatccatgccttatgcaatgtgacttgacagctccttccatcaaaagctgaagtttttccctagtgtgtgaatgtgggctggccttgggacttaccaggccaatagaatgtggcggaagtagacaataggccagtttccaatctagctctcaagtgatcttgccctcttttattttctgtctttgaatcctgcccatagcaacaagcttaggctagcaggtagataataagtgatccagggccaggttagtaccctcaccacaaccaagagccatccaatcacaagatatgtgaatgatatcttttccagagcactcagctctcagtttctgtgcccactgaccacagacatatgctttagccctaaaagatcaaccaaacctggttcagatcagcaaaaccacccatggattcctgagcaacaataaatgtatactgagtttgggaacatttgttatgcagcaatagctctcagatatagaagaaattcttcgttttatttactcgttctttctcagccatcgtgcatactgatgtggttattgaaaaaaggaaataaattattaatactaaatacttctgtatatacagcccggtcatcagtgcttgtgtatatgtaaacccattttgtcctcagtgaatttcagggggaatttcttatcttcattcacaggtaaaaaaactgaaactcagaagaggtgcctgccagcaagtcactctgtcattgtggcagtgccagaatttgagcacaagtcaaaagtctatattctttacctttttccatttctgttacctctatcctttctgatgttgaatttcagcagttgccttgagaagccccttaactttaagcagtccttctattaggtgttcttggaaatcctgtagaatagctagtgaataatcattattttttatatcccttgcacttgggcccatcccagatggtagaaataacaccaaaccccatgtcttccctttaaaatctgggtatccagaattggttccttctggtgggttcttgggctcgctgacttcaagcatgaagccgtggacgctcgtggtgagtgttacagttcttaaagatggtgtgtctgaagtttgttccttctgatattcagatgtgtccggagtttcttccttctggtgggttcgtggtctcgctggcttcaggagtgaagccgcagacctttgcagtgagtgttacagctcataaaggtagtgtggacccaaagagtgagcagcagcaagatttattgtgaagagtgaaagaacaaagcttccacagcgtggaagtggacccgagtgggttgccactgctggctccagtggccagcttttattcccttatttggccctacacacatcctgctgattggtccattttgcagcgtaacgattggtccatttttgcagagtgctgattggtgcgtttacaaacctttagctagacacagagtgctgattggtgcgtttttacagagtactgattggtgcgtttacagacctttagctagacacagagtgctgattggtgtgtttacaatcctttagctagacagaaaagttctccaagtctccacctgacccagaagcccagctggcttcacctctcaaaagctcatagcattaaggaatatattgcatgcaccatagtattgaatcaaaattatatcagcaacagtactcttcaagttatgtgactaccattctaaatagcacttctcattacagctcagatcttatccaatctcttcggttgtcctctccagcatcaactccaactcttcctcccctgtccaacaagcccaggccacactaattcattattttcctcagttatttctattctaggttcatcacatttgcttctgctctgcatgccattttcttctgccagatccttacagggctaatgcttccagttactcaggacaagtccgaatctaccttttcagagaaggcttctctgttcgaaattgagcctagaaagctattttttcaccactccccactgttttattttcttcatattagttctcatgttgtctaataaactttgtttttttttgtcttctgccactaacatgtacactcctttaggatgaggaccttttctcctttcaaggctgtgtcctcaggcttagcatacagaagaaactcaataaatatttgttaaaggaattgcctaaagccatttaacatattcaaaagtcaggtgggactgtggccagcttgctcacactccccttctccctgacccttcacaacacacatctagccctttctattcttttcttttttttcttttcttttcttttcctttcctttccttcttttcttttctttcctctcttctcctctcctctcctctccttttccctcctctcctctcccctcccctcccctcttcctttcacttgttttctcttctcttcccttcttttctcctttcctttcctttcttttttcttctcttttccttttcctttactttttgtttttctcttttccttttcctttttcttttattattcttttccctttcttttcttttttcctttttcttttttttgacatggtctcattctgtaatgcaggctggagaacactggtgcaatcatgactcactgaagcctgcagccttgacctccctgggctcaagtgatcttcccacctcagcctcctggataactgggactacaggcatgtgtcaccatttgcagctaaattttgcattttttggtagagacagtgttttgccatattgtccaggctggtctccaacttctgggctcaagagattcactcatcttggcttcccaaagtgctaggtttatatacgtgagccactgagcccagtctaacatccacatttctaatgcagagtccaaatgtgatgtagtaaaagcaccgtgggctttgaggaaagacggagctggccttatcagtcactatccaggaagctctgggatcatagtttgctcatctatgaaatatggctaatcctacctactttatggactgaccatgaacataaaatgggtatatagcaccgtacccagctgtgaggcttagttttgtatgactggccattgtagtgcccagactgaacattatttcacggtgtgtctgtgaatgtttccggatgagattagcatttggattggtgggctcagtaaagcagatggctcttcctaacgtgggtgggcatcatccagtctattaaaggcctagagggggacatttttgatctgggaaaattttctgaagactctcaaacattctgtttgattaaccggttttctgaaagcagacgtctgcaaacaagaagctttaagagttaaggccttgtgctccttctttcagcatcagagttttttctatcaaggctttgattcttcacaagttagttctgcccttctcctgaaatcagagaatcacacactgtaccaagtggtctggctgtaacttttgatcatatttttaattacttttggctgctagcattcctctgcattttaaaaagcatcctaagagtaaaaggactctatcgttttatcaattaattctccatgccctactagagataatgtccaataaaggcagatatccattttcccctgtggaatcccatcaaatgtgtatgagtaaggagtaccagtaatcttttagcatgtgaggttttttttttttttttttttttttccagtggcttaatttcattctggtttggcaatctgatggagaaagcagcggcttctataggaggtgtggggctgaaacacacagtgcagtggtgaagtctcttgaaaaataagaatataaaaatataaaattaagtacagggcttgcatggacttgtgatagtgaggggccaaaggacatgaactcatggcctggaattgttttttttttaatcagaaatctcctaattttaaaatacaccaaataaacatgtctattgggcataattttaaccaaatgacttacggtttgtgacctctaaaatagtttttatttttgcaatatgtttagagtaatttaaaatatgaatgaaggaattatacaactactaagatatggttgaatattggcatatatcaaagatctaacttgttagaagaggcatatgtctcaggcttcaaacctgaaatattcatctcccatttttaatacagatataggatttaaaagtctgtttcttttttccattgcttttcgggaagatttcagtctctctactgactgtcaatcccttccctccccctcttccacatgaaggtagcatggtttttagcatagtgcctggcacataagtaagcccaaatgtagacacatgcagcataacaatgtttcagtcatctgctgaccgcgtatacagtgatggtcccataagattataatattgtatttttactgtacattttctatgtttagatacacaaatacctaccactgtgttttaattgcctacagtattcgggacagtaatatgctgtacaggtttgtagcctaggagcaataggctataccatgtagcctatgtatgtaatagacgatgccatctaggattgtgtaactctactctatgatgtttgacaaaatcccctcatggtacagcactcagaacatacccccattgataaggcatgcattagctgtatatggttgctgaattaattaaaatatgacttagccaaagtttattttaaagttaacctctccttgcttgacctcaaatgtgaggcagccttattcaatggatagaacataacttcctttgatcaaaagcatttgatgtaaatttctatatggaatgtggataagggtgtctatatggactacaaacatctgcatagtagtagtggtagtggtcactgtctgcgttgtcatcatcatcctcgttaatgctatgtacatgccatatactgctttgaatgtttcatacatattaatataatagtcatcattagcattattttttatccttagaacttacttttttaaagtttaaattaggaattaaaaatatataaaataattaagaccatctcatcaatctgaggtcacgccaggaaaagtctaatttaaacaaagatgatttacttttgtattacataaaatcaatcaagatatatcagatatgactctatgctagatactctcctaaatgccaggctacctgcttgggtgagctgatgagtacagaagtgaacaaaagagactgaccgttgatttccaaagctgttccaatattctatcagcatgaaaaatgggagaattaggaagctggtgcatacttcaggtttgccagcaaagtcccgtgatttctccaaccagctttccagggcacatctccaggtttttatttgtgcacagatgtgtgtgtttgttgatcaaacatttcagagatctgccagctttcaagggtcccagttctgttatcatgccccaggagcaagtttctcagcatagctggcacagagggaccacagctacagctgttttttaaaaatctcctgctgaaattcttggtttttaccttagtacttcttttatagcttcaatgaaatgggatggaaacaacatctttatctctgaggaaactgaacagtcactgttaaccaccaactgaggtgttaacttataacccctttttgtgccagatctttttatctgattccctgcaggatatatctaggcatcaggacaagattaaacaaagatgtcaacttaaataatgatcctgtgactggctagagttaaatgatccagagaaatagtacatgctgtttacttcccagggagccgatggattcataatacgggatttttacagggtatgtaccttaaattagatgattgtggttgagtgtaatgtagcaaaataacccatttggttcatcagaaaatgatcatatttggaatggtctttctcacctttaaattggcagagctggactagaggttgtgtaagatctcttgcagtgtagtgcatcttgctttgaaaaatttggccctgcccacattcaaactatgctttgtcttatgcaatagactgaatggcattgtctttttaactttgggcaattattttgcacatatgaatgcaattgttgaaattgatgggtgtcagtcaagtgatgaagactttaatattgtaagggcctttaggctcaatctctatatcaattgtggcatgtgtggagttttgaatgtaagattttcttaaagttttgtgttatcacaaaccacccagatttcagacgaagagacgtagtccattttaagattatttttatgcaaaacaatctatagtgcctctgatctattccagagctgtgtgttaagtgtctctccatttgttaattatgcctttccatttgtttctttcagcattgacagcccgtttcccctcctggctgaacagtatggttttgaactttgttattgtaattctgcagccaaaattgacaatgtggagccataaaatagtgtagattaaaaatcccttaaaggtaacctattatagctttctcctttttcaaatgataaaaatgaagttcagaaatattcagtggtgtgctgaaggcaatgctttccaaatgttttcatgtcatggcaaagatagaaggtgatgatcattctaagacacactgggctaacattttgaggttgttagtggctgcagctgaacagccgaagggctccaaaaattaagatttaagcacatatttgaactcatttatggtatattccataatataccatttgcaaagctctgacctaaattcaactggtagcagagctaccagtagcccaatctctattggcttaaggtaaaacagtatttattaccttatacaatataggtaaggttgaggcttgattcagtggatcaaacttcaccttgaacttaatttcctagctaaaattggttcttgtctctcatgtatgttggcttcattctcaggaagatgacaatctcctggtggcaaaatggtttcagcacttccagactgttcaggcttctgggttaaaatcctacaataatgagagagtttttataaaactttcctagagtttctataaaaactcttctgacatctcattggttctgaatgggacatgaacccattctaaaccaatcactattctcaggagaatgtagttcattcattgccttagattaaggtcacgtgctctacctttgtgtcagtgtaagcccagatacactcatatatcacttaatgacaggaatacattcattctaagagacacatcattagacaatttcatcattgtgtgagcatcatactatgtgcttacacacccctagatgacatgcctactataggctatatggtatagcccattccattgctcctaggctacaaacctgtattgcatgttattgtgctgaatactgtaggcaattgtaatacaatgataagtatttttgtgttcaaacaaatctaaacatgggaaaggtacagtgaaaatataatataaaaaataaaaaacagtacacttgtgtggggcacttaacataaatggagtttcaggattggaagttgctctgggtgagtcagtgagtgagtggtgagtgaatgtgaaggcctaggatgttactatacaccactgtagactttataaatattgtacacttaggctacactaaatttatgaaaattatgttttcttcactaataagtttaacttagcttacagtaacttttttattttataaacttttaactcttttaactttttgacttttgtgtgataacacttatcttaaaacacagacatattgtacagctatgtacagctctgtcaacatttctcaaattacttggtaaaactgttgatacttcacccaatcgactggtggtgaccacatcttcagcacattattattagaacatggagcaacaaaaatctttctaaattacatgctgatcactaaaatgtaatgtgtgagacaagattctaaaatattcaatagaaaaaaacagctgaaagacttcaaagtctcagcagatatttcagcaactgtccattttttttgaagacagggcttagagctcaaatcccaccaagttagaaggatttggtaagcaccttattttaaactccagaagtaacatcatgccttagaactaatatgcccaaaactaagggtaaaatgaactctgaaccaaactcccacaagattaagatgacctgttcattatttcaccactgctagaacaaaacaatagtcttcaaaaaatataaatgatttgctggctttgacaatgtaccattcataatttccagtagataatcaaaaaatatccatcataagaagtgagaaacattcgactcaaaaacaaatgaaggaacagtctatagaagcaaaccaagatagactgcatatgttggaatgagctttaaatgacttaagcataatcattataactatgtttaagaacttacagggaaagaaagtatacaatgaattaagggacacaaatttcagtagggatgtaaaaaacaacttaaaaatgactaaatgtaaatctagaactaaaaaatgtaatatttaatgtcataaatttattagatgggattaatggcgtactggatataacatcttttgatcagtgagttagaggaaaggtaaacagaaatctcaactgaaacccaaactgattgaaaaatttaaaaaacaaataacctgtgagataatatcaagtagcatgacatacccggactccctaaagggtaggaaagataaaagggacagaaaatatattaaaataaatactgacaaaatgttttaaaatgacagaaaacaagaacctctagatcaaagaagccaaacgaatctcaggcagggtaataaaaatcaaatcatatctaggacatcatggtcaaactaggggaaatctatgaaaatgagacttattgaaggtaggcaagaaaagagagacagaaaaatgaaaagagataacgacaataagcaatgctggacctcatatgagaaacaaagccataagataaagatacatccttaaaatggcaaattatggagaaaaaggagaaggaaacaaaaagtaaaagtaaaatcatcgatctagagttgtatatccacagagaatatccttcaaaaatgaagttgaaatgaagacactgtcaaatatgaaagttggaagaattaatctcaacaagcctacactaaaaaatgacaaatggaatttgaaaaacataagggaaatgatgcctaatgatgatttggatccatgaaaaggaatggagtttggaaatataagtatatggacaaatagaaatccttgtctatttttttctattcttatactatttaaattataattgactgcataaataatagtgatgcattttgaggcttacatgaagaaattgttcatttgtaggatttttttatatgccatttgaaatagcatcaaattaataaaacatttagtagtaaattgagcaaaatatgaacatgattattaccctaaaaatttcagaacattaattagaggaatttaaaataatgtaaataactgaagagatagaatgcattcatagtttgaaaagcataatatcactaattttcctttgactgcatctttaacacaattttttttctttgacatgagaagctgaacttcatctaaaaacagagtatggtatctgattacaatggaactttggtagaagtcacaattactaggtttttacaatccttttctaactcttctccccaggaaatgtaaagacagatgaaacatcagctatgtggcaaatgtggctccagattagcctattgcatctacctgggaagtactataagtacccggtggggagccttaaatttaggctttccttagtgaatgaattctgcacattggcacatcttttgcaggagccctggaaactttgtctgtgaagtttttacaagagagattggctcctgtgtgcatagggcttctcaagagcgtagacctcatattcacaatggggaccttgtcccttttcacctcagttgtcatcacttggtagatcaaagatgaaaattcctggatggctatcagatggatataagtactactttgagcagaaacacctgattttaccctgttgccaagttcttgcctgatctaaatccttctaaatagactggcactgggtaacgtccatatgggccttgtgtgtctgagcgagacgtgaatagacctaagaagtctctctagtaggcattgctatgccaattctctccaaattaatctgtagatttaatgaaatctccagtcaaacttccatcagaattttctttgtaaagattataaggctgattctgaaatgtatatggaaatggaaatgagctagaacagtcactagccaaaacaatattgaaaaggacaaacattgttgtaggatttacagtactagatttcaaaacttaacataaatctatagtaatcaaaagagtattacatcggcataacgatgagaaaaagattaattcaccacagtagaattcagaaacagaccaaacatatcaactgattttctatgaaggcaccaagataatccaatagggttagaaaaatcttttcaatctatattacttgaacaatggtgtatctacatatttaaaaaaataaatcttaacccttgcctctcaacatacatgaatattaatcagtcataattaaatttaagagttaaacctatgaagttttaggaaaaaatacatgagaatatattcatgactttgggtgagcaaaaatttttcaagacacaaatagcacacagtacaaaacaaaaaattggtaggctagacaccatagctcattcctgtaatcccagcaccttgagaggccgaggcacaaagattgcttgagctcaggagtttgagaccagcttgggcaaaatgtgagacccctatctctacaaaatatttaaaacaattagttgggcaaaatatttaaaacaattaggactacaggcggctcacacctgtagtcctacctacttgagaggctgagacaggaggataacttgagcccaggagtttaaggctgcaatgagctatgattgtgccactccagcctgggtaatagaatgagacactctctctttttttttaaaaaaaaaaaaaaaaaagaagaagaaagaaagaaaaataatagtaaaaaaaaaactttgccaaaactaaaagttctgcttttcagaaaggcaagccacaaattaggaggaaaacaatatatacccccatctccataatgttttatatattaaaatacctacaaatcaaaaataaaaacacaattcagtaaggaaaggtcaaagaccttgtgaacacttcacaacagaaaatatacgaaaagtaaataagcatttcaaaaagtgataaagtgccaaataaaatgataatgagatgccacattatactcactagaatggctacaactacaactacaaacaacagctacagaagcaacaataacaagaaaccagtaatattattgttgttcacagatcagaactcttacactttacgggtgagagtgtatatggtgcagccattttagaaatatgtttgatagttttttataaagttaatcacctatctggttggtaacccagaaattatactcctagtatttattttaaaataatgaaagcatgtccacttacagacttatactcaatgcttatagcagctctatttattatagcgcaaactagaagagactcaaatgtttattaagaggaggaaggctaataagattgtgctgtgttcatacaagggaatactactcaacagtagaaaggaatgaactactaatacacacaactgtatagatgaatcttaaacatatgtcagataaaggaagccgaatgcaaaagagaacatagtttataatttcatctctatgaccttcttgagcagctgaagctaatatgtatgaggagtatcggaataatacttgcctttggaggggtgggttaactaagaaagggacttttttggatgacagaaatgctttttgtcttcattatgttggtggttacacatttgtcaaagcttattgaacattttacttaaaatgcgtgcattttatgacatgcaaatttttattttatttgaaaaaaaagattgttgagattgaagttaacttgtaagggttcatttctttccagcataataatgtggttttgagttctggatccagattttaaaatattagtgccaaataatggccctgttactttctatggggatacaaactctctatgcttcagatatgccgcttgcaaatcacctatataagagacttatttagaagactaaatgagacaatcagtgtgtggtacctgggcaatagtaggtcaccagtacaggtagctgctcctatgattgttcttattatcacttttatcatcactcatactgagatcagttagagaacagaatagtttgttaaagagtaaagatatttaaaatccaggagaaaataaatatagatcagtagacagccatagatatgaacatggatatagatatttacattaactcgaggactttaccctgaaattcacatataatcttctagaagtctctgtgtagtgaccttgttgaattatatgttaaatatatatgtatatttatatgttaattgtttgggataaaacttccatggttttcttgagaatctcaaagaggttttgtgacctcccccaaaagattaattataccttttcaggaattacctttcacaatttacttacattccaagtagcttactttgctattgaaaataaagccaaaaggaccctagagtatatacgtaaatgctagtgtaccatctgcaaatttctttgcattttttaattgtgctttctttggcctttataatttctttatcatttcttgttgaaggtaaataagaaggaagagttgaagatttctctgtattactttatcagccacacacctagagacaacatggaaatgtgggtaggaaatattttgaatgcttatattaaaaactatagtggtatatgattttttgaaaattcatatagtttaacgacagaaactgtctctgataagggaaacaaaattggatgtagaagtaaaaagagcatgactaaacaaatgactgcatcagcaaaatgaaatgtattgaaacagacaaatcatcacatcagaatgaagttacttcctgaatttaccacatgaaaaaaaaactgtggaaattaacaagaaattagccatctgtatttgttacaatatagatatagctgcatgtgagagagaccaaaaatagcttaataaactggcttatctgtcttgtctgagtggctttgcctgcaagtcatcaggggcctgcactaatactatcttctctgcaatctcaagtgtgttgagattggtaccaggtgataccaggtctgcattcaaaccaggaaggacgaaatgggaagggaagagaatacactttcctttcaaggacatggtcagaggacatgggcatccttatgctccatctcttggctagaagttagtcgcacggtccccgcccctcatgtgaggctaggaaatgtaggctttattattttggccaggtgcttatctaaatattctactgagaaagagaagagtggatattggcagaacaacatatttgaaaccagatatccctaaataatcagagctgcaaaaatccaaaaataaaaaataaaaaaccaaaatgcctcagaagatttcttgtcctatatgcaatttccttgaaaggattacatcattccttataattagtaataatcattattgggagccagaggttataattgttcttctcaattttggttggaagtatgtgaaagtagtttaaagagtgagtatattttataaattatttaactatagaaatatatttggtgttgataaataagcactcatttaccaactaaacatttattgctattatatatatatgtgtgtgcctatacacatatatatttttatttttatttatatttgtttatttatttatttattatttggaaaaaatccaaaaaaatccccatcctgtgccaaccaggctggagtgcagtggcgtgatcttggctcactgtaaccgccacctcctgggttcgagcaattttccttcctcagcctcccaagtagctgggactacaggtgcccaccaccacatctagctaatttttgtatttttagtagagacggggctttgccatgttggccaggctggtctcgaactcctgacctcaagtgatccacccacctcagcctcccaaagtgctgggattgcaggtgtaagccaccgcatcaagccaatattatatatattttttaatggccaactggtgagatttttaaagcctttgcatggtaggtacttgaaaagttgagagtagatcttgttcacttatgagtgcattggataaggtacttgattattagctagagaaaccagttagaaaagcttaaggaaaggaaggatggagaaaagatcaatgtgactagaatggaggtacagagtgaaaggtggaagattctaacagtggaggggttgacttggttagattgtgaagtgtattctaaggcttggtaaggcattggactattattctgtaggcaattgggagacataaggtgaatgaatattacgtgattaagtattcactaatgagtaccaaaagggatgtagccatggttgatgcagttcaacaagtggtccttaaaagtgtgaataaccagaaagaattttaatgctttcaatgcaggtaaaagggaagtagttcagttacttaaaaaaaaaaaaatgtactaggctaggagtgaagatgattaagttattctccgaagtgactaaccttaaattattttaggtttcatagtttcagtatcactgtgaaggtactgttacttttttttcacaaaaaaagtattggaatataatgaaaatatgcataaaaatacaaaatgccattcagacttcatatgcgtgaatcatttgaattagttctatgatatcactataatagcataggtagtagacaattacattaaagtactatgttgggctattatgatccttgtatttttactgtgatacttgtgagacagatctgtcatagaccactgactatatggttcagatggtggcagtgcaaaaacacccaaagcacattaactaccagtcagttcagttccaagatattcagtccactctgtgaactcattctgtgtgcccaaccctgtgacagatcctgcaaatatagtgactcccccaaaatgttctctggcaactgggatttaaggtatttaaatctcttgtgtgaattaaaaatcataagtataacctgatgttgagagcaaattatcaaagatagttattactattccatttttgttgctggaaatgaggccaaaaatggataagtaaactccagtagccggaaaacaaagccttttttccaattattaggagtaatatttaaagtggggattgggacatagggaatccattctctgtctccctcacccaccttcccccactaaacaaaaaatcctcatgaaatagaatatatccaacttacattcacattaaattataactctttcctggggtagcttttgatagcgaaagagggaggagaagatcccaatagaaaggcaggcagagagaacagaatttgttaccgagaggcaagtgctttaattctaagctcattgtgctgtaaggtggttggaaaatgctctgatatgggcaattaagaggctgccttgaggaggaaaagttttattttcctgtctgcctgttccgctcatagccctcaagtccttccagatgcagagccccaaaacttctcagaagaccatccaaaatagagtggtctgcacatggtctggggatgttgatggcctgttgattctttaaagtggcagttctcccccttttctgatgctcacggtcctttgagaatctgatgggtgctacagagcaaagcttataagatgcttgattggaggatttagttagggattgtttgatcagacagaatatttaaagaaagtttgaattagttgtcaacatggaaaacttgggagatttcctaacaaaatctagatttctggcttggcttggcttagcttagcttttctcttttctatttttttcttttcttttctttttttcttttcttttctttactgtgagatggagttttgctgtgttgcccagctggagtgcagtggtgtgatctcggctcactgcaacctctgcctcccgggttcaactgattttcctgcctcagcctccagagtagctgcgactataggcgcccgccaccacacccagctaattttttttgtatttttagtagagacggagtttcaccatgtaggccaatatggtcttgatttcttgacctcgtgatccacctgcctcagcctcccaaagtgctgggattacagacaggagccactgcctctggccaataccaatttctggcttttcttaaaaaaaaaaaaaaaaaaaaaaaaaggagagagttgacttcacaggaataatggtggacatggcagcaaggagctacagttgaggggtagatggctgtatggatacaccatgcactcctcagttcacatgctctccagcactctctattttaaaataccaactttgttcatttacatcaacccttcgtcaacttacattgtcctcagtagtttaccatctcttccttataccctctccacataataaaaatactaacaatgacaatattccaatgtatgcatttaacattttccagacattattctaagcattttacatatttaagttcacttaattctcgcctgtaatcccagcagtttgggaggctgatgtgggcagatcatctgtggtcaggagttggagtccagcctggccaatatggtgaaaccccgtctctactaaaaatacaaaaaaattagccaggcatggtggtgggtgcctgtaatcctagctgctggggaggctgaggcaggagaatcacttgaacccaggaggcagaggttgtagtgagccaagatcgtgccactgcactccagcccaggcaacaagagtgaaactccatctaaaaaaaaaaaaaaaaaaaaaaatcactaaattctcacagcatccttatgaggtaggtactatttgttttcccaccttatagctcaggaaactgaggcacagagaaatttaagagctttcccaagctcacagtgctagggtatggtgtagtaagtcttctgatgcaagcaggtagactgcagaggtggggcttttaaactgttctgaatgatcttttatgcatatatgcatggattttgcgcatcatttcagagtcaattgatgagatatcccctttcccgggtccttgacagaagagttagtgctgccgagtgtaaggagcacagctttgagtattgagtattgtgagcccctgtgggatgcattccacgtggatggcttcacagctttctccctccaaccctggaggtcacccaggactagaagtgcaaggagaggtagggtatcttctttatacatcaggattaccatgtcaggccttcttgggcactcttgtttcacagctaacttcagcaaggtcatgtcagaagcagggcaagtttcatgggtttgcagcctgtccattaaacaggacccgtgctttacaaaggccccgtgcttggtttaggctctgctcttgccaccttgaaagtatgaatatttttttcaaacaaactgcccccattttcactttgcactgggtcccaccaattttgtaaccagtcctaatcaggaagcagcatgtcttagcatattgctccagaaaggcagagaactttatctctcctgtttactgaacactcagaattgtggctcccacattgtaagcattcagtaaacatttgttaaagaatgttcagcgtacaagctgtaggtcagcaaagtttcctgtacagggccatgtagcaaatatttcctctttgctagtgggtctctgtcgtaattacccaaatctgccattgcagctcaaaaacagcaataactgtagagaaaggaatgagtgtcactttcttccaataaaacttttggaagttttactggtagtggtagtggtctggatttggccagcaggctgtagtttgctgacctctgctgcagagtcatactgctcagattcaaccctggctccaccattttctttgacttcaggcaagttgcttaacttctctgagcttcagtttatttttctggaaaactgggataatataagtgctttcctaatagggcaatggtgatgattaaatgagatagtgcttaaaagacatctagaacagctgaacacattataaccctttcaactgctgttggtactacttctataatcactaagaacggcttgactttcagaggtctacagataattaacatatataagacaatttcatcagctgtattgctagacaggttttgagggatgagcaaagattttgttaagtatcccaagtgacttttccattttcctctgcaaatatttcatggtaagaaagtactggttttgttctttatacaggatctatgttcactgaaattagtcaacaaggaatcaaaagatccagtagattctcttcaaggaatctatcatctttgacctcagtttcccatctatgaaataaagaggttgcactagaataatggtcaaatccttttacaaattggaaaggctaaatagtgtacatgttgtgctcttagactctggaactgcattaggttttaaatctcatcttgactaatcaacagctttgtgacgctcagtggatctcacaagggttgttgtctttctagcttttaaagtaaatggcctccccgcttccttttcagtttttggatccttcatgcataaagtaaggaatgagcacattgctttgacaatccaaacacgactttgaattaaagctgatgtgttacaaaagactgctcagaaatattcccattttaattatatgctttggcaacagcatttatttgcttccaaattttcagataagaacaaaatccaaaatgacctaaaaacaatcattctgctcattcaaggtgtgtaaaccatgttcctatttatagaaggcatggaggagagaagtgagttgggtgaaatttctagcggtaatagcttgctttctgcttttgaagacaatgttgatgagaactgaataatttccttataattgacacgaattctatctggattccacaaagcacactaaccagcaataacatgtcatactcaactggattactgtaatagcctcctcaggagtttctgtctatctactcttggatatccaatacagtctttctccaggaagtagcacagcttacacaactattcatcaaactatgccactctctgcttaaattgctccattaacacttagataaaatacatgcctttcaccagcccacagtcctgaggcaaatgtccctgcctgactctcgtaggacctctcacccctctgccccttatttataatgctggcctttttgtccacataccacactttcccccttccagagcccttgtctggtgtttcctctcattgcaatgaactttccccagagctttgcttacttgtctccttattcttcagggctcttctcaactatcacataacacttactaccctaggaaattctctattttatttataagtttatagtttcccctacttgaaggaaatcactatagaggattgtatttttcatcctgacatctagaacattgtctaatgtccattaggtgttcaataagtaaacatttattgactaaataagtgaaagaataaaattaatttttggtttgtagtttgtttgaaggaacatatttaaaaaagcagcatagcttggcagcccacaattttatcacttttgtattagaaaaaaggctggatgctgactggagtatctgtgtggctttctgttatgctccagtaagacaattcagggagttgttatagtgaaggaaccacttcgaggtagtaatatggctattttatctgtgaaactatagacttcctagctacctatgcacacacacacacatgcacacacacacatacacacacacacaaaaaatgagaccaagtccctaaagggaaatgctcaaggcactatttattgagcatctgctatattctaggccttggaaatgcaaagatgaataagtatggtgtatatcctgggggaattttatcatctagtggggaaacagagatagtttaataaagaagctgcaatttaatcaattttccaatagagactgttaaaaattgctgagagaacctaagataaagtgattaattttttcagaggtatttgagaagccttggttaggtagccaggtctcgaaagattactagaatttgctaggtagaaaagatgagaatttcatttcagacagaggaatctgcttaagccaaggctcagaagtgaaagtgggggttatatatgggattttcccatttcctgcctccaattttaaggttcagtacactcactaaaataggtcaacccttagttaatcctcagattctccctttttagggagcactaatccaaggaggcttttcaagtaaaggtaagttaggtgagggaccttataagaagggtgttttctatggaagacctctctgctaacaggtgtgtgttcctagaaggaagtatcctttttatgacatcattgtctacatgttgtccattatatcctccaacatccacccagaaagttattcttggaggatatcttgatcattcaagatcaaaagagttattttaataaaaagcaatttagagttttaagaagcaggccaaatctttctgaatagccattacaatctgcttaccccatactaaataccttaagaagctcaatttctcaccagatggcagtattcagagatggaagctgtttttgctctgatttggcttctgttcgcttctctttctctccacaagtatactgtaagggcaaaaccatgaatatgaatacaaagtcttcaaatctatcacaggatgcaatttattcatatccaactaattctggatagaaacctagcggtagcaagtaaattttatttctacctcataattaacaaaaataattactgcttttgctacacctttcctaacagcatggatcagaccttgagcatcttacttttccacctgtagcatcttccagtttatacatgatctcgtgaatctttccttaacttttattccttggtccttctgagatattcctacactgagtaattaatgtttgtaaaatttttattccttgttttataggaacatgggtgattagcctcaagaaattgcagggaatattttccagtcactttcatgttactcatatgtatgagttttgattgattgagccatccatgcatgggccacaaggctaagcacttattctcatccttataccccaactctaaaagtgaggtagtatttgcatcatatttttttttgattcaggctactcaggcccagagaagtacagtagcacccagtgacacagcctgatttcaaagtctatgatttaaccatcacactatagtgtttcttgcagcttttttctttaaatttaaaccttattttctctcttgatccttcagtgttctaccactgccccatttcttggctagttccctttttcttacttcatttgtatcatgtcttctagagtgattggagactagacagaagcattcttaaacctagagtgtaggggtctatggaatgggtgatcaagttgagaaagtaggctttatgccaacatttgaaaaccctacggcctggggtgtaaagaggtaacattactgaagaaaacatataggctacaagagaggaagagagtggtaggaataagggtaccagagagcacacatctttgttaaagagatacacatccgtctaaaagtagtagccacagacaaatggtttcattggggttaaattatctgatcctccaaggtaagccagaaatcttgattcttatgagatatttccaatttttaaaaagtagataataatttaaatctttttaaacattgtataaagaagattcctgaaggctgggtttggaccatgggccagaagtttatgcctttggtttaaatagtaggcctaggaatattttccacaatccatcatctccttctgatttgtttcaaggaaagctgtgttgtgaactctgaggacatcgatgccaccctaataacttgtgacaaatcagaaggaaagaagatagcaaaagtgaggaccttgagcaggtacacaagtgctgaaggaaaggacaggtaaatgtggcaatccaagatgagcgtggaaaaccttaaggattttgtaaactactttacaagactaacttaagatgcatatgaaaatcaaggtgtgcattctgcagtatgttccaaattaatgcactggcattggcctactgctaggttggagccagatagagcacttaaaggctggtataaatgatttgtgatcacagcctttcatagactcatttggaatctcttttctatccatttttgatcgaccatttggccagcatgccaaacactggtaaattggcattccaaagctcacattggctgattgataaattcactactttgggctcagttttgccatctgtaaagtgatggtgatcaaatgagcaagtgtatttatttattttaaaaatacttttattttagattttgggatacatgtgtaagtttgctatataggtaaattcatgtcatgggagtttattgtaaagattatttcatcatccaggtactaagcctagtacacaatagttattttttttctgattcttttcctcctcccaacttcaacccagtggaggtaggtcccagtgtctgttgtccccctctttgtgtccatgtgttctcatcatttagcccccacttataagtgataatatgtggtatttgattttctatttctatgttagtttgctaagaatgatggcctctagctccatccatgttcctgcaaaggacatgatctcattctttttatggctgcatagtattagatggtgtatatgtacaacagtttctttattcagtataccatcattgggcatataagttgattccatgtctttgctattgtgaatagagctgcagtgaacatatgcagcatgcttgtgtctttatgatagaatgatttatatttttttgggtatatacccagtaatgggatttctggattgaatagcagttctgtttttagctcttggaggaatcgccacactgcgttccacaatggttgaactaacctacgtgcccaccaacagtgtataagcattcccttttctctgcaaccttaccagcatctgttttttttttttgacgttttaataatagccatctgggtgggtgtgagatgatatttcattgtggtttttatttgcatttctccagtgatcagtgatattgagccttctttcatgtgctttttggccacatgtatgtcttcttttgaaaagtgtctgttcatgccctctgcccacttttcaatgttttttttttcttgtaaatttatgtaagttcctcatagatgctggatattagacctttgtcaggtgcatagtttgcaaatattgtctcccattctgtaggtctgtttactctgttgatagtttattttgctgtgtagaagttatttcatttaattagattcaatttgtccatttttgcttctgttgcaattcttttttgtgtctttgtcatgaaatctttgtcagttcctatgtccagaacggtattgcctaggttgccttccagggattcaatttcttccagtttcagtcttgggaggatgtaggtgtccaggaatttatccgtttcttctaagttttctagtttgtgtgcataaaggtgttcacagtagtatctgatggctatttgtatttctggggtcagtagtaacgtcccctttgttatttctaattgtgtttatttagatctttcctgttttcttctttattagtctagctagtggtctattttataaatttttcaaaaaactaactcctggatttgttgttcttttgaattgtgtgtgtgtgtgtgtgtgtgtgtgtgtgtgtctcagtctcattcagttcagctctgatttttgttatttcttgtcttctgttagctttgcaattggtttgttcttgcttctctagttctttcagttgtaatgataggttgctaaattgagatctttctaactttttaacgtgggtgtttaatgctgtaaatttccctgttaatactaccttagctgtgtcccagagattctggtatgttgtatctttgttctcattagtttcaaagaacttcttgatttatgtcttaattttattatttgcccaaaagtcattcaatgccttccctctgaatatctgctaggggggtgccagtcttccctgtgtcccggtcccttggtggcagatgtttctcttggctgtgtctagttggccagcttgcctatctttccacatctgctttcatttcccagcttccagggtctcctagcatcctccttgtggatctcccagtacctgcaggtcacagggccacaaagactgcaacatagttacctagggtctcctggagagagcaaacatatttaaaacagcttgcattaaaccttcctgtatcattgtgttgcaagatcaggttatttaatttccatgtaattttatggttttgagtgattttcttagtcttggtttctatttttattgcactatggtccaagagagtggtttgtttaaagtctgttttgcctgaaattaggattgcaacccatgcttttttctgttatccatttgcttggtagatttttctccatccctttactctcaacgtatgggtgtcattgcatgtgagatgggtctcttgaggacagcatactatggagttttgcttccttattcagcttgccactgcgtgtcttttaattggggcatttagcctatttatattcaaggttattattgatatctgtggatttgatcctgtcattatgttagctggttagtatacagacttgtttgtgtagttgctttatagtgtcactggtctgtgtacttacgtgtgtcttgcagttgttggtaatggtctttcctttccatacttagtagttctttcaggatctcttgcaaggcaagtatgatgataacaaattccctcagcatttgcttgtaggaaaaggatcttatttctccttcatttatgaaagttagtttggccggatacaaagttctctgtcagaattccctccctccctccctccctccctcccttcctcccttccttccctccttccctccttcctttctttgttttctttcttctttctttcgttctttcctgaatataggcccccaatctcttgctgtttgtagggtttctgctgagaggtccactgttagtctgatgggcttccctttgtagattacctgacctttctctcttattgcctttgacttttttttttttcattttgaccttagagaatctgatggttatgtgtcttagggatcatcttcttgtgaaataatgttgggaaagttctcatgaatgatatcctgaaatatattttccaagttgattcattctccccatttctttcagtgacataattacataatcccacatttctcagaggttttctttgttccttttcattcttctttttttaaaattcatgtttgactgtcttatttcagaaagccagtcttcaagctttgagattacttcttcagcttggtctattctgttgttaatacttgtgattgcattatgaaattcttacagtgtgtttttcagctctatcaggtcagttacattcttttctatactggcttttttgtctgtcagtttcggtatcattttattgcaattcttagctcccctggattgagtttcagtgttctcctgaatctcaatgatctttgtacattttcacattgtgaattctatttctgtcatgtcagccatctaagcctggttaagaatttttgctaaagaactggtgtagttgtttggaagaaagatggcattctggctttttggtttgtttgttggttggtttgtttgtttgagatggagtctcgctttgtcacaccaggctggagtgcagtggcacagtcttggctcactgcaacctccacctcctgggttcaagcaattgtgctgcctcagcctcctgagtagctgggactacaggcatgtgccactgcacccagctaatttttgtatttatagtagagatgggatttcaccatgttggccagactggtcttgaactcctgcctacaggtgatccacccaccatgcctctcaaaatgctagaattacaggcgtgagccactgcacctggcctgggctttttgagttgtcagagttcttgttctagttattactcatttttgtgggctgattttccaacaaggtttgaagttgctgtcttttagatgccctattttattttattctattttatgtccttgggggcttagttgtggtataaggtggattcggtcaactggctttgtttctggaagattttaggagactgagcctcagctcagaactcctggactgcctgttcttactctgggggactggtattgggccctggctttgttttttgactcctcaaggttggtataacctgctgcgctggagagggagaggtgcaacaggaccactggtcacaacacttagatggctggtgccagacaaagcacttcatagggcagtagcagtgggatatgttattgttcacacatgccagcagcagtggcagcagcagcatggcagggtgcaccctcattggctgtgacagggtgctagcaggtgatgtggtgccagcctctgtgtgggcatttgcagcagtgttggtggcaacacgggtcaggggcggctccacctccacctcaccagctactgtgcatggtcatgttagcatgagggtggggcgctggtgggcacaggcctctgtgtgacctctgctgtgcgccctctgtgtgcattcatgtgggtggtagtggctactcagagcagagttgggtctgctgctttccatgcctagtttcgtgctggtagcagtgtgacggcaggggtggggcactgccagggacagggctggtgctctctatgcccaccaatagtcccacagcaatggcggtagggtaggttgggggttcattcatgctggcagcagtggcatagcagggtgcgtgctacaggcatgctggtggggaaggtaaggcaaggtctgcctgcatacacacgtgccagcaaagtgatgtggggggtggccgtgggcgactgcatgcaggcaaagtggtatgagagaggctgcattgtggggagggcgcaggcaggctggtgtgtctgtaggggctgctctactggagctgtccacagttcagccataattcaccagcacaggagctatgatgcaggctctcaggagttgtcccctctgggtaccccaggctgcactgcaagcaagtgcagccaggctgggatcctggaaaaggccaacataccgaggggtgttcaggccagactggtcccgtctcatgggcaagaccgccctgcagaattcagatccgacactttctctagggttaaagtctcttatgggagcaagtggagccaaggggatgtgctttcctggctgtgctccactacagacactcctgcgccaaatcctctgggctccataccaggctggagttctgcccctaccacttctccaagcagttctccctgccaactgaagtgtctgtggtagtcatggggtctcctcctgccaggattccagaggcctgtagtaagagcaggttgctccttgcctgttcaactcaccctttccccaacagtcattcagggccaggaataagtccccatacatggtagccccatgcaggagttgccagcttcttccccttcagcccagcatctgtgtcttccctccatctactctcaatgtcttccctctgaatatctgctaggagtgcaccggtattccatatgtcccactcccttggtgccagatgttcctcgtggttgtgtctagctgaccatcttgcctacctctccacatctgctttcatttcctagcttccagggtgtcctggcatcctctctatggtatcttccagtactgcggtacttccagtacaggccacaaagactacaccagagttacctcgggtctcctagagagagcaaatatctttaaagcagatgcattacaccttcctgctatagagttgagagtcaatgaaagttgcattactagtttgctttgaataattctattttcattggacctatatgcatctttctcaataaaggttgtatttaccagttggtagaagaacagatattcaaagttacatttcaaatcacttgtacaccccttagcaggcacattttctgtgcaaagagggcagctagatttttgtaatttcttccccaaggactagggacacattcaaacacatgctatgttagcagggtttcagaaatgatatagcccaacaacctccctacttccatctaatgttctagctatctctggacatatttggaatggaaacctttcagttcaacttttgatctgacttgactttaaggtaattgtagaaatctgaagaatgtctttatgtaatttgcttatttgaaaatgcatataatgcctactatatgccaggttcatttctaagaactttattcattataattcataataattctctaagttggataatattattatccacatcttgcccctgagtggcagtgacaaatgttaaataactttgttttcctgtcatagggaaagcaattctgtctcatgaccttgagagaggactgtaagtgatgtcacagttctgtcatccagaggtgtttggtcccaagagaaagcagcaatgcttaatttaaaatttcatccacaaaaatgcaagcaaaggaaatggagagagaatagtttgagctgaagattctaccaagtctggtgctgtgcagaatgaatgtggggagggtggacagagattaaagagtatgaggggagcctgtcctcttatttgtttcccatcctgttagggctgcactttgctctgctattgcagtacaaaacatgacaggccacctttctttgttcctttctaagtagcctcaaccctcttctttttcagtttccacaaatggccctgctgaggaaatgcacatcttttgatggcataatcttcttaatcctcctaagtgtcctgggaggcctggtggggttacacggaagggtacccagccatctgatgcttctttgagagctcagcaagactgtggtcagtgctgggcacaggcagtgtcttaatcccgatttcaggggagatgtatgagcctgtgagtccccggtgcatctctacaacaatgaagtagaaaagtgggttaaaggaacagaagagagcgagagagagaaaacctctgatatttctcaccatgatgaaatgaacaaatgaaggtacaataatacagtaggggtaaaaaatactagttcattgttcaagggaaaaaaaaatcccaagtacaggttcaagccagtgctattaaaacccactttttatggctagaaattggattcagtatagtaaagtgttactgttcaaaagaaagcattgagtttgaatataccatgcttgacagtcacctaaattactgcatgaaattacaagagctggtcctgaaacgtaaaatcacgtcatggtatgtggagttactcagcgtaggtagaggttgctggaaattgctttttacaaggccactcaagtgacatcagaaagaactgtttgtgtgtgaccagagttgtacccagaaattacatgcaacaaacaaatctctgtgaatgagcagtgcctgaatactgttatcactcacccttgaaaaccttatatagggaaaacaaaatgcctttttttttaaccaaacaaaatgttttctcttttatttttcaactcggcaaagcattcagctcacaatttttgatataaatttactataacccagaaaaacatttattttatggcattccaaacagaaactgggcattgtatcaaattttgagttgctgaatgtacttgaacctaaacttacaaaatcacatttgctttttaaatttggataattcatatttttcaacaggtttctggttttctaccaagtattctcaaataagttttactctgtatttaaatgtaactttaacttatttcacatccactgaacttgccctttgacttcagggttggaaggagacctcttagcgtcttaaagggccatttatcttaatttgcaacagtggttggcagttttccttacaaagtaaagataattgctgatcttcctatctggtgcttttgtatgttgttttgaagaaacttaccataactatttctgtgtatttggaatttgtagttaactatttttttgagtcaaaaacacagaagaaggtggaaattgcttctctgtagaaaatcgaagttcactgattgatactgattacaggaaatcaaaagctccaagtagaaagtgttatatattttggcaactattgattaggcccaactcactgtctttggtttgcaagaacagaaagctgaagatatgtgaacaaggatctccaataacaaaaaggctaataagaaaaagcatttttcctagtgaaatcacatagttgttaccccaagaccctcttgaaactgttgttttattggaatgaattaatgagaaagttgtagcaattggtattctaatcaggagttgggaagcagggattagaattgtacctttgtgagggcttagttttggagactcagggaaagaatagagaacagagtagaggttttactgaaacaccgggggttgggtctaggtcctgctgcttgcagcccggagtgccaatcactgagatgagtataaccagggaagaaggctttcatcaggtgctgatgctaaggttaggagataaagtctcgaatccatctttcccactgagtaaaattggggattttatatagcggggaaagacggaaaacgggcaatagggagggatgagaaaggaatcatgagggatgaggggctggtgtctcattgtctggatgcaacaacatggtgagttttggctctttgcctgagggttggtttcctgaggaggaactcagatgtgacaaatctaagtttctagttttaagacagagtcaaattctatgttttttttcaggagcccagaaatctgatttccatgggataattggttcagtttcagaaggcccagttagtgccgttagaaagaaacgcaccttgctgctctgcactggtcacagtagagagaacctatcaggcctccgcatctcaatgccctcagcactcatttagaataaaagtcgtgttcaaatataatttttcaagaaagggaaacccgtgactcccatacagatagaaaattaacatgctaaaatgtttatttaactaattattaataaaggaatcagatgttaaaactggttcagagagaatccaaaggggagacacagctgggtgaggtggcttatgcctgtaatcccagcacttcggtgggccaaggagagaggatctctacaaaaaacttaaaaaaaaaaaatagacgagtgtgttgatgtgcatctgtggtcccagctcctcgtgaagctgaggtggaaggattagttgagtccaggtggtcaaggctgcagtgagccatgattgagccactgcactccagcctgggtgactgagcaagaccctgtcttaaaaaaaaaggacacatttatagatcaggaatattgaaataaactcacaatggatgtgtcaatagataaaattacaacaaaattagttttaagatctaactgaccttcatttgctactccagaatcagggaacacctcattctgttttattctgatgagctgagcagagaagctgggctttgtagagagaaaagggcctagaaaagcagaaacagtgaacaaaaagaggattggttgtttcagatttcccgtcctaatagggttaaaacagaagggacttaccatgctggctaaaactggccaatttggggatttggtaatctctgtttctctcctcatttcttggaagatcagataaataacttagttttggcttagtgacttggaacttcagcatgaagtgctgttttggtttgatttggtggaccgagtccaggagctcagtccaaaccaatggcctcctataagtttcatttaacagatatagaattgttttggggagggagagcgtagtcagtagaccctccatcagacagaatgtgtttgcatgtctttagacaagaataatttccctttgctgtccgtgatctacaattacagagttataaaatagctcaagggcaataaaaaaacagagacccacagaatcagaaccacatgacctggaaggctgtgctcaaagcaaggcatgcttttccatcgaagcactgttttgcctatcattatctggtgggaatccataatttgttctgcccctgaaaacaaatatataatttcacagataccctttccaatgtgagcagacgaaatttaaacaagaaagccaaagtggtcactctcttgttctttcctgcctgaaccatcatcagagaaattccacctgaactatgacctcactatctcttactttccaaactgagtggtgctcaagcaacccttgctacacattagaattgcctggagaggtttaaaatattctgatgcctgaaccccccccccagagagcatgtttaattgctctgggttggcttcctgcatcttaatttttcagagctcccctggtgattctaatatgcagccaagggtgagaactattactctgaagggccatgtactacctcccagctacgcctcctctgatgatttttagcaaaggctgcaaaaccaaaggccttagggtgccaggctggtgatgtacatgcatgaagattctgctccttctagtcattcaaattaaagtttatttttctgctgggtaaggaagacaggactatgagcaaatccagtctctggactttcatttggcaactgtcattttgaaggctatctggtgttattttcttctcttatatttgtctcactctttgactctgagggcttctgcagctccccctttccctactggcatttttactcctgctgttttcttaactagaaacaccttttcacctctgtcattctaactctccctgtcccctaatcttttgtgttttaattcctacacgtcctttagattaatatctctcaaactttagcatgcatcagaatcacatggaaggcttgttaatacacctattgctaggtcccacgcccagagtttctgactcagtagatgttggagaaaggccatagcatttacatttctaagatgttctcttgggatgctgatgctgctgatctgggaaagccacactttgagaaccaatgctttaaatcttagcatgtcgtcatttctttcttgaagcacgtctgtgttctctttccagttttttatcacaccagggacctctgatctgtgcacttataattatgttaacacttacatgtttgatggttttgataactgactagtgctccactagagtctagctagactgtaacttcattgaggacaaagattttctgtcttttgtataccatagtatctttagtatatggtattgatgatgggccataagtattgaatagtcgataaactttttcttgttaagcattcatctgaaaatgtatagttttttttagcctttctcccttttctttgaattattattattttttctcaatattgaatgtattatgttgctttttactatccagggatcttctccatgataccttagattggctttaaaaatggcttcctgtcccagttacatattctcatcctcaaagtgtagtttgaagaccagcagcttcagcataactgtaaacaaacgcagttacggatgctcgccacttgcagagcccattaacaagagcgagatttagtagaaagaaaatgactttattaatcaaaagtagtgaagaggaaatggtcaatttctatccaaagtaaccacttcgattttggaggtggaagtcggtggtttaaaaagggaaaacttgaagagaaaggcataccagaatcgggctgaatacaatgtgtcttctggtagctattttggtcccagtccacctggatcttgggctggtgttatctcaacaatgacctagttgttaactagctgccttgaagtaatctctggaattttgcagccaggtctctagacttggctgtctgtctcaagattagcccttgaaacttctaagacgacacataattagatactagtacacagttaaagaaatgcgaaggcagtatgtatggtgagaaaaggagggacatgaagtctatttttaagctaagaataaaggcttctgcagtttgcctcaaggttatatgttgaaacccaacagaaagaggaaaaaaaagttttaaaatgcagtttgaagttaagctgcttggttacataacctggaactcgttagaaatgcagaatctcggccgggcgcagtggctaacgcctgtaatcccaacactttgggaggccgaggcgggtggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgaaatcgcgtcattgcactccagcctgggcgacagagtgagagaccgcctcaaataaaaaaaaaaaaaaaaaaaaaaagaaatgcagaatctcaggccctactccagactcagtggatcagaacctggattttaacaaggtccctagctgattcctctgcattttaaagttcaataaaaactcctctctttgtcagcctaaatgggtcctcaggctgatatctttggattaaaaacaataataggaagaaaagaaaatacaaaaccaaagccacttgagaaagctgcttcctgtttcctcaagcaagtacttctcaactgagtgactattgaatctatcaacacatttgtgttgcactcttgacagctgataactgcttagtgtgccctttctctaagatccgtgtttctgttttaacggggtctttctaagcccagtctgaaagaattaaggaaacagaaatctgaaacattgtgacagattcttggaggaaaaggcctatcaggaggcttcaaatcgtacacatattttattgaaaaaaaatccatttctgcgtggttaagatacaattatatttttacttttcaacttcatcttacttctcagttgctatctttttggtccttctattacatgtttttcctctctccctccgtaaccccaccccttctttatgtcatgttctttgacatttttacagccttattttgtaatatatactatctcttttgggctctcacctgccatacaatgcaggtaaaagaatatgcatgctcattttccacaagagtaactgaggcttataacactcaatttagtgatcttttttctataaataaagagtttaacctccctatgagtcagtgctgagtatgtgtcatgagttaatatatggaatacatgggaaacaggaatacgtgttttaggtgattgtttgcagaaaattacacatcattggtaaacccatctaggcttggtgctttctgttttgtaaggctattaattattgtttcaatttccttaatgtgtacatattcaaattgtccatttcttcttgtgggagttttggcagattgtgtctttcaaggagttggtagattccccttatgttattaaatttctaggcacagagttgttcatagaatttctctattattatttgaatgttcttgggattcgtagtgatgtgctcttttttatatctgatactagcaatttctgttctttgtctttttttttcttagtcagttagaggttaattaattttgtttatcttttcaaagaaccagctcttggttttgttgctttttctctagcaatgatatgttttcaatttcattgatttctgctctaatttttattatttttctcttctatgtactttggaattaattgcctctttttttctagtttcctaggataaaattttagataattgcttttagatttttatttttttaatacatgcattaaatgctgttaacgttcctctatggactgtgttagcttcatcccacaaaatttgataagttgtgttttcattttcatttatgtcaaaatatgtttaagtttctcctgagatttctcctttgacccatgtgttatttggaagtgtgttatatgatatccatgtatgttggtattttccagctatttttctgttattgatttcaagtttgattctattgtggtctaaatacacagacagacattgtatgatttctaattttaaaataatgtgttgagatgtgtttgtatggcccaaatatgatctattttagttgaagtcctttgtgagcttgagaagaatgtacattttgctactaacgaataaagtagtccacagatgccgattctatgtagttgactgttggcattgttgagttcaactatgtcctcactaattttctgcctgctaaatatgtccatttctaatagacagctattgagatcttcaactataattgggaatttacctatctctacttgtagttttatcattttttgcctcacatagattgatactctgttattaggtacatacacattatgtattgttatgtctttatggagagctgattcctgtatcatgaaataccctttttgtccttgataactttccttgctctgaagtcttttctgtcttgagattaatatagctacttcttttcttttgattagtgttagtatggtatatctttcttcatggactttttaatctatacgagtctttaaagtgggttttgtgtgtttgtgtgtgtgtgcttgtgtacaacatatagttgaatcttgtttttgatccattctgacaacctctggcttttagttggtacacttagaccattgatgtttaaagtgaatatttatatagttggagtaatagctgccatgcttgccactgttttttatttgttgcccttgttttttattcctatttttatcttctttttttgtcttttgtggctttaatggaacattttatatgattcaattttctttattagtatattgattatattatttttgccttttacttggttttggtcattgccctagaattttcaaaatacattttcaactagtccaagttgattttcaaataacactattactatcaatatttcttcataggtagtgcaagtacctcatagtatcaaaataattctaattccttcttctagtcccttgtatcattgttgtcattcattttacttatacacaagcataaataaacatttgaatacattgttgctattattttgaactgtcatctgttagatcaataaagaataagaaaaataaaagtttttattttaccttcacttttagtccttctccagtgatcttttttcctccatgtagatatgagtttctgacctatatcacctttcttctctctaaaaaaacttttaacattttttacaaggcaggcctactggaaataaattcccttagtttatttttatctgagaaagtcttcatttgcccttcacttttgaagagtaattttacaggttatgaaattctaggttgatggttgatgttttatttttgtttttatctcaacaaattaagtatttaactccatgttcttcttgcttatatggtttctgaggagagattgtctgtaattcttatcattatttctctacaggtacactgtttttcacccatggattctttcataatttactatttatttttaattttctgtagtttgaaaatcgtatgtttagttgtagttttgttgttgttgttgttttgtattgtcattttttctggttggtgtttaagcttcctgaatctgtggttttgtgtctgatattaaattgaggaaattctcaataattatatattgtttcaaatatttcttgtgttcctgtttctctttcttctccttctggtatttgcattatgtgtatatcatatctactgtagttttcctgtgattcctggatattctattttgctcttctcagtctattttttctgtttgcttttccattttggaagtctctattgagatatgcttacgctcaaatattctttcctcagccacttccagtctactagtgagcccatcaaaggtattcttcatatctaatatagtgtttttgatctttagcataaaaattcttaaaattcccatctctctatttatattacccatctgttatatatgctgtttaccttatccattagcaccttcagttaattatagctgttttaaatacgtgcttcaataattccaacatcaatgaaatacctgagtctggttctgatagtcactctgtgtcttcagactgtgttttctgcttttcagtttgtcttataattctttctcctgatagctaggcatgatgtacctgctaagagaaacagctgtaaataggcctttactaatatgttggtaaggtgtgaggggagggaaagaattttataatcctatgattatgtctcagtttttcaggaagcctgtgcctctgcactgtgaacttcatgcatacctctccattatctcctgcccttcctcattaagtagaagatgactagcctgagctacagttgggtatttcccaaggctagagctggcggtagttggggattttccttccccaactaggtgaggtaggttctaataaaaccccggcaagttaggttctgtttagctagtttcttctgagaatagatttaagagtaacagaatgctctagtggtatttccaaatggttcctttcccccactcccagatggagacatgaggggatttttctcacatatattcactgtaagaaccaaacagagctccagaaggtaaaacccacaaaggtaggggctgtgtgggcatatagcaaggcccccctgagtgtctgtctctcagatttatccacactgaccctccagcaattcagtaattacacttcaggttttcctatcccagcattgattccctcagaaggtttagctcatgagtttttgctctggtaagctgtgattctctgtattcacctgttggtccctccatgttaggggcagcagtttgtcccatgaccttacttctttatggatctaaaaagagctgttggtatttcattattcttttttgtttcagtttataacttgttattaggatagaatgaatgctggagaagaaatcagaaaacttaaccattattttttaaattatatatatatatatatgtgtgtgtgtgtgtgtgtgtgtgtgtgtgtgtgtgtgtgtgtatatataattgtcctctcaatgtagaaacattgctttgatctaaggtaaaatgaatgttttgattttagtattccaaagtcatgaattccatccccaatctagttaattgcaaaaggctaatttgttttctttatcccttgataccctgataaaatatgcagcggccacttaaagaagcattgcatggcgatcctccctaccccaggaactctgtaaggtacaaattaggaattattcttcagtttactttcatttctagcctaggatttagtactatagcatgcttcatgatcttagatgaaaatggcggtggtgtcgatgactaatataaaaactaagggatatacttttaaaatcctaattgtgaggttccttttgggttatttttcagatgatcccaaaccaagaatgatgtcagatgattactaactcatgttttcacctaagtgaaatatagccttagcatttagggatcagcaactcctgtttctttctgtttctttctctctttctcccttccttccttccttccttccttccttccttccttcctttttggtggtggcatgttgttgtacagtaagacatattagtcttattatgaccacatgccaataagacatattagttgttactactatcattttgcttaacaaaagttgatttgttgtgaaagtccaagtgttttccaccttagagtcagatacagcattgagggttggttggttgttttcaacttgaaccagttaaaagcagtgttgtagctggtagttaatccagtcaaagcaagtgttctattcatcacatgatggaactattgcacatagccaccatttaaatggtttcagcatggaagaatttggagatacgtgggaactcatctctgatctactttgccctggagtccaattttaacctcagattgctttctcacaaagactttatcctttcacacttaactgggtaagttatttctagactgttgaatttcatggaccaaaaaacctttgaagaaaatgaaaatatatagactaacgtaagattaataatgctttttttttaaccaagtaagacaatttttggaaaaatcaattttatcctcattatttcataaaagggaactgtcacttaatggtcaaattttatcaagatgtccattttgaaccaatcagaagtggcatggggtacagcttcagatgatataaatctggttgtttggagctaccacttttttatcactgctcagataaatgaaagaaaacatgttattaaattaataactgtgcagtatacccacgtttttaaaaagatgtcattgttttattaattcatgttgttatccttaagagcaaagaccatcctatttcctttcttacacattttcttctttttaatttgttcattctcatggagctaccttaagaagaaacagttgttcctgtacattttgaattttttttgcattgtctgtatttgtacaggttgtttttggattacggtatgttaaaatggaaatgaaagatagagaataaagtgaagacaaaggaaaaataaacaggaaagtgtactatgtcatgtttaacatcttttatagctattagctaagaaagatatttgttttacctatttatattttgaatatatttcttccttaggccactatgagactaagtaataattgataatttttgaagatgttaagaattctgaagtcatacattattgctgagaacaaatactgaattgatatgctctcttttcaatatttgctttcccattgcggttgaatattatattaattcttattttaagtctacagtagcatttcttctattttatagggagtttgatttagttagcataataaaaatactcttagctgtgataagatgcacaaagactttacctaagatatactcaaaactataaagacatgtttaatagaagatgccttgaagcaatttctgaactcaaaaatcttaatttattaagcattagtattgggtcctaagttttattttgtccttgagtttaattttatcattgttaaattgaatctaatataaaaataaaaaattaagaaaacccaaactctagaatctgtttcatttgagcaaatcactgctcagataaatgaaagaaaacatgttattaaattaataactgtgcagtatgcccacgtttttaaaaagatgtcattgttttattaattcatgttcttatccttaagagcaaagactatcttgtttcctttcttgtacattttcttctttttaatttattcattcattatttaattgataggtgtttcaattgattcatatattcattgatctaaaaaatctatattgagcatctgtttatacttggtatttaccttgtgttaaggcaataatcatgcataagatgtgattcttagaatcgggtactcaatgtcaagaagacaagcatatgagcaagttcagaaattatgataagaaccatgatcaagtataggagtgaatctgcaacaacattaaaagacctgagttctaacactgcttggaatacagagacttctcaggtcttcactgaatggatagatacaaactaagtaatttgaaagcagagaagaaacatcaaacacaatcatcatttagctttttggtaggttggagattataaatttaaatgttattgaaatcttattgctttgttctcaagggaaaacagtgacaggtccaatatagatgatttctgtaattccttttcaaccttgagaatttatgactctaatatccactttggtgtgaatattgaataaaatataagataatgctttagtttttcaacatagataagaaaacggtatattacagatttactcacagttgacataagggctgggttgatgttcaccaaatactggagtgatttgttaagtagaggtatcaaaatcttattctctaaaagccttaaaatctaagcaaacctccatttattttacataataaaggtgtgaacatgcgtgaatgcatttcaacgtggtgggggtagagtaattttggcatgacagtactcctcacatctcctctcgcttcatccataattccaaatatagaaagtccagataccaatatctgttgaaaagaatgtacagagaggaaaagatctctgtacaactgattgcatgaagactggacatttgaccaaaccatatggagcagatgagaacctgagccagttagccatggagtcagctctgagagttgacaccacatccaccagtagatgtgggcaaactgaagttataagggagcagaatccatgagtaagcagaggaagttctctgtggatagtagaattcaataaatgtgtgcaggtaagcagaggcaagacaccaaacagccctacaataaaagagttggtgaggagctacctgagaccttcatgccttctcagctctacttccataagacacagctgaactctgtttctatgcattacatgctcttcaaggactcatatctatttggtgtgtgtgcttgtgggcatggtctgtgtttatgtctgtgtgtgtgagaaagagacacttacagtcattgaaaccaaaagaactgctattctgaaatgcccggccagttatggttaagattttttctgctatggtcatattcagctatctcctggttttgaaaacagtagcctgttcccttcctttcaaaactttgccatgtgtgctgggtgtcaggaagggagactggtgaccacaggagaatctttcttgccagtgttatttccagtgtctggatacattactatcagaaacaggcatatttgctttgttaaaattaaagtgaaattactgcttaattgaaaagtcagggatatttagcatttcataccctcattaatcataaaaaggccttaccccttctttattgtttggggcaaactttaatttatctacattagcaaaactcagtaaaaggtagcatgttgagctggaataccaggactagatggaaagtccttggtctctgaaaacagtacacctgagttaaaatattacttcttgtcatactttttgtgtgacatttggcatatcacgttccctggtaacagttttctcatttggtaaatgcagttttcaacttcttaaaattatgatgagaaatgtgtcataaaatttttagagcaagttctggaaccaggattgtgattcaaatcccagctcctctacttattagctgtgtgaccctaggcaacatatgcagtgtatgtgatgactttgcactttagctaatgcatctgtaagactgaaatcacagtgctacctatttcataggctgtcacgggaagtaaatatcattaaacatataaagcacttgatacaaagcccagtagcgctggcatatagtacaagctcagaaaagtgtttgcagtacgtgtttacaatcataaagtgctttgtaaaattctatagcactatacacgcgtgatcctgtttaaacaaagtttcttgaggcacaaaatgatatgtttcgagttaatcctcaaagtgcttacaattgataacttgctaatggcttattctgtaatttctatctccttctttaaagaccagataagtagaaatggtggcactgaacaggtatatgaaaaagcttttatcatcatcccgagactttcaggtcaggagaaatgcatgtgtttctagggattttaacttggcaccttccatggacactaaatttactctgaaaagaaaaaaaataaaaagtgtctgttctttcgtgctggcagaggtagtcaggaatggttctctttggtgctctcaagttttcttaagctctttctccttctccaagcaggtaagaaataagataattgatgaggctttctgattccatgcactcgggtatttctaaaataagtatgaaacgtaggaaataaagtgtatgttaaaatatcatttgaaagagagaacaaggcagaaatttccagattctttttttaaatattgtattttattctatgtaaatctattttttttgcagtgctaaaacaggtattttatatgactttgtgattacattgagaatatttcataaaacctccatttgtgtttcatatgtcttctgtcttattagtgagggagattgtgcctaaaatgttagagttggaagatctcaataaattgtgaattttccttctatccccttttccctagaaatttatctgtgtcacattgacagatgagacaatacttgctaatctatttcaatgatcatttatctgcagctaatcattttccttttgtaacttcatgggattccttttactacagttttcctaagaaagcagatttttttttaaatattccctttaaataaacatcaacagtgatatatactgtggggtgtttcccaaatgttccctttaaattttgtcatgctcaatataaacatcagccctgcagcatcaggatcttctaagaggttgttagaaatgtaaatttcaggtcccaccccagacctactgaatcagagtctgtactttaaaaatggcggggcgcagtggctcacgcctgtaatcctagtactttgggaggccaaggcggaaggattgcctgagttcaggagttcgagacaagcctgggcaacagggtgaaaccccgtccctactaaaatacagaagaaattagccgggcgtggcagcgtgaggctgtagtcccagctacttgggaggctgaggcaggataattgcttgaacccaagagacggaggttgcagtgagcagagattgcgccactgcactccagcctgggcgacaggatgagactccatctctacgaaacaaacaaaaaacaggtacctacataattcctatgcacattacaatctcagaaatgctatgttaaaacattagaatcccatgttctccaaactgtcaagatgtatcttgaaacagcagattcacttacaatcaatggcttaaaataatacagatgcattatcttactatactggaggttagaagtctaaaatatgcctcagtggtctaaaatcaacatgtcggtggggttacattcctcctcgaaactcttgagaattattttcttgccttttccagattgtagaggctgctgccatgccttggctcatggctctcgcctatccacaaacctggcagtgcagcatcttcaaatctgtctctctgattctgaccctcttgcttctctctcacttgtaatgacacttgtcatcactagatcatccagaatactctcacatgtcaaagtagggtgattagcaaccttaatttcatttgcaaccttatttcccctttgtcatgtaaggtaacacacttatagattctgaggagtaaggagtgggcatcattagggtgccattattctgcctaccacaaataggatctgtgacttaacaaatgtaggtaatgttgattagacctaattaagattgtgttttttttgcagtgcttctcaaaatgtttaatatattaaagctgtattatgaaacatctgcagtgatatataccgtgggatgttccccaaatgtgttagattgcagtacccttttattaagatctcccagaagagaggaactcatttgaaaaatgtggaccagaggaatttacatttatcctttccattctatccaaggattaaccaacagtggagccctcggcttcgagatttaggactaagtttttatcactgggcctaatagtaagtaactttaatttaggcagatgagattactcttctatttcagttctgcttggtttattgggaaacctattttcacatcttgagtctactgcttgctagtgacatgacctcgattttaatctctctaacattagtttcgaagttctgagttgtagggaatggtgaagaccatgggtctagagtcagacagtctaggttagaatgctggcactggacacttcccagctgtgtgactcagagagaaaggtatttaacctcctcgtgcttgggttttctcatccttaaaatgaaggcaagagtagtttcaaccttgtaaacatttttgtgagtttaagttagataatgcgtataaagtagctgatgcaaagcctggcatgctaaatgctcattaaaggttttgattgaggttgctgttattattattattattattaaaaataactgcaagtaccaaagttccgttcagacacacaaatagtataaaaagataagacctctcatgggaatgttgatttaatggatatgaaagactgcttttgaaatagacactaaacaattgaaagaattataagttaagattttccgttcaatgtaaaccaaggagaaagatttggagggggttttgattggataaagaagagttgaatttaaagactttggaggcattatacagcacaaaaatactttcatcaagaatatcatttcagaggaatcactacacaattatttcctacttgagccaaatcattgaaaaattctttgaagttctacacatggactttacgggcagttaaaaaattcacaaagaagaattattgacatacataaaacacttaagcaggcatttaaaaagaaaataaatggggtttctggcccgacattttattttaaaattctaataaatccaatttcatttgaaagctgattcaaacaacatatatgtcaaaccaattcagaagattaggtgttttaattaaaagtgctgtctataactttgcaaagtgacagttcaaatataactggaacagcagtgtcaatatctttactgagagaggaaaacatcatcaagaatcttaatttgtctcaattgcagcctaataactcaattaaattgtgatagaaaaataaggtttgaaggaaattgagagaaacacactaatttttcagatttaattagctaagtagaaatcacaatactcataatcacagatacatgtgtagttacaaatgctgattaccaaagtaccagagtgtttggcttcaggagttaggggtgtgtggggtgtgcatgctcactcgtgtgtgtgtgtgtgtgtgtgtgtgtgtatatacatgagctctcttggatctgcacactagtacagacaatcaatactaacaatcaagataaatagatcaattcaaaatgtcaacagaatatcacataatgaataggatgaaatatgtcatctgctatgaatggagagatctattaatagtttgggaaatttagatgggatgaattataaatttatcttgcctctttatcgcaatgtagatttaatcaacattcagtagagcactgggtaagaaacctaaggctaaattttcattctctgattcgggtttactccaagccatgactattgttatattttgtttatcatgagggagttaaatatttttattttattattaaaactagttttgaaattaggcttaatttatctactgcttggtcttgggcaaatcatttttcactttcctatgttcatttatataacaaaactattgtttacttaggggcatactatgaactaaagtcattttatatcacctcccccctctatattacaaaagtattttcaataataatcatgaaatgaaacattttggagttctctgagttcacttccctataaaatataatgcttattaaaggatacccaataaaaatgatgctaatttgaagcttatgcatatattactaaaacttaatagttactgcagcagttatttagaacttatattagaaatgagcaaactttgaccagcaggttacatttgtccagctgcttatcattgtaaattttatttttttgaaatgaccatttgcttctgtgttgtcaagggcagttggcagatttgggctacaacagagttcagtagctgtgaaagagcccatagactgcaaagtctcaaatattcactacctaccactttacagaaaaagtttgctgactcctaacttagaccaacaaaagatttttagaagaatagtattttttccctgatgttgtttagaattattattatatgattaagataaaaggcagatggcttttagttatttctttttaaaaccccctacagacagtgcaccgtttattgcctgatcattctaaccacctccatcccagtgtgtctccaatcaaacctgtgttgttatcgtgtgttttattgaatgaagatcatacatgacaatcaaatagggcctaatacgtagtaaacctcccaaattagtgtgccttctcttttgagagcgcaaaatgataaattataaggggtggttgtccaaaaagtacaggtaacagaggaactccagactggggataaaatgttgcatgttacagtgtatgtagactctcaacatccatagaaactcttctattccttgagggccaggccagaatgtgtgcgttctaggatgcctctacctaccaaatagttttttgccctcttggtggcactgtgatgccaattgtctattggtaagtaacctctaaccttgatctgagaggaaaagaaggttcttggttctttatgcctttccactgttctacttatcatatttatttatgatttttttccttctaatttatctcttaatttctgaagcccaacgtgattttaatgtgagtggatagagtttttggagcttaagttcatggggcatcattagcagataatgtgggttgagtccacacaccacatatgaatatagcaaatcactttaaatctggatgattgtgtgcattcctttgatttctttaactcacagcattgtcaaataggtagcaacccagctatgatcctagtctctaattaagatatttgaatgagaagaaacctgtactttcccctcatgggaaggaaatttgccagagctagcttaatgctcaaaactcataatcataaaggtgattgcttagtgtaacctaaattaaaacccatattcattgttacaagattacatgtttttcttaatattttgcattaaacatttaacatacagttttgaggaattacatttcaaaatgtaatttggtatttgtcgggccagttggtaaacctgagcttcatgtaatttctgacttgttatactctggagagaaattatatgatatccacaaatattcacctctcacattcttttcttgtgggtattgctctgatgctaatgtgaaatgctgtttatcaggagcaaatgatttgcggattcagctacttcaaaagctttggttttatttttatgcatagaacatagccttctcattaatttttatttcatttactaaatttcaataaccctttgaatatgtaatgacagaggtgaaaataatgtcttatcctcccttattctttctttctgaatttttttgtgaccccaaacataaggccttaaaaactggtcatgttttattcaatcacttgtgtctctttctagaatttaaggatctctgcatgcatgtctcttcctctcttctttcaagactgttgcaaatggttgatcaaatttatattgaggtcattaaaggtatgattttatttattcctcttttgagtacactctgttttggagaatgaaaaatctttcatgtctattatcaaaacacaatatcattgaatatgccacaaaagacaaatatatttgcaaatcctgtggcaaaaataatgttacattggcttaaaatgaacagttagcatcatcttagataggactttggctttatcaggcacagtttggggtaaattacttgggcgatggctggagctgaatctgtttcctgattcctggacagaaaaattgctccccttccacccccaaaaactggcatggttgatcccatagatagagataaagaaagctattttcagaataattctgccagtaagctcacatctattttgcaaataagtatactaacgtcatctggagatatttactgcagaaaaatctttcaaactctcaggtgtgatctaagaacctaagtattgaattcttaagcttggtagccccttttgtgacttgacttctgttggaattctctaaagaaaacagaaagaggatgagcaagacttcaagagaaggccagtaaattggaagctggagaaatctgcttcaaatgtcttgttttatctcatacgcttagaaaactcaatgaactctttgccctctattgttaacaactcagtcgatcttctgggacttgggaagcatttacccaaagtcatctgctttgatcccagaggtgaagaatgtgatgttaactagcatctttgtttacctgttgtacttaagaagcatagctgataaaagtcttaaatatttcactcctgagtaagaaggggaataattttctctggactttctgaaaaatgatgagagtgacacatttttttaagccactaaaagctggatttatttgtttccacttatttgcgttgggacatacataccgataaatagcaaggtttccttaacaatgataaatctcaaatttaaaaaaaaattgctctaattgataggtgtactctttcaagtcttaagagaggtaatagtttgctgcgggactaatgtatcttagcagagacactaaaggtaagaggaaaaagagctgcagataaagatgctgaaaaatagcacaattcttaaagctcaatttatcatttagcatgcagaggtccctaattcaatgaagactaatcaggttttataactctaattttgatatctaatgtggcaagctgttatccaaattgatattataatcatatgacagtaatgttttctttatatttatttacaaagttaaattctgtgtatttaaacattacatttaccatacgtaacaagactagagatctgaatatatgttatgcccattcctactgacaggatgaagactcaatccttctcctttaaggatatacaaaggaagatgtatttgtttcactggatgagttggggtaaaatatctggcactaattcaccacatgaaaagatgctattacaaaggagttaaattttttttttaccatttagatgactttgatagcctagaataccacactggagttacaagctttccgtttattctgttttattgactcattgataggaatgtgatgcaggaaagagcgaggggtaggaagtgaaggaaatcatatcagaatttataagaactggtaggaacctagctctagatgagggtcatgtttctcaatttttgccctggtcctgcgtttggctctgtagcattggacaaatctgtgttccaagctccagtcttctcatccgtaaagtggacccatacccccacttctgtctatctctggcattacgtggcagtgttcaaataagaatggaggcattaaaaatgctttggaaccaataaaagcagttattattggggagagatgtgactttagtgaaagaagcaatgaagaatgacacaagtacttattaaattattaatggaaagtagtagtatatagatgatttttaaaactactgtggtatagtactgtaagaaatgtacacaccagttactagataattcacaaaggtctgataatatcccgagaaccactgtcttagaagtgtaatgaaatagcgtatatatatgcctgctctaaaatcccactgatttgaagttttctggatggatcccacatggacatgttatcctatcatcctctaattttcatgacttaaaatgaatgataaaaatgcctgcttttttccccatatacatgcaggtaagactgaagaaatgagaaccgtcacttgtaaatacctgccatgttttaacctcatgaattgacctcctttttattgtccaaggatgcacagtgggacatttttacagagaatctgcttggagaccagtgacaattgattctgactgccaagcctgttcaaatcacagggaaaaccagtgactgtaaaattcaaccaatttttagttcttgttcagggaaaggaacagcttgctttgcaaagacttcttgaattagagcacaaacttgagtaaccagctcatgacctgccaagataccagctgttgaaaagaacgtgatgtttcttattgggattttgtttgtcatctaagcttaggtcatttgcagaggtcattgtagtcttgaaagggaattaaaaagaaaagtaaactggttcaaccattgtggaaaacagtgtggtgattcctcaggaatctagaactagaaataccatttgacccagccatcccattactgggtatatacccaaaggattataaatcatgctgctataaagacacatgcacatatatgtttattgcggcactattcacaacaacaaagacttggaaccaacccaaatgtccatcaatgatagactggattaagaaaatgtggcacatatacaccatggaatactatgcagccatcaaaaagaatgagttcatgtcctttgtagggacatggatgaaactggaaaccatcattctcagcaaactatcacagggacaaaaaaacaaacaccacatgttctcacttataggtgggaattgaacaatgagaacacatggacacaggaaggggaacatcacacaccatggcctgttgtggggtggggggaggggagagggatagcattaggagaaatacctaatgtaaatgatgagttaatgggtgcagcacaccaacatggcacatgtatacatatgtaccaaacctgcacgttgtgcacatgtaccctagaacttaaagtataataaaaaataaaataaaaataaaaataaaaaaagaaaagttatcttattagtattttatgttaatttctatatccccctcacagcaactaaaagaatgcctgaaatatgaaagttgcttaataaatattttttaaatgaatacatgaatctaaaaatggcaaagaaagtaactcacaaagtatcaacacaaagtaaaggagtatgacatcagaaatcaatcaaacttaatggcagcctcagctctgatgcagagttgctcaatcatttcccctttctggaacaatttcaccatctgcaaaatggaagcgttgttctaagtattcttttagttcctagattttaaggttaagtcagctagcatgcatatagctttgtccaagattgctttaaacctcaacatgtcccaaagtataatgcaaatgtttctcaggcaaaatagtgcctgagataaaatgataaaattcctgaatacattttatagagacttgctgttcaacatttcttggctgaaagatatgatggattcacacctcattagcatgtgcagatagcacttgcattctgctcagaatgagaggtgtggtcctcactggcaggggacagagaattttttatctaagcattcagtttcctgtggtttgtcttaggaagtcttgtgtacttccaccccaaccccagcagcataacctctgctatttattacactttactgcaaccatgcttatctctccatgttccccaaaatgctctctacattctggctgctgaaaacttctgggggtgttcatctgtccttgcttcctaccttctttctttcctctctctcccttggcaatctagaaaggggtatggatgtgtcaaagatcacgcagagagctagaggctaagaaagatcaagaaccctgtatcttaactctcagtacctctatcaccaaaatctttgtccacccctccccacccccaggtgctgttccagtttctttgtggccatttacactgttccactctgtctccctctctcacctaacaatcttgtccacaaatccatgcaggtgccagccacaccctcttcccagcatcctcactgcagcagtgattccttgggactctttagctttgtaattttcttgacttttttttttttaatattcaggaattttctcgtccttctatactgagcttggaatgttttgaggcaaagatcatttaggacaatgtacagttgcaaataagagaaaactgactgccgcgagctgacacgaaaaggtgtttcattttctcccatatcagaaagtaggtgggtgctaacagtatttattctgctcagtgatgcatgacatcagggactctggttctctctctttttctggtttaccacttttaaggagtaggtcatccttttgctgtggcctagtggtgccaagaggacagtaatagtgcagacatcacagtacagacagggttagaggaaaagtcatgccagctctctctctctctctctctctctctctctctctctctctctctctctctctctctctctctctcaatccctccgtctgtctatttttaccaagggagtaaaacttttcccagaactgacttcaggggatttctgcctgttttgtgtgtcacgtgattatttgtacttgaaaagaggctgggagattgggaaacacacttgaccccttttgactgtgatcagtggtgagtggttgtatgggactggatacctcaccaccctaaaaccagaaatctatcagcaaagatgggagagggaatggaggtgatatggtttggctgtgttcccacccaaatctcctcttgaattgtagctcccataattcccacatgttgtgggaggggcccagtgggagataactgaatcatgggggcagttcccccatactgttctcatggtggtgaataagtctcaggagatctgatggtttttaaagggaaacccatttcgcttggttctcattttcactcttgtgtgctgccatgtaatatgtgctttctgccttctgccatgatcgtgaggcctccacagccatgtggaactgtgagttcattaaagctctttttctttataaattacccaaccttgggtatgtttttgtcagcagcatgaaaacacactaatacaggagggttggacagtcttattcacaatgaccttgaccttttaaagttgacccctctgttgcctccattaagtatccttcctttcacagacatttaacatctcatttgaaattgaatttcttttataaaacctttgatgattcctctaacaagacgtgttgtatgtacctttatctccttttataatatgtatcctcttctcctcttaatctgtggagtatgtgaggacagataactatcttgtcatttagcttaaagtattgaaagatgaaaacctcagtactactctgccattcaagttgtgatttggggtgagttatttaacttcagaatgcctctgtttttctcctgactcatgaggtgctgtaatcattgaatgtgttaatagataagcagtacttagaatagcatcaacatgtagacagaactcatgagacccagtccttcaactatgatgaatattatctctgtgaaactctttggatctcagtttctccatgtgtaatggagaattggatgtgggtattctaaggcttcttctactgcttacatatattatttcttttttttttaaaaaaaaaaacaaaccattgaggctggacgcggtggctcacgcctgtaatcccagcacttttgggaggctgaggtgggcagatcacctgaggtcaggagttctagaccagcctggccaacatagtgaaaccccccatctctactaaaaatacaaaaattagccgggcgtggtggtgtgtgcctgtaatcccagttgctcggggggccaaggcaggagaattgcttgaacccaggaggcggaggttgcagtgagatgagattgcaccatcgcactgcagcctgggggacaagagcgagacttggtctcaaaaaaaaaaaaaaaaattgagcttttcttataatagtctcaataaatatttgctaaataaaattggcatatctaaataatagaatcatcaatagagctgcattgtgtatcagctctctcgggattgagtttcaggctttaaactgttttctgttgtttctgcttattagattaaaaataattcataatcatttgggagataaaagtattttattggaaagcatctgtggtgtgattcctgagattcttcttgttgctaaagattgctagctaccatgcgcagacagaaaactgaccagttttcagctctaaatcaagaagcagattgatttctgggactctgaaattcttttcgttacttcagtggcttgtatgtatctctcttgtatgtatcactctctcaagcctttgacagcggacattctcagtgaaagctgaggtgctatgaatggagttgtcctatctgtcatggctcttcagttgccacatttacgatgagactttccagttctccctacttgttcgctccccacagaagtgtgaattaatttggcaattgcaataccaacgggcagcatcaaactctgattagattttccgtgtgtcagagggagaatgtagtgtgctgaattatcaccattactgagaaataaactaactgatattcaaataccaggtatgtgtgtgtctgtgggccatgaaaaattccattttttgctggtaggtacatgggaccatcattattgtctcacagtgacacacttggtatggcttgaatgtttatgttgaagtcatctacttacaatataagtgaaattttaaacctgccacattcttttatggatctgagacaaataagggatggattgtctttccagcaggtacaattcaagccttccaagaactgatgatcaaaacagtatgtttatttctctttctctgttttccagttttctttcatttttacattttagctttatgaacaggtttatccccattaccacgttaatagccaatctctctcttctgttgaggtgtttaattttgctcacctgcgggcaattccccgtaagaggggatgagcgtctcaattctgcagtcatgaaactccacacatccgttcccctagtgtacaccgggtgagccctcaatccatgtttgcagactgcccctccactagacatgttgccaaatggagtttgctccaatttgcttaatcactcagctgtaattgaatcctgatgagaagctgggtttccatccaaaattataccccttctgttgctgagaagatggtaaagtagccatttcttctccccaggagtcccaggacagtttgcagatggtttcatccctctatcctccataatgctttccagacttggaggaatcatggcattgagactgtcatcgccattgcccagggatatgtctgttgctggctctctgtaccattgtgagctttataacaaagcacaataatttaccctttccttccttttctctatgccaccttcctaagagctccctaaaaaaaaaaaagaaaaatgtttggctagaatatcattgaacaaattctacttctacctgagtaggctacaaccaatatggagacacccaggtgaatatgcctcaaaatctgaccacctgcagcagtttcacctagagcagcgtgggccctaagctagcagcatcagcatcacctgggaacctgttccaattacaaattcacaggctttacacaaactgactaagaatctctagaagtgaggatcagaaatgtgcttcacaagctcttctgtaagtgaattcagatcttttctgtttgaaagtttgtgtgtttattgctgagtttaagagttatttatatatactggatacattcttttatcaaacatatacttttaaccaagtgtctggcttgtgctttcgttttctcaatgctgtctttcacagaacaaaaggtttgaattttcataaaatccaatttatcacgtttttctttatagattgtactttggatattatattcaaaaactcattgccaaacccaaggtcatattgattttccctttgttttattctaaaagttttctagctttatattttacacttgggtgtattatccatttagagttaatttctatataaggcaagatttattatttctgcataagaaaatccaattattttggcatcatttgttgaaaagactattctttttcctttgagttcctttgcatgttagccaacaatcagttgactgtatttgtgttggtatacttctgagcctctattttcttcccttgattcaacagtctatactttttaccagcattacactgcttaattcctgtagcttgaaagtaagtcttaaacttaagtggtgtgaatatctaattttcttacttttcagaattgttttgactatttcctttacctttccatataaatgttaagttagatgttgaggtctacaaaaataaaataaaataaaatgtttactgagagtttgctctagatagcattgaatctatagatagatttgggaagaatttacttacacgtttaaaaatgtattttagccatgttttatagttttcagcacacagaccttgtacatattttgttgcctaagcaggactggtttttcggtgatactattaaatggcgttgtgtttcaatgtaaaattcagtagttccttcctatgatcgactattgtttattgagttcatatcctgcaaccttgtttaaggcacttattctaggagattttttgatagcttttttttgggggggggatttctctgtcatatgtaaatagaactgattttactttttcctttgaaacatgtatatagtttgtttcttttcccctcctcattttggcaagggtttatagtacagtattgaacaggatagggcaaccttgccttgtggtctcttactattaaatgtgatgctagctgtaggctttttatagatgcctattattaggctaaggaaattctcttctaattctagtttacagagtttagtattgttatcataaatatatatatatagagagagagaattttgttaagtactttctctgcatgtattaaggtgctcatggtttttcttttttagtctgacaatatgtaaataataatgattgatttttcaaataataaattagccttttgttctttgaataaaacccactcaatcctaatgtattatctttttaaaaattgttgctggatttgttttgttaacatatttttaagaatatttgcaaatatgttccaagtaatattgtctatattttatttttgtttggtaatatcttttcctggtttaggtattaggtaatacctcataaaatgagttatgttctctcttctcccattttctggaagagattgtgtagatcatgttttatgtattcattcactgatagaattcatcagttaaaccatctgagcctgaatctttattttctgaaagatttttaaacgaccaatttggcatttttaatttacataagactattcagattactatgcattcagttttggtactttgtatctttcaagaaattctttcatatcatttacatagctgaacttattaatgtagagttatcactaatatcctcatattatattttgatatccatgagatcatcagggttacccttctttcattcctaaatagggtcatttgttagttctccctttttgtctcagtctacatttcatatatatcaattttatttatattttcaaaaacagcttttttaaaaaaaaaaaaagctgggatcttgctatgttgccccgactggtctccaactcgtgggcttaagtgactctccctcctcagtctcttgagtaatggatctgtaggttttcacaatcatgctctgctaaacatgcagcttttgatttcattgtttttctctattatatttgttttcaaactcattgatttttgctttaccttttattatgtgctttctgcttttttttggtatttactcagtaattttctcttaaagtgaatgtttacgttgctgattttagatgtttcttctttttgaatataaacatataatgctatgtttccatctaaacactgctttatctgtaacttacaaatattgatatattgtactttcatttatatttagctcaaaatattttaaaatttaccttgacacttctctttgatgcatgggttatttggtagtgtgttgtttaatttccaagtgtttggagatatttttatctttctgtcattgatttctactttgattctgttatactgagaaaatactttatattatttctatgctttaaaaatgttatttgtatggctcaaaatatggtctatcttaataaatattgcatttgtgcttgaaaagaataaatgcatttctgttgtgtgggttgtcaattaggtcaagatgattgatagttttgttgggtgtttatattttaaagaaggaccacaggtgatttcatgcatgctgaaagttgagagccacttagagtgagctaacactaattgggattccagtgtaatgaaggcttaattttgtatttgattttatatttgtctatgtttgtggaagtctagaagcttccacccagttgtccatgttctaggtgtgagcttgttgattacaaatatctcctaaacacattacacattagagtaaggttttttacctgtctctgcccctgggtcttgtgccccttggacggccattaggacttttctacaaatatttcctctacccttttcatcgatgctggcttttaagtgtgtttcataaaatgctagatccaggagcagctgctaagcaagaagcagggaagtaagatgtatacgcattgcttagtaaactgatgcatgtttctccatcttgaaattcataatgccaattaatattatactggctctgacaagtttggagttaacatatctctattccttcctttccctaacataaaatgagcaatacgaaatactttataagatttttgagaagactaaatgaggtaacatctgtaaaacacttaatgatggcttaggcacatagtatgttgtcaataagtgtttgttgctatgatttagtatagttgatgttcttggttttagttttattccacttattccactggaattgatctttaaaaatagagatgggtataaagggaaaaaattctgggaatgcaaacgccacaaaagtaacagagatacacagagctttacctgttcaagtttctttattgtggtttactttttgtagtgttattaaggggtattgcattcattttaaaaaccttcttcaacccagccactttttcttcctacctaaacctgcctcctctgaagtaatatcattggtattgctgggaataattagatatttgtacgtgtactataaagaggatgtcgtgtaataccatggaaagtgcattaggtatgaacaacatctcaggactcagcatggtgtcttatgctgtcctcgcttagcaacagcatcaaggaagtattgcatatccgggattcagaatctcctcctcatctaccttccttggctcctttgacatctctgtggaaacattattgacactatgttttcttctcttaaacaggtggactctgcattgcccagtccgtgagaatcccccaggaacgcaaagacaggaccattgactttgatagaattatcaaacagctcctggacacccccaactccagggccgtcgtgatttttgccaacgatgaggatataaagtaagaataactggtgacaattgttaatatgcatgttgcaattttaggagagagaaagattaggctgctggctgagacaggaaaagatagcataagatcaaagctgtaatcatacagcggcgaagtctgtgcttgcctctacccaacacatacagtggtagcatgttatggtcacgtgttttccctctgttagcaaaataaatgtattcaattatttgtaaaaacagaaaaaaaactctagatcttttaaaggtgcttttatttaaaaatttttccaaatatattaataacagatttttatccaaagaatggttctcttaatgtaaaagaaaaatgtcttaaaattctggttttattgctagtgctttaacttcaatatgttcaaatcaaaaacttgtcttaactctacattctccaatccactttcttttttcttttcagaacttgatctttcttggactcaaaaatctgcttgtaatcttgactttgcttttttcctggttccttgtattgttggccaagccacatagaaacaagctttgacatgtttccacaatgtaaatgtctgttgctttcttttctgatcactaccaacctggtccggagtccttatttttagaatttttagaatatttatttttgtaatctttatttttagaataaacagtaaataaacctgattacaaaatttaaagtaaacatacaatctccatcttgtcgcatagctaacaagttctctccaggtacaataactaattaaaagtttcttgtatatccttgtggagatattctgtatatatgctagagggatgtgctgcttgtttttacacaaatggtagcatgttgtgtgcattcctgttcagcattttatttatcattttatcatggagatcactgaatattagtacctatacttctactcagtattcaatagccaggcagaattttattttacataggtactgtaatttatctaactgctcccttattaattgacatgtaatttggattacagtctattgaagttataaataatgctgtaattaacttccttttgcacaaatctgtgtgtataaatataaatagacaagtgttaatctacaatgtgttatgcaatgtataaatttataatgtgataaaaacataacatgcaaatatactttttatatatattataaatatttataaaataaattcctattaaaaaatttctaagacaaaaatatgtcccttcttaaaaatatataaatattgtctcccagagaagtcatgccaatttacacttccattgatgtgaaagagctgtttatgtgtgttttaaatctttgtctatcttatagttcaaaataatatatcattgactttgaaggtgaatcttttattcagggtaaaggtttaatggcctgggcccttaagttcctgcttggatttttcaatgtctttaccaccagcgtctcaaacctgtctctttccctgctttgtgtatcctagacactgctcctgaatccatccatctcctagtataaagctctgaccacaggtgtggtggcagggctattaaatggaaagagttttgaatttttaaatgaggattacttgcttcttagataatgagcactgtctgaccttgggcaagttcctcccactgccttccaggttctttgggcctcaagtctcctaccaatcaaatgaacatccttcggagttctttttcgggagatctggctgtttcacctttctagtcttattctattccaaattccctcatgatttgctactgtaggcacactgccgtggtatgatctccctcccaattctgcatgcattctttccccctccctggcccatgtttccttccctgcttcatcacctcaatgctatctctagtgctgtcctctcagggaagatttctctgatcaatgtcactttggaaaattcttcatactcactcagtttcattgtttatgtgaatggtgccatttttattgttggattgtttaattaatgtctgtattcttcactagttcgtaaaattagggcagaaatgatgcttctttcgacttgcttttgtactgtcaataactattatagggctcaggacatagtagctcaataaatggcgttgaacaagtgaatgaaattcctaacctaatgcttcatatttaataatttaacaataagcttcttttttttctgaacttcctggtgattcaatatatggtctcatttttacggtttaggcctcatctacattcatccagttctccatccaaaatgcataactcttatcctccgatttgttctgattacttctccatcatggtctttgctcacgatgtttttttctctcgttatctatctgtctaacttacgtctcttcttcaaggtctgtttcaagcattcccttctccagttccggagaactgatcctgattctgatcatcccttaaatatattatttctctccttacaaaattatcttacaacattattttcctcacttcgtattttaggtttctatgagattttgttttcataatattactctttctgttccagtactttaaaaaatatctgctaatacccttcttattcatcttataagtccttttaacacccattttacacttttgctaaatatgtaataccttggtaaaatatggtctcatgtttgtttttaaatagattgcacaaggcacataaaagatgtatggcaattagttctggtaactaattggttataatactgttgacttgcaagtaatgtgagtttttcatatttggatgtaaactgtattcaataatgatattcaataattatacccattctttttgcattggacttgtttgtgtgttaaacattattgtatattgtcattcataatagtgatgacaataattattcttgagcacagtactaaaagccaacagcatataaaaatttattctaaaacatgatcttaaacagtgtgtgaagtgtactgataacccataatgttacgttatttctttcttcggaagatttacattgtagatgggaaaatttgaggtttcttggaacgttaacttcagatactttgtcaaaggctagcagtgagaagacattaatatctagattttaaagctaagataagtgctaaatcagtcatgggtatagatgatttggattttagacaagcgtggattctttttctaaaataatttattctgattataaaaggaacacatgctcattgtaaatccactggaaaataaaagtttttttattgttttttttcaataaaaggaacccttacattttactttgcctccagtttgctagaaaaattaaaggttaaggagaataatcacaaacaataattttaaataatcttctataaaacctgcaattccagcactcagagataactgctaatacaattctggtttaatttttgcaataagtttttttatacatacacaaattttcctcaacagaataaagatcacatagaattttgtcatcttttacaattcatattatagattaatcatttcatatcacaagtacttttaaatgctttaattatattcttataacctccaaattttacataaatatactaaactgaacatacttttgtgtttgtatcagtttttactttcttttcctgttttacttggcttatccctacctttctcttcaaacttcgtcagcacctccccaaacatgttaataaaaattgtatgtcgttttatatttttggtgccttgatatgattctatgcttttaactatgcatatatacacatatacaggcaatttttggtcagcttttattttgtgaaaattaaataatcttttatcatgtatttaattttaattttcttttttaatgtgtagtatctagtttgataccttgtggaaatcaaactaagtatatttgtaattgctctagaattcatcctttggatgtattgtctttttttttaaaccagtttcccattgctctgtacttaggttaactccagtaatgaacagacattttgatagcatctttgatcatttttggatacattatcaaagtggtatctctaggccagaagtattaacatttgattgttctattttttttttttttttttttttttgttgagacagagtctcgctctgttgcccaggctggagtgcagtggcgcgatctcagctcactgaaagctccacctcccgggttcatgccattctcctgcctcagcctcctgagtagctgggactacaggtgcccgccaccatggccagctaattttttgtatttttagtagagacgggctttcaccatgttagccaggatggtcttgatctcctgaccttgtgatccacctgccttggcctccccaagtactgggattacaggcgtgagccaccgtgcccagctgattattctatttttatgaaaataataaatacataaaaaaactaaaatatgactaaagtacttttgatgcaaaacattagtctcctgttccatctcaccatgcttcctggttctgttctcttttggcagttactttaactctttaaactgtttcttctggttttatctgcataatgtgtacgtgttacaatttttaaattattaattttaaatattatctaattcttatgttaaacagaacttattcctatctctatagtcataatctatcaggttttaatttgacaaaaatcagtatttacattattgtgattatataaatatgatgcactacagcatcaagtattttttctatggtagttatttttttggaaaacattttgttgttttttggagttaatatgacagtcttcatactttcattgttatctttaatattttttctgttgttgttataggcctttcacttttctccatatgttcatatataagattatctgagttgccttatttttcccgaatatttcttcctgaaatttccattattctgttttaatctggatcagttattatcatttgaagagtttcttcctctcactctctctttgttttaccacttccttttttctggaccctaactgaattttattcttgaattatttcctcattttgctggagcatatcctgtagcttctttttttttttaagagtaaattaagggaaaactttttcatgtgttttacatctaaaaaatgttctcattctgcctctacccttaattagtagttagggtggtaatgtgcggcctcatatttatttttattaatcaatgcatcatacgtggtaaagaagtgatttacaacaaatagctgttgtgactaatgagttgcagaactcttaacttatagggaacttagggttctaattgcggagggaaaaatctaatagagctactgaacaaatatgcaagttctatttgtattgagattctttgtgtgttaaatgttaaaattttaaagtctttttgtcagaatattgaagccattgctccatcatccatcatccatcctttttttttttttttgcctcttgagaggttaataatatcatttcttttttttttttgcatgtcttctcattttctcttgaagagcttttagaacattctcattatttacagaggtcttatatttcgtgatgtgcttgattttcctcccattatgcggctaagtttttaaacttgaaaatttgtattttcaattttttgattctttatttattaaaaataatatttaaagatttactctattttctctgtacgttcttttttctctaaatgttagctggatataggtcttcttgggttgattattggtaagaggaagaagaatcttatttcttattttccaactttttgttgttttgctttctagagaattttctgcactttatatctatgccaatttaattttcatttcatattttcaaaaagagctgtttcttgttattttttcgtatcatgttcttgattaaagatatgatcattctcatttaaatgtgtttattattttgttttttttcccatatattatctctgctccacctcacacatttccttttccttgttaatatttctatttggcaatggagattttcctcaataatgagtgtcttctggcaattcacatatgaataaggcagtaaaaagctctgtgcccacgggcagtgcatgacaactgatggggttcccagggaatcagattggccattccatcagaggacttctttataacaatatctagagtctactttctgatatgtatcagatttttacagaaaaattattttctacctggggtgacaaacccctagttcccagcattttgtgagcagaagtttaaaattcctagagtgtcttaacatttcaatttctattatactgacttttagtcattccctcccatccccatctgcagttttaacacctcttatctaccttttactattttggtgtttttttgttaccatctcttatccaccttttactattttggtgtttacaatatcagaacctatttcctatgctgctgcttttttttttttctttttttttttttttaattatactttaagttttaggatacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatttttttctttagaaaactgtcatttcctgcctggaagaaaaaaaagtagaactggcctttgtcagcttattcacaatctttgacccaatcttcctgcatttagccatgtagctctgtggtgcctgatactcccaagtcccaagagacaaacaaaccacttatcctgtggtcttacccaccaaaggggcttcagttgtagctttttctgatctaccaatgcagttacatctcatcaatcccctcttccaaaagtactattgcaataactttttcattaatagctagttcccttttttcttttatttgctcccattgtcctgattatgtatatataatactttcaatcatacacaagttataaatttttcatgtttcacatggagttctgtttattttaataaataattaacatctttaattcataatcatattgcttttcagagatagtgtataccatcagcagtaaatgagagtgctcatttctccagccccaagccaaaactcttaaaacaaaacaaacattttggccaatatgtgaaatgaatttggtatctttgtctaatttgcacttccatcctttctaacatatgtaaatatgtgtctttaccttattggacatttgtatttatctttttatcttttaacaattactattacttgctcttgtttctgaagatgctttttcattattggtttacaaaatatctttatatattagggatataaattctttatcaagttttttgcaattatttactttttgaggaagaatagtacctttccttttgctgacttgcaatctacacggattcagctgacgttctttatcattaatataactttccatatttctttccacaggcagatccttgcagcagccaaaagagctgaccaagttggccattttctttgggtgggatcagacagctggggatccaaaataaacccactgcaccagcatgaagatatcgcagaaggggccatcaccattcagcccaagcgagccacggtggaaggtatgggtttcatcagcagtaggtttgctgagagaagttctggtgccatgctgaatggccaagcatgtgactttttaggggtttggcatttttaccaaactcatgtggggttgtttcaaacttatagccatgaaatgcaaatgaggccacacacctggtctgttcttttagttgaaattcctcttttgaggagatcatattattttcataatatcacgattagcaaaaacattctttctttttcattcatgccataggaactttctgagaggagagcattatcattaataagtaaagtatacacatccaagtgtgtataagtgagctacgttttccaagagaatcctttcactttgtaacgcatccattatttccttattagaagaagtacaagaaccctttccccccttatctctcaaggtcccttccagctcagggaggctgtaatacagcacaccacctctctcaggcaccagcatcccctcaccttcctaggtcccttttgttttcactctctccttttcttgcctttctaaacttatgcctctttctttgccttccttgctactgcaaagatattttgagaggcagaagtaggaaagagtgtctgttgccaccctgtaatctgacaaaatttgccgattataagttatgttattctttaatttggaaagaaaagttgtttctaaaagaagacgctgtgtaaaaggagcttctctgctgatagcctgctttgtgttccttttctgatgggccatgtctccaaagattctctaaaacatgctttgcgcattaaaaagaactctatcctctcactcaaaaagggatcaaatatttgcattttctattctctctccactcaaatctaattaattattctcctcagaaggctgcatgttctgtgtaggctttttagacaaatcaggttgtggttctgtcactgtttcctttctgttatctggaggagataaaaatctcatgagtcacccatgttttcactgggaggctttgaattaatttcattccccagtacatatccagaaaagattgcctatcttacaacccagaccaatgcatttgcagatgggttgcaagaataaaggacgatattttaaccttctccattccttgcactggaaaaactgtgtatctgttgtgtgccttgctcagtgctaggagtcaggaaaacaaaagatgaggactcaaaattctcaccctcaaagcatacagagctgagtgcaggtgtcagaacaggcagagactacatgggaaacattgtaagtacagtatggagggcacagagagttaccatggaggctttcctagggtggtggtgatatggttggggaagatatcgttggatgcgagaagtgataactgggatgaaagttccctcagagatacagggaaatgaaggaacaggacacattagggaaaatacaaataattcattctgcagcactgtcctgcactcctgccttcttaaaatccttccagttctttaagaatgttcctatttacaagacactggggagaccctttcctcttctagagtactaatcattgctacactgtttggttgattgacttctatttattttgggggtctcagatgttaatttttcatgggagccatctgtggccatctcaccccaaccaagtgtgggttagaaaccccttccattccttctatggcatcccacacatctcctactgttggaactacctctttacttgtctctgtctagaaatatccctattatgcaccatcgtacccccagcacatggttctttgctgaaagttgtaggtgctcaaacacattcttaagtgattatgtgtctggagggatggaggaatcgcagatcatataaggacatggcacaaaatcagtttgaaagtgggccagaagttgcattgcaaagggtcttgaaaactgtactaaggagtttgttactttatgctgaaaatctgaagagcatccgcatgtgtgagatgtgattgtggtggcattggaaggtttagaagttcactcaggtgactgtaaggaggggtgaagggcaagagttgggtgagattcaaggaaaacgaagaactttcagggcttcaactgaggtcctctcttcctaggctgtggatgccatgtagacacaatgcacatattccatggccattaacccctgatgcctgatattttagggaacttactgggttatctcaaaggtttaacaaattattgaggtaaaatattattttcatgtagatatagaaatatacaaatttacaaaatcagacaaagaacagcatcatgaactagcaaagtaaaaattaagattccaaagaatgaaattggagagcactgttttaaaaacaatgttagaatgtgatggaatagcaagagttcatatgaaattttctaatctcacccagagaagagtgaagattttttgtggccatgtacaaaaatgctgtggcttccatctagccatattgcctaggtacatttcttataaagaacaatcaagttttgttcactttcgtagcagacagaacattaagatagcatctatgcatttacagtgtcacttctatgaaagttaaaaaagaagaaatgcattcagttatgccaaagcttctgaacaaaactatgaaataatctaagataaaactataaatggagcagagcctatgtgggcaagtaagttttcctgtccttccctacagtcatttgcttgttttcttgtttgtttccttttatctttttcctgttttgcagatgtttcatattgaattatgctggggtagaatatttttcaaatattcatgatactgctccattcctatatctttgtgttgtataatgctataccctcagatggaagggaaaagccaatcagtaatctacctttttttccctttagatccatatcatgactacgttcagcaaacatctggattttcggccggcatttttctgagtatgcattcaaaataagcagaaattgtgttaggccaaaatgctggcagatttattgcctctttgaaagtggcctttctcttctatctgtacttattctccatttgtggaaaaagggaactttagtgtttcttagccaagggtgtcatttcccccctttcgatttaatgatgaaaggagccagtttcctggaggggtggctgtggtcccgctgcctgcccagtgtttatgggaaatctggggaatgtctctagaacttggcagcactcctccagctcctgagccaaaacacttctgtaatttttagtgtgtctgcattgtctgatgagccaaggaatccctggcatttcctcactcatgtgttgccccattaactagactcttaataatcctctgcagcctccaaggaatctgcagagtactaatggcctacgttgccttcaactcttcatcctccaaagtgctctgcttctctgaaaggaggctgtcctaggcatcctctaattatggccaacaagggtcatggaccagcataatttcatctcttccatactcattaacattaggaagctagtataatgaagggtagattttcaaaactaactataatgactctcacaattggtgatgattttcaaatgggactgtagaacagcttggttcatgagttaaatctgcaatgtatgtaggaatagacaaaacatactctggacccagcattaaagagctagctttttaaaaataatagtaatttttacttatgatttgaatgaattctttatttttcctaaaactggaaagaacaaagctgtgaagatctgaactaaaatattcctggctccaatttagatatgccctactttagcttctcttgattacctgcaatggtctacctgtgtcacagggtttctctaggtgaatggggaaaaaaaatgagaaagaaaatattgccttgaaccacaatgctgcttctaagcaatgcgtatgtcttttggccctatcaccttgtttgataagagagcaatgagatactgcatgataaacctgtactcctgctatttgtggcagagtgggtttctgtcacttgcaacccagactacttgaaaaaatatagttgagcccaaactacttgaaaatatggttgaaagcttcttcagggccttttgttccactttttatggtttctgagttataccctatccaagtgccatttagcctacatcattccactctcttttttctctcttcccttatccctctcgcatgagatctctgcattctctgagccccattataagtctcatctacccttccatactttcctttcctcatcacatcagccttgttccacatctcatcccctcaggtgtgctgtgtctattccactttgaagcatctgtcacatataattagttattctttgtatatatcaaggttattaagtaggatcaaaatgatacatatatcctttatgaacaagttctagaggtcaagaataaaatagtaaagagaaaaatctttttaaaaaagatagattcaaatatacctgggaaatgtagatgaactatgcggtcattctccagaaatctaattgagaattgagaagagctttgagagacaacttcttctacaggaagaatgataaaatgagccagatccagtaaataagttttcattgtcaaaaggaaaagacaaacttccctcttccaaggccagcatccactggactcataggtgaaatcccacagggaacaggcaggcagaccatacataagaaaggatctcagtctgataggctaagctacatagtggcaacagatagactctcaatggactaatggaatgcatgaatatttctcacccatgtaaagtcttctgtggttctaggagacttcccagggcatttatcctccctgtattgttctgcaatctgggccgtctcaatcttatggcacttgtgtttcaatacattttttttttttttgggatggagtctcgctttgtcacccaagctggaatgcagtggcgcagtcttggcttactgcaacctctgcctcccgggtttaagtgattctcctgcctcagcctccctgagtagctgggactgcaggcatgtgctaccacacctggctaatatttgtatttttagtagagacagggtttcaccatgttggccaggctgttcttgaattcctgacctcaagtcatccgccagcctcagcctcccaaagtgttaggattacaggcataagccactgcacccggcctcaacacattcttctttcaccactgtacagctttggaaagagagtggtagattcacatacactactcacaaatgcttttacctgtaagaaatgtccatgatttctcctcctctatcattaaccaataacaaagtcatagcaaattttcctttcaaggagcttgtttatgaaaataaaggagagctgaatattgatgaatctgagtcctgtctccctcaagctctgtttaactgaaacctttggtagcatttaggacactaggagcagtgctttggaactttttaacagcgggcaataaatgatgagcgatgccctgtcccttactttgccacagatgtctgaacagctctgacaccacatgcggtgtcttggcagcaatgcaaaggaggggcttccagggtcagtagaaaacatgctacttggcagtgtcttggcagtgctactgtggccagaggatcccagaagaagagagcagttcctcaaaaggaagggaggcaatcagtagactcatatgagagaagtaggtggacaacctttggggacatactgcaagagccatgtgggaaagtgtccctggggcttggtagggtcgagtgatattattccatttattcctgcagactgtagcttggtgaaattccagttacctcaaggagactgtggatttgtcatttgtgactgatgttcttgacattctcttggcctttttgataagcagaaaacttctcccaatatgttggtttaaaatgccaaatgctgacttacccaaccttccctgcagttagaggatgaacaagtgacttaatcctgaccattgggatggatgatgacattatctgagggaacttcatagagatatttccctcccttagaaaaaaaaaatgtcatgttaatagggcaactatataacattttatccaaaccagaacaccttagaagtaaaagggccataaactgtgattgtcccagccaaaccagggtatgcagtgacccttctcacatgagaaactcctgccttctcctccttttttttctttttttcttttttttttttttttttatctcactctgtcacccaggctggaatgcagtgatgtgatctcggctcactgcaccctccatctcccgggttcaaacaattcttctacctcagcctcccaagtagctgggattacaggcgcctgccaccacgcccaactagtttttgtatttttagtagagatggggtttcaccatgttggtcaggctggtctcaaactcctgacctcaggcaatccgccctcctcagccccccaaagtgctgggattacaggcgtgacccactgcgcccagcctctcctcctgtttttaatgttatcatgtgaggacaggatacttggagctgctatagccatcttcacagaaaggaaatattaataccagaggaaggcagaaaagacagatagaaaaagcaaaaagcctaggcccatgatgaccttacttaagctgtcaaaccagtcctggaattatctacattagtatttgttcttatgttagaaaaattactgttatctttaagccccttttaagctatatattttgttatatgcaacctaaggtattcttaataaaatacctttcttattcacctctgtatacccagcacttgaatattacctgtaaattaatggactcttacaaaatatctgttgaataaatgggccttacaaaatgatgatttttttaaaaataaggagtataagtcattactgtagagtgaaagttcagatagcttcaagacagattgttacctttgctattaatatatatccctatatttatcaccacaggaaataatattttggtaaatttctattataaggtgaagctatttcacatgcgttttttatagaaattatgaactttgtgaaaatatccatgcaagaattgtccctaagggaaaatataaactaacgaatgctcttacaatcatgaagtcagtacagcttgtggttcatgagtggcagcaaagttgtaaaatggagagagagagagagagagagatttaatattttaaacaaataccctttgtgttgaaattagaaatgtataaatattgatatcctgaattttaattctaaagaaaaaagcagaacgccagtgtcttgataaaacatttctcaggtctaggaaattagacatcaattatattattggagggtttcattgaataagcacatctgacactgggtagatttttcctttaaaatcatttaatacctcaaagcttaaaatcttgaatttcatgtgacccttgcccaattgagaactgattatgtgtataatgtgtgctcaggattataaaatgattcatctaactatgtcagcagcaactttctccctaagttatcgtatccacattgtaatattccatcccccgtctttctccctcccccctaaaaattgatttcactgtcatcacatcatcattagcatctctatatattgcaaagttataagtaatgggctgttggatatggaagataacattcatccagttttcaagtgttaactgtctgctgtttgtcagacactgactatggccaattgctggtgaccacaaaacagagatctttgctaacgtatgaatttacactctagcagaagtagacagatgataatcaataggcacaataagtaagtaaattatatacaataataggggtggtaaaagctgtaatttctactctttattgatactttttattttggtcatgtctttttttcctattttcacttagttctttgtccatggtttcctgtagctctttgagatatttaagataattgatttaaattctttgtttagtaagtccaatgtctgggcttcttaatggacagtttctgtccatttttcctccctttgaataagccatatcttcctatttatttgtattttttaaaatttctgttgtcaaatccttggcattggaatcttatgatgtagtagctctagaaataggattttccactttccccttagtataatgttcttgattgttgaaggctacaatcaagtttgtttagtgacttttccatactatttctgcaaagattgtattctttgtcatgtgtgattactgaaatctgtttttttttttaaccttatattcagccagtgtcttgtcagagatttctctaaatgtcaggactattagaaagaaaacaaaacaacaacaaaaacaaaacaaaacaaaaaaacactcccagtctttgctgattggtcctgtgctgggacattctgtcaacccttagttaggcccctcataactgtgccttatctttcacttcctgcttgccctgacctaggtcagtcaccagtgaaagcttaaggtcttctcaggtcttttctgagtgtacaccctgccctggacatgcccgtgggtttctaaattctctattttacataggtacttttcaatgccctcatttttcaaaagaactctttccagctttttctcctaggcttaatgctgtatattgcatgcctcaactttaatcctttgccccaggtggctgtgggtttttcattcacctcacagtgttttctagcaatgcctccctattctccaccctgagaagttctgagttaggtgaaaaagaaacaaataaactttgtccatccttcaggtagcccccagacaaattagaacagacaaatacaataatttgtgaataaattcgtctttattccctctggaaccctatatgaggatcccacaataggcacattgacctctgttctcagggccactgctaagcctggtaagaggtgggacaaagacaagtaaaaatgtcacaaagctttcccatcctatttgtctttttcttgatttaatgttcacttggttgctgtaaacctttgagttttcagcattctgacaaaattggttttgacagtttctacttgcttttcaatatttctgtggagggacaggagcttggagctgcctactctgccattttgctaacatcacacctgacaagtgctataaagtaagaaaaaatagagcaggaaaagggaaatcatcagtggtcaggggtgttgcaattttaaatggagtggtcaagatactctcatcaagatgtcttttgataagtgatttgaataaataaaggaattatccaagtatctatcagggaaagagtgtactgggcatagaaaacactgccagggtcctaatgaaggagcacactgggcatgggtgagaaacagcacagaaactggtgagccggagcacagtgaggaagagggagatgaagtcaggatataaaaggaggatcagatctcatgggaccatgcaggtgattgcatggactttgctattgattacgagtaaagtaagagaccattgtagggtttgagcacaggaataacctgatctgtcttatgtacttaaaggatcatattggctattaggctgaatgcagaatatagggtaagaaggataatatctaggagactggtaatgaggttattccccccaaaacaaagaaacaacaaccaccgcaacaaaaaacaaatgagagatgacagtagggtgaaccagggtgtaatgctgaagataatgaaataagtctggatttaaaatatattttgaagctaaagtcaatagggatttagaacaggaaaaaatatataagaatgactgcaaggttttttacttgcataactagagagatggaattatgatcagctgagatggagaatactatcattagagcaggttttaagggaacaaacagcaatgccaattctggaggtgttaagtttgagatacttattagacatccaagtatctatccaagtatctcagtatctgaaggtaggcaattgcaattaagtaagcaaccggatacataagcctggagtttatgggagacatctggaaacaaaattcaattttgtgcagccattgaaatatagatggtattttaagtaacacagaaaataggggaccaaaggacacttgctagaatattctgtcacttgctagaatattctgtcatcacgaggataagaaaagagaagccagactggccagtgaggaagaacaaaaataatatgagtataatttattggaaaccaggtaacgtaactgtttttagagtggagcgatttcatcagcttcatcaatgtactgctgcgaagttaggcagaagtactgagaattgaccattcaatttgacaatgtctctacatcattggtgattttttacatagacttattgcgtctgagtgattggaaaaagtctggtgaagtgaatacaaaaacgaacgtggtgatgtgtctatagtgaataccatcccctagaattcccaccaacctcttcccaatttttatatgagcataccacagaccttaaggagaactatagtcatatagaacttttgagtatcttcgaagaataggccattgtaagtgacaaaaagtcataattatgtagaataaataataatactgtcctctagaataccaagttgattttgcatatgaggtcatgttgagacatacagattgagcaataacttaagagaaacttaaatgaggcaggtattttgctatcttaacagcatgattcaatttacttctagtcctataatcgccaccaattactctgtattgctaagaatagagaaaacagattggttctggagttaacctacatcagttacagtgttggttgtgacaaaaaatagctagggtgctaagtaggcatggatagatgtttttgatagtctattctagtgctttcatatagaaaatgagtggacaggattaagaggttattgagaatgttttttagccctagaattctctgattttctacaaaaaaaaaactgtgcaaggtagacaaaaagaacttgaaagactgctgtcaagaagaagaggtgagggaataaagagaaggaattacaggcttcttgaagttatgggtacaaaagttaaaatgattaaacaacaaatttaagatcttgaaatacctctctattttattcatgtagaggataaacaacaatgaatggcattattagaggagagtttgaagaagaacaagaaagggagccaagtaaaggtgaagtctaaaatctgaaactgaaaaaaataaatctacaaaccgagtaagaaaaaggagaaaaaaatcacaggcgtcttaacattttgaaacgtcctatcttttgaatcaactgctgccaaaacaaattgttctgaaacttgtccaaaatctaacttttttcctttttcaggacatcagcaatttatttgtttttttatcacaaggacaagaaaacagtttttatctgtttttaccatttaggaaagcaggaacttggtgcatcactggggagaaggaattaaaggctggggctaagacttctcttccttgcaagcagtagatcatgccaggagctcacaaactcacctatgggctgtgaagaactgtacctagtgcagtaagaaagtattattagtttggattgagtgagaacaataagaaagaagtgcttgaaactattaaatacagggcttaatatgaaagcaaatcagtagagggaattgaaagggccattaagttagccaaatggatggctggaagaaaagtcatttataaatttggaaggttgaaggggttttttaaatgtcctttaacaaaaatcagatgctggttaatctcttttcatttggaaaagggaagaaaaaaccctctaaataagatgggcattttttaggctcagtatattcctgatattaggtgtgtgctgtaggttaattgaaattttaaagttaaaatgaccttcttctaactttaagtagaaactgttttttccttagtcaattgtaaaaggaggatgttttacatactgtttccaagactaaatttactgtactatttgtaatttgtctgagaaaattacttccttaacctcttaatactccatcctctttaatattgcaaaaagagctgactgcttttttctctgaattcacatttcagacaaaaatgccaatttgtcgtttggattttaggaggttttggcaagagacatagagtggtccaacttgtgagtttttgaggttgtttcattgaacttgccttcaacaaactttaattgagttcaacctagaaataccagtaggtcctagcaaaaaagatataagatactgtgcgtgttttaaaggaacccatgattaatttggggaatcagacaaaaaacatcagaccattataatgtcagaggatggatcgtgataatagagataagcttagggggttgtgtgtacaccagtagatagagggtgcattagctgaaaaaagtaggcaacatcagagtgaggccttaaagaacacatagtagttgaactaagaaataagggtggaagggttcatttaagggggacagaatttacaaagagccaaaagtatcaaacagtgtgttaacatgtttgttaggacaagctggagaaaatgaaagacttgtgatggatatgtgatggagattttggcaggaacaacatcatggtctgtattcatgccttcttgagacctgtagcctttggaatatgggttctagcatttgatatcaacctagtgctgaaaccggtctttctgagatttctagtggagtagagaatttatcttagaatgcctagaaaccagaatgtctacagtatggcaaaagagtctaggactgatttactatttgaatatatctacttaggttcagcctgcctgataccattagtaaactttacacaaaagccaacaggttccttaatttattagggctaaagaaaaaaactgacaaaagatactgtttgtttttctcaactgttctttagacatatttcttgatttaaagacacttatttttgtatcttgttgcctttgattattattgttaaactttttcttgaagtataattagcatagactaagatatgcaagtcttaaatgtaccactcaatggcattttatatatgtattcaccaaggtaaccactacacaaatcaagacataaaatatttctatcacaccagatagattctcagggttccatttcctgtcactaattctaccatcctcatagaggttactgttgacttatctttcactttatataaatataattatttatttatcatacagtaaatacatttttttctattcttgcacttcaaagaattatgtatgcatggaaatgtacagtacctgtgtttgtgtgtgtgtttgtgtgtatctatgtgcatagtaggggagtaaagatttttttctcatctattgctagactcatggctgagacgcctataacaaaagacaaattaacaagagaaaagcatacaaatctatttaataaaagttttatgtgacacacaagcctttagcgatgaaaaccaaaagaaaaagggaaacctgtatattttatgctaagtatgataaagaactggacagttgtggagaagtatgattggacaaagggggtatgatctaatggtaataaactgggaaaacatagcaaggtctgtttgttcagactcttctctctatccctgtctttggagataagggcagttgtgtcctccagatatagagaggatccttcttgagtgagagttgtataacatgcttcagagaagaagaacaggaaaaggccagagagtaaccttcctgcttcttctgtttcctcaaatgacaaggtaccatattttggggtagcatatcctgaacaccatcagtgggtgatcagtgtgtgtgtgtgtgtgtgtgtgtgtgtgtgtgtgtgtgcaacttctttcacccaacataatgttttggaaatggatccttactgttgcatataatagtagttctttttattgctgtgtaatattccattgtgcaaatataccgtgatgtatttatccattgatacatcataaacatttgttttatgagggctctgtagatgtaatttctgatactttctattttaaagtgaaagattgtattaagacacaaatattcctgtctttttgaagaagatgtcttactgggtaaattcacatttttgcacaattttttcagctaatgtaccattttgacaaagtatcctagtgcttttttccatcttctttaggcctcactgctattgagtcccctagatgagctttcaatacagacatacagtaaagtcacaaagaaaaataatatatatggataaaaggcagtggaaaagttagataatgcagaaagatatagctatataatgcagccagtgttagaaatgaattatttttgttctgacttgtcacacaaatatacagttcataaggttctgatactaataatgatactagcaagttttaaatttagataagaatcctatttgtacttctaactataaacttaagtgccttatgacctatgtgtaggcatggcattatatgtaagcagagttcaattatttgatgaaatcaatgaatatagaaactaacctctgaccagtcccaaaaagtagtgtaattaatcatgtaaatttcctcctaaggaaataggtagttttttagctatttctgatctctctgctgtgtgtttttttccctgttcttatacaacaaaccacagtagaacaaaatttatctttttctattttatttcatagtttaacactcttgggtttgtggcagttttatgtttgttttttttttctcctagtcaaataccagttttcctaaagtcaatcactctgacactgatatttggagcactaatttattctaacctcagggaatttgctttttaggaataaaatgagcattaaaatttctgtctgatgttttaaaaaaagttttacagaatttattctacataagccaagtgaagcatagcatattggcacttacttttaagtaccatggaattctaaaaagtgttcttgtctcaaattgattatttcaactatcgacatcattcatgcagatgcttatgacttatgctatggttaggttacacctggcctccatatgtcaacatcagtgtgaatggcctctggcaaattagtgtgtgattccaagaaaaaccccagaatattatgaacatcgtcaatggtaaaataaaaacaggattcccttgaaattagttgggtaaaaaataaaaatggaatatatgaagtttttaattatttttccttcatgaatagagttgttggatacctacatggagatatttccataaaatgttaatgatgacaatagcaatgatattagtagtgaacttctagtggacgcttataatatgccaggtatacaaaataccatcttgaaagtaagaactactttattgatatttcatagattaaaaaatgaatacttgggttaaacatttgcccaaagttacataagaatatatctgctgaaatttggatttcattataagagctatctgatccccaccacctttttgtttttttaaacttttatgtatgtatgtatcttatttcagtagtttttggggaacaggtttttttttgttgttgttacatggatacgttctttagtggtgatttctgagattctggtgtacctgtcaccccaacagtgtacactgtacctaatgtgtattcttttatcccttgcccctcacccctcttcccccaccccagtccccaaagtccattaaatcattcctatgtctttgtgtcctcaaagcttagctctcacttataagtgagaaaatatgatatttgtttttccattcctgagttgcttcacttagaataatggtctccaactccatccaggttgctgacgatgccattatttcattcctttttatggctgagtagtatgccacctaccactactttctttactactttatactctatatagggagtgggagatgtacgagttgaagcacaaaattcgttatcctcttttgaaaatgagctaggggaagtactgaaagtggcgtatggtcgttagaaatgtaccttttgtaatggcatcagtgtctctgattgacttccttagaagcagagtcgaactcagggattctggggcatacattattgaggcattgcttatggaacaaaggaaacaagtaagcaagagtatgtttgccactggagtctcgcttccccctgaacacacggtgatctctggagcatgaattgtacaagagaattggtcactgaaaggcaagagggatggatatgtgtattccagagtcagtcattcattagccacaggctgtctctaggaatgagttataaataactttggagtcagctcctgttcagccaaaggagagggagatagttgtgaatcattagcagcctatcccacatagtgcatcttttttaggagtaagaggggaaaggcacaataactacttttactttgaaaggttagtcttgacatgtcccaggctagcagcccctctccaccccataacaccaacaaaaactaaaaacaaactgtaactggcatagtaggatcctaaatctttgtaatgtgtatttctcaccatctggtgcacatctgtcttactaaggcatctggagaacttgctgcttatcgttcaacatgtctgattaatatgatatcatcaatatagtggtttcatctgattttctgccaaatggccacaatgttaaaatatactgtagcttacatatactgttgttcctctcatgtgaaagcaagctgcttcttatactcttttctttgagatattagaaaaatacaaaaaactaatttgccaagtcaatggccacataacgtgtcatggttttgttaatcttctctataaatataatcacattgttacagaaatatttctaaaacaatgttaatgattacaacaatgacagtagtgaacttctagtgggcacttataatatgccaggtattatgaaatgtaatcttgaaagtaagaactactttagagctataatttgatctactagttggtttactttgcccactataatctatcaaaattaagctgttttttataaggagcaagctagtaagatcatggatatgatggatattaccacccttgctttctttaaatctttacgggtggcaccaatttctcatgccttccctcaaaggtgtaatatagttcattctaattatatattaggacccaaggaaaccagtactgtgtgaatccatgaaccacctgtgaaacaaacctggaccaggactccatttatttcctgatccagaacttccattctcatgtgtgttttcaggcaatggtggtcagcatcatgattttcatccctgcgtatgagcttcaactcaggtgtatgaaagattccttgaaaaatctagttactctccttagtgtacagttttcaaagttaatgtcataggttcatttaaggaagaagtggaggaatcacttctctatttacttataatgttgcaaggtcctacctcacggggaacttcagtcaatgaattctgaatctggaaactgggcaaagaattctgacttttccctggacctgctgacctcagcccagttctataacagtatcttctgttagtcacagcttacaaagaacagcctcttatggccttttcagtgagtatggattccccatatgccagagtaaaaggtgtacctacgggtcccctcaagtgacctagttcgtctctgtgttttcctttctcacataatagtcacatactagcaagtctttttgtttgttggtttgttttactctgagcattgttatttcttccttcactttctgctaaggaattctggcatctcgacttcatttaaagccgttgcttttttttcaagttcccgggaaccatctcaaccctgcatagaggggccctcagaatccttgacaaagtgttgagtcatagacaaatctccaatatcagcaaattctcttgtatccagctttatagtctggcctcttctaaccttggcccagcacctgtagaatctatttttaaacatactctcctagtttcttccagtatatatcagccaggtcctgcagcttttccaacgtgtaatttatctcctcacttagcaggctagcactttctcagttgggccacacagagatttaaacccagtggattttttcagtcgccaggatgggagaagagacagagcctcattgccttgcagaccacctgcttccttctaagcttttccagaatcttcaaacaagagcccctcaactgtcttctaacatgaagagtgggccagaggtttcaggggattctgggtattgaaagttctcaaatatatttaccgagctgtcaccatgctaagtgaggtgagggagatggttacttccttcgttaggtcttgttttacctaaagggaattattttgtgaacaaaaatacaaagaaattttgaccaaaggaccaaagattctctagagcaaagcttctcaaatgtttgcatttactgaatcacttgctgggtgaacttactaaaacacagattgctgggcctcaatccagagtttctgatttggtatgtctggagtaggataaaagtcttgcattcaagttcccaggtgatgctgatgcagctggctcagctcagggaccacactttgagaacctctgctttggagaaaggggcagtcctgagccatttagcagccaacacactcagcaactgagggatagatatcccagcctgggaaaggagaccagcggagtaccaaactgtccagcacaaccagtgccacataaatctaaatggtgttgacataaccattctggtcaaaggtaattcatttcagaacagcatgtctatatgcatctctatatattgagtcttttaaatatttgtagtgttaacaaaattaatatgaatacttttattcttccaattgatgtaccaattaaaacattgggtatttatgagcttcctcccaaatttgttagtttacagtttttttgtctctctctcgacaatgaagaaatgcatgcctacatcagatcatgagcgagaaacagcaccaaagccagacctgaatgtgtgtttcatcgtaatgagtaactacttaaggaagcatccataataaaaataaatccaacttgtctaagaaaataaactaccccttctacacctccccgcccccggccccaaagcatgaacactacttgattcttggcaaagtgaaaagagctttgaaattagatttaagtgacaaccacagtaattaaaggtatcaacatctgttgaacaacagtaggcaaaaaaaaaagaaaaaaaaacacattattttgagagaaaaacaacaccctaattgtggttttatacaaggaggcctctttaaagttcaaattataattattgaataggtgtctcacttcttcagtgttgggctaattttgtcttgagaacatcttaggtgggacggcaggtgagttacttttatgttcttttaaactgcagatggtgatgcattacatagcaagtgattatagcattttttctttaaagagctgaaagttaaaagtgttctcaggtggtatttgttgttaatggccatatcattagttaatggggtttaattaagcaccctacgtatcaagagaaaggaaaagatattgagcagaagcaaaggacatttagaaaaggagactgggggctgggcacagtggctcacacctgtaatcccagcacttttgggggccgaggcgggtggatcatctgaggtcaggagtttgagaccagcctgaccaacatggcgaaaccccatttctagtaaaaatataaaattagccaggtgtggtggcacaagcaactcaggaggctgaggtaggagaattgcttgaacccgggaggtggaggttgcagtgagccgagatcacgccattgcactccagcctgggcaacacagtggaactccgtctcaaaaaaaaaaaaaaaagtttatcccaattattttgcccacaatctatcctcaccactataattccttaaagatacctgtattttctcctcactacacttatcaaaattatatttaaatacttacataaatatttgtttaatatctgtgttcccagaatataagctttatgagactacagatggcatctctcttgttcatcactagcatggtgcctggcacataacaggtgctcgaagaaactattgaagatgttaattggttaattaaagtgcttttctgtatttgcccagtatctctggagctaacactcatcctgagcatgcctgtgaagttattgtttattgctcaaattgcattttatcaaataattataactcaggaaaaaatattcttatattgagtattttaaacatgggctccaagtgaatattcatgaatttctttattgccagatctcagggtgtacctttccccattatcattctaccaatctaaaatattgctgactcccctctgcctcctatcagaaggaaggaaaaggagaggagaggaaagaaagcataagaaagaaaagaactattgctatccttttcctcaatttaaattctattatgtaatccaattggggtcaacaaagaaatattgattctaaactccagttaacatattcatatttatatatctgtatttattcatatatttaacattttgacctttatagtgttatctaagtgcaaaattatctttccacatttgcctccaaaaatcccattgccactccctagtataaagtattcctaaaattggaaggcagttggatgacttgattttcacaccaacttttgctctttaatctctaatgaagcttattaagatataaacattcctgagccctataacacgaggtggaccaggtgggaagagatgtcataatatttgcatgtttaacaaatccttcaggtgatcctgatgtataatcaaagctgaccttaaactcacctaatttcaaaagcaaccatttattgaacatctgcgttgagcaggatgctattctaaataatgtatcagaacattgtaagtcctacagaaaacttatgaaaatataagtgatatttacttctttgtgtagatgaggaaaacaacactttgagaggtgatgattttggtcagggctactagcttccaagttccaaagccagaaattgaacacagggccctctaatgctgaaatccctgcttttttcatcccactgcaaaaccaactatggcactaaaattcagtgactgcggcttatttcaactttagaattagcaaagatttttcccatgaaaagacatattttaaaaggctgatttaccaaggtaacagattaggaaaaattttctaactcatcgtcatggcttttgtgtcctataccatttgattaaaaagtttttgacactgtggataccctgataatgtagtctggtttagaatctttgaagaaaggtttgatgtaagagaaactattgatttgtgtgcccccaaaccatttccaaccgattcttcactgctaggtacttaacaattagtattttagcttccctgctgctttgagatggccaggtgtctgagttctggcccataggatgctagcaatagcacagccctttgaaccttgaccccttctctataccttactggtagatgtgatacctggagctgcctttgcctgtgagtcactaagtcaacctggcaaggacaatagagaatgcaattcagaatgcacctgtgtatctggtaactgttgagcctcagtgccagccctagactttctgcttttggaatacttgttaggcaagacaaatgcacctctttaaggtctgtgagtcactaattctatttcttgtagctaaatgcattcctctctgacatgaattttcctagacatagcaaattgcactataaacccctcacaggtgattttttttctttatttctgtggtgcccagggccgagttttgcagatagtagaaaccctagtaagtttgcatggtgatgagtatatgtgggatggattttgatggatttcagtatgtctaccttccgccttatgagacttgttagtctctttgcaggtgctcttccttttcaacataactttacgttttctgagagttagctttgataaagaaccataaataaaagcaaatctcagcccccacccccaccaccccttagtttaaaacctggcctgtgttaaggatgttagttctgtgacattagtgttaatcataacctgccttctgccatgaaagacatcatcaaagtatttgaaccaaggccacaaaatcactagaggaacattccgatgacaaattttctcctaaaccttgttacttcactactgcttccaggaggagagaaacaggttcccaaggtgctcattctagtaggacagctagactggaaactgttccatccatcatttaacaagcagggtcctttcaaccgtgcctcgccataaattggttcacccttccacccacttgcattggaccttggataagctacttggtccacaatgagcaagactgcattgccggtaattgagaagttgcagcctgatttattctttgtgaatgggtatgtggagctgcccagtgatgggctgcacttctccttgccctgctttgaggagttgagactcagcctttttagagcaaagccaggtgaatggattagactggaatttctgaaagagtgatatgtgtactataaaaaaggtgatttttagctatatataaatgaatatttaaaaaatttcaacagtcttatatttctatatgtaacttaaaagtatacctggtgtgtctcatctatgatttcatggctgttcagtagcattgtgtgtgtatacgtgtgtgtgtttatatttcctttaaacttatgttcatatatctgtgagtgggggtatatatgcatggatgtatgtatacttagatatgcataacatatatgcatctatttccttttaaaatgtacttatttgagtaaacagtgttttattatagagaaatatattaattttccagttgtgtagatggcatatggatttaacaaacattttgaggatgttacatgaatgactagtgtttgggagtcactcaatagtatgatttgctcaactcttaagaatgccagtgagaagaagaaaggtaattaaacaacacagaaggtaatgttcatgttacccaatcacagaggttgaggcatggggtatccacttcaaaagatagaaggaattctctctaaatgaacccaaaaggtctcgtaaaagcacacttcagtcagtttgtcaaatatatattgaattcctgctgtttttaaggcatcatcttgatatgttagcagcacagacatgttcaagatatacttgacgttttcagtgattctataatggtataaggaaaagtctgtcacaaaaccctccagtgactttctgtccctggaagaaaacccatttctgtgttgatttacagggactgcaagctgacctccatcctcaagtcttagccctcttctctctgtcccccttgtaacagccatacaggcttacttcctttctttccctttttaatgtggttcggctctgttcccacccaaatcttatcttgaattgtagatcctgtaattcccacatgttgtgtgagggacctggtgggagatcattgaatcatggagttggatcccccatactgttcttgtggtagtgaataagtctcagaagatctgatggctttataagggctttcccctttcatttggctgtcattatctcctgcctgccgccatgtaagacatgcatttcaccttccaccatgattctgaggcctccccagccacgtggaacgtgagttcattaaaactctttttctttataaattacccagtcttgggtgtgtctttaccagtagtgtaaaaacagactaataccccttcctccagggcaccatgtttgttcctactttcacacctagagacaggatggtctttctatctggaatcttctttctctttattttcatagggctgatttattccaattaccttatctcacctgaattgtcacccttcagagaggcatctcatgaacaccacatcatctcaccctgagcccctgtaagagcttgctatcttacttaccttgttgatttttctttacaacacttatgaatatctgaaaatcaccttatgtgttacctgtgttccccaggagaacaaaaactccacaagatcggggatccatgtctctcttagttaatactgtattccctctatactaaagtttttaaaataaaggctggcacacattagatactaaataaatatgtttaaatgaatgaataaagaggaggcatgaaggcttatggccaaatctcaaaaacattatagagtagagtgagcgtgtctgaaagggtgatcaaaagagtgtcatgatggagaaggaacttggtggaatcctaacagacagagctggaagattggagaatttccttgaagagcagaattaaatgatcaaaaggttagataaaataatcaaacaatttgaaggatgtttttaaaatacagcagaagcagagactccaagtggacataccacggctcaaattactgtgtaagacacaaatattccactctgaaagcataattcaatttttcttctctagtcatctagctaatctctgtgagatagcagcatggaccctatagccaaaagcacctgaaaccctgaagcttgagtcatggacatgcaggcctcattattccacatatttccaggagcttttgggaaaacctatatcatagcacagtatctcatgtgttggagctctgtcttgtgcttaatacttgttgtatggcataaaagcagtctcttttctgcggagcctcaatttccccctaggtaaacagcacagaggtagctctctaagggctctaccattattaaagaattagagaagaatcaagggattcaatgtcaattatattttttaaaggttcccatgcagtttgacactgagaagtagcaaaacctgaagtaattatattgagcgtgtctggaaaaggatgttgaaacttaaaggaggtgagagaggagtgtgactcagactgtgataggatcagaagtaatggtaggaaacggtcaagttataggtatattttataggtgtatacaagaggaattttcctttcgtctagagtagacttgacatccttgcagcactaagtaaaataacagtgacaccacacctgagcaggatattaaacgaggaaagtgaacatcagcctagcatcccatgggttactgcttttctgagtttgcacaaatgtttggaacttacataactaattcctcctcattatctaatatgattctcccaacaactttgtgtggggagaggaggagaatagacaatttatcttagggaaagaaatagaactaagatcatatacctggttaatagtgagggttggactttggctgcagccttctgtttccatacagctatgatcaaagaaaatttgtgttgagaaaggcaatgaaatatattcaccatatcaaatcgtttttccaagtagcatacatacataagctttgaaatcatggagtatgtctttgcctaattcccctctggtttatatatgaatgaatatcagaatcaataacaaccaagtcttgaaagatcttttccttgagttaaagacatgtttctctaagggggaaaatggtggataagagataggagtaacatgcagctcccacttagatgaacagaaatagcgtgtggagactcacattgtgaacttatgctccaagaaccacgacaggaacataccaggaaaactgaaagaattcacagaacctttgaaagaaacagcttactgctgcaagctctgtgagacagttgaaaaacttggcctcagcaagccccacccaacgagagtctgagctctgaactgcctaaccctgcccctactggatggatggttttttctaccagccctggtagctaaaggcaacagacataaacttttgggagctctatggctcctcccatcacttgagaaacacaggtacttatcctagccaatgcagggcaagcttatatcccccttctactaccatagctggtgctttcttgaaagtgccacctcctggctggaggtcaatcaagtcaagccattatagcaactcataacagaacaaccctgctccaaagaatgaaaaaacaacagctaattccactgcctgcaacaccctggctaacctgagtctgcccacatgacaacttctctgctagcataaccaacatttgagaaaaccagtgcactaagcaaaactacacccaaagactcccacagagtccactttactcccctgctacctccacctgagcaggtgctggacctgaagagggatcaaattacaagtctctttgcagacattcgccagcaccagcccagagcccggtagccccactgtagggctagcccccagaagggcaataaaaatcactgcagtctgcctcttaagaagccccattcctaggggaaggaggaaagcaccacatcgagggatcgccccatggggcaaaagaatctgaacagcagtccttgagttacagatctttccactgaaacaactgaaccagaaaagtaattctggtaatatgacaaaatgaggttctataacatccccaaaagatcacactagctctccagcaatggatccaaaccaagaagaaatgccagataaagaattcagaaggttgattattaagctactcaaggatataccagagcaagttgaaaaccaacataaagaaattaaaaaaaaatacaggatgtggatgaaaaagtctccagagaaataaatattataaagaaaaaacaatcaaaacttctggaaaataaagacacacttagaaaaatgcaaaatacactggacagtttcagcaatagaatcaaacaattagaagaaagaacttcagagctcgaagacaaggcttttgaattaagccaatcagacaaagacaaagaataaagaatttaaaaaatgaacaaagcccctaagaaatttgggattatgttaaatgaccaaacataagaataattgttgttccttaagagaaatctgcaagtttggaaaatgtatttaagggaataatcaaggaaaacttccttggtcttgctagggagctagacatccaaatacaaatagctcaaagaacacccaggaaattcattgtaaaaagatgatcacctaggcacatagttatcagattatctaaattcaagataaaggaaagcatcttaaggactgtgataaaaagtatcacctgtaaaggaaaacctatcagattaacagcagatttctcggcagaaaccctccaagcaggaagggattggggtcctatctttagcctccttaaacaaaataattatcagcctgtcagctcagacaaacaaatgctgaaagattttgcctgctaccaagccagccctacaagatctactaaaaagggttctaaatcttaaaataaaacctgaaaatataccaaaatagaatccgcccaaagcataaatctcacagggacccacaaaaaaaatagaaaaacaaaaacaaaaacaaaaacacaacatacataggcaacaactagcatgatgaatagaacagtacctcatatctcaatactaacattgaatgtaaatggcctaaatgctccacttaaaagatacagaatggcagaacagattaaaagtctatcaaccaagtatctgctgtcttcaagagactcatctagcacataaggactcacataaacttaaggtaagtgggttaaaaaaagatattccatgcaaatggaaaccaaaagcgagcagaagtagctattcttatatcagacaaaacaaactttaaagcaacaacagttagataaagaggaacattatttaatgataaaaggactagtctaacaggaaaatatgacataaatatatatgcacctaacactggagctcccaaatttatcaaacgattactactagacctaagaaatgagatagacagcaacacattaattgtgggggacttcagtacaccattgacagcactagacaggtcatcaagatagaaagtcaacaaagaaacaatgggcttaagctatacactagaatgaatggacttaacagatatttacagaacattctactcaacaactatagaatatacattcttttcatcagcacgtgaaacattctccaagatagaccatatcataggccacaaaacaagtctcaataagtttaagataatctaaattttatcaagtactctctcagaccacagtgaaataaaattggaaactaactccaagaggaacctttaaaactatgcaaattatgcaaattaagtaatctgctcctgaatgatctttgggtcaacaaagaaattttgatggaaatttaaaaattatttggattgaataatagtgacacaacctatcaaaacctctgggatacagcaaaagtggtgataataagaaagtttatagcattaaatgcttacataaaaagtttgaaagagtacaagtagacaatttaagctcatacctcaaggaactagagaaacaagaacaaaccaaaacccaacccagcagaagtaaagaaacaacaaagatcagagtagaactaaatgaaattgaaacaaaaaaatacaaaagataaatgaaacaaaaagctgtttctttgaaaagataagcaaaatcaatagaccattagtgaaattaaccacaaaaagaagagagaagatccaaataagctcaattagaaatgaaatgggaggtattacaacaaataccacagaaatactaaagatcattcaaggctactgtgaacacctttatgcacacaaactagaaaacctagaggacatagatacattcctggaaataaacaaccctcatagattaaatcagaaagaaaaagaaactgaacagaccaataacaagcagtgataccgaaatggtaatttaaaaattgccaaaaaaaggtctaggaccagatggattcacagctgaattctatcagacattcaaagatgaattggtaccaatcctattgaaactattccaaatgataaagagggaattctccctaaatcattctatgaaaccagtatcaccataaaaccaaaaccaggaaagaacgtaacaaaaaaaaacacagaccaatatccctgatgaagatagatgcaaaaattctcaacaaaatacttgtgaactgaatccaacagcatatccaaaagataatatgccacgatcaagtggatttcatacctgggatgcagggttggtttaacatacgcaagtcaataaacttgatatagcacataaacagaattaaaaacaaaattcatatggtcatctcaattgcaaaaaaaaagcacttggcaaaatccagtattcctttataactaaaaccctcagcaaaattggcatagaagggacataccttaaggtaataaaagccatctgtgacaaacccacagtcaacagtatacagaatggggaaaagttgaaaccatttcccctgagaactgaaacaagacaaggatgcccactttcaccacttttattcaacataatactggaagtcctcaccagagcaattagacaagagaaggaaataaagagcatccaagtcagtaaagaggaagtcaaactgtctctgttcactgatgatatgattgcatacctagaaaaccctaaagtctcatccaaaaatctcctagatctgacaaatgaattcagtaaagtttcaggatacaaaatcaatgtacacaaatcagtagtacggctatacaccaagagcgaccaagctgagaatgaaatgaagagctcaacctctttcacaacagctgtaaatctatatataatatttgggaatatgcctaaccaaggaggcgaaagatctctacaaggaaaactacaaaacactgctgaaaaaaaatcatagacaacacaaacaaatgaaaacacattccatggtcatgaatgggtagaatcaatattgtgaaaatgaccatactgccaaaagcaatctataaattcaatgcaattcccatcaaaataccatcatcattcttcacagaactagaaaaaacaatagcatgatactggtataaaaataggcacatagaccaatggaacagaatagagaattcagaaataaatccacttacttacagccaactgctctttgacaaagcaaacaaacataaaatggagaaaggacaccctattcaacaaatggtgctgggataattggcaagccacacgtcgaagaataaagctggatccttctctctcaccttatacaaaaatcaagatgaatcgaagacttaaatctaagacctctaaccatacaaattctagaagataacataagaaaacctcttctagatgttagcttaggcaaatagttcgtgaccaagaacccacaaccaaatgcaacaaagacaaatataagtagatgggacttaatttagcaaaaaagcttctacacagcaaaagaaataatcagcagagtaaacagacaccccacagagtgggagaaagtattcgcaaactacgcatccaacaaaggactaatatccaaaaatctataaggaactcaaatcaacaggaaaaaaataatcccattaaaaagtgggctaaggacatgaacagacaattctcaaaagatacacaaatggccaataaacatatgaaaaaaatgctaaacatcattagttatcagggaaatgcaaatcaaaaccacaatgtgataccaccttactcctacaaaaatgaccataattaaaaaataaattaaaaaaagatattgacatggatttggtgaaaagggaacacttatacattgctggtgggaatgtaaactagtacaaccactatagaaaactgtatggagatttcttaaagaactaagaatagaactgccatttgatccagcaatcccactactgggtatctacccagaagaagtcattatatgaaaaagacagttgcacatgcatgtttatagtagcaaaattcataattgtaaaaatatgaaaccagcctaaatgcccatcaaacaatgagcaaataaagaaaatgtgggatatatataaatatatatatccccccttaaagcatacatttatatattatatatcatctacatatatatttatgtacacacacacacacacacacacacacaccccatggaatactattcagccatcaagatggataaaataatggcatttgcaacaacgtggatggagttggagaccattattctacatgaagtaactcagaaatggaaaaccaaacattctatattctcacctataagagggagctaagttatgaggatgcaaaggcataagaataatataatggactctggggacttggggggaagtgtgagagggtagtgagtggtaaagactacacattgggtgcagtgtacactgtaggggtgatgggtatactaaaatctcagaaattaccactaaagaacttattcatgtagctgaacaccacctgttccccagaagctattgaaataaaaataaaataaaaattaaaaatatactaaccttaaaaaaagacatgttcctcttacatgaatcgttaagtacaacaagcaactgtagctggttctctggaagttcaaacagcatttcatgaccacatgggggacattcgccctttgaagttcacaccatggatgctctgtgaaaatgtctgtattgagatcactggaccactggtattgaaactggaaaattctcttcatttgctgtcatgattgtagaaataaaggtagcttattgtctcctaaacaagcgtataaatttggggtacactagtgttgaaaccaacaaattatctccctttggtttcatgataatagaaataaattgaggcctataaacttggccttttatcatgtaaattctgggctagctgtagtttcataaacagagactactttccaggctggggaaaaaaaaaaaaacaatactcctacctggcatcagcacctgacaatatcaccttttcatatctgtgtctttcataaaaatgtcagacttttaaaaccagaaatcatcaagccacaaagtattatatttagcaatagtttgataattcaaattggattaaaggatcatgtcccaaatatgttctaggtagggatatgattacacacttggaatctctttaaagaaaagctctagagaaatccactttatcctctctgaattgcctaagtagcagtggccattcaaaatttgcttggatggaatatatacctgcaagagattggaaagcaatcaaaaaaacaaaaaccaagacagtaggtgccagctcttttgtttcattgctggtttgcccctctttttctttctcaagccagcctaagacatgggaaatacaccctgttgccaagtacagcaattgaccacagggttcaaactttccgttgcaatgggcatcctatgttaattcagcagcttatctagagtttctggtctctgatagaatctataacactccctgtggagtacggacagtgttcctttgcacagggcattgacacgattttggggtggcctcctacgacctctgagctccaccctccattaaagttggcttagagcaatagttaagcagaagttgctaggaagatcagcattcctggtgcacaggttccctgttttaaaggaattgatccaagggaaatcctgcttcttcatggcaaggaacaaagtcaatcatatctaagtatgggaggggtgaactgaagtgctttgctgaatgctctctgggtgtttggaggaatgagctttgtgattttttttcctaaatggatggttgaattgtttcaactactgcaaaaaacacattctaccaagtatgaaaggattccagtgaccgctgactgtgttcatttagagagcagaagaagaaaaatacaagtaatccacggaacaataaattcttggctttaaatgtaattatctaggagtctgaatccttgcatagctaagaaataactttcctaaaaatcattttaaatattcagagtatagtaatattattatatttcttctaacactcaaaagttcaagagctcttatatgttgaatatttgatctcacatcacagtcactaggatagttttaatatttctgtgaaataataaggttcttttaaacaagaactgtgtcatatttatcttctttgaatgtgttatggtgtccggggtcagtgtgtccatgaatatagtacattttcaataaacatattgtattagttcgttctcacactgctattaagaactgctcgagactgggcaatttataaagaaaaggggtttaattgattcacagttccgcatggccagtgaggccttaggaaacttacaatcatggcagaaggggaagcagacacatcttacatggcagcaggtgagagagtgtgtatgggaagcaaagagaggagagccccttataaaaccatcagatcttgtgagaacacactccctatcatgagaacagtatgggagaaatggctcttgtgatccagtcacctcccaccaggtctctccttcaacacctggggattacaattcaagatgagatttgggtgaagacatgacgcctaaccatatcacatctattactgggtttccgtgatatccagtcttcgttagaaagagggcatccccagaagaaagtgcccttgccctcaaccataatacctcagttttggattaatcacttttgccactttattctagagaaaggaacaaataaatatccatgagaagcaaaagaattagtaattgcaaatctctgaccaggagccttaagtgaaatcaatgttctgtcacaaaagccagcttgaattatctttgcaatgtgttctaacagtgcaagggtaggaattacgtgtctgcatcaagtctagaactggtagtgagggctggtatttattgcttcccctgcttgtacctggcacctgcagagagacaggctctgcctctcacagcttcctgtagctaagaggaaacaagatcaaacacatcttaaggctataagtgaagaaaggccatacagacaatgcttctctttgttctttagcattgttaattttggcacaacttttggctcagagaagagaacagagctttagagaagaatcatttacccgaaagatatgaaatatttctgagtgaaagtcaaaggtcacagtcaactgatgctgtggaaaagaatacttctcaaatttcagagtactttctagagtttacatgaggatgaaaattcaacaaatgtaactttaagcaatgataggagactattatttaaaggagattgtgtgtgtgtgcaggggttgagaagataatgttacaaataacggtaaaattcaactcatgttttttttttgtttatttagcaaacatttattcaatgtttgttgaataaatgtttgttaaataaagaagaagtcatgtactactagatagagtattactattttatgagcctttgcaatcccacacacggcctgactcagtaccactgagaaaattgtccctctcttacaagagcttgcagtctagtatatagaggtaaactttgtaagcagtgcactctgcatgttgattagataagcaaaaactgcctttaccaaaagtctttttgtctttttaaactgttttccaatagcacttagcaagttacagaagatacttatagtttgtcccagtaatgaactattattgggtgtttactatgtgttttacatgtgtttaattctagacaaaactatttggataggaccccacattaaagaacctaaaacttagaagaagtttaataacttgctcaagtttcatgctaagttgaaaaatgagctggaacctgaactcagtctgagttcagaacctggggtctaaaccattaatctattgctgctgtcattcagaagacaaggctatacccatagaatacaaagttaacattatagatcatattataggataattttaggaaaggtagatgacatcagacaagttctcctaaaaaataaatattcacgagtataggatgtaacagacacagcattccattcatgtgcaccattctctagaattcatagctcccaagtcaattccctgctaggtctgtgcctcactttcttgagggacactggaattaattgttttatgtcccaatgactcagggacccagagatgatattttttctgactccattgcattttcaagacaaaactatgacttttattcagtctggcttcaactgtttttcttagctgtaccctcatctcaatccagacatcaaaacttgtcaagaaacatcaaaagttctagggtttggattctctgatgtctctacagggtggaaggcatgcagtctgcacactacacattcatccttccaagcccatgctagacatgaccaatcaattactgtgctgtttcctgctgcatctagatttggcttcagagttcctctcaacacaatttttaccatcagcatagaaaatgaaacttattttttatctccagagtacaccgagggaagaacctatcctgttcaagtctgtctaccctgtactaatcatttccaaactttagcctactttaaaattacctacagaatgttaagttaaagcaggttcctaggttccatcccagacagagaatctaactcaacatatctggtctggggtcatggaatttttgtttctaaagcgtttctaggtgatgctgattcgactggaccaggtaccacactttgagaaccgctgctgtttaattagtaccattgtggttgagataatagaatcaagatccaggcagcctgctgacatgccagctctaccacctatgtggtctgtagctttggacaagttattgaacttttgggggactgcaatctctcatctgtaaaatgcggtatagttaacctctcttaggagatccttgtgaggacccagtgagttcacagatgttaagtactttaaaaaggacctagaacttagaagcttcacccaaaaatgtttactaatattacttatttaactaatattgcttattattgactcagtttagagctatgtacatggcagctacccaaatgctcagtgtattgggattcaacacccagacgtagaataacatgtctgacatgtggccccctttagcagcagaagatgataagattaaagaggtaatagcagtttacagatcttttaagaggtgttttttttcttcttcttcttctttctgagacagtgtctcactctgttgcccagactggagtgcggtagcatggtcatggctcactgcagcctcgacctcctaggcttaagcaatcctcctgcctcagcctcctgagtagctgggactacagggatgtatttttatttttgtggagacggggtctcactatgttgcccaggctggtatcaaactcctgagctcaagcaatcctcacaccttggcatcctaaagtgctgggattacaggcataagccactgctcctggcctgtaagaatatttatttgcatactatggtacaaattgcttgatttttttattaaattaatgcacagaggtctactgttgcacagttattgatgctcagaaaagccaacacttgtcatagtgaagaaagactaaactgctgaatctccttcagcaatgttttttaactttgcaacacaatgcttcttttttagaaatactgagaaagctttgaattaattgtgttgtcaccagacagtggcttggttttatgactggtgtttctcctgatgattgagatctgtcatctgaattactttgccctttttattgttctttcatgtgtctacagtcatgcagttgccacgatattccttcatatttcttctgagcccttcagctagcaattccttgcagcaagtagggaatgaggcccaggagtttggtgcctggatgtagcggctagagctaaaaggttgactatttgtctgaacttaaaatcagaactctcaaatcagcaaaaacttcttttctctgacttgtaaaattattcatataaaaagatatacatacctttaattgtgtattcatcaaatcatgtttttttttttaacttttaagttcaggggtacaagcgcaggtttattacataggtaaacttgtgacatggggttttgttgtatagattattccatcaccagggtactaagcctagtatctattagttattttttctgatgttctccctcttcccaccctctaccctctgacaggacctagtgtgtgttgttaccctctatgtgtccatgtgttctcattgtttagttccaacttataagtgagaacatgcagcatttggttttctattcttgtgttagtttgctaaagataatggtctccagttccatccacgtcccagcaaaggacatgatctcgttctttttatggctgcatagtattccatggcgtatatgtaccacattttctctatctagtctgttatttatgggcatgtaaattttttttaaataataaaaattcataaaaagtaatgtctgcttttcagaaatgcctatgcagataatttgcccatttagttgtaaaaaattatataaaagcctgttattcgtgcaacatggaagaacctggagtgcattacattaagttaaatgagccatacacagaaagataaatatcacatgttctcactcatatgtgaaaactaaaaatgttgatttcactgaagggagtagaatagtggatacttgaggctcagaaggttaggggagggtagaatagggaagaggttggttaatggaagcaaaattatagctagagaggaggaacaagttctggtgttctgttgcactttagggttactgtagttaacaattcattgtatattttcaaaaaaactggacgagaggatttttgaatgttccctatacaaatgttaaatgtttgaggtgatagatatgctaattattctgatttgatcattacacattatacacatgtattaaagtagcatgctgtaccccataaatatgtgcagttatgtgtcaattaaaactaatttttaaatgttttttaaaaaaaggtaagatgaaaaatctagaatgtgtgatttttatagaaagaagctgacctgttatagaaatgacgtttgaattttccattataaatatcctggtctgaacttgatctgaactcacattatatggggttgtttataaaataatgttaatgattttaactctgtctcatatcttaacaattattccttttttttttttttctttgagacagagtctcactctgtcacccaggctggagtgcaatggtgggatttcggctcactgcaacctccacttcctgggtgtttaagtaattctgctgacttagcctcccaaatggtagctgggattacaggcacccgccaccatgcctggcttatttatttatttatttttagtaacgacggggtttcatcacgttggccaggctggtctcgaactcctgacgtcaagtgatctgtcagccttggcctcccaaagtgctgggattacaggcaagagccactgtgcccagccctcttaacaattattctgacttgctgatgcccggcagaaattgtttgcagcctattttaggcacatataataaatacatatttgaataaatgtcaactctctgattataatgtgcttggccagtcactacaatgggtggatattaaccctgtttacagatgctccccatttttcattcctgtagtctttgggtaaacttgagacctgcaggaagctgagggtaaagtgtgttcatactcaaagagcctcaaaaaaaaaatcaatttggaagatgtttttaagctttaaaaatgtggatgtagtaacgtaagttaggtatggttgcagctttcaagcagagtataaagacgttatgattaacaatatcaatacagaaaaataatcataaactatgaatcaaactatatttctttcccccaaatatactgatttcagattgcaaatggtgcaaattaagagttagtctctaattaagctatttatatacctaggagacctgtggtaaatactcttattgtgttttatttgaattaggtgacggcaaccataattgagaaggaaaatgcttattatatggtttcattattcatgggcacttgtctaccgtgtacctaggtaatttcaatactgtaaaagtattgatctcagattttaacaacattagccaagtggttaccagctcaccaatttgatgtgttccagcatgacctatatcaattttaataacccacctcagttttccgaatgctggaatttgtgatttccaaaagtcatccgaaggtcttcatgttttcagcctgcttacaaagctgatggcatgaatttcttcttcagagttaacctagttactgaaatactgaggaaaacccagtgaatttcattgggatcacttctgtgatttctccagtgaatcatttcccttgtgagaagaatcatattccagggggatgcaaagagaacaattactcccagggatgcctagctataactgcaatggtgtgggagaaatgagagaaccatgttttcatgtgtgtttcctctggaaatgagtaattataagattcatattttctttattcttcctattgtactaagtgaacaattaaagcacccactggaaaacgtactaccagtgaactcaggtcacagaatatacgtgtttttaaaaaatattttaccaattctttgtgatctcatcatttgaagtgcacccattagatctattctgatcctttatgataagatgagaattctgagtgagctctggcaccaagaaataccataagtcttaccacaagattgtgtatctgtaagacagcttctaatacctactttgggacttctgacttcagatcaagtgagatcgtgtgctatacctacactttctaaaagaagccagacagataaaatggtaaggcagattggttatggagtgaaaacactgtattagatataaacagaacatccaccaggaaaaaaatgcccttgaggaacttttagtgtgttaagcttctccaacttttcaatcaatccaggtcacttagtgaaatcgataaaatgtcatcgcagttccaaagaggccctcaagcatgtttagagagaaagatggctccgaaatttaaatagagtgttgttactaccgaggtaacacaacatgcttaaaactatttcaaggctgctccttataatgccttagagtttgagaaaacatgcctagacctctgttatacattttatgttcttgagcaaaaggatatttggaacctactctccagccatagataaatccaacaagatccactttccgaatgctttagttcacctgtgatatttgcagatatgccaataagattttcatgagagtgagccagtttaactagaaaactctattttgagtgctgcaaattaaatttggagtaaaatgtttctgtcacaggacccgtgcagattgtcggggtttgagttttttcaaactcactgacgaccacagtatatttttgccataattgtttggagatctgcagtatctcagcatctcaatactcaattttgttctaaggctttcccaaatttgcctttgaccaaatgtaaggcatacataaattaaaaacaatgcaaaaactttatcgtcttcattattctttccatgttcaccatttatctctcctattccaatcttccaaggcatcctaggttagaaatataatttagttccatgtttcttctccagcacatataattggtcttcaaagtgctttttgacattgtcccttggacttcagtcggttctctggattccctccacctcaattctgatcttttatctaatagttattgtgagtttacagcaaagcattgtgctgaatgcacaattccatttcattattatactaactctgaaaggccattatttatattttatagaaggggaaactgaggcacttagcagatgactcatcccaaggtcagcctagtggtaaaatctgtgtgcttctgagttatggtaatggactccttccgtgtccttagccctcaaacataagcagtgacttttatcggcctaggtcatctgttgcttagaaactgcctttttggttaaattttctactcaatctggcattccaggccatatatctatggacttcagtttgtatcttgacactttgatctccattatttgctaataccatttttttctcccactaggtctgttgccttattggcatgccccaacagctccagcatcctaatttccatagtcacatctcatttactccttttcccactttctactgatatcctgcttatatttgttgctccatatcaccaggaaaatttcttttatttttctctcaagtaccagttaaatgctcatgttatcccagaatattccttattcattttctctctcttttatttgggataatgatagctgctttaccaaatagaccccaagtgcataaagttgctaatatagtagaagtgtacatccatgatcagcaggtggcatttgtccacacaatgattcaaggacccagactcctctgatcacatggctcccacatccctcaaagagtggttcagtctcacatcagcaatatcggcatcacctgggaacttatcagatcagagatgcaaattatgaggctacatctcagatctactgaatcagaaactatagcaatagggcctggcaatctgtgtttgtacaagccctccaagtgatccggatgcacactaaagtttaagagttgctatgctgtggcctcctagttccctatatccagcctatggaaattcaaagagaacatgaataacatacatgtaattctttaagcattgatcaagagggatgtacatcattttcattcataatttattgatgaatactaattagatgggccatgccttcatgcaacggaggggttataaaacgtggtccctgtggtcctcctttcaataatatatagatacacaaatgagagcattgttttcttaaactgtcttccctccctagttttcataaacttctttagcatgcagtctgacaggctcttacagtcgatttctgtgcttctgtcagcttagctcgtcacaatgaacatttttactccttttccctcctcgttgtagtttgattttcctcttcattttacttacttacagcttgacataaatttctttctctattcattaagagactggccactgcaaactttccatttcaggttgctgtaacatgtcagcttattttctattagcataaagtggcccagctgatgggcttgtcatgcagaactcaggatataatggctagctgttcctcaagcacagtatgaatatttctgatttggaatttgtcttctccacatgtatttttccctgaaattcgtaggtactcagtctcaaagatactcatagatggaagagaatatattttaacttgtggtgtcgaagtagataaagggcaacatccctgggtgtcctagtcgtgtaaaattgaataagttatgttcattaccatgactgggcgcagcccctggggaactttagatagtaccgggctggccaaatcattctggaacgaggtgtattatttattacatgatataaagcaatcttcccttttaccaataacaagattcaaacaagtttatatttgagcaattgcatatgtaattgtcaagggtatagatgaaatgattaaatatctattcatgaagtttaaactactaattattccatatatgtatttactatatatggattcatatattaggttagattcctcctcttttttttcttttcatgaagcaattatattcaaatgcttgataggcatctttaagcccaattcctttgtttttctctagcaccgcttttgaatcatcttgtagttttccagagcatattttcttgacttccacctgtgttgttggaaatacaggcctcacttgatccgtgtagcaggtcattgctgggattattgacccttgcgtaagtacctaatcacaaaacataaggacaatgttgttttgtattgtttcaagttttacttcatcctttaagtatttagggtgcttctccacatatatgaccatatactgcattgttttctaaaattactgagaaaaagtttttgagcttgttaattgatatggtttggatctgtgtccccacccaaatttcatgatcaattgtaatgcctaatattggaggtggggcctggtgggaggtgattggatcatgatggtggtttctcatgatttaacaccatccttcttggtgctatcatagtgatagtgagttcttgatttggttgtttaataatacgtggtacctcccacttctcttcctcctggtctggccatgtaaaacatgcctgcttcccctttgccttcctccatgattgcaagtttcctgagtcctccccagaagcagaagccactatgcttcctgtatagcctgcaaaactgtgagccaattaaacctcttttctttataaatttcccattctcaggcatttctttatagcagtgtgagaatagactaatgcactaatacttataaaatttaggtcataccaccaaggataatccataactatatattactttggatctttttttctcctccttttagtgaaacttggtaatactgcaaactaccattgaggttgttttgggttagagtcttctccgatggtgctctgatattccaaacaaagtaaaccagagaacgtcctgtcacatggacagtttcatgaggattaaatcataagcaagctttctctgttatgaggcataagagtgcaagacaatatgaccaaatgatacaaccagaggggtgatctctgaggtctgtagaagatcagagtaaatctcctttcatcattgaaacttgtttattcttatatcaaaacttctgtgagaagggcatttgtcgaggttgctaaaaccctaaaacagtgagtttcccaaagtgctttgccagtaaaggatccagtcaggtctcactctgaagccaatgatatttgtcttctctcatagaaagaagttcttaatgcaaacaggttctttgttcccatcagacaaaagtgatgtgccctataattgccaaaggatatcagagtagatggaagacatgcatcttgtgtcccagagaacacaaacatagcaggggctacatgctgccctctctccactttcaggctgttttctcccaatattcactcagttgccttattcccacaggcgaaaaaaaaaaaaaaaaaaaaaaaacaactgacttataaactgacccaaccctccttcatcattgtaaaactatcatcttcatatgcttgcagccctataaaagctgtaagtcacattgtctgtgatggttaattttaggtatcaacttgactggattgaaggttgcatgcagcattgcttctgggtatgtctgtgagggtatctccagaggagattgacttatgaatgagtggaccaagaaaggaagacatgacctcagtatgagtggataccatcctatgggctgtggatatggctagaacaaagcaggcagaagaagtggggcattcagcttgcttggctttctgttttgcactactgctctctcttcaggagcagaatacctttttttttcctccttcttcccttagacatcagtctctttcatgttgctttttggcctttggactctgagagttccaccagcagactcccaggggctctcaggtcttcagcctcagactgagggctgagttccttggttttgaggctttcaaacttggactgagctatattaacagcttctctgggagacacattactggcttctcattctgtagcttgtgaatggcctatcatgggactttgcttttgcgattatgtgagccaattccccctgataaatatattcattcagtcattcgttcattctctctctctctcacacacacacacacaccacacacacacacacacacacacacacacacacacacacacactcatattctattttgtctgtctggagaaccctgactaatatttggggtttctggaattgattttataatctgattagacctaacatataaaaggttctactttttatagtactgagagcactgatagttcatgttatgaactctttatagagatacacagaacaaatgcatttgatattcctaatcactacttataagaagcaaggagttcagtgactctatacatggcatttttaaacatttgtggaaaaccaaggaatataatgaagtcagttggttgcttctagcatcactggacaaagtaataaaataaaaggataagctctgggatttgaactccaggctccagatgcacatacatagcctaaatgtttctaagtatgccctgaagacgagtctctgctcctgtaactatatgttgaaattactgaaaatcaaacacaagtcctcatcatgcaattggctgattataaggaaaggtgaactcttagccccaaagcgtttctactgttaaagagaggacattgattgggaaagaatggactcttgcaagagaatacggatgtgtgtgaggaccttgatgaagtcataaatattgagctcttaaattctgatgagtcgtttttgcctggggaagtgacttccccacccctagtggcagcagcacctccacccatatgatatcagtcttttcacctctgaggggattaactttgtgttgcctgaagccaatattcctggctttatcagggtcctccaacatgtccctgtcctaacttacaggatcccattctttctcaatcaatgtcctcacgttaacagtagacaccctggagggctgagagttcaacttcattgtaagccagccaatggcttgataaggacttgtgtctgattttcagaaatttccatcctatggctacaggagagaaggtcttctttagcacatacttagcagcttttgggctgtgtatgtgcagtagtggttgcctctgaggcggtcactaggcaagacactgctgattgtcccctggagccacctccaccagccttttttgcttccagacctctaactagactcaagacgcagcaggtccctaaaggtaaggtaccaagagtgactcatgaggaagtatactatactcgaatagaactacttgatttttctaatttatacaggtagaaatccaggaaacatgtaacctgtgtgggaatggtaggaatgaatattaagggtgtgggataatagtggaaggaacaaaagttggatcaggctaaatgtattgatatgggcccactaaacagagattctggatcagtgttgcagccggggaagttaaaaaacttagtttatttagtgggttggcagaaacatggatcaaaagatgtcccaccatgaatgagctggagatgcctgatctcccttggtttactgtagagaaagggattcacgggcttaagaagattggaattacagtgttgatttgtaacataaaaccacccatactaggaggctccagaaaacatacctttcaccaatccactgagaaatagatttgaatagagagcacaaacattctcgaagagccctgtgattgctcttgtctgcattccagaccttacggtgggaaccacagtcactcaattggaaaacatatatgcgatgagaagaattggatcctggggtgacaggcaccaagtggtggcactccaccaccaaaagcaaggtgtacatagttactataatggacagcagaggcaaagcaacaatcagaatagtgtgacttgtgtagacctgtggcattggctaattaatcatggtgtttctataagtgaaaaagataggaaggctattacattatttcttgatctgtatacacagaaaacttccaggtcaagtgaacaaaagtctaattgaaatcataaaaacagagaatttttagtgttgagtcagcttatagacccagaatccctggaataaaagagaagccagtttcccttgagaaaagtcctttgtataatactaaaaagttgtgctgtcaatcctcctgccatcgttcctcaaagggaaaccttgccttttaccaggataactgtgtactggggaaaaggaaataaccagacatttggggactaccagacactggatctgaactgacactgattccaggagacctgaaaagttagtatggccctctaattagtgtagagcttatggggttcaggtgattaatggagtgttacctcatatctgacttacaatgggcccatgggtccctaaatccaccctatggttattttcccaggttcagatgcatgagtggaatagatgttcttagctgctggcaaaatccccacattggtcacctaacagtgagggatgttataatggaaaaggccaaatggaagccattagagctgcttctgcttaggaaaatcgtaagacagaaacaatattgcatccctggagggagagtagagattagtgtcaccatcaaggacttgacagatgtaggggtggtgattcccacatccccattctattttcctatttggtctgtgaagaagacagatggatcctgaagaatggcagtgaattgtcaaagccttaccacatggcgactccaattgcagcttctgtaccagatgtggttttattgcttgaaaaagttaacacatcttctggtacctggtatgtaactattgatttaacaaatgccgtttgctccatatctgcctataaggcgcatcaggagaagtttgctttaaactggcaaggccagcaatatgcttttactgtcctacacaggggtatatcaactcttcagctctctgtcatagtctagtttgcggggatcttgattgcttttcccttccgcaagatatctcaacagtctattacattaatgacatgctgactggacctagtgagtaagaagtagcagccactgtggacttaattggtaaaacatttgcttatgagaaggtggtaaataaatcaggctaaaaatcaggggttttttacttcactcaaatttctaggagtccaggtgtgtggagcctgcctagatatttcctataaagtgaagaataagttgttgtatctggcccctcctacaaacaaggaagaggcacaatgcctagtacgactatttggattttggaggagacacattgcttctttgagggtgttacttaagcctatttattaagtgacctgaaaagctgctagtttgtagtggggcccagaacagaaaaatctctgcaataggtccaggcacctgtgcaaactgttctgccccttggtccatatgattcaccagaccccatggtgcttgtagtgtcagtgccagatagaggtgctgcttggagcatttggaaggcttctgtaggtgaatcgcagcagatgctgttataatttcgtagcaaagaactgccgtcatttgcacataactactctcctttagagagacagcttttggcactctactaagtcttttactgaacgcatgactgtgggccaacaagttaccataaaacctgagctgtctgttatgagctgagtgttatctgacccacccaagacagacatgaagttggatgtgtacagcaggactccatcatcaaatggaagtcgtgtatctgtgatcaggcctgagcaggttctgaaggcacaagcaagttacatgaagaagtggcccaaatgcccacagttcttattcctgctatgttgtcttctctctcccagtctgcacctgtggtttcatggggaggttcctagatcagctgacagagaaagggaagactcggtttcttgtttacttgggatggttctgcatgataagcaggtgccacccagaagtcaacgctgcagcactatagcccctttctgtgacatcccctaaggatgttggtgaagggaagtcttccccataggcagaacttcagccagtgcacctggttgtgcacttttcttagcaggagaaatgatcagacacatgtgattttatactgatttatggactgtagctaatgctttagctggatggtcagggacttagaaggagcatgatgggcaaattggtgacaaggaaattgggagaagtatatgaatagacttctctgagtgggcaaaagatgtgaaggtatttgcgtccacatgaatgttcatcaaaaggtgacatcagcagaggaggatttttttttttttattttttttgagacagagtctcactctgtcgcccaggctggtgtatagtggtgtgatctcggctcgctgcagcctctacctcccaaattcaagcgattctcctgcctcagcctcccaactatctgggattacaggcatgtgccaccacgcctggttaatttttgcatttttagtacagatgaggtttcactatgttgcctagcctggtctcaaactcctgagctcaaaaccatcttcccacttcagcctcccaaagtgctaggattacaggcataagccaccactcccggccagcagaggaagattttaataatcaagtagataggctgacccttttttagataccactcagcttctttccccagccatccatgttatcagagtctttgatgttgttctttggcctttggaatctggaatttgtaccagcagctttttgaggggtctcaggcctttggcctcacactagaggctctattgtcagctttcctggttttaaggcttttgaacttcgatttagctatgctactgactttcccaaaaccaccctactggcttctctcatcctccagcttgtagacagcctatcatggaactttgcctttttgatcacacacacacacacacacacacacacacacacacacacacacagttatatgtaatatacttcaaatgtgacatattttatatatcatataatatatatttgatataaattgtataatatatatgttcattttcatatatataatattgtttctatccctctagagaaccctgacttatacactgtccaaggaagcaaacataaataacaaaaaaattattaaatggcaactaggactataaaggttctgttttctagcataagcatttgtataatctaaactccaagacaaatccaattttactacttcaaaaaaaacaaaaaagtattttttttgctcgtgaccttaaaggatatacaaggaaaagcagcttgtaaggctccatgacaccactctctctcccttcttgccagttttgtttctccccaataattcagaacctcttaattacaatcacttttccaagaatgtactgcctacccagcaacccagcaccatagaactcatttcccctcttacccccttcaatagtcatacctgatgtctcaaactggcagttcctacagacatattttttcctctaggttgttataaaaatattgagacaatatttaaaagtaaaagataccctgtaaaatctaaatagctgggctattttaaaacaaaatcagaatgttttattacactgccacctttctagctggtgacagacccgaatagcttcctgcagaaggaattaccctgtttagccagggcatgccccttgcagctcatcacattccctgtcctttatgacctccctgatgctcaggctgacaggtcaccatgtgtcatagcttttgcattctctatttccactataattttcttcaaaaaaacatttctctgtattcatgtctttatcaaaagtgggaaatggaaagactgaccaagaagattgcctgtaataaataagcaattatttttagctatggaaaaaaaaacccacttccaatccaatagcccaatactcagactcatgagcttaactcatgtcagttacctgcctggtccctgcaggcatgtgacattatgaccttgaatatagagcaacataatattttgctacttccctctcatcccctcttttcctccgttgctccattcctcctccaacccattctaagaatacacatgacaaacaactttcctgaggggttggtagttgaaaattaggttagcaatgtagggatgctatgtggaggctggaagaaggaagcaagtctataaagatcccagaagtaagaatgagagacctttattttgtaggaaattatgattgtagagtccaagttatggtaaggcaagaaagggcagactaaagccaagggcagactaaattacaaaaatccagttaattaggtccagcaaacaacaaggcgtggactgagtcccaggagatcatcaaccatagtcatttgacaaataacaaacattcataaaagttgacaaaattaaacggtcatgtgaaccagaatttcctaataatatttcatggaaccctaatgttaaaatgtcctgcattaaaagtatcccatggccaaatatatttggaaaatgtattctatcatttttttctgaaaaattcacaatatattttaatctcataaaggttctgagaagtcccgaaataagtgaaccaatttaactttaatccagtgcttccaaactttatgttactgggatctcttttttgcaaataaaactgtttaacttcctgtggaattaatattccactgaatgccttttgggataagcttctcttttgaatacatattattttttataggtgactgccccttttcataatttattttttgtgaccctgtctctcactatagtgtgtaagtattttataaacttagagaatttcctggacgggcacagtggctcacgcctataatcccagcactttgggaagctgaggcaggcagatgaattgaggtcaggggtttgagaccagcctgggcaacatggtgaaaccctgtctctactaaaaatacccaaacttacctgggcgaggtggcacaagcctataatcccagctactctggaagctgagacaggaggatcacttgaaccaggaagttgtggtgagccgagatcatgccactgcactccagcctgagtgatagagtgagattccatctcaaaaaaaaaaaaaaaagaaaaaaagaaaggaattgccttaggtctaggtctatgtattttattttaaaataacttctttgcctttaccatttggtagggtgtttgtgtttgtgtgtgtgtgtgtgtgtgtgtgtgtgtgtgtgttgtggttttatactcaggttttccctttcattaggcacctcacaaaaagtaactgaatcctattcacccctcctcctcttttttttttttttttttttgagacagtcttgctctgttgcccatggctggagtgcagtggcacaatttcggctcactgcaacctccgtcttctgggttcaagcgattctcctgcctcagtctcccgagtatctgggattacaggagtgtgccagaatgcctgggtaaattttgtatttttagtagagatggggtttcaccatgttggccaggctggtcttgaactcctgacctcaagtgatccacctgccttggactcccaaagtgttgggattacccaaagcgctgagccaccatgccaggtcaatcctattccctttaaatgtctctatctaaggaacagacttttctgttctctttcatttttgtgatccagtgttttaaagtttactctgtattattgtaaatgagtatagcacatggcacatgataggtgtgcagaaaacgtttgtggaattgtattgagcaaagtataaacttaatgttaagcaaagtgcttacaccgacaattcttgttttctcattatcggtcatttcattttaggaattgggtctcaaacagattgttcttgaggtttctaattactgagaagcaaattagtcagcaggataagtaaagactattagttactaagctttttaggagacataagttaccagcaaaagtttgctattgatagagaaatgttttaccatgattatttcactctgattttagggaaaactcatttttatcctgaaatatcaaatttgcaatttggcaagcataagggtatctctttctcccccccttttttttccctctgtgtgtgtgtgtgtgtgtgtgtgtgtgtgtgtgtgaaagaaaatgtgtgtagagagagaataatgactaaatgggtctttgaataaacctaaatttgtttattcgcaagccatttttattaggaaatagagtatcagcaaatatgcagaaaattgaaatctatgatttaaaaagtcttttttaatttggacttttaaagaaggaagacaattaaaattagtaaaaagtcataaaaacgtattctctaaggaaatgaaacatggcaaataattaccttttgaactataatgcatcagataaaaaataattggggttaccataacaattaagattatgtaaattatccccaaggttctataaaacggtattttttggttgtagatggaaaatatttttcaagtattgtgctcatcaatatctttattattcatttatcagcttcaggaattacagtccagctgtgaccaataatattctagccaaataagtgaagtttgtttaactatttctccacataaattagcaaggtttggactgtatttcaggctggttttatcaatctgtaaggtttcctgttgggacacatgtcatggctagatgatgtagcctgattatgggcaaataatcatcaaaatgtgataaagaatgttcaagcgtagcatactgagttgaactaaatcattagtccccacaagtttgatcttcttttcttcctttcttcctttattctctttttttcctgtcccatgaaatcttacgttttgaaaggtcaggttttcctgcattcatgtttaatgacagtcccatcttggacatgctttttcaggggttctgaaattctctggctaatctgtggctcttgaactgatgcctaattccaaaaattatctcctaaaaagaaagtccctttgaattattgtagtgattaattaggacttccaagtgccattgtctaaccagtgttaacagttatttatgtttgtgtttcttttcttattcgttgatttattgtctgtcttctggatccaagaagagatttgacattccaaaaagccatgttagatttacaaacaataagtgtttcttttttttaactagattatttttaacgtggaaagtaccttctcagaattttatctgtagtcacctctaccctatgcatttacattatcccgaattctgaacaccagcctgcaaaaaagaacaaagcaagtctagacacaaggtcactcagggacatctttgctttatgtcctaaccatattttattgcaaactagtgtcctcttgagcctactgcctattttctgcacatagtttcattcctgttctttttacatggcataactgtttgcttttccagtttcctaaacagttcttgctaagactcacatttctgttttatttgttacttgtgttttcctgtggttccgaagaccccctgtagattaccttatcctgtttgtggaagttggagccacttcaggaatactatatcattcaggattctttggttgaaagcaaaagaaaccagtacatgctaatttaagaaaatgaattatatagaaaatatatggctcacagaagtgagagaaaaactccacaaagacagaaagtgaagcagctcttgaatgtaagaactaatgggtattttcttctggctgctgatgcattcctggccccaagttgctcctcaaatccttttatttaaggaaggagaaaagagttagatagctattacttatgtgcagtcttagaaatgtacaattaattcaagattgggaaccatagaactggaggctctctagggataatttctgccgattctaaaggataagaaggctttgatccatgttgattcatcaggcacatcttggactaatgtttaataactgggttattcaagtcttaagtctcagccttgtcagtactattgtgcctcatagtgacctgggaaatgaaaagtggaaaccagaaatgaagagttatgtcatgtcattgtgattgaaatgctgctttataatagtcatttttttagtcatttgtaacagcgtaattaatgtacatgggaacatggatgagtgaaagttgagctacatcatcagcactccagtaagagaggagaaactaatgatagtgtgaacattttgaaacacagcatagcagatttccaccattaaaactgtattcatgttttaaagaatacacacacacacacacacacttttgtcaaaattcaaaacgagagaaaatgactattcttgaaaataattattatttggtcaatatctcagcagaatttaaaggtaatattgatatgagatgtaaatttttaaagatacattagaaaaatctttttttttccccacagctagttattttaagttaagtatgattcctacatggactgcctttcacgtgttagcttatgcatctggtctacttgataggtattggtgagatccacagtaactgatctataacaactgctctttagctgtacgattcattaaaaacataccttatgcgtgcttcttttgaaactgtgtgtaataagcataataaccttagacttatactttcaagtttatgtgtggtgtagcgtgaagaggtgttaattcagatatcagtcctactgcctgatacttgagtaatattatgccacttcattccaagttttagttcctgttcttaaaagtagggattgcagctgggcatgatggctcacagctgtaatcccagcaatttgcgaggccagggtggaaggattgcttgaagccagagtctgggcaacatagcaagacctcatgtctgcaagaaaataaaaataaaaagttacccaggcatggtggtacatgcctgtagtcccagctattcagaaggctgaggcaggatgatctcttgagcccagacatttgaggatgcagtgagctatatgatcacaccactgcacttcaacctgggctatagagtaagactctgtctctaaaataaataaaatataataaatgataaataattttgaaataaaatatataaatataaaaattaagtataaatagtgataaaatgtatcactcagaatttttgtcgtatttaaataacagtctatgtgaatcacaaaagccatggttgctatgttgctttaagatgatttgttctgcattaaccactgaaaagatcatgagatcacaagaagtcacctgacaatagtcaatccagagatcaagacaaaacaaagttagagaaaaatctatgttatttaccatttgaatcagcattaccaaaagagcaggtcatgcagtataacgaacactatttaataaccaaaatcatggtagaccttaggaaacctgaccatttattttattttactcgtttcaattattgcttatgattatatacaagtttatacccttaatggaagaataatgtattccccaatatttcattttaacacttataaagatgatgaacatctatgtatatacatgggacaatttctccagggtaagtcacataaaagggaaattactgggtctcatccaatatgagcaccttcaccaatatgagcatcttcaacttaattgaccctgtcaaatgattcactccaccggcagttaacaagagctcctcgaattctacatcttcaacccttgatatcattagatttttatatttttaccattctgatgggtaaaattattaccattttagtttgcattgcatgatcagtttccatctttgtttgttattctaattttctcttctgcaaatttactgtttacattctttgtcaatttttctgttgatggattagctatttctgattaaaaagaaagtttattctccaactgttaagagttgggtgctatgtatattatgggtatatcctgtaaactgtgccacttctttacccttaatagatataattctatttaatctacatgtttttaagaaaggtgtattaaaatgttctaccttgattatgtttgttttttgttttattcctctatataattttatcaagttgtgagaaaaagaatttccttgttagatgtatatatatatcacattcagaattggtatctttcttcctgagttttccctttcttaatgtttcaatgactcctttaccccattaagaatttttgtcttaaatttgattttgttttatatacaggctctcacagttttggtttgaggcatttataaatatgtttgtttgttttttaagtttatgatgagtgtcttataagcagtgcctatctggatgtctaaaaaatgtatttgagaatctctgatcttctagtggtgagttttattatgttctctttgttgcaaaaattgacatatttgtatttatttatataatttgctttttttctatattttaatattttcatttagctttttactcatttttcctcctatcagactgactttttgtttttattccttttcttctaccaggaaatatacattttatttcctcttttatactgataattctgaaattttaatatccatgtttgacttaaaaattaaaagttgtttggtgttattcttatcttggagaataccagattttgtggaatgctgtaatcctgctcactgagttccaaatttcacagttttttctccttatttttaatgcaagtgcttataaatcgcttactatttgtcctaattgtggttagtgtttatagctatgttaatttagattaacccacatgataataaatttccttgctcatcattcctttttgcatcctactcacttacctggttcgctctcttttctcctgaagtaaagcttttagcattaatttcaataaggatacataggtggcaacttttgtctaaaattgcccttattcttgattgacagttaagttagacatacaaatcagtgttaacagatgacagtatttgcctctcaatacctttcaggatactttcccacagttttctggtttttctgttgccaatacttgatttgctgccaaacgaattttttaaagatttattttagagtaacttgctcttctttctgattgtttaaggcactccctcttccccttttgttctttgtgatttctctataagaaagacacatagctgatattgaaattgacatattgtataaatttaagagtaaggctcagctatgttatctttgaatgtaaactcacactcttctctctcatctgttcttcaggaagtcctcacagtctctccatctccatgcctagttacataactttgattttctcttctgtttaccactttgtgctaaattctatgaagtgttctcaaatggtcttccagttcactgattatctctttacgtatatccaatctgatttttaattctttttaatagattccttcattcaaataaactttatttcctatatttgtcatttcaataatcaactttataaaaatctgtctttcatggtccatacagtagtctgatttaatatgcatgtgtgtgtgcgtgtgtgtatatatatatatatatacacacacgcacacacacacacatatatatacacatatatatgggtatatataatttatactttatctctttaatcattttagttcagtaatttatagcctctttcacaatattttatagcttctttcacacttgcggtttataatttggcttgcaaacttctctttggaggaggtagctctttctctaaaggatctggatgcccttctctgtggaattgtggctacaaagcagattaatatttaattttccaagagactggaagtttcaacattctggggccagctttatgttaaattttcagtgtgacaatcccatactatactaataaagtgcatttagactataaaaccatgtatggtccatttttccattcctacttttgtggactgtgagatcaaattgttttgtttcattggaatggagggagctacctttcctgagtcctaactttatgcagagatctccttacttcctgtagatctaaaatcataccttccatccccaaaaggactttaacagccaaccctcatgtgtaatagcctagatctggattctactatcttctgtaactcttttctgtcctctgcagaattacaagcctgtctttaattttcctctttatttttaacaccttgacactttccatttactctctcaagattatgtatgtatttaaagaatgttgaattttttgtcatcgacactttccaggtttttaaaattataatcattggaaagtttgcatttcctcagtccaccattttgctgcaaatagaagcagaggtcctctcaatgtctttatactttttgagtgaagtatattaatacctttaattaagatttaagaaataaattggaaattggtattttcttattaatttctagtacttaatatggttagaaattatttaaatgattgtctttatttttctgtaagtgcataccctgaatttaataccctgaatctttctctggtattgaaagttcctacagtgtcacttatataccatttgcaatatctcactatattaaaagaaagaagagattgagaaaactatgtgagagctggctgtatgaattctgaatcacagcaactaggatttctgtatattaattatcactctactctcttatcagtttttcttataaaagtaatatattatgaaaaggcatgggccattgaaacttctatttaataagaaataaagttttaataggaactggtagagataaattataattcttggtcatggttatactttttaatgaattatttaatgaatcttaaaattatcttggaagtacttttgtctatactctgactattaattaccctaaggattcttgtaggaatataataaagttatgttctcaatgggttactggtcttctctgaagttgtgctagttaaggttttcttagagttggtttgtcaatttttacatcatttatttctttacttcagaaatattgatgtatgggttccatattctttctagatgggaatcctaaaatcatctaaaattttgttagagaaggatcaagaataaaatgtagtgccttttttccccttcccacttttttctcagcttgcttattctgtatgtacgacaccattgctatatttccagtgatttttttttgcctttagtttatcttgacaatggattttaatatcattgaattctttttgttggagggtattttgtttgtaagaatggtaatggtctaaaacctaaataaatccaacaagaagcaatatttcttatattccaactcccttaataaacaaaatatagttagaattattgacaagatactagaaaggacatgtttggatatttggtaaaatatgaatattatttgttatttcccttttcctcttattttctttataccaagttgaactgctgtaggagaataaacatgggagggttgagggccctgcataataataatatctgaccctccaaaaaataattcttccaatatcttattaagaaactcatatgttttaacagtgtagtgtggaatggtagttctaggagagaaggagaaaaaaaaaggaaaaactagtactgaccattgaaaaatgttctgaaaagagtccagagaataaaattcccttgtgatcttgctgtcaaccatctagacggggtcctgtggacagctgatccaagcattcatctgaaaccttacattccacattcttccctttgccataagtattccccaaacctgactattaagggaaaagaaacattaatcctcaaaaaaaaaaaaaaagaaaaaatcaacaacaacaacaactacacagacaatgaaaaatacaatgatacaaatccttaagaaaaaattctaagaagtcttatgagaagaatccaagaaataatgtctatttagaggacatagaacaagtgtaagagatgcatataaagtataagaccatcacaccttaggaaaatatttaagctgtgtggacttcttatctgcccgggagattggtttacaaagactacaaaggcatttctggaacttgtttcctgggttacagaggtgagatcatcaagctagaactaataattgtgccactaattaaaaaatgaaggcaattttaaaaactggaatgatatattattatctttcctcaccacatcacaaaatgagccatttttttctttaaacactatttaaatgtcaagtttattttttattataagtgtttttcagtagtaaaattcttagagattatgccttaggcgataggtaaaatgagactcacataatttcattgatggtaatggataatttactttatataattcatttttttctattgaaaatgtaattcatgccttgggattgctttagcattcactgttgaaaataggaagtgtgtgttttatttgttttatggtattccttagggagctgcatgatttagttgagagagcatgagttttaacagcagataagccagatttagatcaatttacttaaaattatctgagccttagtctcctagtgaacactactgtttggttgtggtgaagatcagatggacagcacagagggctgaactgttcttggtatagtagtcccttaatctcctagcctataccatcagggactacatctgttcttgattcccatcgtatctctaacatcaaatttagcgcttagcacataatagtggcctgttacaaacatgttgaatttttaaaaatgagtgatggttaaaatcagtgtttttcatgcacactctaaatccacctatttgatcccattacttttcaaaaattttattcaattccagtcacctttaattcttcagttgttgttgctgtcacactgttctccctttctatggcacatcacaacctgagaaatctttctttatcttttttaagaggcagggtctttctctgtcaccctggagtatggtggcacgatcatagttcactacagctttgaactcctgggctcaagtgatcctcctgacacagcctccggagtagccagaactacaggtgcatgctactacacaaacaactttttaaatttttcatacagacacgatctcattatgttttccaagctgttcttgaactcatggcctcaagcgatcctaaagagatgactctgatgttgtcaccacgtgtcttccatatctaggcaggtctcatgctgagtcaggaggagggagaacagaggcctaggccagggaggtgagggcacacattcattttttttttttttcccagaaagatgagtctcacttctcttcatgttcctttggctataactttgccaaatggacacaatcagttgcaagggaagctgagaactgtaacttttagctggttagacatgtctgtagctaaaactttggagttctattatgaaagaaggggaatggatggtagagagcaataagcaattattgtcatatgagttttcataattttttcttgtaagactgttctccaagaagagtcattgtcaatttattttgttctttttccaactaaagtctgaagtttttgaaggcagtaaatatgtttcattcatcattctattactaatactgatcatactccctgacacagaacaggtattcagttaataattgttaaatgcatgaaatcccagaatccatgtggatcacttggagaaatgtggcaaaataagattcttttgaatagcataaccgtattctggtttacagtatttttctattatttttcttctattccgatctagtcgaggatcccacaggtaacagaaatagctaagaagatgcaagcatccctcatgggaaatctctctgggaaaaaataacagcaaggcaagtgttgattccagccactttgcctcacccaggccattgggtaacttcataatatatgaaatgaatcctgtcaaaagcacttgctttccagggttaaaaataaaaattttcaattagctttctcagaatactaaaaggtttttttgggtatctgaagccaagacttaaataaatgatactgagaattttttttactacaaactagtaaattaaaagtcttttcataagatccccaatgcccatcagtattaagtgttgatgtgattcctccttagacccttttctcttatccatgtaccccacaggcttggatgatatggatccagattggagaaaagtcgatatgatttcgtagtgtcttcacccaaatctcatcttgaattgtagttcccataattcccacatgttgtgtgagtgacttggctgtcattctctcttgtctgctgtcatgtaagatgtgcctttcactttctgccatgattgtgagtcctccacagccatgcggaactgtgagtccattaaacctctttttctttataaattactcatgaaggttcaggtatatctttatcagcagcatgaaaatggactaatacaaaaggaaatggataaagatgtctccagaaatatccagaaactgaaggacaaaaagaataatgtctaaaaaatatgactagaaacgactcccctccttccctgccttcagacctcaccctccctcatagaagaaatcgtgtacatcagtgtcagggttggtactttaatatgtttggtgcaagataaattaaaaatcagaattcatgtttcctcttccattcctcaggcagcagtgtggtaatgtgcctgaactgtggtagaagatgatttagaactacttaaaagtttctgaaattcaggattcagtaaattaatctatgcttacatttcctcaagtcttgaatttgattttaggagcctgatttgttggttatctgtatatgttgctaacttgaacaagtgcaaaagttcccagtaaaacactattttcagtattttttctttgtacagagactattgaatgttcagtggaatctactgtaggtcactgcccaggctatatattctaagacagtgtaactcaaattctgtagtaaaggaccattttaaaaaaacatagattgcagaccacaatagagtgacgtagaagaaaagtgttgtagccgtggcagattgctatggaagcttctgaaaactggctcaaattctgaagttagctggccatggacaactgtagcaggcagtttgcagacagactacacttagaaagcactaacctaggagacgtaaaaagtaaaatatttcacctctcaaataccttatagcttggtgagagacttaggcataattaatttataaccaaaatagataataattgtaatagatggtttacaaaacttaggataaaagaagcatgaggatgaaaaaaggcaacaaaatggaggttggttaatctagatgttattaatagttatagctaataattcttgattgtttataatgtgctagggccaatactgagtgctttctgcaagtataaagtaatttaattctgagcaatgcacaatgatgtacgttctgtgaataagcactttgctcagtctcttttctgtttctgtctctctgacaccccctttctcctcctctatggacatatgcattaagtagtagagctgggatttgcactcaggtttgtgacttgaacagcccatgagtttaatccctttctttcctctaatgatttgaaagaagaatccaactgtaaaaagggaatacttttctaacaggcacagcaaacagaatgaacagaggtgtgagtcagtgagtgggtgggcgtggtgggtgtagaccagtgttccggaacaggggaccctaaagatacagttggagataatcttaaagcagtaaaagatgctcaaagggagagagatggattaagtttgctggaggaggagccatgtgcagagacagcagggcctgataggagagaggtccagtcagacattctgtacctacagatgagggcctcaactattgctacattctaagttatggaagtagggcgggagaggtgggtggaagtctgggcactgtgggaaggagctcctgccaactagttaagaaataactagggaaggaggaacggtttgtggcagaagatggcattcacattgagatttgttgagttttagatgttagcaaaacaatcacgtaaagacgtttgtgtgtattttctggaacccttaattgtggcaggcagtgctaggtgttggcagtatccattttgtgtcctcagttgtgtacaatcttataacactgagcaaacactggaaaactcaggtgtgaagtcttaagtgaagaacacttaagacatgctggattttagaaccagaattgtagagggcagtctgtatgcataaaatattctcccaattactcttgggtctacagatgtacagacaactttgtaggccttaattgtacgccattcactttgaccacagtttagacactgtgatatttcaacctctgatcttatttatagtctgttgcaggaggactcagaataaaagatccctaaaagtagcaggtgttttagaattttgtactttagcaccaaacaggtatcagatcgatacttgtcatctttgtcaaggacaatgaacaattcatcattttattttaagccatgttatatcttatcacaggaatttgaacaacatcaaattttatatgtggtgtatgtgacaggggtgtgtcaaggaagagaaagggggtaaggaaagaaaaaagcagaaagctttttttttaattggtcttttacaagaatcttatctttggtagtggaaagcagtatattttctctctttattttttcttgaaaaacgagaaacctcatgtaatataccactaagccagcatagttcaagttgccatttagaaagcataattagaacagcatatttgaaatctttttgaaatgtggaattatgatccacttattgaaaaatttgaaggcactcaaactgttttattctctttcaaggacactcagtatgaagttacacagttcaaaggaaagctaccactatctgcttaataccttaattatttgtggtaccttatcttggttaccactgatatacactgctccctaaatcctatttactaagtttttcttttagaatcacaagtttattttataatcagtacccaacagttgggtcactgattttctagaactgcctaatttagttagcccaagtttatttgtgatattccacatgattttaatcttggctaattttattttattttatttctctacatgtggacatataaataaatcagattatgtggatgtttaggctaagctttaatcccccttctggtgcctgctaggtctagcttctttatcagtcttctccagttaatctccagtttgtattaaactacattaataaacgcagcaccaagaagccagtcctccatgaggaaaagtaagcccttacttatttctcccattctttctccttgttttaaggtggaacttttgtatccacaaatgggtctggaatagccactgaggcataaggagaaagaaaataaaatgacagctgatctccattgttctgggcttgtgacagaaaattctgctccaagtttctactttgatagttttggaatgtggccagcatctctgggatttagtattctgaagtagtctgttcaacagaccgttctgtgatggtgaatagtcaatatctgtgctgggcaatatggtagctaccagccatgtgtagctatcaaaccttggaaatgtcgcttgtatgatagaggaactgcatttttatttaaccttaattttaattagatttaaataaccgtctgtgactagtggctaccatgttggggaagtgcagctctgaatagtgattatgtcaaggacatgttccatgggagaggcagcatagtgtcgtggaaatccaacctctcccattatgatcgctgggatcttagctttgttagacaagtctctgtgcctcagtttccacacaaaacaaagtccaagtaacaaaacttacttgcatgaaatattagtaagatataacatgagtgaaacaggctttctcaaggtccagcacttatagatactctatgactattagttaaacatatatatatgtacatatatattttttattatatatgttttatgctgttcaagcgattttcccacctcagtctctactctagctagatctacaggcccatgtaccatccctggctaatattaatatttttattgaggccacacctcgctttgttgcccaggctggtctagaactcctggcctctagcaatcatcccacctcagcctcccagagcactgggattacagatgtgagctatttattatcattattattattattattttgagatggagtttcattcttgttgcccaggctggagtgcaatggtgcgatctcggctcactgcaacctctgcctccagggttcaagcgattcttctgcctcagtctcccaagtagctaggattacaggtgcccgccaccatacctggccattttttttttttttttttgtatttttagtagagacagggtttcaccatgttggccagggtggtctcgaactcctaacctcaggtgatccgcctgcctcggcctcccaaagtgctgggattacaggcttgagccaccatgcccagccggtatgagctattttaatgagcatgacatagagaatttggagtaaacctaagcttccttaagtgagatagtgaactaatgatttcagctttctgagtttgtgacctcatttgtaaaatggagattataattcctgccctgcctattttaggatgttgccaaactctgaaactgtgacctcctaagtgtttctttagtttatttccttttcttcacccacagtgactgcctcatttttcaggtggatgatacatcagcttcctagcagatctccttgccttcactcttctcaaatatgaactgtgcatcatgacttgaatttgaaatgtgatttccatattctctatcactaaacaatcaagtccatactgctcagaatggtaaccaaggccaaaccataaactggctctcatttaaacatcccctttttttttttttttttttttgagatggagtctcactctggtcacccaggccaaagtgcagtagtatgatctcggctcaccgcaacctctgcctcccaggttcaagctattctcctgcctcagcctcctgagtggctgggactacaggcgtgcgcttccatgccccgctaatttttgtattttttagtagagatggggttttaccatattggccaggctggtctcgaactcctgaccttgtgatccacccacatcagcctcccaaagtgctgggattacaggcgtgagccaccgtgcccggcccccttctttacatatgtttccttctctgaatttactcttgggcttccccagacttcatgtcattcccctatcacatgcccatgccctgctctttctcacctccatgggctttgctgttcctgtgcctgcacttttctcttttgctccacctccatccaaccccaatctctggattgattaattcttcatatgcccctccctgcaaaactacacccttgcccctaattctaggttcatcctcctctattttagcactcactcaagcaaaataacctcagaaaaatgtccttgcctatgacttcctttagcctaattcccaaaccagagtgagtctccagcctctcccaggtgcagctcttttactgaacacatgctgatgttgggcttttcttcttccttatatctgcgttccctactagaccaacatctccctgagaggaaagcatatatttcacttgctttataacccaagtgactatgagttacagctcagagagccttattgagtagatgatattgtcccaggtataccatgaaatcatgtaggtgaaagcattttcaaaatggcaaagtactcccgagatataaagtggcgatgttttaattaaatttttctgctgacttagtgtctgcatcatgctgaccaactttatgacaagcagtgttcttacacccatggttctcgctgactgcatgtttctcaccatgtgggccagacatcttcatttcaaactggatgttgcctctcctctctgtattctcacttgctagtttctgctctgtggctgcaagtactctgctgactgtccactcttatagatgctataatcctcacaccgagctgttctcctcgtgaatgctatgcacctaccccacacctatgcaaaatacctttgagttccttaaggaaaacaggtgaggaacaagctaggagacctgctccgtagagactacctggttatttaccacaaaatataagtcttcctgagaacacatatatggagccttcaacaatctgtgggttgaggttaagcagcttcaggggcactctagaccagaattttgcaatgtgcagctctcaggatgcatgtgacccgctgccctgaatgcatgtgtatgtcaataagttttattgaaccatgctcttttgcttatgtattgcttatggctacttttgccctacaatattgtacaagagaccgtgtggcttgtaatgcctaaaatatttactatgtggctctttacagaaaagaaaattgctgacctctgttctgaggcagaactactgccattaggagcgggagaattctttgctgggtaaggggacaaagagggtttttctgtacaatatgggatatttggcagcatcccatgcctctgcctaccagtgcatctacagtagtaccacctccccatttgtgacaaccaaaaatgtcactagacaatgccaaacgtcccctgggggacgaaatcactttcagttgagaaccactgctggagacaaagtagacccaaatacactttagaagaaagtaagaaaaaaatcaattattgaaaaacatgaagatgtcagatgcactaactacttatttttctttggcaaactcattgcacagatttcactgacctaaatgtaatactgttcaatctgcatggtcaggaggggagaacatattgagatttattggctgggttcctaatattttttttccaccataaattcaagtcaaatgtgtagagtggaagtgtgaccacaggggtgttgagcacagcctgtgtgacacttgcctgaactaagggtaactctgagacttgtcaacatgctactctgtaagtgtgggcacactattttgtttatctgaaactgaatcttctcttttgtaaaatgttagaattaagtgagagcattgttcttctaaactgcttaagacagcgtctggaatcaatagtgggtgcttacgggatatcagtgatgagagtggtggtgatggaggtgggaaggaagaagaaaggggagagaaataagaaactgatattcacaaagcaccctgtggagtgttagaaagaaacattaaaatcataatgtgttaaggttgaaaaaccattaaggtgacctcagatgttgatatctttgtgctgtctcctgcagggattgttgggcttctagtccctgcaagacatgaactaaatctattagtaaaagacaccaattcttcaagcagcaacttggaaagaacataaaaatatttacataatgggaaattatatgagttcaaaatactgaatactagtgttcatagaacataaaaatcatgtatttagtcttaaagttattggaggttaccacttagttaactaatcagtgctaaaaagcctttgcaaaaagatccctgatctttccatgtatctgtggaagctgacacggtggttctcagtcacatggaacttctgtgcctttcatttcccagaatgtagtcaccaacatctgtcccccgctaggaagtctccctgaccccatcccaattcatgtagttttattggagctgactctaatctcatttctagacaaaattatatgacttcaaagctaagccactccacacagcctcttggtgactcggtgtgggatggctgcacagcccgggaagagacaatacactcctagatttctagagaaaaatattcttagcttctagtcctcaaagaagaagttgtaggggctggaatggctaccttgattttggtaccacatgaggtctgagtctgaaatttgaaagaaaaaggcagagatgaaaaataaagaaacactgatgttttaagatattttgtgtctagaatctaccaagcctgaaaataattggacatctagatatgtatactaatatgaagtaatatttttctacttgcataagctaaactgggtcagattttctaccacttgaaagaaagaagtcctaagtattacaacagtcttgggagttaagggactactctgtcattcagatggagcaactactaagacggcctcttcttgaacttctctttatacaaaatgccatgagaaaattcatgttatgttagaatactttttgtgacaagagaggttatattttagagacttttaaaaaccagttgtgtgtttggattatattgtattaactaacattagatattaatataataaaatcttaaaatatatacattaatatctaaacttctgatttttattatgaagacccccatgtctacaatacctgctttcaacacttatcaggattttgccacatttgattcatctatcttttaaaattttctttaagcgtttgaaagagaatcccagacatcctactttttctccctcacatgtttcagtcagcttctccaagaatcaacaatgtcatgcaatgcatgactgcaatgccattatcacatctaacagaaacactatccagcccattatcaaatttccttgagtggctagaaaatacctttataacgtcagctttaaataacacatattaagtgccaggcgtcttctgggcattttattaatttttatttttactttttttgaagatggagtctcgctctgttgctcgggctggagtgcagtggcgtgatgttggctcactgcaacctctgcctctcaggttcaagcaattctcctgccttagtctcccaagtagctgtaactataggcacctacggccatgccaagctaattttttttgtattttagtagagactgggtttcaccatgttgcccaggttgcccagcttgcccatgctggtctcaaactcctgagcacaggcacttcaaccgcctaggcctcccaaagtgctaggattacaggtgcgagccaccatgcccagactcttctgtgaattttacaagcgacatcataaccacctctaaagatcagagatgtttaatgacttgcctaagacttaccaaactaaatatcctgagccttagtatgctaacaataacacctcatttcttcctaaacctttattagtaaaatctgtattctttaatttcttaaaaattatgaaatcatgagaatgtttggttttccctatatattttttcttatctttttggtgtaaaattgacaaatgtttttataaatctataaagaatgcaagtatgttaattttcaggggaaaaaatatacccttagtggatattttaaatataaaaccaaccacttttgggaacatgttttacatatgttccttctgtttgtaggaatatgatgttgtcctacatccttgcttggctccttcttgccatctgtatttttagttgcccagggtgcagtattcccacagagggtgaagctgattattcttccttacctgcttcctcagggtcatctcaaactctgccgccttcccttcatcatcaccctgggtctccaattctccaaaccttcttactacctttattttcctctgacagataaccctgtagcaaggtaacttggatgtgtttttgttggttctactccatttcgaaatgatatttcaaaactattgaaagcactggaacaataggcagttgtagaatggcttggcttggcttgaaatatgggaggtccatatttagttgctagaaaaaaaaatgctggtgacatttcaggagaaataaagaattgttcagagaagtcttgagtgtgtctttcatgaatgaataaaatggtttgagtgacctagtttggccatgccctcaagtagttttaacattccattttggaatatctgtgttattaaggcaatgagattaatttagaacaataagaaaacacagaagttatcctctgcgcatcatatttagttcagaggaccaaaatttgctttctgttcataagatattttgtgacaccaatctattgtgtcaccacaatatttcaactagagttgaaatgttgcatttcctgagggagagtgaatgagtgcatcattggttgattctgtacacatttattctctctcaaccttattctttggcttgagattgagcacatattagcagtctaaacagcttctttggaaatcaatgaattaactgtttggctatcagaaactgaagcaaggtgagcaagaaggaggtgatgagggctccaggccctcctagcctaccaggtggtaaaatacagccttttaagacctgcccaattttgaacattctaactatcctgaaggtagcaaagttaaaactcaaggaatgtgtcctctgcactctgccaggtcatgaaggttcagcactgagaaaagaattccctaaaccccattagaactgcttagccaaatcaatttctgctcctctgtttacatattccttccagtatataaccctggagaaactggtgtttttcattgtaacatccaagtctctgaaaaatttctattaaaatggagactataaaaggaagaccgtgtgttttgaagtcataagtcaagcaaaaataaggaattatgataagagaggcattatggggtggaggaagtcaaatttggaagcagaagaaatttatcattcttctcttagtttcgtcagtagagggctcaaagccagtactacctttctcaagtacatttgagtatcatctacttccttgactttatgctattatttagttagtttttttttgatgttcaactctattttaaaatatttttattctttttatttgttgtataacttcatttacattatgtggggctctgaaggcatgcaaatctggacaaaaatccaggcttttctactcaaaagctacacaattttgcacagtttattcattattcattcattcttttccctactcattaatatattctgccagtatttattgagtgataattaagtcctatatcatgtgcaggtaatgggggttacattggtgaatgaaactcatcaaggtctctattcttggggtttatggatcattggggaggcaagcattaaacatttatactaaggtgtatataaatataaactaagttttctagaaaaaagcaaaatatgatacatcagttggttctatgaaaagatgtatatccaaagagccgcctgaccgtattgaagtatgggattagttgacctctatgagcctccatttcctcatctatacagtgggaataataatagtgactacactattggtttgttgtgaacattaaatgtgataatgtaaataacgtgcttagcagagtgccttgaaaattgtaggatctcattaatttaaacatttattattttggttttgattatatcctatcaatgtgatcttaaagtgataataatgggagaatcaatcatttctgagttgaaggcacatttaaggttacctagctcagggtaagtggccttcatgtgttaggcaaacactctcacacaccacagtgttttatgtgtgtgcatttatttctaggatgatgacccatgggttacataaaaatcatgtttgttttatttaaagtccatgacccaaaatgagttaagtcactatcaaatgctgtaccagataaaaaaaaccaacagccattcatcaataatattttatgaaattctttataatgatccttcttttctctctgtctctaaaaaaaattctgcttaccttatggcttttttattggatcttttggtggatttagagtcttcttactatgagtgaaagctgtttatttctgtaccaagttgatgataattatcaggtaatcttatgagctttgattgcctttagattatcagagattttccatgtatataggcctattaaatgggaagcatgaagattttgtatcttcatttctattccatgtctcttgttactttttcttcttttgttttgatagagaagctcttcatcattgtgcagaacagggctgcgatggtgtgtatcttggctttattcctgaaatttactgggaatgctcctcaaaccatcagagttttattacagcaagtaacaaaacccatttctgactcattatgggaatgtaaactctgcaaggcataaatgttcatgttttgttccctcatgtttgagttcactctgaataataactggaacactgaagacacttcataaaagcttgttgaataaaaagggaaaacaatagaatacataggaagagtaaggattgaaaggaaaaaaataaagtagtctgatagtgtgtttatatatcttgtttaattagttgagatatgggtaacctaaaacaacatttgaagaaagttgggcaaactgccctcttagttatattaaggaagcagaccttggagatggcagaaattaatgagtctgaatgccaaactacattgcacaatctcagtaggctctggactttggaacagatcatttacatctcatttcacacatactttgcttaatacactggaggctgtacccttgctatccacagactgtgacttcaaggagaggaaattgagatttttttcaaccgtaccaagtgggccatgtgtttgtattgatttttctcgtgctccttagcgagtgatcctgaatatccttacaacccagatccacactctagcccccacatccaaatttcagagtgaagctgttgggtgtcaagacattgatcctgcaggaaatatcgtattctcttctttttcataggttctcatggaaaatgatttaagatgtttaatttagatacaataaatatctggatccctacaattgctgttgcagtttcttacacctaagaagtgctcagactattgagtgggtacctgtgtttcatctttgtttctggcttttaggtttatagaactgtggtatctgaaaggagataatgaaagtggggatggacataaagatggtttatggagggatagaaattaagctttgtgatccaaacagatatttaaaaatgaaacttgtagagcagtttcatgttattaggaaataataccttgtatacatagccatgccaaaaaatgacacaaaatcagttctgtttatatacatacttctctattgaattattacagagtaatatttacctatcagataagatgccctaaagactaacaaactttagtatataacattgagatacaccattaagaggcccttcaaaggaaatgtcatagattccacccccgcaacagtccacttaaactaatcttctggctttccctgctacactggaaggcaaggatataaaaacagaaacatctgcattcaagtcattcaaatattaagccaaggaaatatataaaaattgatccataccaccctggggtatatgaaatctatctaaagttattttaattaacgttaatgtttacttttttacgtagaactataattttccttgtccctcttcagcttcgtggagtttacctttttaacctaagtatatttaaaattctcactaggtagaaacaagccatctaagtcatctggaccctactctaagggtaaaatgaaattttaatgacattttaggccaaaaataaataatacatgtatttatttctttatttaggagacagagtcccactctcttggccaggctggagtgcagtggcgcaattttggctcaccacaacctccacctcccgggttcaagcgattctcgtgcctcagcctcctgagtagctgggacagtaggcacacgccactgtgcctggctaatttttacatttttagtagagacagggtttcgccatgtcagccaggctggtctcaaactcctgacctctggtgacctgcccaccttgaccccccaaagtgctgggattacaggcatgaggtactgcacctggccgaataatacatttgtatcaatttttggagtaatataaattaaatatttggataattgaaaaaacatccaccaacatttggaatcttttaattgttgaagtttgtgccaatgctgtccaatagaaatataatccaataatacatacaaattagtattttctagtagccatattttaaaaaggtaaaaataaataggtgaaattaagtttataatatattttatttaacccaatgtatcccaaatatcatctcaacatataatcaaataacattatgaatgagatactttacattctttttttcatactaagtcttcaaaatcttggatgtcttctacatttagagcaccttaagttgatcaagacacgtttcagttgttcaacagccacacggggctggtggctatcaagtcgaatacagcaggtgtacacacagtcacaaatcagtttagctctacctggctacagagagattggggagcttttacaagggcatctatcagctttgcctgatcaaaaaaactggccacacttcccctctctctttcctccaaaaagtgacagaaacttaagaaatgtgctatggagatcaaatatcttacaaatacattttaaacaatagatgtaatactggaaaaaagataacaattttactttcctttgtaaactgcctttaaatgaaacatatttcatgtgaaaaactccaaataatatccagtgttcacattttcccttagggctaaagaaagaaattaaagcctccttttaaaatgtgcgaacaataacttgataagcctttctcatcaaaataagggaaaatgcatttccgggagattaagtcattatatttgacaatatagaatgtgacttatttctcttaatataatttatatttatttaaaggagtattttagacatattgataaaaaagcacttatttgtggaatcttatttctatatggatttttttttttttttttttttttttttttaagacagagtctcgctctgtcgcacaggctggagtgcagtggcgtgatcttggctcactgcaagctctgcctcctcggttcacgccattctcctgcctcagcctcttgagtagctgggattacaggcgctcaccaccacacccagctaattttttgtattgctagtagagacagggtttcaccatgttatgcaggatggtctcgatctcctgacctcgtgatccacgcacctcggcctccgaaagtgctgggattacaggtgtgagccactgcacccggcccctctatgtggatttttaaatacagaagtatcaaagcaatagatttaacttgtataaattaaattatatgtacttggcaaagtggaatatagaaaaataagtagtaactttaacatattttgagaatactcttccatgtgtacacaaatgcattgcaagacatgaataaagacattcttagcattcttgttggcagaagccaaatattaacagtaacctaatatttcatcagtgacagaatggttaaagatattgtggtatattcgtatcttgaaaactaccagcaatgacaatgaatgaattctaatggaatgcattcataggaatgatgcttcatactgaaacaaagtgttgaccaagagatgcaaagcaaaacgtgcatacagtctgattgcatttacactaagtcaacaaatgtactatactgtttagcaatgtatacaatgggcttaaagtataaaggaaaaaacaaaacaaaacaaaacatggagctgattaccatgcaagccaaaataatgattgaggcaggaatttgatggtaaaggggatagctcttgtgtagaaatctatttttttgatctagatgtttgttacatggatgcttttaaaaacttattaattataccagcaactaaattgtatgtaattttcaatttttaaagttcttttttaatgtttttaaaaaattttagattcgggagttcctttgcaggtttgttgcatgggtatattacgtgatgcttaggtttgggcttctaatgtacctgtcgccaaagtagcatgcatagtagccaatagttagatgttcaacccttgtcccatttccatcctccccgcttttggaatctccagtgtctattgttctcatctttctgttcatgtttacccaatgtttagctcccacttataagtgagaatatgtggtatttggttttctgtttctgtattaattcgcttaggatactggcctccaactgcattcatgttactgcaaaggacatgatttcattcttctttatggctacatagtattccatggtgtatatgtaccacatcatccaattcaccattaatgggaacctatacagattgcatgaccctgctattgttaataatgctgtgataaacattcaagtgcgggtgtcttttgggttgaacgatttattttcctttgggcatacacccagtaattgggactatttggtcaaatggtaattctgtttcttgtcctttgagattttcaagctactttccacagtggctgagctaatttacattctcaccaatggtgcgtaagtgttcccttttctctgcaacctcgctaacatctgttatgttttgatttttcaataaaagtcattctgatgggtgtgagattgtatttcattgtggtttttatttgcatttatctaatgattactgattttgagcattttttataagtttattggccatgtttatgtcttcctttgagaaacagacatttctcaaaagaagtcctttgacttctttttaaaggtcaccatttaatggttatttgtttttttcttgttgatttatttaagttcctcatacattctggatattagtcctctgttcgatgcatagtttccaaatattttctcccattttataggttgcctgtttactctgttgatagtttcttttgtggggcagaagctctttagtttaattaagtcccatttgtctatttttaaattttgttccatttccttttggggttttcatcatgaattcttggcctaggccaatgcctagaagagttttccctaggttactctcttagatttttatagatttaagtcttacttttaagtctttaattcatcttgagttaatttttgtgatggtgagagatagggatcaagtttcattctgctacatttggttattcactttcccttgtaccattaattgactaggatatattttctctattgtttatttgctgactttgtcaaagatcaattagttgtaggtgtgcagctttatttcgggggtctgtattctgttccattggtctaagtgtttatttttgtaccagtaccatgctgttttggttactgtagccttgtaggataacttgaagccagttaatgtgatgcctacagctttattctttttgcttaggattgccgtggctattcaggctcttttttggttttatatgaattttaggatagtttttttcctaattctgtgaaaaatgatgttgataaattggtaggaactatggtaaatttgtagattgctttgggcagttaggagattttaacaatattgattcttacaacctatgagcatggaatgattttccatttgtttgtgtcatctatgatttccttaagcagtgttttatagttttcctcatatagatcttttatctcctttcttagatatattcctaggtatcttattgttttcgtggccattataaatggaattgtgttcttgatgtctttctcagcttgaatgttattggtggatagaaattctactactttttgtatgttgatattgtattctgagagattactgaagtcatttatcaggtctaagagccttttggcacagtcttaagggttttctaggcatagaatcatatcatcagtgaagagaaagagtttgacttcctccttttcctacttggatgccttttgtttctttctcttgcctgatcactctggctgggacttccggatgtgctgctgggttcagtttgctagtattttgttaaggatttttgggtttatgttcatcagtgacattggcctgtagtttaactttttgttgttttcttgccaaattttggtatcagaatgacactagttttgtaaaatgagttagggagaagtctctccttctcaattttttggattattttcagtagggatggtaccaattcttctatggacatctcatagaatttggctatgaatctgtctggtccaaggctttttttggttcatagattttttagtactgcttcaattttattactcgttgatctgttcgggatttctgtttattcctggttcaattttaagaggttgtgtgtttctagatatttatctatttcctttagattttctttgtgtacatagagatgttcatagtagtctctgaagaccttttatatttctttgtgtgctttttgagtattcttttttctttgttaatcaggctatcaatcttgtttatacttttaaagaagcaatttttcattttattgatcctttgtatggtcacaattccatttagttctcttctgatggtagttatttcttttcttttgctagctttgggattagtttgttctatttttccagttcctttaaatgtgaatttaggttgtcagtttgagatatttctatattcttaatgtaggcttttagtgctgtaaactttcctcttaatgccacttttgccacataccagaggtttcagtgtgttgtgtttctattttcatttgtcttaaacaatttttatctctgccttaatttccttgtttacccataagtcattcaatagcaagctatttagtttctatgaatttgtgtggttttgagagttcctcttggtattgattttggtatttattgcattgtggtctgaaaagatgcttgatgggattttgattttttgaacttattgagaattgctttatgactgagaaaatggtaaatattagaatatgttttatgtgcagatgagaagttatattctggttgttgggtggaatattctgtaggtatttattaggttcaattggtcaagtgagaaatttagaatttgttagttctctgctttgattatttgtctaatgctttgatgggtgtgttgaagtttcccactcttattttgtggctatggaagtcttttcttaggtataaacataattgttttataagtccaggtgctccaatgttggatgtgtgtacattttggatagttaagtcttcttgttgaattacagagtttattataatacccttctttgtcctttttttctgttattggtttaaagtctattttatatgataaaagaatcacaacccctactgtttttgttttatatttgcatgataaatcttcatccctttactctgagtctatgagtgtcattatatgtgagatggatgtcttgaaggggcatgaatcttgttttttttttaatccaatttgccactctatttttaaggggagtgttttgattgtttgcattcaaagttaatattgatatgtgaggctttgttcttgtcatggtgttgttagtacttgtttcatagcattgatcatgtggttacttttcagtattgattgcttgtgcagttggcttccatgggctatgtgcctgcatgtagctagtactgtttttacattttcatgtttataagtttcttaagcatctcttgttggatgggtctggtggtgattaattcccctagtgattgcttgtctgggaaatattttatttctccttcatttatgaagcttaatttggtgggatattaaattctcagctggcatttttttctttaagaatgctaaaaatgcgcccccaatctcttctggattgtaaggtttctgctgagaagtccaccgttattctgatgggtttatgtttataggtaacatgaccattttctccagctgctttaaggtttttttgtgtgttgaccttggatagtttgatcattatgtgccttggggttgattgtcttgtatctcacaggggttctctggatattttatatctgcatgttgacttctatagcaagattggagaagttttcttaaattatatcctcacatattgtttctaagttgtttcttttctcattcaggaatgccaataaatcatagattcggtcaccttatataattttatatttcttgaaggctttactcatcttttaaaattcttttttatttttctttttttagtattttggtctaattgggttgatttgaaagactggtctttgagctctaaaattatttcttctgtttcacttagtctgttaaggcgtccaattgtatttttaaattcctgtagtgaattttttaattccagaagttctgtttagctctttcttaatatagctatgtcatctttcaaatcttggatctttttctgtcctctttgtgttagatttcaactttttcttgggtctggttgagtttttttttgccttccaaattctaagttctatatctgtcattccagacattttattctgattaggatccattacttgagagctactgggatcctttggaggtgacaaaacactctggctatttttttaattgccagcattcttgtgttggtttcttttcatctgagtgagctgacactttttgttgttgttgttgttttgaattggctatcatttggatgtggcttcttgatttttttttctttttttttcccttggaggtatgattgtggtgtatattgtatatgatctattggtttcaattctgggtgccttcagggtgccaagactctgtacaggttccttggttgcagataggtttggcagtggctttctcagatattgcttgttatgatttaattttgtttagtgatataattcaggctgcagtccagtagatggcacttaggagtaagagcttgtttattgcagcattattcacaatagcaaagacttggaaccaacccaaatgtccatcaatgatagactggattaagaaaatgtggcacatacacaccatggaatactatgcagccataaaaaaggatgagttcatgtactttgtagggacatggatgaagctggaaaccatcattctgagcaaactatcacaaggacagaaaaccaaacactgcatgttctcactcataggtgggaactgaacaatgagaacacttggacacagggtggagaacatcacacaccggggcctgtcgtggggcgggggaagtggggagggataacattaggagatatacctaatgtaaatgatgagttaacaggtgcagcacaccaacatggcaaatgtatacatatgtaacaaacctgcacattgtgcacatgtaccctagaacttaaagtataataataaaaaaatataaaaaagaaatgagctaagaagggaatgaaaaggtgtgcatggaaaaaaaacaagagctggcaggtagaggtcaggggagaggtaatgaagaacgatgaaaaatgccctcccccagagcatgtttgccttcagtgggggtggagcctctcgagaagctggaaaagcaaactcaaccatcttagcccaggctccccaggccctgatgggaagaggcactaccaagtctgtgacaatgcactgagggggttggcaagagataaccccctctctacatctattcttgagttttggtggtgccaccttcagtagctggtgcagtttcacgttttctttgacccaagagggcctttggcagactgtgctatcccctcctttggtgtggtttgaactgaggagtagatctccaggtaagtggactgtgcttcccttctgcctctcagacctggtgggcactgtcccccaactgaccaagggagcagactagaacactgagcaatgacactcacagaccagttccaggtcccaaagctgtctctggctgcatgtctggccacacagaagaaaccttggcttcagcaactctcctcccactctagtcctgagacagggaagagtctaattccagcacctactgctgtgggtgttctccatgcttgctgcccagttttggctatggaggcccttcccacgctccagagcaagcccttcaatgtctgatctaagactaaaatgcctgctgtggccactgctgccaggtttctaaataatgtctctaaactcccaaaatggtgccagctgtgggcttgtgaccagaggtgggtggaatccctctcaggtgagaaacatgggcaaggcactgtggcaagtgcattctgcctgagtcttggtctcccagcagctggtagcaaggtgtcaggtattgtcctagatatgtgtagaagagcctggtttccccactcctttttggttgagtggtggctgcatctgtgtcagtctgactcatgccaaggataagaggaacttagcattaaactatcaaaatatgtcttgggcctaggactcagaaaggcagggtgctacctgggcaaactttgtgggtgaaaagctgtgagaagtgcagtctagttgcatctgagtctcaccacagcctgttacagggcagtgggcattatcctagacatatacggggtagccaggtttccacatgggtccttggctgggcagcggctgcagacacatcagcctgaactcaggccaaggtcaggatgcagcccagagttaaactctcagtatgcaccttgggccgagaccagagagggcaggctaccactcaggcaagtagagtgagcacaaagctgtggggtggggagtgaggtccacacatatctcattctcaagagcacctcatagaaatgtagcaagtaccctcccaggaacgcatggccatgccccttctcccctgtctctcctcggggcagtgcagcaactgcagctgtgtctataggttcccagtgtctcagctctcaaaatggctcccagctgaggctactccaggctcaagtgcctgcggaattctgtgtgggttccctttctggagcatcatctctgtgtgagcttcaggtggctttgtataccaggcatgaggccctagtgagtcgagggtttctcccattgccaagattgtaaaagcccatgtcagagctctggatgtttctctctcactgtttccctgtgtccaggggtctctcccaggtctcaaatcggtttctggctggacaagctacctggaacctctccttacttatttctggtgcttcctgtcttttctctggtgaatctgaggattctctcctatacaatgtgttcgaaatatgagtatctacttatattctggctgttttctgtggaggaggaacatactacttgcttgtagtcagccatcttgattgtctcttcccaataaaaatggttttatgtatgcacacaattgctccaataaatttcatctcatttatttcagactcttatgtgtctcttatcacactagtagcttttttcccaaattttgagtttgtaggaaactggtaagtgtatcaagtaagtcttcattcaataagctgttaattagaatcttgaagagaccagcaccacgtggtccatgtagagacttcccatcagattcttgttgaagtggtagcattaccagtagtaattataacaattaagtggtacagttttcgcaccttaggcactctgtatgtattttacctatgtcatcttttataatctttaccatacaattattatgttaaatcctttttaagtcattatcattcttcgcatcttagagataaacctcagcttagaaaatttaaataacacgcccaagtccacacagctataagagactagaatctgaaagtgaacccagatatgtctgattccaaaaactgctctccttcctctctcttgtcctaacttcttgctctgttttgaaccattattcagcagacttcagttggttctgctataaatccacctactcagatatctccaaatggtagattcacacagcatttcttctgctcgttcacaaagatactgtaaaagattgcagagaagtaaacatacagagaggacatgtaaagtgttctcgatcttttgtgagatcatctggcctggccactgaaagagaaacttgatgtcaccttgtttgccactgaaagagaaacttcatgtcaccttgtttttctaaagacatatagttctcgttgagtgtttattacatattttacttgtgctcatatactaattgttatacaaatatatagaaattttttgagggtgatataaagatttttccatatttcatcttcttttttcctccccttttaaaaatagggaaaatacttttccacgtgggatcttgcaggcagcactcaaattcttatgatttttcagcaacttcgtattgtcttattcatagtataattggtctagacctgagtttgaattcattaaaaattataagggcagcagatgtggtggctcatgcctgtaatcccagcactttgggaggccaaggcgggcaggtcacctgaggactggagttcaagaccattctgaccaatatggtgaaatcctgtctctactaaaaatacaaaaattagccaggcgtggtggcgggcacccataatcccagctactcaggaggctgaggcaggagagttgcttgaacccaggaggtggaggttgcagtgagctgaaattgcgccattgcactccagcctgagcaacaacagtgaaactctgtctcaaaaaaaaaaaaaaaaaagttataagcgtatcttataacttacaaattatagctggagattcagttcccatgttacgattattttcttcttttccgctttaaatatgtttatagagccaaaatatggatccaaaatagactttgaacagctccatttattctatcagccatttgagttacatctatgatgtattcaccaaattgtatctatgtattcacatgtatctatgatgatgtatctatgatgattcacatgtatctacattcacatgtatctatgatcatgtattcaagttggataggcattttttctcataataaatttaaaataactgttttacattactaatttgcttttccaactctagtatggagttccacttcagatagcatgtcatctcaccatttctactagagaggaggaataatttctattgttatataataatatggtttggctgtgtccccacccaaatctcaccttgaattgtaataatccccacatgtcaagggtggggccaggtggagataattgaatcctaggggcaattttcttcatactgtcctcatggtagtgaataagtctcaaaagatctgatggttttataaatgggaattcccctcacaagctctcttgcctgctgccatgtaagatatgactttgcttcttattcgctttccaccatgattatgaggcctccccagtcatatggaattgtgagtcagttaaacctctttcctttataaattacctagtctcaggtatgtctttatcagcagcgtgagaatgaactaatacatataccattgtaggaagactgtagttaatgataatatattttcagtttcaaatatctaggaggagaatattcaatcttctcacgcagataaatgatacatgtttgggatgatggatatgccaattaccctgatctgacaattatatattacatgtatcaaaacatcactatggaccccatgaatctgtataattattatttgccaatttttttaaattgaaaaaattaaaaccaatattttatattctctcttaattcatgatttttatctctgagagggttcattttgtcaaaattatatcaaaatcatcaatgagacccaagtacacctgggagaaaattttggacaaaacaaaaaatttcccagtaagaacctttaaaaaatcctcctaatgacatgttgagtttatcgtgacctacattttcaagctgtaataaataaagtgaaagtgcaactacacacactaaaaaggtgaatctgaagagaggtttctgaggtagcaaaaaaaaagtatccctttaactcccttcctattttatttttacttcctttttaagaaatactttacaaattaaaaaagacatctgttaaatcctctccagttagcctaccctaaaattcaataagttttcatcttctgcatcttaaattaacatatgttggaaacattctgatttgcccatgttttatatttttattgctattattttagtatgactgcctaaaggaagctttgggatgtgcatgaatagtgtttcatgcaatttttctcttctttgtatcattaagactggaaatgtagttatttaagaatcgcatttgggatggatgggtagctgggagtataaaatgagctcagtctggtgatctgtttcatgaggaatgcataaaccctctttgtgcatgttatctgatgcaagtggtgccatcattattcttccttaggaataactgtgcttggttttagccacttcattttaaagtgctacctctggcttatatggtgtattaaaatagtttcgtaccataaaatagaagaactttatggcatctaatattattctcctttcctataaattataagatatgggtttttaaggaagaaaacaaaagtaccccaggagcctttcttgtgaatcttccttgaacattcaaggaagatggacccattctgtgcccatgggttccattttcctactactcacatgtgcattgtttgatttcagattgaaaacaccattttactatgattataaaaagtattcattctgattgttaataatggaaagagtttgaaaagtgtgaatgagtaactaaataaacaaaacaagataaagaagaaacaaacttatcacccagggaagtttatcatattgaaattttggtgactcgtcatccagacatcttaatactcatacacaacttaaggaacagtgtgtcatacaatttacatgaatttttgcatcaatttttcaccattagaagaaagttctgtaattcaataaaggaaacatcatcccttgactcaaagccattatgtagagttgctttactagagggtgaaaagggtagcggggaggcagagatgaagtagggataattaatgggtataaaaatacaaataaaatgaataagacctaatattcagtagcataatagagtgactatagttaataatttgttgtatattttgaaataactaaaggagtggaatttgagtgtttttaatatgcaccaaaaatgataaatgcttaaggtaatgcacactccaattaccctaatttgatcattgcacattgcatgcccatatcacatcacatgtaccccataaatatattcaactattatgtactcataataactaaaaattaaaaagcattaaatcagttgttctcacttaagggagattttcctctaagtagacacttggcaatgtatgaagatacttttcattgtcacaacttgggggctggtggtggtacagttagggaatctagtaggtggaggccagaaatgctgctaaacatccttaatgcatccccagaacagagttttctggccacagtgttaatagtgctgaggttgagaaacactgctttaaagggagccaaaacgtggatgcacccaagttaaaattgacccatgtgatataaacgaaacaccaaccccccaccaaaaacttataattttagtaaaagacgaaaagaaagaagattcagtgtaggcataacttctaaaagttttcatggttgccatgtgggaatgacttttaaaatgactgcatagtcagaattattgagttgagggactataagtaaattttaaaatgtcttttctgaaggtgagaaagcacttaggaaatatggctcagaattgcttcaaaacatcagtattcactgacggcctactatgtgctaaccacatttttcgcatgtggcagtgaacagtttatcagttccatgaaacgaaaggtttgaaatcagataatttatggaagttatagagaacatagcagtacaattatacttaactctttgttatcatcaagaggggaaccaggatgaatgcacagaaattagagaaacaaaccttagcttactacaggaagagcttcctaaagtttagatctgataatgcaatgggctatccctaagatatggcaagtttcttgtactagatacacatatagagaaatttggtagcctacgtatggaaaaattttaaaggcaattggagaaaaggtgactcttaaatcttgggaggactgtgggtgggttttttgtgtgtatatatatgtatatatatgcatatatacacacacacttgtttttgtgtcggtgttggggggatcagtgcaaaagaaaagcatgagggtatttgatttgttcaaaaattaagagtttcaagaatgacataagagccttaaacctacatccaggggattttctgaacttggggccctgtttgagtgctcaggtcccatggccatgaagccaaccctggttgttactaagctttgagattctatgattctgtaccttcctccctctttctacttctctgacaattcctttctatctccattgatggcttctttgtttgtctttgacaccttcaaatgcgggcatttcccaatagctcttcccttcacacaccattctttctttatatattttctattgatgatttcatccttttaattcccagcatcataggcattttcttggcttctgaatctacagctttacccttcagagcattttccttcatgcttccaccttccacttaagcttagtgatttggaaatcacacatcttcctatttaaaaaacaacaagaacaataataataataataataataataataataataaaatgtcctcaacattttctggaatccaccctctaccttgttctctaagctctagatccaatcaccccatctcagttttttctttatcaaggtcctcatttttggtctgttctgtaaaactttcaactagactgtagatgtcacacttattacttcttagtcaactgctgctataattgagggcctcacagcagaaccatgagcccaggctctggagccaaagatctgaatgaaatctcatttcctccggtaatgagcaaatgacccctgctgtttctgcctcatttttcccatctgtgaaatggggataaggtagtactgctatggtttagatatggtttgtttggctccaccaagtctcatgttgaaatttgatcctcagtgtcggagatggggcctaatgggaggtgtttaagtcacaggggcggatccctcatgagtggctaggtggcatccttactgtaatgaatgaattcttgctccattagttccctcagaattctcacaagagctgagttgttaaaaagaactaggcatctttccactcctcctccccaccacttgtaatctctgcataccagctccccgtcccttcctgctgtgagtagaagcagactgaagccatcaccagaagcaaatgctgtgagccgtgctttttgtacaggctgaagaaccatgagccaaataagccttttttctttatcacttgcgcagcctcaggtattcctttacagcaacacaaaaacgcacgaagacaagtacctacctcagaggtattagaaggtttacataagttattacatgaaggttacttagaacctagaaatcgttaaggctcaatatttgcaacatctctttactacttttgtttttcacattgaattgttaagaatataggctttgaagtaaacagactaggacaaaatattgtgtccatctttcccatctggtgaacctgagacaggcatcttccctggcagaacctcagttcattcatctaagcatggacatggtagttttacatttccaagtgttgtaaggattatgaaaagcttcatacatgaatacttctatagcaatgtcactcaacaaataggaatcttcctccccattctgctagtatattcttcctcaaatgcagctattatcacagtatgcattctaagaaccaaccctcaatgacttcacaatgcctgtgagataacatcctgactctttatacggcagaccctctacaatctggctccattatacctttctataaagatgttctgtacatcaaacacccattgtagtcaaatcagtctattcatcacctggaaacacaagtgatacaaccacctcaccctttgtgcttgctgtaattctccactctctccagtccttcctatctgtatgagctctgcattttctaggctgaactcaaatcacagctcttccatggcataaatgtgtatcattctatcctggcatttttcttcatctctgaaatcctgtaactttcataggctatctttgagtttttagatggcttcgttatttcttcttgtattgtggtttaccatttggaatcaggtagactgtattcagattctgctttttagctatgagcctttgggcaaattacttattctgtatgagtttcagtgtgcacattcaccaaatgtggataataataatggttaactcctaggatgtttgtgagaattgaaataatatatcattcttagcccagtataatcatttaaattttttttttagtaagcattagctggaatcattggtattgtttttattttcttatctaccctcaaacattgaaagtgtcttggagcagaagttgtatattacatactttcagaatctctctaccatggggccttttgctttaattaatttctgctataattaattgctctattatgccattttctgatttcatccaagacacactctaaatgtatatgacgaagaagcaatccctggtgactaaaatgagattgcattttctttcgatactgtcgctgacccaggtagcaagcacaggccctgccagtaactgtcataaaactctcatctggcactcagagtgctgcctgctccttagaggagcagaaagttgtcagtagggctgtagtgcaaacagtgttgaccacgttttgttgttggaaacatcatgtccaaggcaagaccatatttataatgttgccatatggcttgaataccaagttcatcccattgctctctctaaaatacagagcatgaagtactcctactaatagcactccacattgagataaaagcaatgatttctgtgtctgaaccaatctggcggcagattgaagttatatttctgcaacaccaattacctagaaaaaactttgaaaaaaaaataaagcattagtcatcattttaaacatttccaaatatactgaatatcactgcctccaaaaactttttgaactcaccttattcagagtcaggaatgtttgcttcttaatgtgaaacttccatcattgcatctctctaacttctgaatctcttccctttctgtgaaaattatatgtgtatgtcctacttcttggccatctccttgagaacaggatccatatctgacttatccccacgtcaatattagttatgacccttacagttgccaatgacagacaaacactgggatttgcctaaggtaaaaaaggaggggtgttgatttattataagaataaatggatgtcctatagaatccaagagcaaggaatatatcaaggccttagaaatagattggaatcaggtacttgaacattgttaaaaatgtaagactcttttctccctccatgtcttttttttctaggactctaattgactcatctccccaggcaaactgaatttttctacttctcagcctatgtggctgctatcagcaactcctgagtttacatctcttctataaagtgagcagtcctggttgacaggaattggttattcccagtttcaggttaccaaggaagagaatctggttggcacagataaggttacgtgctcactgccaacccagtcagttggtaaccattacaaacctataaatgtggaagtgatttcctagaaaacaagatgtagttgtctaaaagtgtaagaggtcagaggtgaggacaattcacctttcctattactgcacctaatgcaatgtctccctctcaggaatatcttagtaactcaggtggtgagagaatgaatataatctgagtttgctgcttgaacttgatcctgcatgaagacatttgtttacgagccatctattctcatttttacacttctgcacatatgatgtcttaatatgccagaaagacatggagaaataacatacatcaaaatagcatgttttagaacgttggacagttcttctcaaacctgaaaatacctgcatataaaagtgacctttgatgtgaaattgaaaaatattgtaaatattaatttaagcttctctaggtgtccaaaacatttcttcttttgatttatattttcataggaattcaaatactaagtggtcatgcattcgggacactggtattattttctttgagtgttgttttcctttttttttttttttaagattctttttcccctctcagacttgcatatgaaaagtctttccttcaaaaggttgctttcttttcccctcaatcattaggtggtggctgaatctgtgattaggaagaaaatgaaatatcattttggtaaaattccttttgaattgttatagatgtttgattatataagtttagatgttgagctcactgaaaacttctggctgctgagacatttttagaccagagtacaaaatgaagatggtaaccaggcaacatggttcttctatagttattaaaaataaaacgtgaagcttctacaatgcacaataattttctgacaagtttgtctggctttctttctgtcattgcctggagaaatgggtaggtgccatttgctgaattgattaataattgatatgtgctaaatacattattctgtaagattatgattcttggacagttatatacacatgaaagtgattatgataatttgctataattcctaaaaaaacttgcttagacatttctaaaaaaattatatattataaatgtataattgtatgtattgtaatagatacaatatccacgatctgtggaaacataaatttcaccctacattcattaggatgacatcaagctgaaataatcatatgtataatctctatgtagcagaatattactcattaaatcttggaaagctttcatacaataaatgatgacattcaaagaatggcaacaagattcggtcaactatggcaaatgtacgtccgttatttgatgtttccaaagacgtgaacatgtgatattatctgagtaattctgatatatatatatatatatatatatatatgtacatacacacacatttttacatatatatacacacatatatatgtgtatatatacacaaaagaatgtatagatgagaatatctgtgtatatatgtgaatatatttgtatatataagaatatacatgtgtatatatgtgaatatatgtatatatataagaatatgtgtgtgtggatggatggatagatagatagatagatagatagatatgctcaaattaaggggaccttgtctctcatgtttctggtactccttggatagctcgtccagggctgtaaaatggatatatgagcgatgaaattgcacaatcgtatagagtagatattcttaaccctgacagcatatctgaatcacctgggaagctaaaaacatggatgctcaggcccaacagtagaatctttgattcagctggtctggtttggagtccaagcaaacgtaatttaaaaaattctatacttaattccagtgtgtagaccagggtgtaaactgttgtaaacataagtattctgcatatacttcctctatgtcagggataacttcctagaaagaggggctctatacaaatcagtagttgtggattgttacagcactctcctggagaggagcatttgtaggtaggcatcaggtcttggcaagcactcctcttgtaatctaaaggctgtcttctaagaaaggcagatctcacttgggaattccctggtagattcttggtgattggtttagatttcccatggtcttccccagctagttaattaggctgacagcctttctgagaactaaccatcaggcttcttcctggaagttgagaaagaaatagaaattaagatgacatattggagttcagggaacagagaaaagaaattctggtggatgactgatcctttgaggcctggcttttataaaaaggagtttaaaaatataatgccttggaatctaccaatcctacggtaagtgttcagccatggttggcagcaggagcacaataccaagatgtgtgctccctggaatttagcatagggaaataacaactgtgtgttccagatactgtccctttaagatcttgtccatctcttccaacaggaagcatcttgttggtccagttggagatcatagaaagttctgaactcttttgagtcctacataaaaaaaaaaaataataataatgcaaacaagattaagccaaagacactctatatataatcaataaaaaatgtttgcaatacaccctattggtcttggttttcttgatagacaatctctaacacctaccatatttcttttatgaagatactgaacatattatatcaagctaaagcaccatgtgtttttctttggtgtcttccaagagagcatattgaaccggaacttctatgagaaccagagaacagtacatttatgttcagtagctaaaatccatgcaaaacacttaaaccaaagctctgggcatagtagtcacctacacagtgggagattttgttactattaattaatttaaatgtttctatctgagaataccactttatatacagtaaattttcaggaataatttcttgaaaatatgtcatatcaaggatagtatataagttgtatgttttaaaaagtcagaagaatattagctttttaaagcaccaagctagaaagaggctggagaccaggtttgttaagactgagtattatgattgattattattttatttatttttataattgacacataatacttgtacatattttggggtacatagtgatattttgatacacattatatgtagtgatcaatcagtaattagcatattcatccactcaaacatgtatcatctctttgtgttgggaagattcaaaattgattattgatgtctgctatggttgtagggagcggtgacatgagtatatttactatacctacttcggatagttataaataatagatttatagattacatttgtaaaaattaggtgtgtttagaaataggaattaacttatcttggagaacggctcttgtacaaaattttactatttgcaaaagactgaatattctattgaatgagcatttattttggagagataatattttatatacatattttttgttttatgtggcatgtgtctgtgttttgctttatagatgtataaggaattaaaaaacgtgaatgagctaaaaataaaatatcactcatcatctattcatcacatcatctaatatcaacagtaggttatcacatcatctaatatgtcaacagtgtgttattactattgacactgacattcattgttactattgacattgatattagataatgtagtgaatattatatatgtaatattatatatataatggtaatactatcaaagtatttttaacttttaaaatataacataaaaacacacatttttttggctcctagaatacacttctgaatactttctgtagtctgatggctgcatactacttcaacacatgtatttaatcatgtgttttggggacatttgcagtggttttacattttcattgttctagatagtgctcaaatgattatctttaataactacttttaaaagaatctatcggccgggcgtggtggctcatgcctgtaatcccagcactttgggaggctgaggtgggtggatcacgaggtcaggagatggagaccatcctggctaacaaggtgcaaccccgtctctactaaaaatacaaaaaattagccaggcatagtggcgggcgcctgtaatcccagctactccagaggctgaggcaggagaatggcgtgaacccgggggacggagcttgcagtgagccgagatcacaccactgcactccagcctgggcaacagagcaagactctgtctcaaaaaaaaatcataaaaattattaaacatacataaaaatagaatgatacaatcaaatcaaatgaattgaaaacccagtttcaaacattatcaatattttgctatcaggctttaactttctctcctgaatttttgttgtgatggggcattttaaatcaaagctgagacattatgtcttcttaactaaaatattttagaatgcatctcacattgctattcacatatctggtaaaactaataatttttaaaatcacctagtgctttaaatgccttttcaaaaatgcatatcctttttccattaggataaataccttgaaacatgttgctagatcaaaaaatttgcacattttttatagctttggatataggttggcaagtgccaatatgtattgcagtcaagattgcacaatttagtgtgacaattacactcactgttagtagagggaaaaaagatataaaaatatgggatgtcattaatacagcatagtgtggaaggaggaagggtagaaaggcaagagattagaaaggcaagaaattctaccaacaacaataaaaacccaagcctggaagtaatgttgtaatacctgtgagggaccagtgctcttgagtaaaacccttaccacatttctgcacagaacatttaatcactaaggcaggggttcaagttggcattgccatgaggtagggtagaaggaaggatagcaggagcctccactgtgcgcttatttatcacccgttccacgccctgtggaagcagcctgtggcctccaggtagatgcctcttcaagtctcacctcctaaatcatcctctagagggatggtcattttatgtttcattctactgaccttgtgcatcttgagcagcctcaaaacaatatgtatgtgggccattaagctcacatgactgcacatagcataggaaaatgataagaggctttcaagggtagagggttgttactttacagtgcctcgaactgatattaaaactgcttaccttaacaaaaggaaaggaacctgcatttactgaaccattttaaaatgttggtttatccttcatactgaaaattttaaaaatcatctgtaaggtatcctactatccttaatttatagatgaggaaaagtaggtgccgctttaagtcgcatttggaatatgtgaagaaatgaatgaatgaatgaaataataagcaaattaaaaagtatagtttgatagcaaaacaaaagtggcagaaatgtaagtgatagacttagcataagtcaagttaaataacatagccagtagttggcagaggcaggattcaaattcaggtctatctgactgcaaagcgaggcttttcatgcatagttcctagtgttaaagtacaaagtttcttaaattttttgttattgttctctcttttcctcaccttatatgtgtgtctgagataattttctattaagttagcttacatttacacacttacatgctggacactgttctaaaaactacatatattagcacatccgatagttagaacaatcctatgaagtctatattatcatcgtccccattttatcaattgagaaacttcgaccggttagctcatttgctcaaggtcatctagctagtaagtgtcgaagctaggaattgaaccctacaattctagtttcagagtctgcttttagccgttaaactatcaatttaatatgtattgtttatatctatatttattcccatataagtatattcggattacataaatgcccttctgtttcccaagcagtttaaagggataaaaaatgacaggcactctggtgttatataatatgcaacagccctttggagacattttgtgcaataacattgcagacattatttcctctacctcatccataaacacttcccgtgagatttttgttctttgtggaataattttcgttgcaataattcttatttgttttctcaaaaataatggctggtttccacctctctcatcaatagacacaccaaataatttgtgggtgcatctgagagcctagactcctctcattagatcaataatgatctagccaagccgatttacatgtctttaacttcaatttacatcagttaatattgataggaactggaatggggaaggagaactgagtccctggcctccaggacctcaaagattctcaagagaggcagacaagaaactgacacctgtaacactgcgcaaatgctagcggggctacctgcggaacatgtcctgagagcgcagcacatggcatagagtcgagggtgcaggacagctagttcctacaaccatgcaaaattccccattttgcagacagaaaacccaaatgcacttgctgtggttgaatccatgcagtgcttcctcatatttcttgtgggattatatgttaaattcctaactaagattcaacttgatcattttccaaatatccaactggttgctgtttattagacaattattaaaacgcattgttttgctagtgatttgaaatactacctttattctccactacattaaattctcatgtgcaattgggtctagttctggactttctgttctgttccaatgataaattgatctgtttatttatgtgccaagactactgtttttcaataatagtgaatttaaaatctgaatttaaaacctggagcttgctctcgtttttttcacttccttcccccaaactaccaaacactcaggtatacttgctcttctttttcagcattctcttggttctgatatttttctgtatgaactttaaaagcaacttgtctatctctaggcaagaaaagtttgtatttttattgagatcacacaaaatctataaattaacttgaacggaattgacataagtgaaagcttcaacttttcctgaaagacaaaagccctgataaatggaaagatatcacttgttcttggatagatgttctctctctttttttggggggtggggggtagctattttaattgtgctctttttcactgtgtctctaagtggttattgtttgtgtatataaagatggatgatctctctgtgtaaattttatatcctgctgctttcccaacttctctgttttgtgtttgttttgttttgttttgttttgttttgttttgttttgtttttgagatggagtcccgctctgtcgcccaggctggagtacagtggcgggatcttggctcactgcaacctctgcctcctgggttcaagcagttctcctgcctcagcctcccaagtagctgggactacaggcacatgccaccacgcccggcgaattttttgtatttttagtagaggtagggtttcaccatgttggccaggatggtctcgatctcctgaccttgtgatctgcccacctcagcctcccaaactgctgggattacaggcgtgagccactgtgcctggccaacttccctgtttttagttgctttttcaaggatatattcttagaggcctgaaatagtatttctcatttcagtgaagtttttagattcctcaaattgcctcaacagcacatgagagagatgcatttctcagtggtgggaagcttgtgtccaccctgacaaccacatacagctcaaaaatgagaaatgtagcctaggttaaaggcagtcgggtggtgaggaaatactgtaagctgaagagctcaggcctacctaaaaggaatatctattttgtgaacacatggagttggggttcggtgttactagatcttctaacttaataagcaaaactagaaatctggactttcaagtaaaatcttctggctttgaagctgattttaaaagtattttggggctgggcatggtggctcacgcctgtaatcccaacactttgggaggccgaagcaggtggattgtttgaacccaagggtttgagactagcctgtgaaacatggtgagatcctatctctacaaaaaaaatacaaaaattatccaggcatggtggtgcccacctgtggtcccagctacccaggaggctgaggtgggaggatcacttgagcctggtgggttgaggctgcattgtgccatgtttgagccactgcactccagcctggggacagagaaagaccctgtctcaaaaaaacaaaatatatatatatatatacacacacacacacacacacacacacaaatacacacatacacacaaaaccaccaccaccacacacacacacacacacacacgcacattttgtggcaaaagagaaaggacaagacaagtctatatgttaaatatgccctacaagccaccactttgtgacatctgagaacaatgttatcatttggaccaaagagaagctagtaaggtatataccacaacaggattttttatttactaaggtgtattcctttcctaaggataacataaaaaatggctacaaatttggtgctttaaaacaacagaaatttattctcttacggttctgggggccagaaatccaaagtcaaggtttcagctggtgccactgccctctgaaggctctaggcggagtagcctttcctgtttcttccaggttctgctggttccaagcattcctaggcttgtggctgcaataccccatctgtgttcttcttcacatctccttctcgccttctcctgtgtgtctctcttctgtatgtatcttataaggactcttgtcattggatttacagccctcacgaataatccaggatcatcctgtcaagagatccctaaattaattttatttgtgatgtaacttattgcaatacaatattaatatattttccaaataattcacaagtttagggggttaggacatggacattttttaagagccaaatttaaaccactgccataggttatattatagaaatataaaagggcatgacacaactatgtagggtttaaaaatagttataacattaccacccaatcaagaatactagcagaaggatagatgccccaacactctgtttctgtccaccatatgtctgtctcctctcttgtaccaccagaaataatctaattttttttagaatatcctacttttactgtaataatttcaatgtttttctttgtagttgaaccacatatgactgcctcattaaacaatgtggcttatttctgcccaattttgaactttatgtgacataaatgataccgaatgcattctttattttctggtttgcacatttgttatgagattcatacatgtttttgtgaacagcatttttttctgtgtatttcataggcatttgggttgtttcagattgtagttattacaggtattaccacactacacattcttgaatgtatattgtggtacatgtgtgtaaactttctctagtgcatgtacctagcagtagaatggctggtttttgaagaatgcatattagcaatgttagtagataatgctggcctattttttaaaatttttgtacttatttgcactctcagcaacagggaattcctgtttctcaccctaatcaatgcctctctcttctctcttctctcccctcccctccccttcccaacatcacctcttttcccttttctctttttgctctctcctctctcctctctctctctctccctctctccctcttgtcatttccttttgttctttttattaattgcttcattcactgattctgttagtgtcatatgcctatgatgtgccaggagctttatttttctgaatcattgggccattcttactaagaaggaagcagaccctctgtttataggctggttgaaatgaagccttgggtgccccctggcacctcggccaacagagatgttctaatctccaatacatgactagtgttgagaaggcagccatcaggactcctggtcactttctggttgccacaggaagcgccatcaatatctgttagctcccattatcctggcagagcagacagctgtgtcctctgaccccctcttgacattctgataggtttcccttcataccacacacttgcaagagcttttactctctctcacctggaaaggtcacttcccaaatgagacgcctgggataataatgtttctcttgttttgcagtctcttgtctcagccaccaatttcaaggggtgtttgagggcagcaacccagttaaaagaggaaagaaccagattggtgtggtcttcacaccagctaaagtccatttcattttctctatgttgttctaagtttgctttcaagattacaggaatattgctcaacatgtaaccaatggggcatttgcttcagaagcacctggagattaatttttgaaattaaatttatctgtctaataaaaggaacaatttcataataaaaataccatctgccccttataaaagaatgatctttttcctttaacatgactctgattctgtttccagcgaaccaaaactctggccttggtgccttggtttatatttaaatacctgacaatttaactaatagtaatgctatatgtgttcagattacttttcttcttggctctagtagaaagtttagaaaaaaacctcaattcactatgacacacacacacacacacacacataattatattaatagagttattctaatttctgcttctacccctgactttccctctgttccaccttggtaactgtatgtcttgtattggacagcctattcctaaaacaagataggtagaatctttaggttgcaggaactacaatgacagaccaagagtgacggcttgatgacttcagccagagggaaaactttaaaccattctgtatcagaagctccatagccattaataaagaagagctatagtgtgtgcctaacccagagagctgccaagtatattccaaggcattgtaaatacatggctacaacaagatctctcttaaaaacttaagtctctcgtggacaattttattccttgtgagcgaaattgaatagaggcaaacttcaagacttaatttattttttgccctagctataagaataaacagactcttagatcctgaaagaatctgactcagctaagaggaggcaagtcagcaagaagtaactaaatggaataatatccatttgacctctgcttctgctgctttgaattgtctgagaggagctccatttttgaaactggctttggctcaggactatcagactgtgtagtgggttttaccgttttgattgacttatccattccaatacctgaacacatgattgttttgctcttctacctgtcgaaccacccagttgccctgtggaatcaatagctgatacagtaagttggtgatggagcgtctagtagagaaagagaggaaatggcttggtaagtgggccatggaagagcttcatagcagtagttgttgactgttggtgactaagacaatctgctagggaacttgaaaataataataataataagactcagatactgcctacctcaatgagctggactctgtattctttatcaactctccaaatgatgcaattcccaccaaaatgtgaaactcactgccctataggatgggtgtcagaaaccagggtctggaattaggcagatgtaggtccaaattcttctctaagccttcatttttaactttagagtatggatctgagactacctacttcctttggttgatgtgacattttatgagaaaatgtacataaaatacttcttatttttgtaattgtaatgattattccatttttatggccttacaggtaagggaaaactttgaataatttaagtatttgggaagtaagtccattttttctcctatggttcttgatcatagaactcaactttataagtttccaaagtttttccattgccacaaacaagatactgtgggggaaggagatggtgtagtcttcattgttgcaggtggattgaaagaaaatcgtataggttaagtatgtacctgctcatggttccatgactgagtgagattcatagatttgggatttgagcctaggccttgggacactgaatcccgtatctttttccactctgactctcttgcaagatcttatgaccccatacgaacatttaaagtcacactgtcctaaagaggaagctagagagttcctggcgtcctcgtccctgctcatctggacactctttatacattggattgaggtttatattggactcagttcacctacaacctcttcaaaaacttttccttctaatttgactagaaagtcaattacataatgggatattgctaagtgaaaggaggttcttaaaataatattcatggatcaggagctgacatggttagggatgcagaatgtggcataatggttgaccttaggcatgttactatttcttataactctgttttctcacctacaaatggaaattatgctagtaactacctacctgtcagattgaactaggaatttagtcatggattaatgcaattagaatatttttcctccttctgttaatttttttttttttcggtcgacacacaagaggatccaattcactgaaacaaagaaaaaaaaagtcacttttatttttatttctgaatgtgccagcagtgccccgcaagcaatgaccttttcatttaactctgtttagggtttgatgcctactttacgtcccgtacacttgaaaacaacagaagaaatgtatggtttgccgaatactgggaggaaaacttcaactgcaagttgacgattagtgggtcaaaaaaagaagacacagatcgcaaatgcacaggtaatttaattctcgttgtccttctcctattactctacgtggctagcactgacatgtctgcatagctgacagaaggaagcttggctggagacaaattgaaaaagtaaattaaattttactagattgttcagaaaatggaacaggagcatacgtcttgcaggacaaaagacatacagacaagaatgtattcttttctgcctatctagcagtaattgacattttcagtgattctttgaattcagaaggggtcatgttgctttgaatcctcttgttcagttccagccaggagtatgaagtcattttcacatagacaaaattctctgacaaatcccatgccattgtcggatttaactgttaccatggacagtatacttgattaaggaaacagagtgattgggtttagaataatgaaaatccaaatgattttcattaatgtctaagttaatgagttacctattatttaaaatattcacggctccttatatgtaaccttgtaaatgaaaaatatctgtgaataagtgagaagaaaaatcacacattcattcatttattcactcacaaatatttactgagtgactcctttctgctatgcactgtgctaggcactggggatctggtggtgagcaaactaagtgagaatcctccctctatgttgcccagagtctggtggaaggaatttgactttattccagtgatctcacgaacgaattcataattacaaactgtaatccatgttctgagtgttatgagggcatataactaaggaagtttactaatgttgaaggtagaagctgtctcaaaagacccttttgggagaatgatgcttgagtcaagataaaatgaagaaatggacattggctggttagggaaggaaaataggttggagaattctgattaaacacggtaaatggcttgcagtaggaggagtttttgtgtttctgaggttgtgaaaaacagaaaaaacatgactgaagtacacagaacagagagaatgtgtgagccaaggctgcaggtgtagagagatggtccagaactaagtcattttaggatgtacgtgggacttggcttttatcctaagagcagtggtaaccatggaagggtgttacacaagcggatgacatgatctaccatcttatcaactagacctctttaaacatcagcctttacaatttgtagtgatgaccttcaggtatactaatgtaataaggctaaatgttttatatatgatcaagaaagacacattcatgtgggacacagttctgcctctagtctctctttgtaatgtagctgtttgaataccggtcacccacatgttgtagattaatccactcaaccatcatctgttaatcaggtaatacatggtatcaggaacaccatgaagtctttgggggtgcttaaatgtagtctcaagaagttttctgtgaaaaaggagaaatgtacaacatatgaccagaaacatgaataacaataatgatataaaataagtatgatgcatatattaaaggtatcattcagtcaactggactatcggattcaccacattctccagatcatgctatataacaatagttctgagatatggtccctagaatagtgggggaaaagggaaaatattaatttaatattgactagacctaggcgacacaaagctttcaagtggaaactgaaaaaaattagcttgacatctggataatttgtctctatgacagggtacattcaagtgcaccggaagtatgtagatgattgaagacagttttcctgggttctttctgacattttgtgttctgtagagtgtctggaaggtggaatcggttgatggacgttaggattgtcccactctgaggccacacctctgacttctatgagcttaaacacaggctgttttatgtggagccatgcttcaggctgatcattgagaatttgggcttatacaaactagtaaggtcattatgcaagcctctaccttacaaaaatggaaatagaagtgtttgtgtcttcctaactaatatgtttcttccatgtgaatatttataatcacattcactaaattataagtgtacccaaaatattcgtatattctcaccttcctttttccttcctcatcactttctttgtgatgagctgtaccatatggaatggaggtagatactgttaccattaccgtatctcttactcttccacctattgatatggtggtcatattttgtttgttttccttgtccttcctttttccaaatccaaccatatgtacatctttctttgatagtattccaaaaaatactatttaaaaaatctttacatgtaagtatacttcaatttggaagtgaagaatcagtgggaaaggtaacctggttgcatgctttggtgactagattttaaaacactagaacaggcatgttagaaagggcacccagatgagcaggctagctgagtagtctgacactgaagatctgcgctgtgaatacaatgaatgtttttatctgaggactgtagaacatagcccccttcacagagctctctctgtgacttggctctgctaaagaaaaaggaagtcttattaatataacattcactcttaagatgtgagcacaaattaaaatgtaggccatttttttttcttttgggctgggtagcctccttagccatactaaacaatatttgttatatattagctgcaagtagaccaacactgaatcagccatttgacaagttttaaagatgagggatgagacccatactatttggagagagcaaattactgaggtcagagtatagcaatgagttctaaaatcacaagaaaatgcaaagtcatgagaggaataataattattgaaaaatattcattaagaaacatgagataagctgttcatacttcataattttacttggggctagatgtgcatgaattcttatagaaaatgacctgaacaactatgtaatctttatttctgtaaattatccatgtccacctaaagtcttaaagaaagggatcttaccgcattctttagtatttcaagaacatttccactttccttgataccaaatcccaagatgtgacaatctgagagctagacattcttcctcttaccttccttcagagtagcctaataaccgttgatatagatcaggcattcgcagtgagccatcctgctcatgggatatattgggtgtaatcactcagcgtgaaatgcagttcagcaagtatgtggttgtccaagctatcacagaaaacacaacttccatttgacaggattaatgccattcatgctgcttcatagaagagctatgttttctcatggagacaatgctagatatacacatagtcatctcttctagagagtttaccacataccattttcatttgcaggcagaaagatcagatgtgatttttttctgcgttgtatttatgttcccctacccacagcccaccagctgagtgtgttcacccttgagacttgccaggatgctgctggcacaaagaccagtttagagtatgacctctttgggaataatatgtttcaatggagatactaagggtcaatgaaagaaggaacattacacaaatgaagtgacatctctgcaaaaagagattgaggccatcttggggtcaggaacattataccacagtggttaagaaaccattggttttggaatcaaaaagatctaagcttctgttctaaggacatccataaccacacatgcctgtgagagcttggataacatgtttttaacctctcaaagccatttcttatttttgaagtgagaatagtaaaaccttacattcaaaattgttgagtggattaaatcagttaatttaaataaagggtctgaaattttactagcacatagtcgtagctaacaatggaaattttctgctcttctgggctgaattcagtggcctgtgaggaattcatgaagatctttttgtctgtgtcagtccttagagatcaggatgtatatcaactccaatcagaaaacaagtacgtaagtatagacaagaatttttactggggtgcacactatatagggtgatatattgagtatcaaagagtttgcagacaggcgtcatgcaatgttatgctatgagtgaaacatgaagcgcaaggcttaagaaatttcggtgctttaacacagagtgtgtgtccaaggcccaatgacatttggacacagagtgtgtatccaaggcccagtgacatttggacacacactgtgcattatagagagcatcatatcccaaagttttctcattttctcctgaggagctgtgtccttacatagctaatggcatccccaagagtgtaacactcaacatctcatatcccaacatttgctcatcttcttccgagaagctgtatccttacatgtctaatagcatcaaatatcttagctcccaaatgcattttttaaactcagaaggaggttctgagaacctgaatatgtttgcctatgactgggcaacatcttatggcttatcagtcataactcgtgacttacccagaacatttgtctaactaatatcactgttctatgaaataccacttggtgaatactgattcattagagttacctccttgctgaaaagcaggaactcagcatttacaaatccatcatctgatgatgggacaatttaacattcagagatttgtttttctttcgcgatgacagaagatgaataaattggtgacatatattttttgtaacaagccttcatatttcattgctagtgctttcaagtcacacaataagcaaattcagttttgatttgtgtccctaatcagcccctgtttactgtggaaagatatcaagggctaaagagcgtactctgataaatgtctacattttggaaggtcagaattcttaagctgtgtttttctttacacctcacttctcagagctaatagtttaagtcctcttttcagtggagctaacaaaaagcctgttgataaacgctgttaatgaataaaccatgtatttcttaagtcttttatttttaccaggacccaggctcattagagcctatataattcgttaacaagactgtcaagacaaaggaattacgcttaaagtcaagtgctcagaatatatgtgcagaaataattgatgattatactgattagtttttttatactcactgtcattttattattctattctgaattgacctttaattgtcacaaagatgttttattgcagcacctaatttacttaacatgattgaggaatccacaacaaaatgttatagataaatagtgtctaactctttggtactctaagactttttttgaaaccgttttgatgagaagcaatgtcaaatgcatttttacacctttgtgctttcttaaacagaggcttgccacagattaatgatgatttcatctctgtgagcatgcataggattatgtgttaatgtggttctttgttaaatttttggttctctgactcatctctaaatatcggagtcttggttgacatctctcttgcttccatcacccttaaatcttcccctacctacctctataaatggcttgtttctaattgtgggaactggaaatgtatcaaattattaagaatctttgctggttaattaattcatttatttaaaaatgaatgttaaatactaaatccttacagaaaggctaaggtatataactttgaggatttagtaaggcattctctagcaactgtttgggtaagtttgctaataacatttagatacatggaataccaattaatataggattcttcaagttaaaatggtctgaatgtcacatctaaaatcctcattgtttttgggacacctctttaaatcctttttggaatgtaaggtattgaataaaaatgccatgcccataaaaggtaattatatttctagacttcagtttttcatgtgtaattgttaaaaatagactttagtgtaacattaaatcatagtaagtgtcatgctaactctatgggtttgcttttaagtcacttaaatatgaaagtttatcttcttgtattatttaaaaatcaataaattttgtaaaggcatttaagaacaaaaatttaacctcttttcaagggaagcatagcgccacctatgttaattgccaattattccactggataaatctgacagaagataagcaagatgattaggcaatgcttgattctgagggcaataattagcatagccttctgtatggttgtgtattgtaataggtacaaatctcagatcataaaattgctagtgcaaaaaaatgaacttttggttgttttctataacttcactttgtttttcaaatctccatcctattgttttgtagaaattcaatctttttaaaaccccttatcccacatggtccacaggcctggaccttagttacaaagagatttttttttaaagcccaggacttgaaaattatttgtgaggctttgctctgatccttcggcgtgcatgatttttcactagccatgaatccatcttcaggaatgcaccttgtccattcctgcccttagtagtgaagatgtgaaggctactgcagcatggactcttggtcctgacctcagggcttctccaggtacaactgtggttttgatgactccaggtccttcctgtgaccatggttgctggaggttctagagcctaggagctcttcagttttttgttttcgtttttgttttaaaggagtaaaatacatttttaatactgtatttttaaaaaatagggccaaatcccaggcaacatagcaagaccctgtctctacaaacagtaaaaaaaaaaaaaaaaaaaaaaaaatagccagaagtggtgacacacatctgtggtcccagctgcttacattgggaggctgaggtgggaggatcacttgagcccaggtagttgaggctgcagtgagctgtgatcatgccactgcactctagcctaggtgacagagtgagaccttgcctcaaacactcaaaaaacagggccatagcagtaaacttttgctcagtgttctatccctttagatcagggcagtgaacttttcctctcaagggcaggtagtaaatattttaggcattatgggtcaggctgtttctgacacaactactctgttcccataacacaaggcaaccacaatatatgtaaacaaatggacaataaacaaatgatcccttgctttagaccagcgttgaccaatggaaccttttacaatgacggacatattttattttctgactactgagcatttgaaacatgactaatgcaactaaggagctgacttttaaaattatttaaaacgtaaacagccacatgtgcctagtggcaactgtactgaccggctctgcagagcctaggagctcttcaggagcttataccagcatttaacttttacatatcccgttagtttctcccttctcatctgtcactcctgaatgtcttgattacaggctgggcgaggagactaatttagatccattcatatccttccattattttttgtatatggcatatgtttcatgtccttaatacttcagtatttttgaagcacagagccaagtactgaccatataacactggcttttagaacacaaaggtcagtcctttatttattattattattttcttttttacttccattgttcttctgtgttttattataaccatccttcccaaaagcaatgaagaagagttctgaaactaccatggttagaaaataaatggtggagaggaaataaaaggcacatttgttgatatattaatatgttagaatattaccatatgacactaaccgaagtacaagcaaagtagatggatggcaacccagatctttgattttactcacaaacctcattttcccaaatcttgaccagatgcccaagtggaggctgaatatcttcagccttatgaaatagaggtgtatagatggaccctgcagtaaataaatttttccttcagccaccaactcttcaaagcataaaaaggggtctctactgaatgccattttaattcagagcacactccctcagtttttttcctaccatacagcactttaagtcacccatagcaactgtgtttaattctgtgcagaagcaagccaaacagtgaaacaccaacttgaaatcccgggagtattcaggcaaagctctttccataaatgctagaagccataattatttgagctgtgtgtcatttctttctcattaactccaacaggcaacgtctttaaaattgggagttatggcctttccatattcagaaagtctgtcaggcttgcctgttaatgagaaggaattcctgaactagggaaattaattcatatgcatcttctcagcaacaattctcgtaaacaaagtgcccttataagcaatagaagtattataaatcggatgcttagagtcattttagtaggtagaagaaagggttgtggaatgacttatcaagtatcatcaagcaagttacagtagaatatagccttccttagaagagtttctagtaatagaggctttctgccccccacccccacccaccaaagagaaatatggatacaaaaagcattttaggtttttatgggatgtatagcatcatatttatttttctacagaataaaatgtgatcacaaaataaatatcaactatatatatatctccagataaaaactttctagagctattctaactttgtccccctgattctgtgaagaggagatccaggtatgtgggcgaacacatatggaggctgctaattttttcattctcatctttaaatagtatttattgtttaccatcctgggcactgaaagctgggtgctggctttaagtacagcctcactgctgtagaaacacaatattcaagctgcctgcttcagtctcactaatttgttcataaaagaagttaagacttgagtcagattccctgggtttgaatcccagctgtttctgttactgtgtcaccatgggcaagttactcagacattcccaacggcctttcccatcccctcatctgtaaaggagggataacaacagtccctactatatgggctcattcacaagaattaaatagagcaatacctggtagggatagagggcgctcaaccggtttaggtgccattgttgtggttgtctttgttgatagtggtgattgatcctacttttggccttcgtttaaaaccaaaaaaaaaaggaaaaagaaaaaagaaaagtcagggctcctccatgacttaagtagcccatctttcctttattttcatataaagcattattcttcctttaccttaaatacctgttgccttatatcatgctaggcacataacaaaaacttgtatgtgtttacgttattctagttgatccccatatcagccttgtgagatagtcagggtaagtaatgccctgtttttacaggttaatacaaaagaccagaaccttggagacactttgtgacttctctgagagtatagctaccaacgagaaaaatttaataatctcaacaactaagtacatacactcatttaatcatgtactctgtcactcatttaattactcaacaagtgaatgacaagtgagctgcactgggccagtttctgtgctgagccagagaacacaggcaaggtctttgctttcagggagcttttattccagtacaggaggcagaaagaaaaccaaaagcagatatggaaaataattacaagttgtgattagtgctgtgaaagaaacaagtaagacgctgagctagaaaataacagtagacaatttttccaggaatgtgtagtcagcagagatgatcacaacagccctgactgtccatgagaggttattatttccattatacacgtgatgaaattgtggttcagatggatcaacccaatggtacatagagcttatttctccctatgctgtttctcctctcatgcctagttgcctcccaagacccttggaaaactgaacacaaatagatactttctcatttttcggtaacttcgtagttttgcttctatagcaatttcctcagtctgtgacacccaggcacataagggctcgtagtagaacatgtttgataatgatcctggattgatcccttttggtccgcactgataaacagctgtagtggagaagtgagctgaccttgtttcttttctcctttcttgaaattaaaatagggcagtattttccagtttatgttcaaactttgttataatgataaaaagctagcagtctgtacaaagagaaaagacagagctcaaactccttgttcagaggcagcatagttacacaagagggaattgtagccctgactataaaattctctctgaatatatctcatttgcttgggaccttctgtccatttagggtaggccaaacacaagtcggcagccttgttaaagcagatggtggagactgaaatagtgtgaaaccaaggtggtacaaaataatacctttaagaaactcaaaggacttttggagtagcagttgtaaattgagctaccaaagtggtccaacacactggcagaagtgggcaatttactatggaaggaaaatgttggattacaagatgctattgcttttttattagagaaaaaatgcaatggttacacacaggttctggtcaagtttataataaatagttacattttaaaattaaatttaaaaaaatacaaaaaagaatacaaagaaaaagatgccaagaaccaagctgaaatggttctccttttgtgctgaagtgtacagaaatcactatgacaagtagttattggacttctaatgtctgcctgtgtggctgttaacatgactataaatcacgcttccagcaccgagtatatatcaatagattctttctttccttggatgagttttgagattgccaaataagtgttactgagctttaagaggcactaaaagtatagattggtgctatttttaacatgtaaaactaattcctcaacatttaagacatttcagtggccatatcatacgttctttctttctttctttctttttctttttcttttttttttgagatggagttttgctcttgtttcccaggctggaatgcaatggtgcgatctcggctcaccacaacctctgtctcccgggttcaagtgattctcttgcctcagcctcccgagtagctgggattacaggcatgcgccaccacgccctgctaattttgtatttttagtagagacagggtttctctatgttggtcaggtttctacaagactaaaacctcagcatggtctgtagggcacctggtagcaaggccctatctcatactcctgggactctgatgttctagttctctagaggtgtctgcatttttcttgccacagggcctttgtatatgctgtttctctgcctggattttttttttcccccaatacaacttttgacaatcactcactcttcacatctcagtgtcacctctttaagggagtctccactgaagctcccatcacgatctagggcaggttctttactgtctgctctgccaccttcctgtccttctgagagacacttgcctgtttgtgacactgtgctcctcagtgtgcatatgaggtgaatgtctctctcgtacttggcttcaagctccataaaaccagctgctcacatatctgtggatccccatcttcacatccccagccctaggccagtatcaggcttacagtaggagtttaacaagtagttgttgaggaactacttgttttggaactacaagtggttgttgagaaactactaattttactttccaggcttaaaaccaaaaatctgctttgcataaaacatttcaatgcaattgatcagattggaggagaagaaggagatgatttgtgcttgtgtttccctaaaggtgctcagcttgctgcacttagaacactgaagcagcatcttttgctggaagactatcctgggcaaatggattgaatcagagactttgtaggatcttttgggctgcatgtgataaatgtttcagaagcccattatgttgttttccacaagacacaaaaggaaattagcaacatctgcatatatttgaattgacaagtgttcccactttaaggaaaaatgtgaaaatcccaaaattcaataaactgtaatatattagccatttgttctttaaaatgaattgacaggaatagagaactaagaaatgtattggtctctcagctttgaccacatcttctctgcattgatcattgttacgttcagtgctcttatgttatgctcttatgctcttatgttatgaagaattattgcattttatgtgttatgaagaagaaattgcataaagggttaaaaccctaatagtaaaaataataaaataacccatgcttactgggtactttcttaaatgatgatgtctcttcctgcaaatacctattcctgtaggtgaatacaaatcgaaataaataaaaatttttatatttttggaagttttacactgaagattttaattttgtccatctttttaaaaagtacagtaagcaatatttgttgaacactttgctatgcattggtcactcacttgagcactttgcacagatgatagtgatcttcaaaagtcccacttttatccaccagttttagttgagaaaggtaaaaccccaattgatcttttttactcccctctgagatcatttttgctattttataagtgagtaaatggaagcgcaggaagacatagcaatctgcacaaggtcacacagcacaaaatggcagctcagggtcagcgaggttaatgacatgacaggctcatggtcagtcgctgattagaaaatggcagagccagaatccaaaacaaggtctggcagacttcaaaaccttatgtttctttttgtttcttttgttccaaactgtccacctgggttgagacccctcatagggaaaatgatgtgcaaaacatttaggacccagcaccagccactacagaagcaaagaaaagatacggagtgacctatatgtctgtaggcttctgtgttttgggacagaaaacacgggtttctgaaaggagcttataccattgtttctaaaaggagctcattactctaggctttgtgcttttttgagttggtccaccaaggagtgtgtctctgccattcaatgactagttattttgttatccaagtgtagggaaagaatgtgggcaaagaaaagactgtccttgaaaaagagctttcacttctctggtggagaaaatttgcagaggtcgtaaatctgggagagtgcctaactgtggctcaactttttttctcctgggacagcctgtttgattgttcacctgcttttaatgttcttgtgatttcaacacaatagtgtgtgttctttcattaaaatggtgaatgagatctcattcactctgtactattaatgagtgcttactcttgaaaagtgtacattcatgagtgcttactcatgaaaagaaagaactgctcatgatatcacttgggttgtggtcctggtcttgtcactcatgggaagatgtttgcctaccatttatagtcctgtgtggtccttaacagccacacagtcagacataaggtgtccaataactacttgtcctaatgatttctatacacttcagcacaaaaggggagaacttacaatgctagcacaggcagaacccccaattctggtaattctgtgaccccagaataataataagaaattcaggtacctttaaactgtattttttatcttatgaaacatacacactatatctgttgttaattttcttcattaaaatattatatgataagccagtgacttcgtatcctatcgtttgcagaaatttcactaaaattatttatgaagtttgcaggtatgtttaaaacacatcaggacataactcagtagctcttgcttcttctttttgaggggaattgctttcttgggatgcatttctagaagttgttaaatggagtagtaaagaacaaagacttggaaactaagttgccttaaatcaatttcaattcctgcctcattagctatgaagcctgacacaagtgactttgcatctctgtgcctgttttctaatttctaaaatgttgacgataataataatgatgatagagttttgtttttttttgttttgttttatgttttaaggagaagcactaaatgagttactacatgtaaagtgcttagtccaatgcctgacataggaagcctgtggtaaatgacaataaaatgcacattacctatttttatcattactgattcagagtacaaacatttttggacaattgaaatatattgctaagccgttttctgaaagcactctactaatttattcagccattggcaaaactactaaaatgttatctctattttgatttgtatttcttggaaaacttgcaaggttgaatatttttccatatgtttgggtatagatttatcttttttatgagatgcacttgagagtcttcaaattgtttttaatacccctgtgtcatttgatcctccctacaactcagtagagttggcagagctggtaatatttacaatcgactacaaagaaagataaaagtaaagttctcggaggtttgttaagtggcttgccgaaaagtcacttggctagcatctggcagcactggaatttgaaccaaagtattttactctactcttgtaaataataaacaattatacatagaagtggcatctccctggcattaaagagttaacacaatttaaaaataaaacataagcaatgcctaatttttccttgtaaaaagtttaaacccttagggaaatacgatttaaacatcttataagctgtttcctttagctcatttagaaaccacaaaagaaaaattatgctctaactggctccttaaaatatgtattaaatggcacagaattagctgcagtttacaacttggaagtagtgagatgggcatggtggtgcatgcctgtagttccagctactcagaggctgagacaggattactttgagcccagaaattcaaggccagcatggatactatagagagaccttatctcaaataaataagtaaatataaaattaaaaatgaaaaactacttggaagtagttgtgatcttataaagtataatttaatggttgcagcctatagaatcttttttgaataaataagtagattttggccatattcctgtggccttctgaacttctgtgttcttccagtggaaaattgaggtcacctgggatgttcagcttctaagatgtttggcaaggagagctgttagatttcatacaatgggccagtaggcatacaagaaaaatgttcattgttgtaattcaccagagaaatccaaattaaaccacaatgaaattctactacacagacataaaatgaaaaatatagataacatctaacatcagagaagatatggaggagccagcactttatgcgtcgctgttagaatgtaaatgctataagtactttagaacacttctttagaagttaggcacataccgatctgtgctatacagctctactcctaagcatttatccaagagaaatgaaaacatatgtctacaaaactcttgtgcagaaatgttcacatcggcttattcataatagcccagttggggggacagtcctccattggcctctcttgtttctgcttattttgcaaatagaagcactgattatcttttcgagatgtttctgtagcaaatagtctcagaagatacagatagggtatccctatggagtatagggaagtttgcttactaacaaatataataaagataatatcctctctggagcaaaggtcaaataggcttgcttaaagtcctttataaaagatttgagtttctgaagcccagagtttgactgatgtaacacagacccattatgccttctgcatccacctagaccactctgcattacccccactggacttgagggagttgtggggaggggcccagtgcgaacataatgactgtgcttgttgccgtgcttggctctgaaccaggggttccacatcttcagccggcactcatgaaactatgtcgggctaacttgacacacgtaccccaaactggaaatcacccagatgtgcatcaaaaagaaagtgaattatcaaactctagtctgtacaatcagtagaataatatctatcatttaaaaaaagaatggattgttgatatatgcaacaaaatgaataaatctcaaaaatttttgtctgagtgaaagaatccagacccccaacctacatattgtatgatcctatttatttgaaagtcttgaatagacaaaactaatttatagtgctagataacaaagcaatagttccttcttagtggggggagatttctgggggatgaaatattcttcatattgatatgtatttgtcaaaactgattaaacagttcacttctgaacggcatacgctgtatgcagaatgtacttctattaaaaatattcacacattggactgagagccaaacagctggagttcggtaacttgactagccacttgttatctgtataactttgggtaagttatttaaatcaagtctcagttttcttgcccataaagggtcaataatagtaatagcaaacacctcattggatggttatttcattaagtgagataatgaatgtaacgtggtgaggacagttttgggagtgtagaaaacattgcatgaatgtgaactgttgttcaccgcagtacactctatgaatattggacaacctgaatttggtagttatgggagtaccaacagatgtatgtggagcaatatgtagactccgttgtagagaaataaatatgcattcaaatgctaactattaaggtttaaatacctagcaggatgtttttttatttttctttagtcctgagaagaagcctgatgggccataaagttaggttaggggactgacttgactttgagcagtgtggcttcccagatactccaaagggccccgaacaagctacaaggtagagttgctaaatctgagactcaagcatgaagctggaactgctttgggagaaataaagtagcagcaggtgggttttgccttctggattccagcaggaattattttcaagaaaagaatgtcttctttaggcctgagtcaaaaattttaaattaaaattaatcaacccttattacctgataattaaagctgataaaacgcaaagaaaacactaggagtgaacgccagtgtaaacaaacataatatatgtaagtaaaccaaggcatctagttgtttttgtttgtttgttttggaaaccgattcttgctctgttgcccaggctggagtgcagtggcacaatcttggctcactgcaacctctgcctcctgggttcaagtgattctcctgcctcagcctcccgagtagctgggactacaggcatgtgccaccacgccctgctaactttttgtatttttagtagagatgaggttttaccatgttagccaggctggtctcaaactcctaacctcaggcaatcttcccgcctgtgcctcccaaagtgctaggattacagatgtgagccaccatgcccagccgggcatctagtttaaaaaaaaaaaaaatagaaataatagatttagaataaaaccatgcatgaaatagatgaataaatgtggaatcctaccaatgtgttctatcaaacgaaggctatcaaaaatgataaaacactgaatggatgggttaaaaaagattagacacagtcaaagagagaatgcttgaactggaacatatatctgaaagaaaatgcagcacaggacaataaaggacagcaaatatggaagtgtatggaggataagggagttaatgcaacactaatcagccctggatcccagaagtgaataatgagaatggaaaagaaggaatttataaacagataatgactgaagaattttcacaactgaagaaagacaataatccatagatcaaggaaagccagactatgccaaccagaattaaaaaataaagaaggaaagtagagaggaaggaagaaaccttctatggacacaataatggtgaaaatgcatgactctgaagacaaagagaatattttattatggccaggtggcagtctcatcttccagttcactggaatcatttttatgtagcctggttcaaacattcttatcttgagaatcaagaagtctacataagcagagatcaaaggtgcacccatggaaaacattgtgtttgcacatgagttatttggcataatagtgatgcacgtgtttacacttccattccttcccagagctccgtgttctttctgatggagaaacagcactatatattggttcctgttaaaagcacataccacctcttgtgggatgttgtccccactttgcaatgtgttgtctactagctggcacaataactgagtcttcagtaagctatcctgtcatttttgttaggccaggtagaagggtatgtggtgagacagaccagtgaatcctgtcatatcgccttactttgtttcagtataaaggttatatggtgaaaaataatgtgaatgatgtcatgaaagtgattgaagcataagtaattctataggtcatgatccaagtatcttttccaatctcttctgctgagcagttttcttccaggactattcttgataaaagatatccatgccaaattcattgacacaactaaaatatattccctaaggaatgttgaatatctgtagaaggcttacaaaaaatgggattgaaaatagaattttgtctgtattgtgataaaaatgctctcatcctgtctcatctgtgaattctttagtacacacccaaatgagagaagcagcagttttatttcaattgcatccaatctctataccaatatggagaaaatggacatcttaatattggagactttaaattcatcaacatcatatacctctctgtttatttaaatctttgatttctctcttgttttcttatttcattatatagattgtgtatatatttttgttaaattcaaccctaagtttttcatgttgtcatgtcattgtaaaaatagtatcatcgtaattctttttcgattgttaacgctaccattactgaaatagaattaactctgtatgtagaccttgaatattataaattttcaatgtttattacttatagtagctcatttgtagatttcttagaatttttatatagatgatcacatcatctgacacagtgctttcttatttcagtgcattttgtcttgctttattgcactgatgaggacttcctaatacaatattgagtagaagtaataatgggagtaccttactttgttcccaatcataacgtaaatcagtctggcatcggtgaatatgatcacagctgtagagattttgcaaatgtttatagactttctgtataatgttgaaggagtttctttccattttctttgctgagttttgttatgggtgaatgtgtcaaatggatgaatgtgtcaaaggatatgtttgtatctgttgagatgataatactatttttattttttagttgatatcacaaagtatattgattcattttcaaatattaagtttgcagtcctaggataaaccatacctgatcatgatgtatctattttttatataatgctacatttcattggataatattttgctaaggaatattatacctatttttaatcatgagtattggtttatagttttcttctctggtagtgtctttttctggcattggtatcagattaatgctggacacaaaaaaatgagttagaaaatgtccccacctcttctactctctgaaagagttcatgcatattttagtaatgttatatattcttaaaatatttagtagaattcacaaagataatcatctgagcctggactttactttctggggagattttcgaatgtatattcaatttatttaacatatacaaggacattcagagtatatattagttcttaagtgagctttgtagtttatatctcttaaattttttttcattttacctaaattaatttattggcaagcaaaaacttgttcataatgtttcttattatttatttagtgtctgttgcatctgtagtgatgaggtttccttcattctctatattttctttttttttttgggcgggggacagtgtctcactttgttgccttggctggagtacagtgccttgatctcggctcactgtggccttgacttccagggctcaagcaattctcccaccttagcctccctggtagctaggactacaggtgtgtgccaccacccctgggtagtttttttatatttttagtagagacgggttttcacaggctgatctcaaacacctgagctcaagagatccacccaccgtggcctcccaaagtgctgggattacaggtatgagccattgtgcccagctatgccttctattttctttctttacttcttgattagtttgtcctagagatttatcaattttttgttttgtttttagagatggagtttcactcttgtcacccaggctggagtacaatggcacgatctcagctcgctgcaacctcagcctcccggctccaagaaattctcctgcctcagcctaccgagtagctaggattacaggcccttgccaccacatccggctagttttttttttttttttttttttttttgagacagagtctcgctctctcccccaggctggagtgcagtggcacgatcttggctcactgcaagatctgcctgccgggttcatgccattctctttcctcagcctctggagtagctgggactacaggcgcccgccaccacacccatcttttttttttttttttttttttttgtatttttagtaaagatggggttttgccatgttagccaggatggtctccatctcctgaccttgtgatccacccacctcggcttcttaaagtgctgggattacaggcgtgagccaccaggcccagccatgcccgactaatttttgtatttttagtagagacgaagtttcaccatgttggccaggctggtctcaaactcctgagctcaggtgatccacctgccttggcctcccaaagtgccgggattacaggcgtgagccactgcatctggccttatcaattttattaaccttataaaaataacctttgttttctttcttgtctgtgttgttttctatttcatctatttctactgttgtctttatatccctctttctggtaactttttgtttatagtttttttcttcttcttttccaggttgttaagaacaggcttagattagggttcagcagactttttctgaactagataataaacagtttaggattagggtcacatacagtctttgtcttaccttcttttctttttcttctattttttaaccatattgtttaaaatttaaaagccattcttagtttgtaggacatagaaaaacatgtcgtgggccatactttgtctacctctggcttagctcattgatttgcagccttcattttttcattatataacaactaatgctacaaattttcctgttttcattatcaaaagatacgggatgtggctaaagcaactctgaattctgtcatgctcctctgaatattgtgctgttttctagaagacagttacctacaatcaaactgcaaacttgcctctcctgcagtctacagctacttatatatctctccaactcttgccatttcacacttctgcttttttcagcctggacttctctggccctcccctgtgcctatgaactttgcagtcagtcaagtatttgggcacacatggggctcaccttctgtgttgtttccttgcttgcagaaataccccttatttccagtttctctgttgactttggaatctatattctggcctcaggtcttttatcatcatcatcatcatcatttcactctttatatatgttatttgctttagtttttggagatcacttcatggtttctttggatacaatagacatcaagtccaatgtatactccttacaactgttatttcctttcacaccaaccctgtagcatgacttttattattcatttttgttttctagataactagccacacagctgataagtggcagaaccaaaatttgagactaactgcaaagcctatctcttctactttaagcttttatttcctatttttaaaagagtgagatagtgcagtctatttcatagtgctgttgtatgagttaagtgagttcaattttaaagttccaaatttggtgccttctcttagtagatttttaaaaatgtttttgcaccctcctttctctatccacttctctctcctatccactctgtcactaagtcctacttagctttctacaaaataatctaactcataaatcagttatttattgtgctagactctgtggggaacagataatcctcactgctaccgctgcagtccaagacatcctcaccacatgcctcagttttttagatagtactaactagagttattgcctccagtcctagaccctaaattaattaaatatataaatttatggtcttcttcatttcttaactcataatgtttattgtctctattatttctttttttctaaaattgcatcttgcctggctttatgttcttttttatagctgattcacgtctgcctggtttccttcttttgcttcttctttccttttctttctcttcgtgtgttccccatcctacatccagcccgcctctctcaacagccataatataactatataattctttgtatctttgcatagcctaaggctaggctaggggcaagtagggaaattgtacagagagaccaaactttgagaattagtagaagtctctaataatataacatttaagctagaatttgagagtagtagttagccagaatgagactttttcaaatagaagaaagaggaaattagaatatgcttgaaatttgtttaaaaaaaaaaggtcacagaacattaaatataatgagaaggaatacggctctaagatgtgactgaagggagtcagattacactgagcctcgtagactatgctgaggttctgatttccaagtaaatgaagtggggaacaggtgaggggtttcaatcaggggagtggcatggcctagtttgcaatttagtggtaagttgactactgtatgaaaatcgtgttaaagaggtgccaggatagacattgtgagaccagtgaggaggccatacagcagtccaggtgagataggataataacttggagaagggcagtggttgtggagatggagagaaggagacaactgtgctaagcatttgggaatcagaatctctgtaatttggtcatgggtgagatatggggaaatgagagcaatcatgacacccccatttctggcgtacacagctgaatgtatcagtgagaatccaagcagaaatgatggctcattcaaaaggaattacttaaacagaatctcacaaagggatgatgtccaaaagtgccagaagagtttcttaaggcagtgaaggacagtgcagtacctctgggcaaataacatagagaaacaccactccaaaccagaaggggcaagcagacagagtggttaccagaaacctgggagaacaaatgtaaggagaggctacctaacacggaggtagccagaccaataaacagcaacaccaaaccaccctcctgcccttcagtcttctgcctgtggctcccattgaccaaattaaccagatgtcaaaaggtaagagagctctgtatttgttcatcagagtaagtttctcaaggtgtagagaatggtgccagattcatctgggggacacacacaatatatacagcacaggagctgccacatatttatgtgagcaagatatcgggggtggaaggggcaagagtttaattgtagacatgttgaatccaatatacccataagacatccaactagaagggttatgaaggcaactcaatgtatagatgtagaattcggaagtctatatcgcagatacaaagcataagttcatcagtggttgatagttaatgtcattaaaatgaataaaattgcccaggaaggagtgagtgtgagaaggaaaatatggatcccaaaccctgagactcataaggagggacgtgaacactgttggaataaaattgtccataggtctctcatgtttctgtacatcttgtgagcagagacaatgaccactttttttccagactacctttccaagggcatttgtatagaaaaaatctttggaagctggagatagtgtttctctttagagcaaaggtcagcaatatttactgtctggaatcaaagaccaggctttctaaggtcggagtcctctcctgtaacgtagcccatggtgtcacttggcactttttctgtcagcctatgtgaattgcagctcaaggaaccagagccagaaaaggttgatactctggctactactgtttctgtgaaagataacaccttttgtccctgcccatgctgcttctgtcttccgccaacacccaaaactgtggcaggctaacttgtgggctgcagatatggtaaaatcccagacccttcacagtttgtgacaaacaagtcaagacatacaggggttaggaataacccctgtattattctttgttgttttgcacagggagaaacaaattagagaatgcaagtggcattgggaagtaagaaggacactgatacatggggctatgcaagggggaaaatacttctgcttaatagagccctgggggaagcagtgttctcagcaaacctccaggttttagttaaggaagtatttgaaaactgggataaggttgcattgaggagtagtcaatgtggatttggagttccagagagcacaaagtatttggaaagacagagggagctggctattacttctgcttaatagagccttaggggaagaagtgttctcagcaaacctccaggttttagttaaggaagtatgtgaaaactgggataaagttgcattgaggagtactcggtgtggatttggagttccagagagcacaaagtatttggaaagctggagggagctggttgttaaacaatagagaattggcacacagggatgagagcttagcagatacaggatcagagaggcttgtccagtgggcagtaaagcttcaaagggaggcatgaatgatttatttctgagaatgttctagaggagggaagtcacttgagcctaggaaaatgcaggtgaactttggaagtgaattcaagtgtaaagctatcaactctagcaatagtgaaacacatctggcccttattttggtaatttatttctgactgtgggcttggagacactggaagtaacgcaacatttcttacagcatctagtcacacagagaaaataatgtttctctttggggatgactatttttccttcctatttacagttgcaatcactagagctagtccaatatacccataagacatacaactagagataaaatggagtgaaatcatggctttttaattttaatttgagtttagtttcaagagtacatatgcagcttggttctgtagacaaattgagtgtcgtcggggcttggtgtacatattatgttgtcacacaggtgataaacgtagtatccgacaggtagtttttcagttctcatcttctagcctcaaataggccccagcctctattgtccccttctttgtgtctatgtgtgctcaatgtgtagctcccccttataagtgagaaagtttaatgtttggttttctgttcctgttttagtgtgcttagaatagtggccttcagttccatccttgttgctgcaaaagatattatctcattctttttttatggatgtacagtattccatggtgtatatgtactacattttctttatccagtctaccattgatggaaatacaagtcaatgccatgtctttgctattgtgaatagcgctgccatgaacatgtgtgtgcatgtgcctttatgttagaacaatttatgttcctttgggtatatactcggtaatgggattgtttggtcaaatggtaattctgttttaagctctttgagaaatgaccaaactgctttccacagtggctgaactagtttacattcccaccagcagtgtataagcattccttttttttctgcaacctcaccagcatctgaccatttaataatagccattctgactggtgtgagatggtatctaattatggttttgatttacatttctctaatgattagtgatgttgagcatttttttcatgtgttttggtcatgaatatgtcttcttttgaaaagaagtgtctgttcgtgtcctttgcccactttttaataagattatttggtttttgcttgttaatttatttaagttcattatagattctggatattagacctttgttggatgcatacattgaaaatattttctccaattttttgggttgtctgtttactccattgatggtttcttttgctgtgtagaagctctttagtataaataggtcacatttgtcaatttttgttgcagttgcttttgttatcttcataaaatctttgccagggcctatatctagaatgatatttccaaattttcttaaagagtttgtatagttttaagttttacatttaagtttttaatatatcttgggttaatttttgtatatggtgtaaggaggtggtacagtttcagtcttctgcatatggctaaccagttatcccagcaccatttattgagtgaatccttttcccattggtcatttttgtcacctttgtcaaagatcagatggctgtaagtgtgcagctttatttttgggctctctaagctattccattggtctatgtgtctgtttttgtgtcagtaccatgctgttttgtttactgtagccttatagtatagcttgaagttgggtaatataatgccttcagttttgttctttttgcttaggattgctttggctatttgggttctttttggttccatatgacttttagaatagcttttttttttctaattctgtgaagaatgtagttggtagttgggtagaaatagcatttaatttgcaaattgctttgggcagtatggccattttaacaatattgattcttcctattcatggacatagaatacttttctgtttgtttgtgtcatctcttatttctttcagcagtgttttgtagttgttttagatatctttcacctccctggttagctatattcctgagtttttgtggctattgtgaatgacattgcattcttgatttggtactcagtttggatgctattggtatatagaaatgctactaattttcatatattgattttgtatccagaaactttgctgaaattgttctgggagcttttgggctgagactatgggtcttataggaatgaattcacagcatcttcaaacagagatagtttgactttgtttcctatttagatgccttttgtttctttctcttgcctgactgctctaactagaacttgcgattatgacttttgtaaaaataaactttgataaaactgatggttctgaaatgtcctttcaaattctgaagtgagattaattcccttatgtcttctctgtgtgcttaaggaggtgaaggggcatggtagcagtgagatgcaatcattccatccccacaacatgcctaggtttcatccaggaagggactaaagtcccttgggagttagatgaaccttcccatatagcatagcttctgcaatatgtgtgccccttaattagatacatgggaagcacattaatccaagagcatctgtaagacttgacatgagagtggaaaccctggttttcagcagaagtatttgagtagaactgtgaaagctgacaacatgttgtataattatttatatctgtatccctcatctttagtagagtgtctctgtctggtacatggtagatatccttagatgcaactaacttcatctcctctcttgcctcccccccataccctccctgtttcccccttatatcatcttgatcttcttttttattttcctcattttcttttccatcctcctcctcctcctctttttattctacttccttctctttttctggtcttctccctcttctgtttttattttcatgagcatcatgtgatccttcagaccaacacaaaagcagaaagagtagtgtaatgaatcaccatgtatccatcactgaaccccaacagctgtcataatctggccaatttatttttacagataccctatacatatttttttcctcaccattggccaattcaaagtaaacctctacatatggttttattttaaacacttcagcatgcaactttaagatataattgctctcaaaaaatgtacaatacacacaaaagacaatagttcattatcatcatggaatagctagtctctcccttctctcataaatgtctttataaaattttttttttcacatcaggatctaaatacattgcacatcccacctttatttgatatgtttctcaatttttttgtaatctaaatatgtttccctccgttcttttacttcttgccatttgtcaaaacagcttattattgggaactgaattttacttttgattgacattttctttattttctgcatttcctgtaaattaatacatagatccagagcttgatcaggtttatgtctctctctctctttctgtgttgatttggttatgtatttgacagaatttctaccacttggtggtatacatttagtattgcaacactttagaaaacacatagaatctgtttcttaattttgtgtgttattaacataagaaatgagagtagttatatttagaagagggactattctaggggcaagactacaaggtgacattttcctttctactctgaaaatttatgtttttgtgaagatttttgttaattgtttttttacatgcctacatacgtatgcaatgccattttccaaactaacaaacaaaaaacttgctaatgtcaagaacaaaacaggaggaggaaaaaagattaagctatggttccagtgttgtcaacctgatctattcactgcaaagttcacatcatccttttatctcatgcttttagcaacgattgatggtaattgcacagattcgtttttcatctggcttcttaatgcatttgtgaataaacagattcatgaatgtcctgaaagttcaacctgaatacaactcctgggatggcataaacagagtttcagagtggtacaacctccttattgaaggaggtttggttgaggaatgagctaagaggacaggcatctatagagacatttctttaagtctgttctagaaagaatactttttcaatgattctatggcttatagaagaggagcaatcaaaattgttgaagtagaaatttggcttaagaaagcttaggagaaggaaatctatgtaagacattgaaactgaatctctgtgcttctttaggaaaccatatctttttgtttgtttgtctggtaacaaggtatattaagttttcttatgtcagttttagtgacaaacggtgtttttacctttactgaacagattggcattacccacaacaaattgctcttggccataaagtccttggtggagtctctcaggacacctttcacatgtttggagtgtgtaaacattgagactgaaacattcctcctttcaacctcagtccctgtgtgcattgtacctaaacatatccccaccatccaccccctgctcccaacacacatttattcactgcatgtatctttccttgcacttacctgaaaattgaaaatggaattgcagaagaaaacacagttttaagtgaagatgaatagccccccaggaagcatcctagttgaaaaatgcttagaaataatgggttttggctagacagtttttctcctttgctgtaattctttttgagtctttaacagagcactcagtacttctgcagaacattaggatgttaatggttcaattgcaatcaaattttggtcatttaagctggacgatcaatgggtaagtcatctggcctttctgcgttgttttcttccttcctctgctggccttgtgtcagttgttctgggcgttaacttttccacccaaagggaagtcaagcaagaatacaatggtggttgtcaaaaccatccatttcctccttgcaggaaattctgctgaaacattcagtaggtataagaggatgtaaataaaaatcatggcccgcatgaacttttagattacttatggctctaaactaatattgaaaatgaaaagaattaaaggaggacaagactgtcccttttccctgtgtggatagggaagaaaccatttggctcattttttataatgggcaatgaagtaacagagaggcaagaaacggaagacaaatggagaaaataatattaatagtacttatcccagaagtgtgctgtgagggttaaaaagtcaaatcatgaaaagtgcttccacaggacctggtgcacagaaagttcgcaattaacacgtgctgcgggtggtgctgtgaccccctgtgaaccccagcattcttttcaggagtcgctcatcacattcaattctcacttatcttcacctgcaaatagaggcacagcaatactgcagacattttggctcattccagacctgactttgcttctactgataattctcacaaggccataggattttactctgggattctctaaatgtggacactatgaaagatgcaccaaagtcaacttcaatataacacagaatcttagtttcacattaatattcattttatacagagaaatgcatacccttgagggggaacaatacccagttgacagagttatttatctgtttatctttaaatattacaaagctgcagcagctttgtaataaggcttgctgggttactgtagcactttcagaacccagcaacattctgtaacactccaggatattcaccctgctgtccctgtgtccccttcacccagaatatagcagtttgtcacaaatcaaatatgccctgactctctttttcaaagctcttgtaatacattcatttactatttattgaagcatttatcacttacaatagatccaaacatcaatatttaagttaattgtatgctgttactactcaggacttcagcctcaagaaatatttaagtttgaggctttacattcaataaaattgtgtaatgcaaagtctaaaagcactgccagcacaagtgtacacagcttcagatcagactttccaaagcaaatcacttcaattaatgtttgaaataaaaatttcaattattcactcccttaaaaccacatgagaagccttatgctggttgttcagatctgctgaatctttctggcatctgtgtgtctcagtctacattagtaaacatctttgatttgttttctcataactccatctctttcttttggttttccttttgaaacacgattttgttgttgttgtttttggtcttgtttttttttttttgttttttttttttttgagacggagtctcattctgtagcccaggctgaagtgtagtggcgcgatctcagctcactgcagcctctacctcctgggttcaaggcaattctcctgtctcagcctctcgagtagctgggatttcaggcacacgccacagcccggctaatttttgtgtatttggtacagacgaggtttcaccatgttggccaggctggtcttgaactcctgacctcaggtgatctgcccacttcggcctcccaaagtgctgggattactggcgtgagctaccttgcccggccaggatttttttttatattaacaatttcaaatccattatatctttcattttccatatcttttttatcctaataatttgctgatacattttaactaaggcatatattctgagggagcagtatgctgaatgggcaaattaaacaggtctttcaaagaaaagatcttccccatagcatgaccattagaaattctgagagtgaaagaatttatgggttattcttgtgtaatgcaactgacaatttattcaacagaaggttaaaagagtgtgccttttaaagataaatactggactctgggtaaaagtaataatgagaagaaaatcgggagacgtgaaaagttaagctttgcatactagagaggtaaaagataatgcttcagagttctcattttatctaaaccgcagactctttcctagaaaacgtgatgaaaaggatgaacctcctccaaataaagaatataataatgtcttattaaatcacagagatcaaaagaacgtcctgttaatgaagaattaattgaaaaaaaagctgatttttctttggtccacttcaagctatgttgttgaaaatatctcttaacattgtatttcagtgtgtgtgtgggtgtgtttaatgctagtcccttagaattttgtaaatgggtatatgaataagaagtgtagtagttaaataaacctggaaaatactgacgatcaagctttagtaaatgggtgaaccatttcatgtattactcggaagaccatgtggagggtgatttcaagcttggctaactcacagctcagttgcattttcacttccctatcaagaatttatcctttgtcactggtatgctatggtctcctcaggactacaaaatgactggagtagttgcggggtgcgtgggccgggtgtggtgtgggggatttttgacacaattgactaatctctttgtaagaataaataaactttctcagaagttccccagcaaactcttttttttttaatatttattttatttattttattattatactttaagttttagggtacatgtgcataatgtgcaggttagttacatatgtatacatgtgccatgctggtgtgctgcacccattaactcatcatttagcattacatatatctcctaatgctatccctcccccctccccccaccccacaacagtccccggaatgtgatgttccccttcctgtgtccatgtgttctcattgttcagttcccacctatgagtgagaacatgcggtgtttggttttttgtccttgcgatagtttactgagaatgatgatttccagtttcatccatgtccctacaaaggacatgaactcatcattttttatggccgcatagtattccatggtgtatatgtgccacattttcttaatccggtctatcattgttggacacttgggttggttccaagtcattgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggcaaactctttccttatatctcattggctagaattgtatcctatcccttgttcctaaaccagttcttgcagaggagattggattggcttagacaaatcaggattaactcagtgaaaagtccagaaatccttactcacattggtggcctccaatatctgaacagaatcagatttcagttgggagaggaggagtagggatggtatatgagtagtcaaagactcagaggttggcaaataattgtgactgccacactagggaaaataaagcctaagtcctttttataaaacataaacttgtcacttctgattttgttgatataaggctacattttcaagtcctattagctccaaagacaaatttaatacgtaagtcttctcagagcctttaatatgttaacatacctggagactctctgagagagggataaagcctgcaatgtttcacagataataaaatattttattatgtaaaataatgcaattatttttcaaggcattctctccaggatgattgtctttattagtgtagtttagaaatgggtcccctcaattattagtctgaacctatttcatagtatatattttataatggtcgaaatgcctccgagattgccttttctaagttctataaaaaataagagaaatttataaagtagcaggttataaaattcatattaaaaatgaatagccttaaaaaataaatatagtaaaatggtaatgttagaatttagttagtgggttcactctaaagttcttttaacattgctcaatgtttgaaatttttcataatagaaagttggaaaacagtaaaacagccacaacgtagcaaaaaatagcttttatatatagatgaaataccagtaaaatgattcatgaaaaataacaccatacttataatagcaaaaatgaataaaacatcttggctaactttgcaagaaacattcaaaacctatgtgagaaaaactttaaacactattgagagaagcaaaagtagacttgagcaaacgaagatacagataggaagattcaacttcagcaaggcttctgttctaggtgagtttatttttaaatacaacagaaacccaataaatggaccaccaagttgctagattttctttctgaagataatggttaataaattttattggaagaaataaattattcagaaaaatctttaaaaatcaacaaatctggcacagaggggcttgctctgtcagttattaaaatatgttataaagcctttataattgaaactctagtttggtgcatggatagagaaagtaaaccatgaaacagattttaaaatatccagaaatttgacccagtcgcatatggaaatttgacatatagtaaaggcagaacctcaaatcagcaagagaaggtaaactgtcatgtattacaataactgcatagctatatggtaagagataaaattttgattcatttctcacattgcataacaaaatacgttccaagtgagtcaaatatttaacttaaaaaattatagagtactaagagaaaacatggatgaaaacttctgtactctggaagtgggctcatttttttctaaccatgattcaaaatccagaagtattaacagaaaattaaatcaatgcattttattagaaagaaatgaataaatttttatttggaaaaagatacctaaaggaggtaaaagaataatgacaaactgggaaaaatatttgcaacttaatctcaaagagttaatatatctaattaaatttaaaaagagaagagaatggccaataactttttatcagaatggcttatttatgaacagtttacaaaaaaagaaacaagtttcatctttccacatgaaagaagctcattttcctttataacaagaaaaatgcaaataaaaatacactgtggtagcctttctcacgtacctgattgacacaaattaaagttcgacagcatactctgttgctgaggttgcagggaaacaaacattcaaatccattgctggtgggacagcaaaatgacacaacccttttagagtggaatttgccaatatatataaaaaatacacatgaatttaccctttgacaaaactcctccacttctcaaaattcttccccaaaatactcaggcagaacatgaaaaacacatacaggcatatgcagaaggctgttctatactttttagactgttagacatgattgttattctaagaatgttatctgtatattatgggataaagcaaatgaataatcataacagtatcattaagaaccaagattgtcctcatgagagaaaggaagtagagatttaagagtgtcaaggttaagcaaaaactctgtagtcctgaatttgaatgggaaatagctgcataaattcatgataaattttatctttaaaaaaaaatcctatactatatacactgaaaaaccctagatcccgtgacaggcagtgagcataaagttgatttggtatttaaatgagatacatataaaacacaactctctggcatatgagatattaatggtgctctgaaatggaaaaatacaaattcaagtaaatttgggaaattctgaatttccctcttggaggttacattttatgttatatgttaaatgttctggaaaagtcagtgaagcaacctaaaacattttagcacagtggctgtccggaaccctttgtgtgttttgcaggaaaaggggttgaggttgtagaactcttattgtgaggttgtagaactcttattgtttcttcactacacaaatgtgccgtaggaaacaatttggaaaatattgctgtgaaagtgaaatgcaatttgtggataattcttcttcatagagggacaagaggtctagagagagctactggtgtcgtgtacttaatgaatgcataatttaatgcaacaagtgttatttagtatctactggatgctaaaggctatgttcaatggtggggatccaaaggtaaaaacaagaaaaatgtcttggacacctggtagagcattaaaatatgattctatattgacagtgctataagcaagatttgaaatgttttacgggaatgttgaattgcgactgagcgcctcggtgtgacaaacagttgggaattaagtatgatggtgaaagcaaagaggaaggatctccctggcaaagtaaacagcatgagcaaagatagtttaacagcaacaatagtcacacctatctggaagaataaaggaaaataaatgtgagagggtaggcagggtccaggtaatgaaaagaatgtgggctttggggtctgacaagcctgggccatcatcattgctctacctgtaaatgacctttggaaggtgatttaacctctataaggctcagctttcccactggtatcataaggataaaaaaaattacctcacaaagtgatgatgacataaaaatcccacatccacagctttcaacacagtgtgggcacttagtcaatatcagttgttatcattattaggcagatgggagcaaaatggtaaatatctactgtgaccagtgaaagggatctggatttaatctgtagtcagcagacagccattgagggactcttagtgtaggaatgatgtgactagctctgtagtttgcaaaggtgaacgtggaggaatgaatggatgaaaggagacattgagcattgcacgtgatggaaaatggtgggaggcataaagaggccattggtggagtgtttgacactgttcagtacttcacaggtaggactgctagaattcattagacttacatatgtgagagctgggattgtgaaagggaagagaaagaaaacggacatcagtgtttctagcctgagcatctgaatctccagtaatactaacaatcgagacaggcaacagagacggtacaataggtgtgtagaaagtaatgaattcaggtgtggaatttagtttgttttctgtcattatccatttgacctttctagagtaagcgagcttttcaggttcgaatgtggcaacccagcttctgatctcaaagatccttttattctaagggaccactatattttgaatagtatgtaaggtgtcacaaagtaaaatactacaagctattagagaaacctaacatggtagctggatatggataccaactggctatcacgtggtaggcaaatgtggcttgaattactgtatttatcgaagcagtgttttctttaagcataattgaaagtttacttttaaatttggacattctactcaatgccaatttgtgtgtgtgtgtgtgtgtgtgtgtgtgtttcttgttttaatgtgcaggacaggagagaattggaaaagattccaactatgagcaggagggtaaagtccagttcgtgattgacgcagtctatgctatggctcacgcccttcaccacatgaacaaggatctctgtgctgactaccggggtgtctgcccagagatggagcaagctggaggcaagaagttgctgaagtatatacgcaatgttaatttcaatggtgagtctccaaaaatccatcctttttggaatcctaagtgttggcattctgtttcataagttttaaatgtctattattatttactttaaaatatgtgtcaaaacttgcttgattataaaactttaaatgattgaatcaatgcatgaatgagcaaatgaatgtaagaatgagttaagatatatttgggggttatggtttggtctcattttcttgaaatagagattttttttttttttttgcactatgccaaattcttctttggtgaatttaggtgggtataggatggaagaggaagggaaaggagcagttgctgtaggtacctctgaatatggaaaaactgaagtcatttttcctctgctctcataccacaacaggaattcacacagaagacttctgtgaccaaatgtcagtggagaggtttcccccacacaccaagctagcaataaattctgcagtggacacaagctgactgtcctctacttcaattcctacatgatctatctggcatgctgtgaaaccccacaagttggaggcttagttcccaagactcttccccttgccacttgcaatgacagtggcaaaccctaggttgttttgtctgggcttctgatggtccggctataaactggaattttcacaatctcctcctcaggtttgattaatttgctagagcaactcacaaaactcagtaaaacacttacttaaatttattacaaaaggtattttaaaggacacaaataaacctccagatgaagagatcctagggcaaagtctgaaagggtcctgagagtaggagtttctgtcctcagggatttggggtgtgctggcctcccctgcacaaagatgagttcttgctcactttcctgtcagcctccatgtgttcaactctgaaccttgtcctcttgggccttttatgaagatttcattggaataggcatgatcgacaaccacgaagaaatgtgactgtacacaaagggtataatctaatactaataggctaagcgggaatacctggtgaggcctgtctgtccagatccttcttggtctatctgtgcaacatttcttcctccaggatatggggcaggacccttctaaaatgacgggctgatagcgtattaacaaaaaggtggaggaaggttagaatgctgccttgggctggtaaaaggagggcagggtaaggtcagaaagagaaattgttttctgaggcctaaagtgccccaacattataacaagggctatggtaattatgagccaagaaccatacatgaaaagctacacacacactctctctctctctctctctctctctctctctctctctcataaactaacatcacaatactcaagttaattgggataatatttgtaatttgccacatcaaccatatttcaagttttaaacatatttctcaaagtacaaaactcttttataaattgataggtttcctaaaagaggtgggtagagataagtgaaaaaatgggccaataggataaaagacataggagaaagcacactctgataatgtctgtttgaatagtctcaactcttacaacatcttaatgtttcacatgccaacagctaaataagtaaacttgaatgtatgagcaatgcaacattcaacacagacagtaacaaataatcataattatattataaacaaattgtgtaactgaagtgaaggagggtgaggaagaaataatgaatgcaagtaattttggaaaatagtatctgactatataaggctgaagacaaaataactgtacacatatattagacaatatctagtaaatctgtatttttctcacaattctgaagctaatctatgtatataatgggactgagaaaataattatatatattgcggataatgagagccaggtttctcattatccaagataaaaatccctaacaaggaatgagagaaatatagaatgaaccctgttgtgttggattacaatatgtatggtttttaatatacatgcaatgggtaaatatagaagtaaattttacatgtatattatatataccaattctgcctggctctgttccctgagagggcctgagagcaatggtacactggtaaaaatgagcacatgtagcacacatatcttatttataaataccattgttaaattaaaaaggttaaaagaacccttagaaaatggttgggaccagggctagggcagggaaagtccaatataagctggagacatgctgtaccagaatataagaaagttctcaaaaactgaagtggtcatgttgaaagggcacagaaaccaaattggaagagatcccattggccaactctgggaccccagtggattataactcataaaataaataaccatgagtccatactgatatcagtaaacacttgaactaattaaacaaatacaagagaataggcagcatgatggaataaagttaagatggaaatacaaagtcgcccttttgtaaagacctaagtagtaatttttttaggcaagaatcatgggatgctaaaagtattgggttacagtatgatgagaaacaagatatttgcatagccctcaaagtacctttcaccaagatacatatgaataaccaaaaacaaaatagtagctctgtggtggagaaaactgggagatagcacgtaaaagaggtaatcaaggtggacatcatcacttatgagactcatgaacattgtgtgccttttgatatgatacactggcatgcttacagcatcgcttctgaggttttactgccaaaaagcctaccttaaatctaattttaaggaaacatcaaacaaatccaaattaaaagatgttctataaaatcactggcaagtacttttcaaaagtgtccaggtcatgagaataatagataaaggaactgtttctgactcaaagagaccaaggaagtactactgtcaaatgtaatggggaaatactgattaatcttatgctagaaaaaacactaatgggaaggtggaggaattttaataacatttacagattaattttagtagcattccatcagtgttaacttactggtttagatatagtatgattttaaaaaactctttacttttttctcttaataacaactcatttaaaacgcacaacattgtatcaatcttcaggagttgcctagtatctgaatgaagaggcaccacattcaatatggggatcattagtttcctaattttgatggagagaaagaaggtcaactacaagttatgttctttctgtatttttttcttgatgttgcagaatttcctaatacttgtataaccaattttcccagagtcaaacaatataaattttatttttttcaagcatcatatttcatttgctgaggtcagtttctggattttttattctggttcatggatatgtatgaacattcttacactagcgacaaaaataaaatttgttaggtgagttttcttgatggttcttccctgattcttcttttagagaatgattatagaccattttgtctagatggtcttgtctgttgacaagccaaaatgactgagctatccatagggcttatgtttattaagtggttattgtgtgccagaaactgctaaacattttatgcattggcttattttatctttaaaacctcataatggtttaggatgctatttttttttcctttttttttttaacagataaggaaactgattcatggggaatttaagaattacgatattcaaatccatacagctaggtagcgatgatgttatacttgagacacaggacaactaagtccacaatctgcttcctggaatgttattcttcaagttgctgagaggaagggcttcctgcatcattcctgctgcctcctcttagatctgaggttgcatgggaatttcaggaagggctaattttctctctctctttttttttttgtcatcattgtaatcacactctatggtcaacaaaatcttctttctctgaggatatatttttcttccatatgacagctcagagacttctggctcccaagacactgcagtattcatggatgacagtgctcaaaagttttgtaaagcaaagaagctgtgctaaatttaatcagtgggtcctatgtcactttacgggagcaaagcttagaggggaaaaaaacttgacatgttttactcattcaattttctgactttcggttaaaaaatcaaatcctagagaaaagaaaatatttgtccaagactccatagctagcaaaggacagagacagatctagaactcaagtctttttccaatccattgtgaaaaatttaaactttatatcgcatgttttaggaggatattgatttttctttgtttcaagaagcttgagattatgtttcactgttacattagtacaaaatttgctgtataggtaggagttctgttccagatagcagagtataatttaataattctggtcttcacatttgccaaagtagcaatttaagaaatgataatatcgtaccctaaaggcattgatacagtttcatcaagtatttagcctcctcttatgcattgaggaaagaaatgggtaatttagtttttatcatgcctagatatttttcctgcatcccaaatcaaagcaaagtcccaagcctaaattcattttagttatctttatgttggcccatcaaatataaatttaagtaatttggtgtcttgattgtaaaatctcaaataatagctatagaaagaaggatttcatctgaagcatgtctgtacttcaatttactagtttctagaaaacaaattggagtaggttatattttgtagagatggcagatctcacatgctttttttgcaatatgatgttagctttccttcatcaagaggtgagatttatttttcctccctttgagtgagcctgtgactaatttggaagtagcactgtgacttctaaggcaaaatgtttttgtctagttttgttagaacatttggactataagcatggctaccatgctgggaagaagcttagatgccccactgatgggccacatgtagccacatattctggctacaaccccagttgagtatcccaccggttagccaatatcaactgtcagacatgagagcctcgaattgccccagctgacatgagtggaccagagagctgctgtccccacagagctctgaccaaattacaaaatatatgttgccactgttttgagtactaatattcagagtggtttcttgggcagaaagagatatcaggaacccgaacaaatgcaacgttcctggaatctgtgcatggcgtggtaaaatgagaacagaaaatgtgtctagtaaatacgttgatgcagaagactggtttattatctgggctatctgaatctctattccttctctgtccaagaagaaagaaactcagatactctcatccagtaggggagatttcgggcttcagtacaatctgttatctgtcctttactgtctgttacccatcttgtcaggtgaccctatttcttttgccctagtgtacctgcatcttggctctaatgccttgtgggcatctctgtggggaatcatttcccctttggtgaattctttatctcctctggacttttttaaaatatagagttcattgaacacaatgcttcttattctgttttaagaagttcatggatgctgttaaaaaggagatgtggggattaaaaactggaaataataagacagctgcattagagaatccatcaaaaaggccaaacccacacaatgtgctattacaagtcatcacttagataaagtatgcagctcttctgccttaatttttttaaaaccggaactttaatgagaatggaaagggcgtgacaagaccgtttcttctaactaagattgcaagaagggaaaaagattaggtgatggggcccattctgatgaatatgtagctggtgcacttgagttcctctggagccccaggcctcccatattcttcctttctcctctcaaagactatgaaaatctcaaatcatgttgtttaatgaatagaagctatagaattacagtaaagcacatgaatgctagtatccaatgtgaaagaaaaaggtgagtatctcaataataatgtcttcatgcaaactgacaggattctcatttctttgctaataacatgtgaaatccagattttatttcttcttcttatatgctcgcaagacttgttgaaatcagaaagccaatattaaaaatcttttgttgttattgatgtttttgttgtcattattttcttcctatactggaaagacttgtgttgattcttacacacagcaggcttaagagatccctattatgataaagtgggtgcctttgtggtctatgggggtagtgtctaggtaaaagacagaaaaaaacaaattgaaatggtgctttggccacacacagattcagctgttgactcaaattggtgggaccaaagcagtgttgctcacaggagatcggtgtccactcccagagctccagcttgctgtttggaaaattaaaaaaatgtttatagtgatggagaaatttaaattagataccagttaagtatgaacacttaaccagcaggtggggagcagagagggaggaaggagccagtgtgccaaagcctttattggggttcagggcatgtattaatccattttcacactgctgcactgctgataaagacttgcctaatactgggtaatttataaagaaaagggggtttaatggactcacagttccatgaggctggggaagcctcacaattagggtggaagacaaaaggcacgtctttacatggtggcgggcaaaagagaatgagagccaagtgaaaggggaaaccccttttaaagacatcagatctggtgagactcattcactaccacaagaacagtatgggggaaactgcccgcatgattcaattatgtcccactgggtccctcccacaacacataggaattatgggagctacaattcaagatgagatttgagtggggaaacagccaaaccgtatcagggcattacctggatatgtttcctgtgacagagttggatttgttaacttgaagagtgtgtgagtataagcaagggaactcagtaagcccgttcttggtagttccaggagcagagtaagccactcaagtggttcaggttatacagccttgtttgtctagaacccaaaaacaggaaatggatgaagactgccttcaaatacatagatcaagagtgacaagacagagacaggatgagatggataccgaggcaatttgaatattcatattcaaatgagagttatgacagcatcttaaccagacagggaaaagtatgcttaaaatagtaaaaaaaaaaaaaaaaaaaaaaaaaaaaaagatgccaaaccttgaggaagcagccatgatgttgagaacgtccccacacaaacaactaactcaacacaagaatgacgctaaaatatgtgttcaatagatggtaatgattttttatagtttttatcattgttttatttgcttatacctcaaaaccagacttaacaatgctttcagctccccagacaaatgtatttttcattgcaccaaagttgccctcttctaactgatatctaattttaatttctctgtcactataaacaatttttttttttattttccaaacagcaagctggggctcacattgggagagggtactgatattctcagagcagcattgctttggtgccatcaatttgggtcaatggctgaatctgtgtgtggccaaagcaccatttgagtttgtaaatggcatgaaatagagcattgttttccgctgggaatattggtccagtattagcctatagacagatagcagtcatatatcatattatcatgtggccagtggtattttttcctagatccagaggatcatgaaataaacagaactcagttactgaatgttttgtgattcgtttgtaactattgctgaaactaacaaaaactcatgtcttgcattatttgtacatagttttccagttgttctatgtggttaatattaaggattctttactcatccaaccatacacagttatatattaagtatggacagatagatacagatatagatataggtatatacgcttaataaatatattcgttctttaaaattcactccaaagtctaattctgccagaataattggttgtgtcttaagatagacattttaggaagatccaaatgagagattgagaaagaaaccaatatttactgaatacctgacaaatacactgctaaaccttttacctgcttatgatataaattagaaataaccagcaaaaacattttaaatacaatgagtagaaaagtacatttaaatacatttttcttatttacttcttgttttctaaattgcatttctcttttaacattaatttgttgtttttgaaattgttctttactgacgaaaatttagtgttagatggaaactaaaataatagttaaaagcatcatcatcaggagcataataaaacttaaggctgtctcttaaaattaatgcatataggttttattcctcagaaaggggaaaatactagaataaaattttaagaaatattgagaaacagtgaaactattcaaaaggggaagtagtcttccaccttctataattaaaattcataggccatagtgataacttgcctatgaattgcaggggccgttttggggggacctattaaaggggatatctagtaactacctttctcctcgttaagtctctagcctgtcacccatagtacaagagatataaggaatcttgtttaactttagaatctttcattttttctgtcttccttaggtagtgctggcactccagtgatgtttaacaagaacggggatgcacctgggcgttatgacatctttcagtaccagaccacaaacaccagcaacccgggttaccgtctgatcgggcagtggacagacgaacttcagctcaatgtgagttctgcttgcttctcttcttcccttgttgagatgaatgaacagacttttaatttgctcagttatacaaatgtttcttgtttaatgtttgtgtgcatatacaagtgagcatgcaatttgttgtgggcatcagcaggaactgatatccaataataatgatggtgatgacgatgatgggaaatgtgcattgagttttgtgcattatattcatgacctgtgcgaattatctcatttaatctgagactggggttacttagcaaacaggttactacttagcaatttcacaagatccttctcttggttaaactttttatttcttctgcctccccccattccttcctttttcttctttatttgatggtactgatatttttattattattttgagacatttgagtgtatttatgtgagatttgtaatgggattatctgagtaattgcagtgcttccatttctgtaacctctcccactttctataaaatgtgacctaagtaagcagccactttccttcacaagattatgtcaaatccatcagccaatgtcccagctccaaaacaatccaaaaattctctcttagcctttttgttctatttaggccttgaaataattgggtaagactcatccacattggggagggcaatttactttactcacccactgattcaaatgttcatctaatccagaaacctcacagacacacctagaatattcgaccaactatcagggcactgcatggcaaagtagaatatgagattaaccatcacagtctctctcctagaaaaatcctttaatgtcctttgtaaagcaacaaattatgccattagcctttattaatctataccttaggaggcacttttggaattattgagaacaaggcttcttgggtgtgggaagcaaatccatttcttgggaagtggaaggttatgtcatggtttctatgaagaaagggttattcacatagggagccgtgaagccactacaggccagttacctcatttgcacagagccttagcctagatctgcttgcacctgtccagttctccccattgtgaggtgcaccatacacatgaactggcactaaaattgggtccaaaagattatgctctggcatttgggaatggttggaatcaacaggtaccgtccatggcttatataaatgcaaacggccaagatcaaaaaagaagctaagattattctgaatccaaggcacactaaacttgcaagtgaaaggagaaaataaaaacaacacaaacaaaaacctaaaaggtaaactcaaggtgggggagtagtaatcaaaagcagaatcaaagcagtataacctggatgacacactcaaagtgtgtttttactgggtgctgccatgtgatatgaagatgggtcagcctcaaataaaggtaagagaatcaaggtctatggtacataggtgaagtgctcagggcttattgtaagatccagtggattaaataggttcattaatcttttccagcataaaccctgcactcttgttaaatttctggcacatataatttgtccaatatccgtaagagttcccaagtagcattcaccaacttcagatggggtcttacatgggggttcttaagcacactattttaagaacaaacattaacactgattttatttttatttgtttggtttgtattttatcctttgtaagaactgcatttgattagctattcaacaagtttttgttgtttgtttggttttggttttaaatacctatcaagttagaagcactgcaagagtcaatgtgtaggtacacagtggaggtgaaacaaatgtggtccctgttctttcacaattcagcatctaggatggagttacatggtactcagcaaacagatatgtacatggaaattctgaggtgtgataatggaaaaggtggtagagaggataatggaggtagaaaaggaaggacctactacaagagaagccagcaaagtgaaaactagagtgaccagcaggtcagatggctgatgtgatgatgatttaatcagcaaggaaaatgagaggaagggtaagaggagatgttggagcaataggtaagagccatactcatgcaaccccttgtatgtcatgatacattttaaacattttattctgagtgcatttaaaagccactaagaagtactaagcaaggaagtgagggagtggctgcatcagatttaggaataaaattactttggctgctgggaagataatggagggggcaaaagtagcagcagaaagaccaattatgattcttttgcaggtgtctagctagaataggggagctaagtgaggtggttctcaaacttcagtgtgcctcagagccatctggagggcttgtaacagcacatattaccgggccctgctctcagataacctgattcagaagaactagaggtgcgggaagcctcaatatttgctttttatcagaagtcattgggcaatgttgatgacactttgagaaccactggctcagggacatgtgtgatagtgaagatgaagccaaatgaatgggatacatatgtaacgtgaggcactgtgtggatgatggcaacacatgagatgagggaggcagctgggagtagaagggagaaaatcaagaatcccaattgggattattatatatgtgagacttcttaaatatactacagccaaaatgaaatgggtataggtctgaagctcagacaacagttgtgaatcataattataaaacaatgtaaacaacctataaatggtctttaaattcattacaaagagagataagagaagagcagagaacccaaggccttgaaaacctcctagaaaatgacacaattccagccaggtgcagtggctcatgcctgtaatcccagcactttgggaggctgaggtgggcagatcacgaggtcaggagatcaagaccatcctggctaacactgtgaaaccccgtctctaaaaatacaaaaaaattagccgggcatggtggcgggcgcctgtagtcccagctactcgggaggctgaggcaggagaatggcatgaacccaggaggtggagcttacagtgagccaagattgtgccactgcactccagcctgggtgacagagcaagactctgtctcaaaaaaaaaaaaaaaaaaattaactgagcatggtggcgcacacctgtaatcccaactacttgggaggctgaggcaggataatcgcttgaacccaggaggcggaggttgcagtgagccgagatcatgccactgcactccagccctggcgagagtgcgagactctgtctcagaaaagaaaatgacacaattccattccgtctactccaaatagcactcagtttaaaatattctgtttaatttgtccagagaattgggctaaccatatactttcgatttttgtttgagtttatgctagctaaatcaggggtttgttcttggcttggaactaagtgggagcattctttattctactttgtcatgctaagagtgatgtgttaggaaaaacaggcacgctcaggtggatgcagtagtttatacttggtattgcatgggacctaaaagagcgaatgacaaccatgaagggagtcatttttagggggaaaagaggctgggtttaattcaattagtgtggctactgagataacgggacttggtaggatgtcaccctgttgacaccttttattgtgagatttaatttgaattgtgttcagggggattaaaaaagaaaataaaagttaagtagagtacccagaggcaccctacccctctcacctgggttcccagagccacagcccagttgccctatccaatgattggtttctctccaacatcatcctgcccttgaagttccttttgctgtaattattctattaaatgttctgtgagagtggaatttgggcaaacggttttgtaggtttgctttcctctagtcaatggaacaaaataaagtatttcaagtaaaaagtgtatgtctcctcacaaagattcatgggtactttttcaattctcagttacatcatctcaagcaaatgaaattttcgagggcggctttctctgtggtcagtaattgcaaatgaatttctgagccaagaaatcagagttttaggtttttagaatcccagctctgtagatcagactgctctgctgttccctgtgcaatttctggaatttaagtgcttagcagtgtgctgtctgcggtaaaatgtctcatgtaccctcactacactctgtctcctctgtggcccaagagatgactgcatggttagctaccaggatatttctgctgaacaagaattctgtggaagggaatcataaccaacaaaaccattcactcttctgattgtaacctctacagaaacaaccctaatttaatttcttaggtttctattctaccaagaaactttatgaaatactcttcctgggggagagaagaagggacaatgcaacaaacatgattgtctatgtgcagtgtgtcaggagaggtgatagctcatggagatattagaataaacaagaggcagatccatgcaccccaagttcacagtctaggtagggtaagggctctgtagtagatatatggcattttagggctacagacaggcactggtttagagacacccaccacaaagttatattcgaactggatcttttgaaggttaagtagtagttcccaagaggaagtggaaaagaattgctttagaataaataatgcagtaatatttaaaaattagggtaggagtatatttctgaaaaaggcaagaaatggaatgtggatgcttaaaaaattctaaatcgatgttgtaagtaaaatatattatgtgtgatagaaaccatgatggttactttgtcatcttttatctgaaattaggaagttcagaaatgttaaaaatgttaattttccagataaccaaaattctctaatatgccaaaatgtcaattaaagcatttttagaaaggaactattcttaatagcagcttcctacagtgaactgcatattctcttaaatagaagactgaatgaatattatttcctcttttctggataactgaagttctacaaacctcaattttctgccattggttacgatagaccaactttctgatcttctgaggtatatggggtttcttgactttttctggtgatttgttttctctgttaaaacttacacttcacacctatagactaaaaactccttgaaggtagaatccatgttttagtcattgcttggatgcctgtaaacagggtacctagcacacagcaggcatttgttatttttttgttaatatataaaatcatgtataatgaacctgtactttttaaaatgatggacgttatctgcagccattagtccctcttcctccttctgagaagggcacacaagtttctctttcttgttttttgagacggagtcgctctgtcgcccgggctggagtgcagtggcgcgatcttggctcactgcaacctccgcctcccaggttcaaacgactctcatgcctcagcctcctgagtatctgggactacaggcacgtgccaccacacccagctaattttttgtatttttagtagagatggggtttcactgtgttagccaggatggtcttgatctgctgaccttgtaatcagtccgcctgagcctcccaaagtgctgggattacaggcgtgagccaccacgccgggcgccaagttttcctttttagccatgtggtttgccctgggtgtttcccaagtccaggaaagtcaagtaattcagtttaagccaatcactgtagccatagtgatagggatgggtacccgtactacgtctccctaatcaagacatcactggatgtctgctggccaatctgagacatcaacatgctcttcttggaggcggttgcttcctagggagtcattctgaggccaccatgtaggagcttcagggaagagaactcaaaacttgaaaagaaaaactagatctaggtcatattgtttgtgccctaggaaatccttaccacaagccatttataatgctctctggattgtttagttatcaataaattaagacaatttatgtaacatactctttctttacaatcttattcaccatagtaatcaaaaatggaaaaaaagaaaaaagaattggtttttgttttagtgtgcccaggatggaaaagaaaaaaaaatcagccatccattattaagcagaaattttttagattttattaaactgaggtgattcaaattaatttcaaaagttgtaatgtttgttccatattgaatctttcacacttattagaattttggctgtcacagacacctaagacataagaaaagcagttgattgccaaaatctgtttaatacaattaaatgtttccaaatcaatatggacttatacctgcctataaaactgctaatcactctattgtttcataattacaacagtaaaaatgttttagaaatcttattatactcataatttacaatgtattacatgaggtatgtaatagcagcaatcaaggcaatgttgacaaagagaaaaatatgtaaggtgtcaaaatctagtacttcttcagcttcaacttgaaggcttcttttgtggaaccacctttctgcccatcataattatcagctcttttcttgtaatttatagttttattgttagtaattagaacagtaggctttaaagctgaactgattaaatggatctgagtctcagttctaccattactagctgtaaagcaggcttatggtagtacctatttcactgagttatggttagcattacatattaataaataatatatataacatgctaaaaacagtgtctggcatgtagtaaatgttcagcaaatgttagccgcaacagcaacaaaaataacaataatttcacatccttagtttgtcccatgatgatatggtttgcctgtgcccccacccaaatctcatcttaaattataatccccatgtgttgagggggcatctgtaatacccacatgtcaaggcagggaggtgattgggtcattggggtggtttcccacatgctgatctcatggtagtgagtgagttttcatgagatctgatgcttttgtaagtgtctggcatttccactgctttcactcctttctcctgccaccatacaaagaaggtccttgctaccccttcacgactgtgaattttctgaggcctccctagccatgtggaactgtgagtcaattaaacctctttcttttataaattatccattctcaggtatttctttagagcagtgtgaaaacagactaatacacatgatccataattgctcaaaacgtcaattactagcatttagctgggttatttttctgcacccccaagcaccaagcgtagtgctgagcatatagaaatggcttgttaaatattaaaaggataactaggtaaacagaccaacagttaaactatacacattacttaaggacagggactaggtcattgttgacttagcgtcccagtgcctattggatgaatggatcagaggatgcaaccagacttctacccaagttagcaattctacatgattcagggattcatttgagaacttggtttaccaaataggttcctcaagggttccctaagtgctctgtaagcttgttccaagtgcaaagttagatgattttggtgtttgttatgttaaggccagtcagaagaaaaggagggaaagaaatagaagagttagtttttgttttatttcagttgatttttttattttagacacctaccagtggctatttgagagcatgaggtgaaattgctgctcttgaggaatgaagttgaagttatcattggccatttatttgctaaagttaaagttaactaatcatcaaaccattgaagctagttgcatctgccacctacttctctacactttaatgctacattacaggaagcatcaaaacaggaaaggacttaggattgggtctctaatcacaccctgcctgtttctgatcatatctgtgaaccaggatgaggaaggtctctctgaaaagatggcatttaacctgacaccacagtaacaagagttatttttatttgtcagcatctctgaatctgtgatattttacaaaatatatttataaatcaaaaatagtactgttattttgatttgtaaatcaaaattaagtactgcttcccatttgtcagttaacttgagatgcgagaccccaaactgattacagacagcaggtgtggttcaaaaattaattacttgccaatattttaaatgtcaggaaatgacataagaatgtttttgacttatctttaaaagatcagatctggcaatgatgtgtccttactccccatgcagcaaaagctggctaaatcaaaggagcagctttccacttgatacaaggtgtgcgctctctatgttacaacacatccccctcctcctaccactctcttacataatccccctaactcccactagcattttatttcattcacctaatctagacttagagtagattctaacttatttccactaattcagaaattagtttcaatgtatgcttaactttttattgatagtctctggaaattggtttctaaaaatcagcaataatatgtcaataccgttaatatcccaaaacattccataatatgtaataatactttcttaaaagggttgataaatgcagtctgaaagagaggactgccttagtaaagaaaatgcttttgtgtggaaacatgtacttgtgtgtattcagaaacatattggaaattaaagaaacagagattttccttttgtcagcatctctcctaggaatcaatggtgtataactgtgttctttctatgaatgtctgcaagattaataatatttataattatcaatatggttccacaaacatgtacattagagagcctaaacctccataaattcttgtttgcattctgggcattcaagcaaatcacttcatgtttaataatagactccagattctctgtggaaattgttgaatgccattactatctgcattttgggctcaggcaaaatatatatgaaaaaagaaatacaacaagataaatgagtttaaagagctggactcttgtaagagggactcaactcattatcatcaaaccaaaattatgaaaagaaagaaagtcaactaatgtacgatctgcctaacttttttgctttgggaagccaaaaaattctagaatgacctggttatgttcaaatgaaaatacaggaagtagatttaaagtgcttccatccaattgggagaaactctcatgaagtggggcatcgtcagaatgcccctgtttgagtcctgccttttctgcttgttgcttgaggaaatcatttaacattcctgaaccgcaattcccttctttatttaaaaaaagtaaaataaaataaagtcaaatcaagcaaaatacccacctcataagaacactttgaaaatgaatagtgaaaacttccctgatacaagaatgcatatgatatttgtggtcatgtttcttgtattagttttttattgctgctgtaaaaaaaaaaattaccgctaatttagtggcttaaaatggtacaagtttattatctcacagttctttaggttagaagtccaacataggtctcacaggactaatatcaaggcggcaccagggctatgcttctttctttgtttcccttttcttagggagaatctatttctgctcattcacgttgctggaaaaatttagtcctgtttggttttgggactgaggtccctgtttctctgctgacagtggtgggtggatcccagcttctggcaccttgacctgtgacccctttcctctgtcctcaaagctggcaatggcaggtcaagttcctctgagcatccagtctcttctgcctttttttctgtcaatgcatttgtttcattgattctcctgtcttcctcttccactttgaaaggcccatatgattgtattgggtccacctagataattcaagataatctctctactttgaggtaggtaaccgtattccaactgcaaagtcccttttgccatataatgtaacatatttataggttccaaaaattagaacatagacatctttctggggagttgagaagaatggattattttgcctaccatagttctttactgtatttaataactttgtttttctgggaagtctgtaacatccatattaaattcccattattcttaaatggggactgctatcgtttgaatgtttgccccctccaaacctcatggtgcaatttaattcccagtgtggtggtgttgggagggggacctaaagggaggtgtttgagtcatgggtgcaaacccctcatgaatggattcatgccctacctcggaggtgagtgagtttttgctctattagttcccaaaagagctgggtgttaaaaagcccaaaaactccctcccctctccttctctcttgcttcctctctcactgtgtgatctctgcacacactggcttctcatcaccttctgccatgagtgcaggcagcctgaggctcttgccacatgcccagtcttgatttttccatatatcacaatcatgagccaaatctttctaatttataaattactcagcctcagatattcctctatagaaacataaaatggactaagagagttcacataattgtgtaaataggaatgttatgaatgtgtaaataggaatgttaagttttatacttaaacacttttggtctgtaattgagctagtctgtttgataaatgtctctctcacatttctgggaagcttggaaagaactctagattcaacgataaacatatagaatcccccactgagtagcagggcaagatggaagattaataggaagagtaagtgatgctaacatcataggagagttagatgagcttgaggagagaggactgttgactccagctgtttttcagggtccttgcagatggcatagccccatccactgaaagtgagtagagctcccaagagggtagtgagagatgaggcaacaaactcaccacttccagaaatctggtcaaaatcaggaggacaatgtaacactactcactcatctctcttcctgatcccaccttatgtgaattcatttacttcttccatttaaagtggaataataacttagtcgtgctaactaatgtttttcaatccccctacccccacttatgatcttttattcctcctttagtccccagattcctcaatattttgtttttgttgcattagatctctttcaatgacaaagcatacgtgcagaccgtttcctcaaaaagtatctcaaaaaggtaaacataaggtgaccacatgagttagcagttccacttctaggtatatacccagctctcacattctctggctgcgaaaggcaatgaagcagtagcacacagtagctaatagcttgggatttggactttcgattgctgacttcctgagaaagctaccaaattttcctattgataaaacaaagtcacattgattgcttactgcagtaagagagaacactaggcccagggtagtggctcacacctgtaatcctagcactttgggaagccaaggcaggaggatcacttggggccaggagtttgagaccagcctggacaacaaagcaaaaccccatctatacaaaaattttaaaaaaataaaaatatggatgggtgtgatggcacatgcttgtagtcctagctactcaggaggctgggcaggaagatcctttgagcccaggagttcgagaaagcaatgagctatgactgcactgctgcactccaacctacgcaacagagcaagactctgtctcttaaaaacgagagggagagagagagagagagagagagagagagagagagagagagaaacaccttgacagagtttttgtaacatctcagaaaagggaggtcaagggcagatattttttaagatttgggggtttaaattaaggcacttctttcaatgagggaagtttgatcagaattgtgcaaagcctgtgatgttatagttttgtatgggtgaatacagcaaagaggattttgaaacaagttgttttgagtaaaccattgtttgattagagagcttggcccagttgagtgatcagtatttcagaaaagggactatttatccctatggtaacttattttcatgactgattattcaaatagatggattttcaggaccaacaacaaaccattaaattatttgtaactttatcttcttgggtaagaatttcttacaatagtaaaatcctgttagtgcagacagttttagtttccttcatgctatttagctgggtgattgcaggggatttgttctgaggatatggaccaagttagaatcttttaatctatgataccagctctgtgaagggtcagcttctacagagttctctgacacctagtgaggggctgtttggtgtcatcacttatggccatgataaaaagtcaaatttatctgtcttttgtactataactttcagaaccaaaatagcacaaccactgagctccatgtcatcctaatatactgttgttgcttaagcaagacaattccataattggtgctatcaacattcttctgttgaaattacagtgttcatgtcctaagtaggggctttagtctgaaagaattcatttttctcattaccgtagctggaatcccctaccctataccctgtcctctcaagtagaccctactattcttaggcatgctttgatcagtccacctttctttctaccattttatgtggcatcatgtgtacaaatagcttttctcaaaaaaaaaaaaaaaattgacaattgagagtagtaaccccccaccaaaaacaactgaaatgagaaaagtcccccttgatccctcagttgtgcacatacataaatgagtctcccattcctggaaacaagttccagctaatctttgcacagctgtacagctaacttccctttgctaagcacaaaagtggtatcagagttttttttaagctaaatcttaaactcttgcatttgactgattgtggagcctaaaatgtagtatctgtcctgctaaaagatgggttcacatataattttgaatgtcatgatgtcacgtttacagtattctagggacatgagtagggaccaattgggaatgtttcgggaagattttacagagtaagtgaaataagagctgctccttaaaagatgtataggcaattatatgcctgcaggaaagcaggcagagatagaactaataaccagtcgtatacttaggaatgattttgtaaattgttaaatacaaagtggtgactggtcttgtatattgaagttagccccacatttaaacacagctttctggccaataggtgtggattccttacaaactcctcaacaaatacacaactattcagttgtaggggcctgttttcaattgccctacgtaaaagtcttcctgaggatgacaatgagaaagaagtaacaagctttgaacaaggaagacagaaaggatgtagtgggtaaatacaaagaagtctacgtttctcatctataacaaatgtgttcttgatttattgtgtggtgatactgtaagggagccttcacaatgactgaataggaaaccagcacctttatcttagcagggaacttgatgcctgccatttgaaatcacactctgaaagcgagctttaacacattgatgggtatgcattggaaaggtaactggcttttggaaattgccctgaaatcatttatgcttcaataagaagctatcattgatgttggtagtcagttacccgattcgtgtgcatatttcctgataattattttttttttccattaacagtatagatcaccttggctttaagtgccgtttacaggattcaattaaggatggcagattacaatgtcaggagtctggggagaaggagtggaattcatagctcttcactttctcgtcactgttattgttacacaaatgagtgtcatcaccacttgaggtgattgtctataacgagaggaggcttgagcagaagactaactgatttgctttatagtcattacctgacaacattatggcaaaaccattgaagattttctggaagccttgcagatttcactgtcaagcatcttattaggcatatccggtattgtgggcatttctatcatggagtattcaagatttaggtaccctgttgaaatgccttctttcactggtctctgctctatatttaaatttgttttaaaaccatctggagctactatggggctggtaggattattttaaaacagaaaatactattgatccttctgtgaaaatttcccgagtcaaatctgctttctttgcctacattttattttctgaaaaaaatggagaggaattagtagatcagtattcacacgtgtagactgacacttatttcagaagaggtcatatgggggtgttacaaagcatgggctgtggaggcaggctgcctgggtttaaatcccatgtttcaccacctattggttctaccagttaacttgcttcccttctccaggcttcatccccccatctgcaaaatgggagtaatattgggacctaacccacaggattattgtgagagttaacaacacgaaaagtgactaggggctgggcgccgtggctcacgcctgtaatcccagtactttgggaggctgaagcgggaggataacaaggtcaggagatcaagaccatcctggctaacatgatgaaaacccgtctctactaaaaatacaaaaaattagctgggcatggtggcaagcgcctgtagtcttagctacttgggaggccaaggcaggagaatcgcttgaacccaggaagcagaggttgcagtgagccaagatcacactacttcactccagcctggtgacagttcgagactccacctcaaaaaataagaaaaaatttaaaaaaagaaaagtgactaggacagtggctgatacaataaatatttgctaggactactattattgttgttgctactttttctgaaacacaaataagaccatgtcactcttctatgtcaaaacttcacaccagttttccctccttccagaatcagatggccattcccagctcctgcttctcctcatacctctctgcccttattctgctgctcatacccacacttctgtctcaaagacctctctgactgtcttgaatctgtcacattctgtctgacagttctgtgtcttgtacacaccatctgaaatgcaatattccaccaccaaactgaatactggccactggacacatttcaccttacttgtgaagactcacaaaagcactgcctcttccttaacccccttagtggaaatttccatcttgctaggtcaacattattttttaaccacttccctgaagctcttcagagcactgtctcttccagggcctagcaaagtgttagacatcaaactgatgcttgaaaatgaaaatgtaaagtggtaaaaacttgaatctcttatttggtactaacttttcttttccagagagctttgcaactacagttgagagagaagagacattattagagatttcaaaagcatttctggtggaatttttttttaaatgcactcaaaagagcaagatactcagctgcctagggtgcattcattcatcaggacctcacagctcaatcttaccaaagtcttactagatcttactaaagctccatcttgtctaaagtcttctttagacagatactaaggaagcactaaccacacctctctcacccttcccaactctggtgtatacttaagaaatcttagctcttcaaccctgacgcaaactggcttccagaatgaataggcagagatcaattactacccaagataattattttcaaaaagacattcatgagtatgtgaccagaggtaacagatttagttgtgttaggtgacttcttcaagagtgaaggctccaccaagtaccagactttggggctgcatctcactttgtttctttctgagatgtgcgtctttattcttttgttgtttctctttgatgtgatcaacgcgaagaaacatcaccatatgtttctttttaaaatatgtcttttgaaatatcatttgaatgtttttgtaccctttcttctagccatttctcatgggattgttaatttccctctctccttgtgaagcctgtatctccagttaaaaagtaaaatcacacacgcatgtattcagcataccttggtccatgtcaatttctgttctaaagcatggtatcaaagaccctttgaaattgcatgttataaggaccggttataagtgacactgtctttgtccttaatcatgatccaatcttcctgctcttcctgaagagcaagttcaataagataactttatcaatgtgagtggatttttttgaatttctaccagaggtgtttttaaaagctccaataatgacccttctatctcccagcttgaaacatgaacttggctgtccttgtttctctgtggtgattatgacttccttatagggatttttctttcttctgctcactgaacctcatgctaacagcacatttcaggaaccgtgaatttacaggcttagtctttctcatgccaactggagggaaatctggggacccactgacctgttgaaaaaccgtatgttcttgctgtcttaggtggaaatctttcccactgagcgctgggctctgttttatcacttcttgtgatatgggcaaggtactcactgggtaattgctcatgccattaaaaatttatgttggcccacgtatcaagtagacatttatttttcagctgagagacgactggaacattttgcaaaggaaggagagagaaaaaagcatggaatttaatcagcaaatatctttgctagtcctctttctttttgccaagagcattacatttcaaatatttaataatcagtgagagttagggagcaatcaatgagtatggtcaacagctcttgatgaaatagggtcctgaagcctcctgtcttattaacccataagttactggatcatgggcaggccatgggcatcccagggaaaggttgggtatgtagaacagtagggaacactggagagggatgagtagtcctagctatcaactagtgtgaaggcattttagtactcaaaggtcattcttgtgtacatgactagttattattcctgtcttggcccatctccccccaggcatgcagtcacctgcacatctttgacgggttagcttttgttttactgactccataaaaccttccctaattcttaattggtccctatgcagtgtccccagagcactctaaacatgactttatagtactcaagagtataagctgagaaccagaagacaattatagtacagagatggaaagagtgtggcctcagaagtccggcttggaagtctctggacctcagtgtacccatatgtaaagtggggacatttatactgtcctagtctgcttttccccaaaagaagattccaaggcaagaatttggcagatgatcctggcaaacatgtaagggagtaggcgagtcaggcaagaaagggaaagaggccaggacagagcatggggatgaggaggctatcactctgggcatctagagctacatctcactggtgactcacagggaatgtctagaaaagcctcaaaatggtggtgaggaagcttcggtactcatctacaactctcatgcctcactgtttgagggatactccttggaggttatctccccagcacttatacctaacaatagcaagagaccactctcaagcagagaggcaaagagtgcgccacgttagcacgtatgctgagtatgttgacctgtatagaaaatgcctgccagatgacagcacctgctacagatacttccctcccagagtttctgtgttaaagtatccaaaggagcctgcttgatgtctaacctatagggccttctaaatatatattgatgaacaataagtgaaaagagttaactttttaatcactcactgtatgccagtcactatgctgtctcacagcttacttattaggtcgctctcacagctcacttatgaggtcggtgctatttttattcccattttacagatgagaaaccagaggtccccaactatgctattggtcaaggtttataggcaataaataagtggagtggtgaataaacccagtttgtctggctctgtagttcacagtcataactgctatgcatgctgactctccatctgtaacagaaaaaaaaggctggaaagatttttaaattcacataaaagttaactaactctaactcttgtttttaccttgctactgtggcaacttatatgaccccaggaacaacctgacattttcttaatttaaatcaactcattcatttttagtgcacaatggataccgcacttgtcagacaaagatgcagtcattagtcaagaacagttagtgaaggtctcctgtgtgcactgctttgttctcagagctgttgagagacacagaagaagtgggggagacagtcctatccatcacagagtctaaccagacaagaaagatgctcacaattatctacctaggtggcaaagataagaactaagcatgcacaactccgctaggcccctcaagatagaagagttggggacttccttctctcctgcaatgtattttccaggttctagctggtagaaatgcagatttagagcaatgtcttaggaaaaagaagtcttaaggggagtgatatatagaaaaaggaagggaccaagctccccacttgcagaagggaaagttagttatatgtaaactagcctcaaagcaattggaataaaattgagactttgggtttagaactgtgttaaagttgactgaagcactctgagatttaccatcaaagtctggcatcggccccataatatccaccccaccagtgtgtttaaacattaaataaaaagtaaatgagcaaaatggtatacaatatttatacatattatatctctttctttgcatgcacttgtgagtagtgattcattgtaagtattgcagagttaaattgttgagtattactattgcagatttgaattgtgggtattgctagtgtttaatgtagggcttcaagctatgggtttcaaactttgctgtacattcagatcattgggatacgtgttgaagtggaagttaccagagcctaccaccaccgctaacattctgattctattgaagcaacctcgttcagatgagttgtggaccacactttgagaattaagctacatacagctaataatcttgaaataagtgcttacccatggaaaaacaaaatatatttaaaaggagatatttaaaaatgggagtatattagagtccaacataagtacctagaggagagtaatatgaaagtatgcaagtgggtgggcaaacacggacagggccattgggctacaagattttattgtaaatacaaagtctttattggttttttttttttcttttttgagacaggatcttgctctattacccaggctggaatgcagtggtatggtcacagcttattgcagcatcaatctcccaggctgaagtgatcctcctgcctcaacctctcaagtagctgggactacaggcatgcgccaccatgcttgatttttttaaatttttttgtagagacaggatctccctatgttacctaggctagtcttgaactcctgtgctcaagtgggctcttgaactcctgggctcccgcctcggcctcccaaagtgctgggattatatgcatgaaacactgcacctggccaataaagtctttatatatcagcctccataattctcaaggcaagttcaatgcatcctttaatctgatgcaaatggtaggcagcaagtaagataagcttgagttgaattccagatttgttaaataatgactattaggcctgaagcaaattatgtggcctctctgggcctcagtttcctctgctgagaaaggagaaataagacctagctggcaggattattttaaggataatgataactcttattgctatgtgtggccaagccctcagtacattttatgataatttgggggaagaatcctctctcaggaaagtaaaagaactcttgcctattaatgtggatattaaatgtacacaatgcctatgtaaagttcttagcgaacatagagatattctcaatgtagctgggcatctgtcctcaacgatgcaaactgtcctgctgtgcactgcagaaagcatagaaggtgtgaatgtacctcagaggtcaaagcattttgctaattagaaatgagtatttcagccgggtgcagtgactcacgcctgtaatccccagcactttgggaggctgaggcgagtggatcacaaagtcaggagatcgagaccatcctggctaacatggtgaaaccctgtctctactaaaaatacaaaaaattagccaggtgtggttgtggacacctgtagtcccagctacctgggaggctgaggcaggagaatggcgtgaacccaggaggcggaggttgcagtgagccgagatggcaccactgcactccagcctgggtgacagagtgagactccatctcaaacaaaaacgaaaacaaaaacaaaaaacagaaatgaatatttcacaccatggcaggcaagtcaaatcctataaaccctgtaagtttgattacatgcgtctcaatcccatagacattaaccctactctagacaaagaatctgccacttgattgcttccaaataaactgacataacctgaagaaaggtacctacctcagtgtagctgcagataggaggaaaaactgatatgtaggtaaccatgtcccattaaggtaccagtaatttaactctggtggacctagggaggtacatggcaagtcaatgtgaggtatattttttgaagggagacaatgccaggaggcatgtccttagagagcgagttataaagtgcccccggatttgtggaaaagcaagtggtatgagaggctataagatataaaggaggcaatggtatgtataggtcagctctgagccctattgtgaaagaccctctatagcaaatgtgggtgactctgttctttcctggaagaaagttgatctagagataaaggttttttaagaaaaattttaagtaggaaaagtgggagaatgagctgcctttactagggtgaggttaagcaaggagctttcagaagtgttctagggaaagactaaggatgtgcttcttctgattctgaggattcatgtgctgtgttgcgtcatttggtgaattttaaaataagtgacattaaataaattccacattccttggggagagaaaagaaagagctaacatttattttcctactatttaaaattacttatatggtcttgttcaatactcctaacaattttaagctgtgtgtttttctggaattcccgttttgcaaataaggaaagaagtaacaagaggtgaagaatgagtatcttttcagcatatccaatgagtcatccattcacccaatggatattcattgaacaactactctatgccaagttgtattgtaaatactgaggatgcaaccttggacatgaggtttctgatcatatggaggataatatttgagtgtacaaaacagtgataaactaataaataaataaagagatagccataggtgctgtgaggaaaacaaaataaggtgatgtgataccaaaggatactttggattggaaggccaggctcctttatgaacatgacggttgatttgacatgtgggtaacaagaagccagccatactgatctggggacagaatgaacttgttggaaggaacagaaagcaacagaggagcagaaccctcgaggcctggcatgtcctagggagtggaagtgaaagaagccaatgtgattgacagtagaaggtgaataggaggtaggaggacaggtcacaaactcagagatagacaaaggccagtctgtcttgggcctggagaagagtttgggttttattaaaaggacaatagaaagccgtgtagtgattataattagggaagcaatatgatctcagttaaatctgtggttttgaggatggaggttgagctatgggggtgaaagcaactgcaagaaagccagttaggccagttggttttattattccagatgagagatagatatagatagatatgattatgtatctgtatctatgtatatatgttatatatattgttatatattgtatatggaatactatattatttaggaatattataaaacacgcaaaatggacattaaaaattgtcaactaaagagaaaacacactctacatgatttatcacattaaaagaaaaaagtgtgcttaatgtgttactattgaaagtgctattaatattttagtgagattaatataattgaatatgcttctgttaaaaaaaatttggcttcacactttttgatgcaaagattcaaagatctgattctataattagtttatttccagaatagttttgaatagttgtcacaactgagaaagcatctcctaaagaaacaatctgtaaatataaaataaagacttatggtaaggtgcatttaacaagagtggagcaatctgtgtctccaatttctgatacatacgtgggtttgttttttggtagactttgtcaggtcttgttggacagaatatactcttcaatgaggctggagaagaaatgagagaagtggaggctctgccacttctaattgttcacttgtgccagtagtaatattttcttatttccaaggttccactgtggctatcttctaaaaatccattccttcatactgtggggattaatttatactggataatatcaatactgtgagtagaatatgtgtcaatacccataaagtgtgagagtatgtttcttccaatgctcagagctgtaagaaccatggagtagaaattacatcactctaaacccctgattgtaaagataatcaaagaaagggaggctagataggggatatggcttggtacatcctccatgcattcctttattcagttttgtgccaggcacagttcttagaactggaatacaatagtaaataaaacagaaaataaaatgtgcctggtattagtatgtgtgtataatttcctcattaaactccttttctgatttagcctctaaaatggtgttgagtgctccttacctcctgggatgcatgcccatgtgcattcccttctttttgtgtgtctgccaaagctagtgactcattcttaacaaatgaaatagacaaaggtggtaggatgttcctttctgaaattaggttacaaaaagactgtggtgtctgtctttggtgctttctcttatactgtttcttgcttgctttgaaagaagttagctgccagattgtgacttgccctatggagagatctgcatggcaaggaactgaggcacttattccaataggcgtgggaaactatatcctgccaacaaccacatggtgagcttgcaagtcaatctttccccatttgttccatgaaatgaaacttagacctcactgacaccttgactataaccataaaagagactgtgaaccagagaacccaactaaaatgtgtccagatttttaatctccagaaaatgagagaagataagtgcttgttgagtcactatgtgttggggtaatttgttacacagcagtcaataactaatatgccttcatttaagttaactgtctttaatgcatacactcaggagaattagagcttatcagtgaaatgttccttaaggagtttctcaactcacctactgaaagtacctggccatatctattagattcatcaagttggagaagtatgcagtgtaaataggttgagggacctcatcagttctaataccacaagtccctaagtttctgggagatagatctgttgataatagctttattctgtcattcacgttatacataccttttccttttgaaataagttggaaaaattaatttcaagaaatttaaacacaaaagatttaaattcacactcaaagtcaagataaacatcaaatcctcccaaaatatcagaaggtacttaaggaagttcaggaatttgtgattcttccaattgttgtggcagtagcccttgttttcccagagggcctttctgctgtcttaatttttgcttttacagaaaccatagaaaacatttatattgcttatcttttggagcaaaccaagagaatcgctgatgccactgcatggaagttaatggcatggattaataattcatgttcacaaactctgttcacatgtaagagtcaagctgaaaagttgaagtacttaaatactgaatttttccccagcaattaaaaagtagctgacagaagctgtaacttaaggtgcctttaacatattaagacataaatgaatgtgtaagggcacatatataaacaaatacagtaaatgtgtatttatttacataccacatcttatagaagttgagataaactttaaagttcttcaaagagtcaaaggatgagataaaatatggattttaaatactgcttcttgaactgactctgatcttagaatatatttcattttgctctaaaagtagaaaagaacaagtaaaatgtcatgagttttcataattttttggttccttctatttccccttgttttatttgtatttaagtgtttttgcttcccaagaaatgatggtaatgataatggcgatgatggtgataaaaggtaggaagactattttatttgtttctatctctgctatgatttgaatatgacttgtcctcagcaaaactgaggacaagttttgctgttgaggcttggtctccaatgtggcagtgttgggagatgataccattgagaggcaattgggtcataaagcgtactcctttatgaagggattaatgcagtcactgggagagtgagtgagtttttgctttcctggactggattatttgccagaaaagtggggtgctatacagcaagtctgcctcacaagtttgttctctctgcacacacctgcttctttcacttctctgccatgttgacacagcacaagaccctccccagaagcagagcagatgttggcaccatgcttcttggacttcccagccaccagaatgatgagacaaataaggctgttttttaaaataatttatgcagcctcaggtattctactacagcaacaccaaagaaactaagaaaatggatgctgggaagtggagttgttgctatgcctgaaaatgtagaagtagctctggaactgggtacctggcagagatttaaagagtttgaaggagcagactagaaaaagcctagattcttgtgaggacatagaagacgagaatactagggaaagtttggaacttcttagagattagttaagttgtggtgactgaaatgtagataggaatatagacagtgaaggtcattctaatgaagtcttagataaaaataaggagtatcttattgggatttgaagtaaaatacagttgtgaagaacttggcaccattgcctccctgtcctagggctttatggaaggcagaacgtaagagtgatgaattaggatttctggaagagatttctaagcaaaatatagaaggaactgtgtggctacttttggctgcttaagctgagattcaggagcaaaagagtaatttaaagacaaagtttataattaaaaggaaagcagagtctgaaaatttggaaaatttgcagacttaaccatgtaaatagtaaaaacgcatgtcctgaagagaatgctgagggtgggtgtggcccagcaacaagttgctagatattagcatggataaaagggattcagttgttgtgcatcaggacaatgggaaaaaggcccagagacctaggagaacaaaatggtttcaggggacaggtttggaatgttctccatgaatctgctgcccaggaccacctctagttgctgctcctcacgtccaactcacatccaagacacttcagtcttggctcaagtggtcccaggtgtgactcaggccactgctccagagggcacaagtgtaggccttgttgccattcactaccaagtggtgctaactctgcacatgtgcagaatgcaagagaagtggaggcatagcacttctgtccaaatttcaaaggatgtatccggaagactgggggcccaggcagagacttgtggctggggcagagccaccccagagagccttcactaaaacaatgctgaatggatatgtgaggctgaagccagagtcaccctcacaaccccagaattgtagagctcttggcagcccgtaatgctagtctgagaaaaccacaggctctagtgtacaaccctaacctttgagagcagccatatgggctgtacccagcaaagccacaggggaggagctgtctgattcctaggggatccacacttgtagcaatgtgtccagaaggtggcacatggagtgaaagattattctggagctttaagagctaatgtttgccctgctgggttttggacttactttgttccagttgctcctttctttattcctatctttcctttttgaaatgggaatatttaccctatgcctgtttcatgatcatattttggaattagataacttatttttcatttcacaggcccacacctggactttggaccctttgggttgatgctagaccatgttaagactttggggactattcagatggaataactgtattttgcactatgaggagaatgtgaatttcctcacagtggagggcaaggggcagaatgcaacggtttggatatggtttgtctccatcaaaactcaagttaaagtttgctccctaatgtgacagtgttgggaggtggtgctttaaaagacgtttgagtcatgagggatctactctcatgaagggattaacagtctcacaggagtgagtgagtcctcacttctacaggactgaattcatttctgcagagcaaattaaggctggccctcgtatttgctctctttacacattcctgcttcatcttccgcttctccatgacattgtaatgcagcatgaggcccccgccaacaggcaagcagatgctggtgtgttacttcttagacttcccactccccagaatcatgacagaaattatctcttttctttatgaattacccagcctcggatgttctgttattacaacattaagctgactaactcagtgttatgggtcatataaaaagttggttgtctatttcagatgctcctcctcactattttttgttccacattctggaaaccactgatctagtaaggtcttatttatttatttatttatttatttatttttggaagaagacactactacatagactgtgtatcaaatgacactttttacatagatggtgacagggtgatagatgtcactaataccaacaccgtccacaacaagtagtaattcttacttaactctttttggttatctgccctgtgcaggtgttgctttgaatacttcaactggttaaattcatttaataaccactctgtgagggagatacatctaccctcctcagagtattaaagtgcctctatggatacatatttttaaaaacgtatttgactgtggttcaccataagaaatatattttacaacatgacccaaatacacacatcagaagaaaagtattttctcttctttttcattttaaaaatttttttatgaactagaaaatgttatccctttcttctccttccgtttcctccccctccactgatatcaccatatgttgaaaccagtttacatcatctaatttagtatccacagtatccttgggatacacattgttatttccattttacaagtgtagctctgaatactaatttaaatctcacacaagtactgaccagctaataggaggcagtgttaggatttagacccagatctgtccatttcaaaacactggttctttcatcctgcattgtaaagccatgacagacatgacatctatctgtaagggtggtgcttcaggtgactacgtagcttgtgtgtaatgttcctgtgatttagtcagattctttaagtagacgatatggttgcacagtagcatgactcatcattttgtgtgtatgcataatattgcttacaatacaatattatacattgattaatttattaggtatatatagtatgaatatatgctcttcatatattcatataatgaggtcacagctttcttaaatttaagctttacttaaagttatagcaaagaatgcacaaccttcaggacaaaatacaggcagcagaaaacagcatattataaataataaatatatgacatataacagattcattaatttatgatattatataccatataatattaaatggagcataacactatatactccatattattaattaaaatatgtatataccctctaaaattatataccctataaaattaacaggtgaaaatctgacaaaaatatgctgaaatccatcctaactaaaaattctcgaacacttatacaattataacagaaaagatatcaattgaattttaaaatccaagtttacataactgataaactgcccattggaatttagtatacaaaagttatacatgaaagataatataatacaaatttattatttttcttttttctgaaccattttatttcccagtgttttttacctttggggtaacatagccatctggcacttaaacgtcacttaaaaataaagttatagcacaaaatgtataggctttagggcaaaatatgagctacacacaagaacagtctgaaatatatgaactgaagaggcacacattattctcctttaaacctccccccggggcatacataagcatagcaccatttcagattcatccagaatgggatgcaattcaaatgttctccatgtgatattctctaactggaaactgacttcttgagtaaatggttgcacttgtgttagcctgaaactataatgttgaaatatcacttgttgtagcatatttattgtgatttgagtggggaaaaatggtatccccttagtgcccctcgatataaaagaaatcattcaaaaagtgctattaatcattgttgaagttgaatgtcttatacatgaggatctattagacgatctatatttgtttatattttaaaaagtcctgttaaaaaagttttgagaaatttcaaaaataccaaaagttgctacagatatgataagactcaatatatcttcctggtagctgtgtaaagtatgaacaagtatttcagaaataaacttggcaatatatgtaaatgccataaagatactgagagtcttgaaattccacagccttactccttggagtttaaggtaaataaataatctaaaacaaaagaaaaacaagaaaaaaattgtattatctaaaatagaaaaaatctgaaaataattaaaatattttacattacaaataagcaagaaaattgttttacctgaatggaatatgttttgatggttcaaaattaatcatgtatacaaataaaaacatttctataatataataataaaaatctacttatcactaagtttcatgagggtagaggttatctatttttgctttttattatattcctaaagtccagcaaattatttgcttatattaggtattcagttaaaatgtatcaaatgagcaaaaatttttacaaaaatggtatagttagataaatcaggagtggaaataaatacaaaaaataaagagagatgatttgttagctttttgttggagctctcaactgatggattattttatacttttccatttatctagttcttatagttctatttgcataataaaatattaaggaaaatgatttagatggtatatatatatatatatatagtgagattattaggacattggcctttaaaagtaagatcctctggtttgtaatttgcataaaatatttgttcattctgtgtgtatggcattgccctgggctcccaggaaggaagccatgggactttgcttccgcctctcattgacaaggtgagggaggtgggcctcttaaactctacatgtcctttcagcttttaaacttaccagatgatatgttagcttgtgattcatgtggcagttggagttggatgccagctcctctacacaacagctgtacgtccgtaggcaaatcattttctcctctttgaattgttttcttcatttgaaaagacaataggaaggattaaataagataaagcatggaaacactggatatggttcttagtacatggtgagtatataataaatacctgaaggagaagcagcatttcacagattctgctacatatataacagaacatgcccttttccagcaagtctcttgcgttgccctgttctacccggcaaggacccaggcaccaaggagtgacgatgaaatcatatggtttttcttctgtggcttattgatatggtagactgcattgatttattttttaatgctgaaccagccttgcatacctagaaggaatcccacatagtcatggtgtataattctctttatatattgtcagatttcatttacaaatatgcgctgaggattttttacgtaaactaataagagatattggtctgtggttattgttttgtgtactgtctttgctgggttttagtatcagagtaaaacgagctttcataaaatgagttggggagtgcttccctgtcttccactttctaaaacaggcaaaattggtattaattcttatttatatctttggtagaatttccccatgaagccatctgcacctaaaagttcactttttttgtagtttttaattgcatatttaatttatttgatagttatagaactgttcagtttgtctacttaatcttgattgagtttaggtagtctatggctttcagggaattggtgtgtttcttttcagttgctgtatttatgagaatgaagctgttggttggttgttgttctatttacctatcttttaatgaccgctgaatctatagcaatatagtaaattattgatgttggtgatttggtatgtcttttctatatgagttttgtgataattctatctattttatattttttaagagctgaccttttatttcattgatcttttttcctatagatctttattttcggttcatttgatttctgctcttaatatttcttctgtgtgctttgggtttattctgttctttttctcatttcttgaggtagcaactcagagtattattttgacaactttcctcactttaatgtagtcatttaatcatataaatatccctctcagctgggctttagctgcatcccacaaattttgatatgttgttggttttcattcacttccatgatattttttttccttgagaatcttctttaattcattaattatttacaagtgtattgtttaattgctacacattgagagattttcctgtttcctgttactgatttttctgtttgatttcattgctgttctagagcactctgcatgattttatttcttttaaatttgatgaagtatgtttatgataaacatgttctatcatggtgaatgttctatgagcacttgggaaaaaatgtgtatgtttctcttattgggtgaagtattctgtatatgtcaattacatctttttggttgactatattgttcatgttgtttatattcttgctgagttgtgtctagttgtttaatactgaacaggaaatgttgaactcttcagctgtaattgtggatttgtctattattcttttcagctccattggtgtttatttcatgtattctgaggttctgtgttttagtgaatacacatttaagatcataatgtttcttggttgattgatcctttttttttctcattattgtaacatttttctgtgtctctagtaattgcctttgctctgaagtccattttatcaaatattaatatagccactcttgctgtttttaaaaaataatgtttacatggtatatctttttgcatcttgtttaccttcaacctaactagtaagttgaatttgaagtgagtttccattttttaagtagcatataagtgggtcatattttttatccattttactaagctctgttttttgattggcatatttagaccatttaaatttcaggtaattaatatattagtgctttattctgccattttattatgtatttatagttttctctggtacttgctcttttgtttcttttatgtcatcctttgtgttacttgaacattttttaggattccatcttgatttatttacagtgtttgtgagtgtatctgtatttctcataatagttgttctgggtattaaaatatatgtacatgacctttaatagtctactaaagtctacattttattatttttgtgaaacttggaaaccttccatttaggtccctttcttttctccactttaaatatcattatcttgggtgtcagatggtgttaccattttgtctcagtcatcaaatgtgatttagaaacttatgataaaaatgatagactattttatgtgcccatatttctactttgttgttacttatttcctgatgctccaagattccttcttttgttatttcctttctgtttaaagagctctctttcagagatatactagcaatacattattattattatttgtcttagaaggtttccatgtctcctttatccttgaagggtagttgcgctggatatagactttacagtgagcagttatcttctttcagaacttgaaaagtgttgtccttctagcctgtgtggtttcaatgaggaaatatactgtcaagtaaattgatgttccctacaggttgcatcatttatctttgctttcaagatacttcctttattagttttcagaagtttaattgtggtatatcttcacatgtttctttagatttatccttttggagattagttcagcttctttagcctataggtttgtgtctgtaaaatttggaaagtgtccagccattatttcttgtactaccctttagcttcactctctttctcttctccttctgggattctgataatacaaatattgaatcttttgttattacacaggtgactgaagctctcttcgtttttatcagtctgttgtctgtttttacattaggtaagttctgatgtgtcctctactttacagattctaatctctgtcatctatactcttgagcccatccagccaatatttttattgttatcattgtaattttaagcaatattgttttcactgggttctttttcataatattatttcccttgatgaaagtctgcagtttgttcatttgtccaagagaactcataattaattgttaaatcatttttatgatggctgttttaaaaccttggtcaaataattccaacatctgatttgtttcagtattggcatcagttggttatcttttctcaatcaagttgtgattttcttggttcttagtatgacaggtgattttcacttgcatccttgaaattttatttattgtgttaggaggcattgtgtcttatatatatgttttattttagcaggaggtagccactgttaaaatttggcatgtgggtgttggcctgcttctgtggactgccattccaatggcagtttaatttctggagtctttgcagagctatttttgctaggtttgtttataagttgctgctcaggctcccatgggttcctgatggtgctacccaagagaggagaagagcagtttcccaggtcagcctgcttggtggaggagcactgtggtggtatcttcctatttctcctcaaaccctggtttctctaggtaatggatgaaagaaatacaacagtcatgggcctgcagggacaaagaagttaaaagaggctcagggacaaaggggccaggcttcttgctattgctgggcccctcactcacccttcttagtgtccctggattagggagaaaaggctcagacccgtggtgacaaagaggcttcctggaccaaactcttgctacagctgggtctctcttactggtttggccttccctgcccatctcagtatctctcaagagaaaaaaagaatctcagggccagcaaggaaaaaaagtccctctcccgattgcttatttctgatgtgattcccagtaggtcttccttgaaagatgttagtctcacttgatgttgtcagagggattcctgcatgaggaaagcataaacctaccttgaacgtcttctgttgctaggttgtgagtctagacatactgagtctgggtcaccttctgttggataggggaacacaagtagcctgccctttggctgttcctctagtccttggttcccaaaacagatcaccttcttttaccaccctttaaagttatttgattgcacctcctgaagggtttatagctgtgcttaatgaggaagacctgagaaaaatgggtctatgtccacttgtccagagagaaagtataaaacatatttttatggccacctttttcctctatcaagtgatgcccaatattttatccatgaaactcatcctgcgtccctcttatcagtagtagaatgtggaagcttctgggcagagacctgtaagcagctgatgtgtatattgtggggaggtggtctgacctttaatcttgtactcaaaagtcagcagtgctaaagtatctctccatagaccatgtattcattgcatgagtaaaacatcatctacctagtgaagaaacccaacaacatcttgactcagttatcattatcaatggggacaactagacactgtgagcctctggacatgatatgctgagaatacctgcatagtgctctgatcaggaatgcttaattgtaatcttatcatcagaaaacactagaacaaagtcaaaatgagggacaaatgattcttttagacatgagcctatatattttttaaaaaatgatgtcataaaaaaacacaaacaagctgagaaacttttcctgagtgaaagagactgaagaggcattacatctaaaagcaaaacacagtcctggattagatcttataatgaaaaaaattgctaagaagtacatcattgcattattgggacaaataaaatattcgtaacatggaagtagattaacatggagtgtcactgttgaagtttctgatttagtaactttactgtggttatataatataatgcccttgtttccaagaaaaatacactgaaatataaagggataaagagaagcaactgcatcgaattaagaaaaatataattatagatataaaaatatatagatatagatgtatgtgtgtgtgattatacccacacacactcagaaagagacagagaaggagaatgtgttaaaaaatgtgacaaaatgttaattggtgaaaggatatatgaagttttctgtattatttttgcaacttttatgtaagttttaaaatatcgaaaaataaaaattaaagaataaaaatagggttaatactaatacatctattctcatagatactatagaaaaatctaggaataggaattctggcccttgctttgtccacttaagatttaccagccactagagaaggccatcaggttatttagaacttgtggccatgtctagcatggtcatgaagtggctctcttggtcatgaagtggccatcatgattagggccaggctttggaagtctgagagccctggatagggatatgagctactttcagtcatgtgtaaacctacaatttatgtcatctcaataaataagcagtgagatgttttagaggtgaccacatcacagccaagctgtcacattaggccatgactaaaagtggcaacgtttcccatggggttttggaaaccacatatacttctctcatggagtataagcccacccattatgttccatgaattcttccttccatgatcaaaagcaactggttttgatcctagaattatctagatttactacagtctctaccaacatgggaggtttcagtgcgtggctcgatttatttattttttctctcagatttatgttttcttacagattacatgttagcacttccactttgcaaagaatgtctgcatgttctttttcatgtaattcttttgtgccctttaataagaagagataggagagttgggtgtctggcatatacatgagcctcatttgtataattaaatagagataatctcactcttggtatctctaagaaaagagcataaatttgaaatcagtcactgattcttgaatttaagtcctaacttcaccatttattagctctgtagcctgggcaaaggtttaacttttctgagcctcagtttcctctcatgcataatgaaaatactaatgcccatatcacagggtgactgtaaagattaaagatcatatatttaaaattgtgggatgtgataggaactcaacagatattactaacaatcaataataattgtattattgattcttcttccaggaagtccaatcttttgaaaacaatcaataaggaaattttgttcaaagaacttttctaattccattagtcccagatttcctcatcatgtagtttcttcaacacaaaagaagtatcctctcttcaagtatatacaaaaatagcctgttggggttctatagcttgctcagagaaaatatttccctagcatttcccacaagtaaaccttgcctccctttttttttattatcgaagtccccacagataattgtttgtccactagagaagttaatgtatgaaagtgacttattgaatgacctctcccaaggggcaatagcctacaatgcatttaccctacagggtttagagttggggacagtaatttgggttgggcacagtaatttgggttgggcaatgttttaaaagccgattgtgccatgtggctgacactcaacttacaagtagactggaccctcattcacgactgtccttgagaagcatgaacattgtttcttgttaagcaaaataccttagtttagctcttgtgttctaataattaggagtgtgagctctgaggccagattccctagggttgaatccggattctggtatttcacatttggttgatattaggttgatgggacatgatgaggatttaaagattcagtgtacataaagcacttgatcagtgtgtgtgaccagcagtagattctcagtgtttttaacataaatttcttttatgaaactgtatctctagaaggcatttgagacatcgcctagttcagtggtttcaaacatttccttttagctataagaagttttttgccccatataaaaatgtatataaaatttcaatctgtaaaagagacctgttctgattaacttaaagcggatgaggccagagccctccactttctgttgtccttggctgcctccttccactggggtgaatgcagagtcatctgtgcagagttgctgcaatctggttatttattgctatgtaacaaataatgggaaaacagtgactgggaacactaaaaattgctgattttgccctaaatttgggagttgactaggctctgctaggcagttcttgctcagattttgccacgtagttgcaatcacttggtggctgggactggagatctcaaaggcttctttgctccatgtctgtctagatgggaagaacggggatgccttggatatctctaacttcccatagatagtctttctgcatggtggcctcaaaatctctgggcttcttttctggcacttgcaggcacccagaaagtgtcccagcagaaaccagcagaagattcaggcctttcctaacctagccttgggagatacatggagtttccacaatgttctgttcctctgggtagtctcaaaggcccacccagttttaaacggagatggcacagatactgcctcctgatagtcaatgaatttgcagacctttacaaaaccatcaaacgctgtaatctagagatccctgatagagtaacttcatttataatgcttaatgatgataatgctgctgacatcaataaaagctaatgtttacttggagattactttctggtaggctctattttaaatgctttacatgtttattctcacaaaattctctgagtagggacttattttcagatgaggaaactgggtcacggaagatgaaaatgcttccagattacacagagtataaaggcagagttggcaattaaagttcaactcttgaacactcccaagataaaactgttgaagtggaaaaagcagtgatccagcaaaaacctcacagtttaattgtagagttggcctagacaccattcttttttttttttttgagatggagtcttgctctgtcgcccaggctggagtgcagtgtttcaatctcggctcactgcaagctccgcctcccagattcacaccattctcctgcctcagcctcccaaatagctgggactacaggtgcccgtcaccacgcccggctaattttttgtatttttagtggagacggggtttcaccgtgttagccagaatggtctcaatctcctgaccttgtgatctacccgccttggcctcccaaagtgctgggattacaggcatggacaccattctttctaattctcctccaccatagcatctttttgtctttaactctacattattacttatgagctatttttccaaatttgttttgacataccaggttaaggtatcttcttgaattcactatgaagctcataaaagctcttgtctctttggtttttagcttccttttggtccactgtatataaaatagtctattgcatcaaatgcattctattcatatatcaaccatcatcaaatttggaagaaaattatttttgtttgagatgtattagaggtgtcatccccttcaatgatgataagaattcagagtcggtgtttgcttcacaatgcattgccctaagctgtagctttctttacttggaattccaaattcagctcttctgccagggggccagtttcttcaacttggtctgcaggaaaagatcttgaaggagcattgaacctgaccttatccagtcatctccattcctaatggtttggttgcccagaggcctggagggaacttcatgtgatattggacgatactgattaaatttgtttatctagctcatgaacacttgaaatccaactatgatggattggattgttgtttgtcaaatcttcactcacatccctcagccccttgggcagatgtacttcacttcctgctgacatgagttgagccacatgacttcttttggtcagtgaacctttatcaagcatgactagggcagaggcatagtttggctgaagtctactctcctgacattcaccatgtgacagacgtgcactggggatacaaggaggatgagaaatacttggtacagactcaagcccaggctgcagcctacttccgaatccagatatcccacatcatgaagcagttgtcctgctgagcaacctgcctcaaccaaatcagtcaaactgcagatctgtgagggtgagaagaaatgttcatctatgcaagacactgaggattttaggcttttattgcacagtatcaatgaagtaaaaagataactaatgtaacagctgatctttattgactatatagagtgttgactttattattgagtacctaaaatataatgccagatactgtctaagcatgttccatgcattacttcttctgattctaaaacaagcccataaagtagataatatcattatcctcatttcagaggcttaagtttttgcctttgatgaaaatgattcaaataatttatcaaaactcacccttttgaacatggcacaaaagtggaatttggatattcttattaagatcagaaaagcaggtgtttctgaaattcttgaggaacacttgcagcttctgctttttaagaatttattttgccattgtcatgtaggcatgacatgattaaggctgccatttattgactacgtgagtcagactctatgctttgatcatgacatttaatggacaatagccatctgagtttggcactagttttatcagcttatattatagacggacagctgaggtttggagaggttagcctatgtgtttaaggtcacacagattgcagctgattcatctagaattctaacacaggacttgacttcttatcgactacactaagctacctattatggtacttatttctttgctgcacaatttaccatgattcctataggttgttcataaccattttctttgtaggaagcatatatttcatatttgagctatttgaacagcttttgcaattacagattgatacaaggcactatgttcaaggcactgtgcaatgcaatggaaataaacaattggaaacagtttggaactgagtgtcagaaaatccaggttctgctgtcccacagtcatacagcataagagcataagggatgtcatataaaacctgcagttgagttttctatcctacgcaagaatttattgcctcatttgatggataatgcagccttacatagtggttctttttcactttgtaaaaaaagttggctttggactcaatcaaaactggactgaaattctggcccttctgcctgctgcgtataaatttcacttagctatgtcaccttgctaagcttcactatccttatctataaaatcctaagtgtagaactaacatcgcactcttgcagagcagagggtgaaatgtattaaagccctcatctcagtgactgccacaataaacagtcaataagtcatataacaacaacaactcttaaaaggaattgtgtccagttccctcaacattatgttcatttatatttggatatattcctgttttaatatattactcctaaaaatatcacacttagaattgaacaccttcttctagttgattttcaataccagttgaaagtacacaagacacaaaataagtctgttttctctccctaggtctcagtttcctaacattaaaatgagacatttgggtatcagaaacttttgatttcttccaagtctaagaacaaaatcaatagcaaaactggcaaaaaaaataaaagcataattcgaagatgaaaaatctgggcaaatgttaattctcgtgtgtgtgtgtatgtgtgtgtgtgcacacacacgcacagatgtatgattgccctacttaatagattcactattttttctgtcccacagaatgttctgtgtgttctgtgtcctgagaaactcagagaaaatggattgtaatttggcaattaaccagcatacactaaaatccttctctactggtcaataagtagctactgtttcctaagtggatgaggatattagtgataataggttgtagtttatgttgttgctgttgtttgcatattcatcaacatcattttaattctaacgcaaccctgaagagtgataaattccattttacagataagaaactgtgagtccaagtgcctagatgatttccattgagttttaaaatgtgacttaggaatctcagtttaaatttctgccccacttctttgcgtatacaatagacttagtaataacttatacatgtaatttgctctatgggatatgactgtccctgtcactatactgtgtctacttacaatcacaaggagcgcctagaaagctgggcagaggaaaaccatataggatgatgtgattgcttccccagcagcaagaaaatcccccatatcagtatttctggcaaaatcacatgttctaaaggatttcaaaatttattgaaaattaaaaattcctgataaaagagagaccagataatgtttctcctctttgttttcctctgtcatatctctcctttccagattcttagtgtcatgggaacaagtccagggaatggctcttttctagatgacagtgacctttccaccaagagaataaaatgtgcacgcacatgcacacacacacacactttctcaggatttgcctgagtcctccttatgtatcacatcaaatgcaatatatttcagttcttttgacttctaggattattccaggcagattgcatacccactatttggcacttctctggtgattattccttcttttcaaatcgattctgctgaaaacagtatcttctaatcattcagtacagagtggatcgcccactctgtacatgcactgtctgtagatggtgctaatgtggtgtatgatagatgattacttctgtatgttagaagggattggaaatgtcggcatgtttgtcactgttgttttttaaatcctctgaagtcaattgctaattataaaagcttgtaactttagggacttaaccaataactccaattgaactgtcagctttttcaggccagacgagatatataaagattttcatcctaactgctttaattaatgaatgcagagctaaggcaacttataggtcaaaatgctgcaacattgttatagcattattgcctcacatgctaccaaactaacaataatctgttctctgtggatggacactgggaatatcaacagatgcacttttatagaatacctacccatgtacctaatatatgagaatataaacaaaatatctgacatgtttgcaactctgaaaagatttaaaattatcttgggtaacaagcctcaaatgtatgaaaaaaagttgagactcaataaaaaattttgtggtataatacttttagagaaagataatatcatttttggagtaggattacctcataaggattttattatcacaagtgactgagaagaacgagaataaggagagaccagggcacattaataggtcagatggctgaaccacttttcttgaaattgccaagctttttcctgcttctttgtacttcttcttccctctaggtagcatattcatgcctcagttctccaatcagctgcctccttctctttagatagatctgagctctaagattatactcccccatcttagagtaattcctctatcaacatatatcttagtttactttctcttactataaaagaataccacagaccgagtagtttataaagaaaagaagtttatttagctcacagttctggagactgggaagttcaatagcatggtgtctgcatctggtaagggccttcttgcttgccataacatggcagagagcatcacatgataagaaaaggcaagagcaaaagaaccagaaagaggttgctttttataataaaggcactcccacgataatgaattcaatcccatgatagcaacattaatccattcatgagggcagagcctcattaattcattaatttattcattcatgggaatagagggattcaattttcaacaaataaactttggaatacacattttagccatagcattctgtctctagcccccaaaattaatgtccttcttacatgcaaaataattaattccatcctaatagccccacagtcttaaccattccagtatcaactcaaagtccaaagtccagagtctcatttaaatcagatatgagtgactcaaggtatgattcatcccatggcaaatttcctccagctgtgaacttgtgaaatcaaaacaagttatctactttcaaaatacaatggtgggacagacacaagataaacattcacattccaggagagggaaaggaagcaagaaaaaaggcataactggttccaagtaagtcaaaaatctaacaggagaaacaatattattcattgaagcttcagaatgatttttcactctgtgttgcctccaggacacagtggggatttggaccccctcctccacaaaatttctggcagccccacccctatgactttggagggctccgcctatgtagcagttctcacagactgagtcccttgcctgcagttgtcacaggttggtgttacacactggtggctctacaattcttgagtcttgagggtgaccctgaccctatggctttactgggcattgccctagagggagctcttagcagcagctttgacttcaatcccaaattttagctcagctttggctgactgtggtctctctgcagtaactctacttgtgtgacaaaccaccgtgtggtctatgtctaggcccctagacttttgtgatatcctttgaaatctaattggaggaagtcatgtgttcacagctcttgctttctgcatgcctgcacaattagagccacatgaacactgccaaggcatgtgacttatgccttcgatgacttataccttctatagtttataccttctgaagcactgggaccatttgagccatagctggagaggccaccatgtgctggaatgcagagagcagagacctgaggtggcccttgccagctgcccaaccccttaaccattctgccttcttggaggtctgggcctgtgatgggaaaggcagcctcaaagatctctaaaatgtcttccaagtttttctcccaatgtcttgattaatagcctctggctttctttgatccatactaatttccttctcaatgggttccatgttgtttcattctctaccgcatcaccaggctgctagttttccaaatctttgcactctgcttcccttgtaattataaattctgtctttaaatcaactctttcttctatattttactgtaagtggttaaaaatagccattaagcagcctgcatggtttgtagcttagctattttctttgaccagatatcctaatttatcactcttaaattctgccttctataaaaccctcaggcacaggcacagttcattgttacctaataacaaggtggaggagggggtcttaattccagtttccaacacctcctttctcatttccatctgagaccttatcagaatagccttttctgtccatatttctatcaacattctagtcataactacttaagtaatctctaaggtccagacattccctagtcttctcttattcccagctttcactcgaatcactcttgatgccccattcatgataataaagactttttctagcctactcctccaaattcttccagcttctgcccattacccagttccaaagccatgtccacattactaggtatttgttataccaacaatcccacttcttagtagaattttctgtcttaatttgttttctgttgctataagaaattacagattgggtaatttataaaggaaaaatgtttatttagcccacagttctagaggctgagaagtctaagaacacggtgcctgtacctcatacgggccttcttcttgtgtcataacatgtcagggcataaaggctcttggcaaaaaggcaggagcaggagagtcagatacagtttatttttacaacaaatctatttcccagataataaaccctgtcctgtgaagacaacatgaatgagggcagaaccctcattaatccactaatctactcatgagggcagagccaacattaatccattagtgagagatgagggattaagtttccagtacatgagcttttgggggaaacattcaaaccactgtaccatatttaaagaaacataccatagctctcacacctaccatcttttatcagacagccttcatatcaccatttttataattatgtcttcagtgtgagcttctacaagcatagacctattgtttacccaacagtgaatcacaaatgcctgacagattgtgggcatttaaaaaacattagttggataaatgcttttcagatagggatattttattgtaaacagcagaaattgactctggttaatttcagaaaaggggattaaatggaattttctcttttgagcctagagaaccaggctgagaaagaggcagggaaaaatccagtctagacaacttggaaagaggagccacagcagtgggcttattgcagagtgtctggtcaggacacagctactgggacaagcaaataccaactatatattttggaaacttctggaattgtttccacatagagaagtgtaaacagatgggagtcaaactgagtcctgagaaggaaagaagctatagcattttgtaactaatggaaaacgtttcttctaaaaaagtattctctatgctccaaagatttgtcagactaaagaaactattttggttctgataaggtatgcaagctaattaaaaccaattaacctatcagcagataaaagccgaggccaagtcctctcttaatgcatagtccaattttagaacaggtatagttctactaacttttgatattcaagacacagtgaatagacctgagttgattattaactggtagttatgattgaggaagaactagattattctagctgttgtgcttttataaaatactgcttatttttataattcagtgtattttatttctcttttaaataatttgcactgtaaaatttggggctcagttttatttcaaacaagacagaatgcttacatatttttatgccttaatgtggtctgaaaatatatacaagttctggttagcttttgcttgttcaacacttatttccattcttccgataactgcaccttgagttttttctttgggcaatcactcctcttcctctatgcttactccaagaataaatatgtggcttctgagagcagaaaaagataatctataatattgtttcttttacctggagaattaaaaactaaagtcacattttcaatgtctgtgtgctgaaagctctggtctagatagttttcttcagatacttgccaattttttagtgctggttgattctgtgaatagagatgatgagggtaatagctgtagtgaacctatcaaaaccagaatatatgggctagggtttagtgataaaataccattagaggtgaaaatcagatttataattagccatgtgagaaaaaatagaaaataaagattaagccagggagtggtaaataatagttgagatttttgagagaaggcaccaatctgtgccttaaatttaagtttcttcatgctccttcaagtgatattttaccttatatttaaaaacaaaaataattttttgtcaataaacatttatagagtaaataatattagtgtataattatatacacatgcacacacatatgaatatatatgtcacaataaaaaagaggttaattggttatatgacctgctaaatactcatgaatgattttcttacagatgtgtaattccattaatgagcaatatcatggtgagtctggaatatattcccaagggtatctttagcaatcatttaagctagtttgttttcactttagggcattgaaaaattgtttttggaaaaacggttcttacggcatttcctgcaagaaaattaaggaagatgaaataagaggttcagcattcataaaaactttgggaaggtatcaatgtcctattagagtcagctcaagatatttttatttaccatgcatttcttgagttcttgctatgagtccagcaccatcttcatttgatgaaataggcattcctaagtccatctgcattggcaagcgaagactagaagaggcagaagtttggaactctctgctccatatgacagttgtttctccttatctgtggtttcacttttcaaagtttcaatgacccatggaaaatttcagaaataataagttttaagttgcacatattctgaatattatggcaaaatcttgggctgtactgcttcatcccacccaggatgtgaatcattcctttgtccaatgtgccacaccaggtatgctacccacccattcatcacttagtaacgatctcagttatcatatcaacaaatcacagggagaagagggtgagtacagtctaataagatattttgagagagagagagaacaaaagagagaccacatttatgtaacttttgttacagtattttgtcataattgttctattttatgattagttgttattaatctctgcacctaatttataaattaaacttcatcttaggtattcacatacagtttgaaaaaacatagtagacatttgccaatccctgacatggaatctaacggggctacataggatgggtactatctggcgtctactggggtcttggaatgtatcctctgcagataaggaggaactaataagatgtattgtatgtatgtatacatcctctgcagatatatgtatcccctgaagataaagaggaactaagtaagatccaatctgataagccacttcatagtgaactttcactataattcctctaggaagaggtgcattcacccaagtgagtcaagcctagaaaagacagtcttagggtcaacccagtaacaatgtttctttagtagcactttagaaagccatggtagagaaggcagccacaactcattttctctgagtacgtgacaagcggggccaaggcttatattttcagctggggaaattttttttttaatattaggacagacctccaaaatctaagtatcaggggattgaaaaaataacagaggagaggaaggatatagaatcaccagtgaaggcttgaaaagtaagaactctgattttgcctttttaattacctgtcatcttggaaaaagagagctaaacctggaaaacttggaacataagccagtgttatctgtaatatttatttgtttctacttttaagcaacaaaaattgccttaaaccaagtgcatcatgtgtacatcactggtttttagattttaatagcttattcctcttccttctctacaaactagagctttaaacccccactttgatagtccctacctttcccccagtaagtttcagcttatttcagagccaaacttctctggtcctcttttacatgtttgtggtcaccctattattaccatcttggactttgtcactttttctttttctgtagaacttgtcttttgaacattcaggctccccagagaacattctgtatagccacagatgattgtttaaataccctcctttgtctctcatcaggattgtctgtgcctgttgcggagaaagctccctcaggaaggcaggactgtattagcctaaattacagctgtattctcagtgcctattacagtcccctgagtataaaaggtactcaacacatattgaatgcatgaatgaacaaataaggaatgaatagtgttggggaaccttgtagccaatctcctttagatacaaacaaattcaagacacattatagtcagtcttcggtggcaggcaacaaaaattggcttgggtaagattaggtaaaataaaagaagttattggaaggagatgggtcagctcgaggatatagctctgaggtcagatcaaatctgtcctgctgtctatcattgtgcagcccacatgctaagaatagtttttacacttacaaatagttgaaaaaatcaaaacaagaataatatgtcatgacataaagattatatgaaattcaaattccagtgtccataaataaggtttattggaacacagccatgcccatttgtttacatattttctatggctgtgtttgcgcggcagtggcagagtggaataactgtgactgagaacgcacatcagaaaagtctaaaatatttactcccaggtccttttcagaactttgccaatccctaatttagcacatggactccaactgggcaacaagaccttagggtggtcagaattccttagggaattaagaaagcaagataagacttggactctaggtagcagaaaggaagagacaattaattacttggggtgtcaccagcagagtgactctgattacccacatcctaatttcattcaactcagtttccaaattccagaaaaagtgagcctgaggagcttgacttagtttacatgcctggccctcgactataggggttgtggggaaggaaccttgattaaggtccccattatctagaaacttagaaaaagggacagttattcattacagtacttgaacagtgatgccaagttaaaatcacacctgagtaaaatcacacctgagcctattcccttctcccttcaaagataaacagaagccatttgctacctggtcacatacagaggctgctgcacagtggtgagtgcaccacagacattgtgactgcaccacagacattgtgactgcttgccatcaagattgagtggacccctcattacagactgtgtttgcattcatcagagtgttacctctcatctcttcagctgcgttttgcccaagatggtcatacccagacatgcaccatctcatgccaaagtgactgaacacctgggagccccagggattgttttaaggattcattttgattttctcaatctagtttcaaaactatggtaaactaccttttaataaagctgtcctggagatttctcaatgagaccacaaaggcattagtgcttgtctaaataggtgtaagaacatgaagaacaggatgtcttggtatcatatcagcagcatatgtccagtctttttcctcaggagctattgcctaaaattaaaaatgaccatttagggctgggaacagtggctcatgcctgtaatctcagcactttgggaggctgaggtgggagaattatttgaggccagtagtttgagagaagcctgggccacatagtgagacactgtctccacaaaaataataaaaaatattagccagtcatggtggcacactaatgaagtcccagctacttggaagtctgaggtgggaggatcacttgaacccaggaaggaattggagactacagtgagatatgattgcaccactgcactccagcctgagtgacagagaccctgtctctggaaataaaaaagaaaagaaaagaaaagaaatgacaattcagtgaccatgagaaaatctacgagcaacagtttcagtggcaagcctgttttacttttgcttctgtaggaggctcatgctaagcagaatgaggagatataggtgatttccaagcttgaaaaaagatgaaaattcagttattattttttaagtgaagtgtaatagatagatagataagagattggtaaattaccttctagtgtgagagtcaaagtttctctgcatgaaatgcagtttctggagagcccaaacacagtgggtaaagagaatgagcccctgtgtgtgtgtgcaatggtaaaatattttttcttcatttttgagttccagagaaagagaagtactttagaaatctttttggaagaaaatggatatgtagggatcttgtttatgtttttgttttagatttttttttttttttttgagcattagagagacatttgggaatttgagagattggtgcaaaagtgtttgtgggtgttctttcttcatgtcaagctatgaaataaagtcattttatctcaaaaagcccttagttaatgctggggaaaacatttttatccaacctggaggacacttgggaaaggatctagcagctggtgctttgagaaggagaagacagacgtttttgggggagtgcagaagggaaaggaggggagacaaggaggtgaccagtctggactctgatggtgtctttcccctgcccagacacccaatgccaggttttaaaaattcatcaacatggagaaggcaggaataccaattaagtgtttagcataatagaaaatcaattttaattgtcccaaatggaactattgtttacagttacagatggctgccaggcagtagtacctggagaaaataaatgagcccagggagtagggaattgctttcaattcttaggagtattgcaggacagacattggagaattcagcctaagaaagtttttgcagagaaaacagattccctataattataggctgaaaaatgtttccctctaggactatgcagttagtagtgtcgtcaatttccacctctcacctttctcctggtgttttcacaggaggagtggaccatcaaaatagttgttactgcatggattaaaatcattggcaaagaagaggggaaccttgattaatgtcctcattatttagaaacttagaaaaaggaatacatattcattacagcactttaacagtgttaccaagataaaacctttttttttctgtttttttcttttctatctattatgctaaactcacttaattggtattcctgcctcctccacattgaagaagaggggatggctaatgaatataaaaatatggttacatagaaggaataagatctagtgtttgatagcacaataggatgacaacagttaacaaaaattcattgtatgtttcaaaataaaagagtggacttgtgatattcttaatgcaaataaataataaatgcttgaggtgatgggtattctaactaccctaatttgatcattacacattgtgtgcacttatcaaaacataatgtttcctgtaaatatacataactctgatatgcccataataataaaaattttaaaaaattagagaagaacatcagcaaagacaacccaaaaccacctcttacctgatcacttcactatgttttctgttttgtttctttgaacttccagtgcaaaggaagtatttcttttattgcacttcatctgtcctagctatagctatttgcatatttgacttatctttcaactagtataaaaattcctcaaaggcaatatttcactttagcagagctaaacccatcacttcactactaactgtgtgtaccttgagtgacttaatctatttccttagctgtaagctgggggccatgatggcatccgatttatagttctgtggtgagtattgagtcaatgagaatgaaccttccagaaaaaacccggcatgtagtttgaactcagacattgactactagtatgatttttatatcctttttgtctcttttaagaaataattgtaacacatcctatacaaaaatctgtaattctcctattgagaaatcctagagaggaacaaaaagaaaaagttggagatagatgctcactctaggtaactttcagcatagattggcttaagacctattgcaacaaaagtacatgaaatgcttattaatattgcaaattcctgacaagactctctgggatagaatctcaaaatacctatatcttcagtaagcttaccagagtattccgacacaagctacattttcagaagtttggtcaaaggaaaatggtcatctctggatatattaactggtaaaaaccagatgtaggctctaaaatgcccatgtggaatgtttcactcattttatcatgaaagacaacttgcttggggtggctgcaatcccactcctgtttctatccaccacagtgaggataactgatttctcagacagtctcttaaagctcatgggcatggctccttggacctgccttgtaaaaactatggggctatttcatttgcagaactgaataattaacatacatcaatgcgtggtgcaatataaatccactgtgaggctgaccttgatctaagtgtcacagtgacgcactgtggagctcagtagaatactttccataaagcgcaggtgcaggattttattctccagagtccgcttcgatgaaactttgctcagattttaatttctctaaaacctaatagtgtttgggagttagctggatttttttttttctgaattcgagttatgactgttgagtcacagaagacatctagtgcttcaaacagaactggatttgacttttggttctgtgtgaccttaggcaagccattcagcctttgtgtccttaggtttttccatgtgtaaaatggagatattgataaacacctcaaagagtgttgtgagaattaggaatacacttgagagcccctgttacacacgtgaaatgcccaagagatgccagtttcctgttcctttaaaacacaagtgcagtgttgaatgtagaaggacaaaaaaaaaaaaaaaaagacatcaaatattttctcttaactcagtttcttaacttcaggactacggacgttttgagcctgatagtttttgtgtttgagggaggaagggagacaggtgccccgtgcattgtagcaggtttagctttggcagcatccctggcctctgtctatcaaataccaggagcactgccccgagctgacaatcaaaaatgtcaccagacattgtccatgttccctcaagggcagaaatcaccccattgaggagcactgtcctggttcctgccctataattttaagccattaagttgtaaaatcaaaccaagaaatcaaattgtcagtgttttaccaagccagtatcaaaaaggaaactaacctggctatgatggttatccttttgacagttccccagccttataaaggggaaatctcatagcgctattagggtatagcaaaggaaggtacctgtcaccttgaggactcacaagtaatccatgagccacaactaaggttagattctcagactttagaacgccataatctcaggctggcttatgtcacagatcttactaaactagggccaagtgcctcttgctgtgtaaactaggggacaatgacttttgcatgaggctgatataaaaatgaaatggtaaggccaagcatgatggctcacacctgtaatcccagcactttgggagacagagacaggggaatcctttgaatccagttgttcaagacgagcctgggaaacatagggagaccctgtctctacaaaaaataaataaataagaatagtaacaaataaaaaaattaagttgacatggtggtacatgcctgtggtctcaactacttgggatgctgaggtgggaggatcttgaggctggaaggtagagcccgcagtgagtgtgatcacaccactgcactccagcctgggcaacagagttgacaccatatctcaaaaaaaaaaaaaaaaaaaaaaaagggctgggcacggtggctcacgcctgtaatcccagcacttcgggaagccgaagccgaggcgggcagatcataaggtcagtacatcaagaccatcctggctaacatggtgaaaccctgtctctactaaaaatacaaaaaattagccaggcgtggtggtgtgcgcctgtagtcccagctacttggggggctgaggcaggagaatggcgtgaacctgggaggtggagcttgcagtgagccgatatcgtgcccctgcactccagcctgggcggcagagcgagactccctctcaaaaaaaaaaaaaaaaaaaaaaaaaaaaagaaatagttagttcattaattcttaaagagaaatggaacgtcaggggtacttccattcaaactggtataaccagcaactttagattcttaagtgcaggggaagccagatcactgaaggtccttggtgagcattcagcgaggactagaggtatgagctggagcattgaatggcatcaagctatcagagcctgctgttcctttccaaatagggatgtggaccaatggggcacactggctagttctttgaaggttattgccaccatttgcctctgcaacctgactctgcttctgctgatgaccaagcattttagcattttttcatttaagtttaatcaggcctgtcagagctttgctctttgcattggcaaggctttgtgaattattataggaatctaactggtggtatttttataaatgtaccgtaattctaggttcctgagatgcaccttcctgtagaccccacctgccctctggacagtcagtctctctgctgccccgctcccctcagcacacttgatctttcaaatactcttttcacaagcagggctatggcatgctttctttcacactctgcatctctcttggaatcatgttcacgaggtaataaacaggagaaagtggacaagtcaaggctacgcaaatcacactgacaccccaaatgtcctgtttcctctcctcctggtaaaattgaggtagatgcagagaagttttggtcatttattttgtattaatttcttagaaattgctttgtcctcactttatacataattagcatttaataaacatttgtcaaacagaaaatgtttgtataaataaacaaatgtgtgatattattgtaataataacagtggttactattattattagtagtagtagtagtattagtattattagtattattatttgagacagagtctcgctctgtcaccccagctggagtgcagttgcatgatctcggctcactgcaacctccacctcccgggttcaagggattcccatgcctccgcctctcgagtagctgggattacaggcacctgccaccatacctagccaatttttgtatttttttgtagagacaagttttcaccatgttggccaggttggtcttgaactcctgacctcaagcaatcacctgtcttggccttccaaagtgctgggattagaggcatgagccaccatgcttccctagttattattttttgatactagctgctgattgccttttaggtcttatccgggccaggtattaacactgtctggggattatcccagttcatcttcataatgattcaatacatctgaacttcttttatcaccagattttaacttaagtagttttcccaagctcgtccagctgacatgtgacagaggtggaatttgaactgttgcccaaagtgcatatttacagcggctcaggacctttacatctaattggtgaaagccagatgtagcctctaaaatgtcgatgtgtgatgtttcactcattttgtcataaaagaggacttggttggggtggctgcagtcagctgagattccactcctgcttctatccactacggtgaggataattcatttctcagacagtcaaagctcataggcatggctcctggacctctcttgtaagaactgtggggctttagttcccaaaagagcacaagccccaagagagcacagctgtggtgtgattcctttttcagcaagcggcttcaatgtcttcaactaggaaggccttggcagcatttccaaggcgtcagggaattgtaactatgataatggaagttctgcaaaattaagcccagggtgaaggcagctgcaagttaatgccatttgaaggttcttatgtaaagtgcattagaaagcatcacagaataagctttctcattctgtctgccatgacaccttatttaattcaggtatgataggttttaaacaagagtataagaaggtttcagttactgtgatctttcctctcttcctaggaaaaggtttcatatcaaggtttctttctcagattttaccttgctcctgacattaagctgttaattcactgatattaaaatgcttttttaaaaaaccctctaaactggctgggtttttcaaacatcaaaaatataataccagagctgccagctcttgttccctgtagcttatgttttggctaacagccaagcaccagctgatcatactcttaagaagccagacaaatttaaaaccatagctgctcaaatagaaattagtaagaaggttagcagtaaatggaaaataaatttcatgtaatacctctaaatataggttaatgaaatcagtcctcaatcttcctaagtgaaaactagacctctgattaatgttaagatttagctggctgttttaacatttaagatttagctggtcgtttttaaaaataacatttaaaaaattgccattcattattttcttttgtgtaacaatctagagcacttttctgtctgttaatccattgaattaaatcttcacaagaactgtgacaatgaggcattattctcccctcaattttgcatttgaggaaattgaggcctggataagttaagtgacttgctcagctagaaaatgacagcgtgaaaatatcaacccagtttttttcactatatatttactgctctttttgcttaagtaagccatttcttagtagaacttaacagcttttactttcactataaaacatacttagctagccaggtgtagtggtgcatgcctgtaatcccagctatttgggaggctgaggcaggagaatcgctgaaactcaggaggtagaggctgcagtgagctgagatagcaccactgcactccaggctggttgacaaagagagaccctgtctaaaaaaaaaaaaaatgccaaacatatttgccattatattttcattcctgctggaaatctgtctgttgatctgggacataggctgtgtctagaacttttgctgttacatgggacttctcagttaaccttaatattcaattcagataataccattcatttatttgcaatttactggggcagaaggcatggagttaaagaggtcatagataattccaagttaacaacgaagcaaaattagagtcatttttgatgatctcaaaatagatttatatcattttgtgtgagtaatgtcaggcacctgagacctgtttctcagtaacagttacctttagtataaaaaagaattgttctgatgcttagtaacttcaaacaagacaaatttgttttgctcattaatctgtaatttgggcaggatttagtggggataacttgtcttagcgctacattgcaacagctgaagtggatcaaaagctgagtggtagaatcatttgaagcttcattcactcactgggctggtagttgaggctggctgctggctgctggctgctggctggggacctcagttccactccatgtgagcctttgtatgccatctatcagtctaggctggttcgtgcttcttcacagcatggttgctgttgctcagggcacacatcctaagaatgcgatcaagagagacaggtggaagatacggtccaaggatttagccttggaaaacaatatagcatcattactaccatagactattggatgaaataatctttatcccccacccagatcaaaggagaggtacatagatctcacttgtggataaagaggagtgtcactcatataaagaaagcatgtggaacgggccattgttggaacacattgtcttcccagaagagcttggtaatctcattatccatggttgctggagccctaaaggaaaggcaggaagataagaaaaaggcaggcaagttcttattgaattaataggtttaagagccacttttgtggtcagccaggtatgtatccagcttaggcatataaaagtcccatcttgcccttattaattctcctaacttctggtctttcttgcatcatttaattctcctatattctggattctttatgttctaaattcaaatgactctctagacctgaaaaaaataaaaaaaaaaacaccaccatgggacttttaattttgttcatcatgataaaatacctaaaactcagaactgactctaacacaagttcacattctactatttatttcccttttattttgtaaggtggatcagggtatagaagacaggtttcctggagcctgattcacactgtgcccttgtttaagactcataatgttgttacacagacaactgagctgtaattgtagcattcagattcccatttaaaatagatcccatttccctgagggagatcatccaacttgtgtattttcctgagtggggcatcagaaatgcttctgtcagctcatacatagtatgacacttcattgtgaaggcaactctagttttcacatccttgctgcacaccctgcaatacatttaaagcttgaggatttcctctcctaacatatcccagattctttccattttcctttgacgcctactataccttccccaacccacaactcaaattctgagctgtaggtgggttaggatccaggttttattgttcctaatgggtcacactgataataattgttcagctgcagtgcatagaagtatcagttcaaaaactcaggtgtgcaaataatttttgaatgactaagtgtatatttgtagtttgagcttactatttcactgggtggtggaacctgatgttgagcaggccactctcctgacttcccatcttttcccaggttcccagtgccttcgatgttcccctagccttggtgcatggccaggtaaaaccgcagttcttggtcattgctatggtctaaatgtttgtatccccttaaaattcacatgtggaaatcctaatccccaaggttatggtagtagaaggtgaggcctttggccagatgattgggtctaaaggcaagcccctgtgaatgtgattagtgcccttagaaaagagatgcaaggaagatcccttgccccttccatcatgtgaagtcacagagagaaggcaacatctaagaaccagaaagcagactctcaccagacactgaatctgccagcaacttgattttggacttcccaacctttggaactatgagaactacattaccactcagttaatggtattgtgtgatggcagctctaatggactaagacaatcattatccctccacatgacatactggagatgtataatacctctttctagacatgagttcatgtctgatgaacctcaccaagggatattctcaggtctgcctctcagatactgctatgctctttagataaaaaaagaacgccgagtagccctcccaagtagacacgtagaaactcagtggggacaaggtctttcaccacttttctgcatgcaaaatcatttatggctccccaattctgaatggattgaagagaggtagatgaagtcccttgagccccacctgcctccacataccacatggacagttctattctgttgttccttctctgtgttggagtgtggaactcagaatctcattctcccttgggctttaccctggaaagtgactcatatagggttccagctgccctttctcccagctcattttggaggttcataggcctattcaggtttgtgttagaccgtagcctctgaaatctttgtctaacctggaaataaagggaaaatggtggaataggctggctctttctgatcaaaatcattgtaacatgactggaccttgcctttctaaatctggtaatttgaatcttgtgtcattctataacatcttttttctaagtacaaacgcaatcaactcggggtagggggaggaagactacagtttgaacaaactaaaaacaggaacaacagtcaaaggttcctgctcttctttttctgcttcaacaattctcccaggaacttgagatgttcctttgtacttccatatgtaccatcttatctatgcttacgtttccattaacacacccattgctactgccttgtagagctatgacacctgccctcctccccacctccagaggtcagtttatgccttcaccccctgacattctccccacatccacacatatacttggcagccagaaaatttctttccatacatttatgatgtaggtatatctgtgtctacatcgcaagacttccagaacactttcacttcgtctcaagttcatttctccagatttgtagaagactgaaagaattaagtaacatgtcaagatcacaggctggtacgtggcagaatggcctgtgaaatccatggctatgaactgagttgtgtctctgaaatttgtacgtcaaagtcctaacccccaatgtatgctatttttgagatgaggtctttgggaggtacttagggtttgatgaggtaataaagctgtgccccttatgatgggattggtactcttcaaggaaacaagagagaggtagtgctctgtcttctcctctctccctttctttctctctttccctttgcatgtaaggatgcagcaagaaggcagctgtcctcaagaaagaaagaagactcctgtatgaattggccagcaccttgatcttagacttctcagccttcagatctaggaaaaagaaatttctgttgttcaagcaatttctattgtatttagtctatggtattttattacagcaggcggagctaacagagacattcacgtttcttttcctttttctccaacttaccgcattcttatattctcccatgactccatgataaggtactatcatcatttgtctcacattgtgcctttcaacaaaaagatcagaaaaggagaaggggcaattgatatacagaaaaatttttttccttagtgaaattgcctatttcctctcccctatgtccctaattaatccttgaaaccaggcttcctggttgcttgtaacaaacggaacctacaagaatgtggaagtaagttttgctggcaatgtgcactctgttttgctaggccggactttaatgcagactggtaagcaggcatctccgagctggtagaagtgtacactcctgctgtattccatcatgtggatcaaaggccagggctaatagcacttaaataataaatgtgctgttttaaggtatgcatcatttaaatttgagggaaacgagcaaatctgggaagactacaagggatgtactttcctgacaatgatatcatcaagaaaagccattaataaaggggaggaaatcttcaagatctcaacagagaccgttttagaaaagctagtcatcaaattttgcctttgtgactggcatggtcactgttgcattagcatataggtggatcgggatatagtggggattaaggacagatatggaaatgcggggatggggagaagaaggattccaggaaataggactttgagaaaaatagaggactttataaaatttcaagactttgagggtaagtatgggtagtctctcaacatagttttctgggttttgttgttaatgctttttcaaggtaataagctccaaaaagcatcaaaaagcccctcttctatcttgctcctagagagatcacggaggctaggagggtgctggatctgagaattcagcatgagccctaagtgaattcagatgatattctcaatcactattcactgatcctcaaagaaagtcagatgggttaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatccaattaaactaaagagcttctgcacagcaaaagaaactaccatcagagtgaacaggtaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagaaatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtgaactagttcaaccattgtggaagtcagtgtggcgattcctcagggatctagaactagaaataccatttgacccagccatcccattactgggtatatacccaaaggactataaatcatgctgctataaagacacgtgcacacgtatgtttattgcggcactattcacaatagcaaagacttggaaccaacccaaatgtccaacaatgatagactggattaagaaaatgtggcacatatataccatagaatactatgcaggcataaaaaatgatgagttcatgtcctttatagggacatggatgaaattggaaatcatcagtctcagtaaactatcacaagaacaaaaaaccaaacaccacatgttctcactcatagatgggaattgaacaatgagaacacatggacacaggaaggggaacatcacactctggggactgttgaggggtgggggtaggggggagggatagcattaggagatatacctaatgctaaatgacgagttaatgggtgcagcacaccagcatggcacatgtatacatatgtaactaacctggacattgtgcacatgtaccctaaaacttaaagtataataataataaaataaaaaaatctgtggtacacgtgtcggaattctctggtgttaaaaatacagtgtattgggttccagcccaggtgaactgaatccaaatctttgggaatggagtataggaaactgatttgtttttggggggatggggtctccctatgttacccaggctggtttcaaactcctagactcgagtgatccacctgcttcaggttctcaagtagctgggattgcaggtatccatcacagagcctggctgggaacagagtttttacatttttatgttcatgtgtgtgtatgtatgaatgaattatttagggggtacatgtgaaggtttgttgcaagggtatactgaatgatgctgaggtttggatttctattgatttcatcacccaaataaggaacacagtacccagtgggaagtttttcagtcctttttctcctctcgtcctccccactttttgattccttggtgactagtggtctcacctttatgtccatgtgtatccaatgtttagctctcacttataagtgagaacatgtgatatttggttttttatttctgtattgattcacttaggataatagccttcagctccatccatgttcctgcaagggaaatgattttgttcttttttatggctgcatagtattccatggcatatatgttacgtaccgcagtttttaatccaatccaccaccaatgggcatcagaagtgatttaagtctttgctactgtgaaaaacatatgagtacatgtgtctttttgatagcatgatttatttttctttgggtagatatccagtaatgggattgctgggttgaatggtaattctatctttagttctttgagaaatctccaaactactttccacagtgtctgaactaatcatgccaacagtgtataagtgttcccttttctctgcaatcttgccaacatctgttattttttgaccttttaataacagccattctgactggcatgagaaggtatcacatagtggttttgattagtgtctctctgccaactggtgatgtaaagcttttttttcccctgtacttattggctgcttgtatgccttcttttaagaagtgtctgttcatgttctttgaccactttttaatgtttttttccttgatttaagtttcttatagattatggatattagtccattgttgaatgcatagtttacaaatactttctccaattctgtaagttgtctgtttactccattggtggtttcttttgctgtgcaaaagttctttagtttaattagttcttaactgtcaatttttgtttttgtttgcttttgaggacttagtcataaattcattgcctaggctgatgtccaggagagtatttcctaggttttcttgcaggatttttatagttggaggttttaacatttaagtttttaactcatcttgagttaatttttgtatgtggtgagaggtagaggtctagttttatgctcctgcgtatggttaggtaattttctcagcaccattcattgaataggaagtcctttccctattgtttatttttatcaacattgtcaaagattagttgattgtaggtgtgtggcttttcttctgagttttctatattgttttattggcttatgtgcatttttttcttaacagtaccatgttgttttggttactgtagccttatagtatagtttgaagtcaggtgatgtgattcatctggctttgttctttttacttcagatttctttgtctgttgtggctctttttagttctataaaaattttagaattcttttttctaattctatgaaaaatgatgttggtaatttgataggaatagcattgaatacgtacattgctttgagcagcatgaacattttaacaatatccattcttccaatccataaaagagggacattttttcatttcttttgttttctatgatttatttcagcaattttttatagttctctttctagagatctttcacccccttggttataagtatttgtaggtattttattcttttgtggctattgtaaatgggattatattcttcattttgctttcagcttgaatgttattggtgtatagaaatgctactgattttttttacattgattttgtatcctaaaactttactgaagttgtttgttggatctaggagtcttttcatggagtctttacagtttccaatgtatagaataatatcattggtgaagagaaatgatttgctttcctcttttcctgtttggatgccttttatttctttgtattgcctgatggctctggataggacttccagtattaacattgaatgggagtgagagagtagacatccttgtcttgttccagttcttagggggaatacttctatctatctgttgctgttgtagtatgatattggctatgggtttgtcataaatgactcattattttgaggagtgttcctttgatgcctagttttttagagcttttatcatgaaaagatgttgaatgctatcaaatttgttttctgtgcctattgagatgattgcatgggttttttaaaattctgtttatgtgttaaatcacatttattgacttgtgtatgttgaagtaaacttgcatgtcagaaataaagcccactttattgtgttgaattaactttctgatgtgcttctggtttcattttgctggtattttgttgagaattgctgcatctatgttaatcaggggtactgacacattgttttatttttttgttgcatctttgcctgattttagtataagcataatactggtttcacagaataagagagaaatccctcctccttaattttgtggtatagtttccgtgggattggtaccagctcttctttgtacatctggtgggattcagctgttaatccacgtagtccagggcgttgttttggttggtagatatttttattactaattcaattatagaactcattattggtctgttgagggtttcagtttcttcctgattaaatcttggaaggttgtgtatttccaggaatttattaattttctctagattttcttgtttgtgtttataaaggtgttcataatagtctctgagaatcttttgtatttctgtggaattggttgtaatgtcactttcactgtttctgattttgctcatttgagtcttccttttactttgttaattcaactaatggtctattgatattgcttacactttcaaagaaccaaattttccttcattgatcctatgtatgatttttggggtctcagttttatttaattctgctctgcttttagttattttttttcttctgctagctttgtgtttagtttgttcttgtttttatagttcctttagatgcaaggctaaattgtcaatttgagatctttctttttgatgtaggcatttagcactataaactttcctcttaacactgcttttgctacatatcagacattttggtatgttgtgtctgcattttcattttttgtaaagatttttttttatttctgccctaattttgttgtttactcaaaatttattcaggacaaattgtttagtttccatgtaattgtgtggttttgagagtgccttttggtattgatttctatttttattccactgtgatctgagaatatgcttggtatgatttagtttttttaaatttattgagacttgcttaatgacattgcacatggtcaatcttagagtatgttcatgtgcaagtgggaagaatgcatattctgtaattgttgagtagtatgttgtgtagatatctattaggtctaattagtcaagtgtcaaacttaagaacttttttgttagttttctgccttgatctgtctaatattgtcaatggggtgttgaagtctggaaactgaatatttttgcaagaatctttcaaaaatattttgtggtaaagttcgagagccttttattatgagcgtcttattgtctagaatagtgccaagctcctattagtcatcaaataattattgcagtgaattaatacatctccagtatgtagcctaattactgacacatgataggtttcagttaaggtttgttgaaggaatctttgtgatagcttctggttcttaagaggcactttggaatgaaagaatccatctattcacctagcaagccagctgtctattcgcacatccattcaagttttgggatttggcatagcaaggagacactgcaagggaagtctgttatatggacagaaattccttatttgtttaggagagagtcttaagagtagaactattgggtcaagatcattaacattatagactcttaacggacacttattgtcaaatgttcttgctccatggctttttcataggctctcctttgttctcataacttggttcctagcccgttgcctgtatgattccctgaatgcatgaacacctttgcattttgctcaaggttcatcaacctgccttaagatattgtttttattgtttctactctccatcctcaatgtctaatcaaacccttgatcctggtacccctaccagccctgttctaagaatgaccactcctggcatgactgaaaaattatggccattctcaaaagactcaacctggggaacaaataagctgttgttgttgttgttgttgttttaaatcaggagaccactggctgttaggaccttttcttttttttttttttgtcagttcaacattttatttatttctttttatacttttaagttttgggatacatgtgcagaacgtgcaggtttgtgacataggtatacacgtgccatggtggtttgcagcacccatcaacctgtcatctacattaggtatttctcctaatgctatccctcccctatcccccccaccccccaacaggccccggtgtgtgatgttcccctccctgtgtccatgtgttctcattgttcaactcccaattataagtgaggacatgcagtgtttggttttctgttcctgtgttattttgctgagaatgatggttgtcagcttcatccatgtcactgcaaaggacatgaacttatcctttttatggctgcatagtattccctatgttgtatatgtgccgcattttctttatccagtctatcattaatggacatttgggttggttccaagactttgctattgtgaacagtgctgcaataaacaaatgtgtgcatgtgtctttatagtagaatgatttataatcctttgggtttatactcagcaatgggattgctgggtcaaatggtatttctggttctagatccttgaggaattgccacactgtcttccacaatggttgaactgatttactctcctaccaacggtataaaagtgttcctatttctccacattctctccagcatctattgtttcctgactttttaatgatcgcctttctaactggcatgagatgatagctcattgtggttttgatttgcatttctctaatgaccagtgatgatgggctttttttcatatgtttcttggccacataaatgccttcttttgaggagtgtctgttcttatcttttgtccattttttgatgggtctgtttttttttttcctgtaaatttgtttctttgtggattctggatattagccagatggatgttgtcagatggatagattacaaaaattttctcccattctgtaggttgcctgttcactctgatgatagtttcttctgctgtgtagaagccctttagtttaattagatcccatttgtcaattttggcttttgttgcaattacttttggtgttttagtcatgaagtctttgcccatgcctgtgtcctaaatggtattgcctacagtttcttctagggttttatgttttaggtcttatgtttaagtctttaatcaatcttgagttaatttttgtataaggtgtaaggaagaggtccagtttcagttttctgcaactggctacccagttttcccaacaccatttattaaacagggaatcttccccattgcttgtttttgtcaggtttgtcaaagatcagatggttgtagatttgtggcattatatctgaggcctttttttctgttccattggtctatatctctgttttggtaccagtaccatgctgtttgggttactgtagccttgtagtatattagcgggatggggataccattgaatctatagattagtttgggcagtatggccattttcatgatattgattcttcttatccatgagcatggaatgtttttccatttgtttgtgtcctctcttatttccttgagcagaggtttgtagttctccttgaaggggtccttcacatcccttgtaagttgtattcctaggtatttaattgtcttgtagcaattgtcaatgggagttcactcatgatttggctctctattttaggtgtataggaatgcttgtgatttttgcatattgattttttatcctgagactttgcagaagtagcttatcagcttaagtcaatttggggctgagatgatgaggttttctaaatagacaatcatgtaatctgcaaacagagacaatttgacttcctctcttcctatttgaataccctttatttctttctcttacctgattgccctgggcagaacttccaatactatgttgaataggagtggggagagagggcatccttgtcttgtgctgattttcaaagggaacgcttccaccttttacctattcagtatgttattgtccatgggtttgtcataaatagctcttattattttgagatacattccatcagtacctagtttattgcgcgtgctgctggatttggtttgctagtatttttttgaggattttcgcatagatgttcatcagggatattggcctgaaattttctttttttgttgtgtctcttccaggttttggtatcaggatgatactggcctcataaaatgagttagggaggagtccctctttttctgttgtttggaatagtttcagaaggaatggtaccagctcctctttgtacctctggtagaattaattcggctgtgaatccgtttggtcgggctttttttgtttggtaggttattaatttctgcctcaatttcagaacttgttattggtctattcagggattcaacttcttcctggtttagttttggagggtgtatgcgtccaggaatttatccatttcttctagatttcctagtttatttgcgtagagatgtttatagtgttctctgatggtagtttgtatttctgggggatcagtggtgataccccctttattattttttattgtgtctatttgattcttctctcttttcttctttattagtctggctagcagtctatcaattttgttaatcttttcaaaaaaccagttcctgggctcattgattttttaaagggatttttgtgtctctatctccttcagttctgctctgatcttagttttttcttgtcttctgctagcttttgaatttgtttgctcttgtttctctacttcttttaattgtgatgttagggtgtcaattttagatctttcctgatttctcctgtgggcatttagtgctataaggggatggaggaatatttaccaagcaaagggaaagcaaaaaaaaaaaaaaaaaaagcaggggttgccatcctagtctctgataaaacagactttaaaccaacaaagataaaaaaaaaaaaaaagacaaagaatggcattacttacataatggtaaagggatcaatgcaacaagaagagctgactatcctaaatacatatgcccccagtacaggagcacccagattcataaagcacgttcttagagaccaacaaagagacttagactcccacacaataatggagaatttaacaccccactgtcaatattagacagatcaacaagacagaaaattaacaaggatattccagacttgaattcagctctggaccaagcagaccgaatagacatctacagaactctccaccccacatcaaaagaatatacattcttctcagcaccactttgcatttattctaaagctgaccacataattagaagtgaaacattcctcagcaaatgcaaaagaacagaaatcatcacaaacattctctcagaccacagtgcaatcaaattagaactcacgattaagaaactcactcaaaaccacacaaatacatggaaaatgaacaacctgctcctgaatgactactgggtaaataatgaaattaaggcagaaataaataagttctttgaaactaatgaaaacaaagaccacaatgtaccagaatctctgggacacaactaaaccagtgtttagaggatgttaggtgcttaagggcagctatgatggctaattcatctttatgcctgtggccccaaggagcaagccaggctctccaataagctgtgtagcttcacaaaagggctctggcaatccagaggaaaccccaatcctgaaggaaaagcaaactttcctgatatttactgaatgtctgtttagtgattgactgtcatcttccttgttgaaatcaataggagactcaatgaagtgaaaatgaaatcaatatttaattcccactggtaagagataatgccatggcctatgttcaactgccaactttccctaattcaaaagggtaataggagctgtgccatctcagcctcatagccaagactcatatcagtaattttttccttactgatttactacgttcctaccacatggtagatgttatgttgtacatttttaccatgctcatacagcaaaccaactagtgatttatcagttgagtatttaaaatgtggcatagaaagggctgaatacttttttttttttttttttttgagatggaatctcactcttttaccaaggctggagtgcagtagcacaatcttggctcactacaacctctgcctcctggatcaagtgattctcctgcctcagccccctgagtagctgggaccacaggcacacaccaccacgcctggctaatttttgtatttttagtacagacagggtttcaacatattggccaggctggtcttgaactcctgatctcaactaatctgccttcttcagcctcccaaagtgctgtgattacaggcgtgagccatggcgcccagctgaaagtgctgaatactttaaatatacaacctcattgaagccttacaaccacattttgagatacgtactattgcctaattctacacatgagaaaactgtggcatggagaagtgaagaaacttgccctcttagaatactgtaggatcaggatttgaacgcatgtctgggtaattccatatcttgtgtttttaaccactatgctttactacctcatttcttagatgaggaaactaagactcagaaataacatttccaaggccccacccagaatccaagtgtctcatttcaccttaaaaagtccctttaaagtgtgagttaaatttcagtcgttgtggttattccatttattcaggagctataataaacagggcccttaattctatgtggaatatatagttgaagacccactccttatctttacagagtatatatctagttgttggcaatatgacaagtaagtaaaaacagaatgcaatatgtggaaatccaggggtgtcacagctggtgaatctatcgagaaatctttggcaatagaaaaacacggctattaaggaaatgcattttcttatataatgggaacatcatagggtgttctggggggtggttgattccacattccagtgtcatgagaatgtacatgcgagctattgccctctttccacttttccactcttgttttgctatgtgtccttcagctaacttctcttactgctagagtatttgtgggagtatcaggtgttacatccagaaatgactatgcactgacggatcaattgccatttcttcctatgtgtctttttaaagtgggaaaatatttcccaaatattctctgcatgtttaagggagtcttttgttagaatcttgtacataccaatcccccaaacaattagtgtctcaggaaatgagacaatcatgactgacttacaggacccacctgacagggctgacgcaactggaggaggatggatacctgaaaaaaaaaagaaaaaagaaaaagaaaaaaataacagggtttcatctggaacagataggggaaataatgaacattaggaagataaccaagaggattgattgctttaataaacaaatgtaatatagttataaagtagtcctaggagccggctgaggtgaccactactgggtgtggagaaggcttagaaatcatggtaggcccaagggaagctcagaaccatagacacaggaggcacctctattcacctggcttcctccataattcaactgacagatcttccaattactgcctttgcagtattgggaagaacacttaacctccatatgctctaatttccttcccttcatagtaagagtctctgtcaggcattgaagagctggactctttactcttcatgcacagggagaccaacaattaatattgctctaaccatacaattgtgcagaaaacatacctggggaattttactcaataaagataccgtgtaagttacccaagctacagagtccaaaggggatttaaatccagcccatgttttacttgtcaaaccatgcaccttggcagatacttgtgtccaccctgaggaaagcatcatcccacaaggacattatccacctgcaagaacaagtccaggggtctgcatctgcgtaaggtgggaagtaacttcaaaacacctacatgtggtttcataggagccctgctcctcaagatgtttcaggagagaaactggtgctcctctaatagggcttcttgggagacagcatacaagaatggtaggcatatgtttgtaagtctttttaacccactcctagtaccaaaagtgtgtggtggctcagatgatgggctctggaatcagaatgctgggacttggtttctgaagtctgctcctttttagctatcttaatttgggtttccgaataagtttgagatcacttatcagtttgttagataatcccaggaagcatggtaagataatgaacaacagaagaaaaccaataactattaccagtattggtagctgggacttcagttcaccaggatctacatgaagggctttgtaggaagcaacttggaattgtctcagcaacgaacaaaaactggggtatttaatccaatgactcctatttctcattacataaggactaattctggggacatgtggaagccagccaacaagataaccctcagaaatatctgcctcataatatttggtatttatgcccttgtgtaatctgttcccctaatatatcaggattggtctgtgcaaccaacagaatatggcacaggtgataggatgtcattgctgaggctaggttatgacagacagcatgacttctacattgttttctctcttggatcactagcttgggggcagccaactgccattgaggaagccaaatgcacaggctcatttggctcatattggcctcctgcccacagccttgagtcagtgatcttggaagtggatccttcagccccaattcaacattcatgtgactgtagctgtgaccagcccttcaaggtgcagtctcatgagagaatttgagatagaatcatttgactatgtttctcccagatttctcaccctcataaatagtgtgagataataataaatatttgttaagttacaacacttggggtaatttttatggaataatagataactcatacatggtgttaactttccaacatttctgaaatgttgcttccatgggcaagacaagctcctgtggccagagaaaatcatcaggaaaggggcacagatgcttgaggaaagaagtttacagcacacaccagaatggctcttcagagctgcaggtgatgtctggaggagtgtgtgaggacagagcaccaggccagctgtgtaaacttgagcatgattatacacacctctaagcttgggttctctctcctcttttggcccactcttcttcttcacttcctgattttaatctcttcttctttcctcccttttatttatttattgatggattgacttttcaaggtatctaccctcttaactaaaactacggttctcaactctcagctcaggctaacccaaaagggctactttagcaaagggacaatgaatctttggttctattaagaagctgttttagaatcttagtgtgtctgattgtgtggcttgagatagacaggggtgtctaccatagcagattcaaggaacttgatagaaaatcttccgaaaataaatctatccactagtcaatcaataaggcaaatgactaggcttaactactatcccagtctcaatgtaaaggtccacaggcacttatttttcatgttgtgtttaccaaaacaattgctacattgattagactttaggtcagttccataaaatacttagaatctgtgcaggcactgggttaggagggcctattctacaaagatggaatgcataagcttactctcctttggaactcaggctggcagggaaggtgacccaggaactgagtgttttagtgtagattattcaactaggcatgcagatgtatatcttcagatgagaaagtctatcgcttttgactaataggcccactaaattgtaagaactactgatgtaggccaatatggtctacagtctgagtcaacatagcaaaaaatagagcttcagctgagttatgttttgtttccccgctccccaccagaatagtctgggcaagatgaaaatagtatttggaaggaatgctctcagcagcagtatccaaaatttaactggtttgagcttatcatctacttgtttatgctgattccatgattaaccaggagtttctgcctaggttgttactgcattttattttatttttattattattttttgagacgaagtttcagttttgttgcccaggctggagtgcaatgacacaatttcagctcactgcaacctctacctcccagattcaagtgattctcctgcctcagcctcctgagaagctgggattacaagagtgcgcaaccacgcccagctaatttttgtatttttttagtagagatggagtttcaccatgttggccagcctggtctcaaactccagacctcaggtgatctgcacgcctcagcctcccaaagtgctgggattacgggcatgagccacaatgttcggcccgttactgtattttgatactcatgactttgtctatggcctgctttagctgttcctgctcctgggctacaaacaaccataccaggccagggaatctgcatcagcaaaactctctcttttcacaaggatgaaaaacatcaaggtttaatgtaatcagaagtcttttttggtgaaagcttatagagatgttggcagttttaaaatattagtaaaattgtattcaaatcagtaaacatcactgagtgcctgcaagttgtctgagtattatagcaatatgctgtaccacagccaccaaaaaaaaatgataaaaagcatgtacaactaaacacagtttaatcggtttttgaagattcagaaggcatattggctgtttcgcaggtgcaacctatcatggatcttgttatttctgtttttgttaaaatcaagtgaacagatgccagataaacttatgttattaagcaggttatcagaatagggacttggtagagaggatgtgatttcgtgctggactgcaactagtaagagaaaatccaaattcttactgcactgtgcatttatgtttctgagaggaactctcagcagccccacaccaaaattaactgtccctttgccaaatgatgcaaaatttggttcctcttcatggacctctaaaattaactttcagatgattgattcttatagatgagatctgggattctaaatacccaaaggtaatagaccatgtctcttgaggtgatttatcgtacccagatcagaagagaactgtgagactacaatagctgggtgggctataccactctccaccaaaccctcatcctagcatttattccccagcctctggcaaggctttatgagtttcttaaaaaatgtcacgagaacagcgtgcgtaattccatgaaaaagatgtgcttttcacctgacgatcaggaagttcttctaaacattttgctgaagttctccgtgctttctttaaaaccaatctctcagccaggtgtggtggctcacgcctgtaatcccagcactttgggaggccgaggtgggtggatcatgaggtccggagttcaagactagcctggcaaaagatggtgaaaccccgtctctactaaaaatacaaaaattatccaggcatggtggcaggtgcctgtaatcccagctactcaggaagctgaggcagggaattgcttgaacctgggaggtggaggttgcagtgagttgagatcgcgccactgcactccagcctgggcgacagagcaagactctgtctcaaaaaaaaaaaaaaaaaaaaaagtctctcactcatcacagacaacctgggaaaagcagaccactgaaatgcagaaggaggagttaaagtctttaaacactagggttcttttaacttcaagagttcatgggaattgtaaatgatattggcactgaattgaatttcaaaggtgtcttgtattactgaatcattaaaatattgtgtgtatgtctgtggcacactaaagaaatactctctgtatggactttccttgacttcatcagtaataacaaggctaaccagtaatttagaaagtacttttatttctattatattaaatgttccttttaataactttgcaaaatagattttattataattccattataaaaataagatcatgtttttaatcaaaagacagactataacaagtattgacaagaatgtggagaaatcataattcacatatgtcactgtgggaatgccacattgaacggttgctttaggaaacagttttatattttttcaaaatgttaaaaatgggataaccagatgacccagcaactccattcttaggtatctacccaagagaattgaaagcatatgtccacacaagacttggacataaatgttcacagcaccattatttataatagccaaagagtggaaattacccagttgttcatcaactgatgagtgaagaagtaaaatgtagcatattcattcaatgaaatacttgatggtaaaaaaggaatgatccaataatgcatgcttcagtaggaattatacttgaaaacattatgctaagtgaaagtagctagatacccaaaaaacatatatgaattcattcatataaaatgtccaaataggcaaatccataaagacagtagattagtggttggcaggactaaggtgaaatgagaatgggaagtgactgctaatgaatatggggttttctttgcagtgatgaaatgttctaaaattagatagtagtgatggtgcataactttggaaatactttaagccactgacttacatcttttaaaatggcagatttgatgtatgtgatttatatatcaattacaaaaagatatgtaaagaagacaaaatagactccctgagaaattatttaattcatccagcaagtgatatccattggcagaagaatggatcattacaaatttgcagtatattcagacactggaataatacacagcagtaaaaaggaaagaatgataggtataggcaagggcatagatgaatctttaaaacataatattcattagaagaaaaagcaagttgaagaagtacatatagattattcaatatgttaataaagcttggaaacaaattcacagatatgtttgtatgtaaaaagtatgtatatttaaaataaaaccaagggttggtgattacagtgatatgggggccaggaaaagtcaggagtttggcaatattcaggttcttaaattaagtgtaaatatgctagagatcaacctttatcatgcttcatttcatagtgtacttttttttgcatgcagatgtaatatggcattaggtgaaaccatgtaaaaatgctatttttcttagtcaaaatagtcaaataccagaaattacatattattcaaacttttttttaagtaagaagaatagaaatttggagccaaacttatactaaattcaactcggggcatgattttggggccgtattttataccacgctttgttagattttggtgggagtgagattaaaatagtagtaatatttgcaagaatggctcatttttattagatgtgaattatgtaccaggcactaagtaaatttttacagcaactctgtatgattcacagtttacagagaaaatctaagcttcagttttaagaacttacccaaagtgactgtgagtgggttagtggtagtttacatgtgttttccactgtcttctgtagaaaactggctccaacataaaaaacctaactggccctttctctccatttgtattgtgacaaccttaatccaatcgacgatctcagctactacaaatctccagtgttcccttggctgccttggcttgccttcaatcacttagaatgaaatctgcatttcttactggtgtcttcaaggctgcaatagtttcctggggctgttgtcacacagtaccacaaattggaggggcttaaagcatatacatgtattatttcacaattctcaaggctagaagtcccaaatcaagagcattgccatactctatcagaaactcacggtagaaatcttccttgcctcttcctagcttttggggtggctgaaaatccttggcattctctggctcacagctgcatcctggcaccctctgcctccagcatcttatggcgttctccctgtgtgtctgtctctttgtctctattttctctttttatgaggacactagtcatattgcattagaacctaccctaatgaagtatgacctcattgtaactgcattactcctgcaaataccctatttccaaataaagtcacattctgaagtactgggagtaagtaattcaacatgtctttttgcaggacacaattcaacccataacaaatacctctcaagaccttctcagctgtctatgatccagtgcttttctccccgctccatcattgtcctgatcttctctcagtttctgaagcagccttgttagtttctaccacatggtctttaaacctgctgctctcagcctggaataatgcacttccatggacttcctatagcctgctccctctctgtctttgggtcttaatttaagatttcacctcctctgagatgtgttttctattccaccctttcttaagcatgtctttattctactttttcattctttttctttttaattccctgagtttcatgcatagcaatttttttttttttttttgacagagtctcactctgtcgccagactggagtgcagtcacacaatcttggctcactgcaaacttcacctcccgggttcaagcgaatctcctgcctcagcctcccaaatagctgggactacaggcacatgccaccacgccaggccaatttttgtatttttagtagagacaggttttcaccacgttggccaggatggtcttgatcttctgacctcgtgatctgcctgcctcggcctcccaaaattctgggattacaggcgtgagccactgcacccagcccatgcgtagcaatttttagttataaataaattataaatttgtttgtaaatatttcattatcgacttgcgtactttctgctctccatcctcccaccctcgccataccctcaaacataaactctatgaagggctggtatcctgactctctggttccccacaattgcagcacagtgcttgtcacatagtgcttatcacaagaagtttttatttgaatggacgaatgaatgaacaaatgaatgaatgaataagccagaagcaattatggtgtgtcctatctgaaacatacatccctattagggagtcagttttacaataactggtttagagccgagaggttaataggagacagcactaaattttaccacttactgtgtgcctactgcaaggtacttgactcttctaagtctcgattacattgtctgtcaaacagggttcatcacagtaccaatttggctcagtaaattaggaggaggtgaagtagccagggcacaagtggtggtggagatgacaatgaggggaatatttggcaatgtatcagaaagcaaagatataagatgggctggccaggaagttcccaaaggaccaatcctgtcttatgcagcttctgtgcctgctctgaaaacctggaggacagcatcatcctgaggccacgttttcactttccagccacgcattcagctaattgctttggcagcaattctgccaccaggctgcaggcctggaaacctgcccctttcagataatagttcacatccttgaagtgaaaagacggcagtccatgaactgggaaagatccatacttctgattttatggagtaaaacttagcaagaagttgtgaaggaagattttgtcagaatttaataggaggagagaattctatagatagacctttccaaagcaataaatcaacatgaaaacctgtagccatggtgagcgcttgcctcaagggacagaaaacaaagtacaagtctggggatggtgctgcacttgagttacctttaaatgagaggcacagtttcatccccgggcttatactgacccagtaaaagctgagtctgagcgtactccctgggcaagaaaaatagattttccttaatcagagcttttcactattaaaaggcagttgtataagttccacaattatgtcaggaaatctagacataaagctcttgattgatttcaagccaggagggacctagttcattgtttggtacccagagaagacaaatgagataggaccccagtactactgcttctaagaaaagagagcatgctcacgcttaggcgtaaatcatgtggaaagagccctgggtttattttatttttacttttttcttaagagacagggtctcactctgtcacccaagtggaatgcagtggcaggtagctcactgcagactcgaactccggggctcaagggaagctcctgccttagcctcttgagtaattggaactatggtgtgcaccaccatgcctggctaatttttaaatttcttgagagatgaggtcttgctatgttatctagtctcaaattcctggcttcaagtcatcctccctcctcagcctcgcaaagcaccgggattataaattaggaggaggtaaagtagcacccaacctgcagggccctgggtttgaagtcagatttgcctctgacttactggatgggagatcctgggtagttcccagcctggctaagccctatgtcccatctgtaaatcaaagttgctgatattccaagaatcccttcaggtggcaaactaagatcactcccaagtctcgacttatacaggactcacagctacctgttttcattggttactgtacctctttgagtctaataatcatgctatttttatgttgtctctttcctccttagacaagtatttctttactttttttcaatactgccccttaagtatttttgacacttttttctctaattgttctcccctctccttatgatttaaataccacagatatcaatttgtatatcaatttctgcaatgtgattccttggaagggcataaagcattgtaagttctaaaaattttcgaacctctaaaatcaatttttgcccccttaggggcattatcactccttgttaaaaaatgcatgcttaatactgcaagttatatgtcaacaggaaatatgtatcttgtttgaacagtatccttagcacatggcacataagaaatgcagtggtatttattggatgggtgactgagtgaatcaattgatggattgaggattaacagagtcatgtaaaaaaattgcttagtcttattcctgctacagagcaagtagaaaatatatatttgcttccacttctgaaacttgtcaaaacctttcagtagcattgatcaaaattatttcagagatttattttcctctttttatctctaacctaactgtcgacacactgagtgcacaggccaatgcctgatactctgtgtactctgtactacgttaagtatttaatgaatgaataaatgaaaggaagaattaaaatgtagggtttaactcatccttgatcggaacaattccaagagtctagtgcttgccccactagcgaaggagacatgatacctttgctcacaggcaccatttctgtctcattacagtgattttgttctgctacctgaaagccctctgtaggcaaaagagaaagcaaccttgcacaatgcagtagtggcttattcagcttgttttttaaccagaaagtctttgtgataagaatcctattactttgcaaaaagagagctttgcctcaggaatgtgaacacgagaagaatgaggtctagcaaattgaatatatggaggtagaattcagccaaggagatgacttggggcaaggagggtagtgattgagagaaagaagaaggcaattttgagggtctggaaaggttctatttcctgatctgtgtgctgattatatgggtgtgctcactttgtaataattcacaagctatacacttaaaatttgtgtatttttctagaggcacaattaaaagaaagaataatgaggccaacaaacttaaccttttgaaaatcagacactcaggctagtcaattttcttctctgagcctcaatttcttcctaataatagtacttacttctcaggtttgatgtgagtattaaatacagtatataaattacttagtgtagtgcctggttcattatttatcagttattactaattagttattattatcattaactcagcccaaatttattaaaaccatactaaaagtgtccattacttttaattcatatgcaaggagtctaaattcagaaaacggtaaaatgaggacactcccctatcctctcatatttcatcataaaaattttcagatacacagaaaagttggaaagaatggtagagtcaatgctcctagagtcaccatctgcattctatgcctaacattttgctagatttgcttcattgcatagccatccatctatccctccctcagggacttctgttacggacacctgaccatggcagtaggatggggactactaaggaaaacaattgtgctagtttcaggaagtctctggccgaacttacccaatggagccaccttgtgttgaataattcaagtcttcatattcatacttctcagcagtccagaaacaagataacttgccgtaggagaagcaggtaacacagcgtcaaggctgctatgccctacagagaagcaagtgaaaaacaaagccttctcctgaccttggcttgcccaagagaatatgcagcagatgtaaattcctcccaagagtttttaaattcataaattaacactgactttgaattagtcatattttccactgaatggatacagaaaagcctagagtttttttttttcttacagacaagctgagtttccatattctagtttttctgtaacaactatgtagcatttgcacaataagagcatttgttttggttcctgctttaataaatcgtggttctgctttaatgaacaaaaccaaataatttgtaattggtccattaattatctgcatgtaaatgccgatgttagagtaacttaataagccattgaaaaagcattcttgtttgccagttgagttatactctatttagtaaacagctcttttttgggaggtgggatgcttgttttcttttgttttgaagcagggaggccttgggaaactaaatcagaacgcaatctgaatcctacagaacccccaaggcctaaactaggacgggagggctccatgaaaattcaattaattgaagtgttaactaatgaacccgtcctatgccagatccatgagaaagccccggcacagtggcctttctcagcacagcccccagagagtgaattcttttttttttttttttttttttttttttttgagacggagtctcactctgtcgcccaggctggagtgcagtggcgtaatctcgcctcactgcaagctccaccccccgggttcacgccattctcctgcctcagcctcccaagtagctgggactacaggcgcccgccgccacgcctggctaattttttgtatttttagtagagatggggtttcactgtgttagccaggatggtctcgatctcctgacctcgtgatctgcccgcctcggcctcccaaagtgctgggattacaggcgtgggccaccgcaaggccaagagtgaattattaatagctagaagagtgctaaactttggggcacgtaagaatgtgctatggtgcttccaaaaaaatcctattgcccaggtccaacaccttatcaattaaatcagaaagtccaggtcagggtgtgtgccagatatcagtaatttttaaagatccccagataattccagtatgtagcaaaatttggataatggtggcctataaaatgatccttttacccatctgactctcccatgtacaaaaggaaaaaatagccaagcaaaataacgaaagcaaagaaacagataaaagaataaattctcccctaatctatcatcataagaagtgtcattcctttggatatttaaaatacagtggactcaacagcaagtgaatcatttcactaactggagatcctttccagaagaacttgtttggaacagagagaggactgactatggattctgaaatgaagcccaaaaaaggcagagtggtggccatgaatggggaaagaagacaaggcaggcaaggacaagtttggatcttgaacagttggccaacactgctggcacccaagagtataactgctgtagtttggatgtttgtctcctccaaatatgatgttgaaatttgatcccagacactggaagtgaggcctaatgggaagcatttgggtcataggtgaaggttcctcatgaatgtcttcgtgccatcctctaggtaatgagtgaatgtcagctctattaggtcccatgagagctggttgttaagaaaaacctggcacctcctaagtctctctcttgctccctctcttaccatgggacctctccacactccagctccgctttgccttctgccctgagtggaagcagcctgaggccttcaccagaagccaagcaggtgctagtgccctgcttctggtatagcctacagaatgatgggctaaataaacctctttataaatttcccagcctcaggtgtttctctatagcaacacaaacagactaagacaatgtctgaaagaaatatttgtgagggaaaatccagactatattttaatggaaaatctcaggcaaaatgcctcttctagaaataggaaaaatgtgttttctggggagggtgggaagcagagccatctgttacaccatctaaagatgtttttggttcttcttccaattgtgatcccctaggactacctcccatttatctaactcaatgtaaatcatctcctacagccattttgaagcactagtgtgtgggcattcaggaagaggcaagtgtatggctttggttgcagttctgggtgtgccccttttctaagaactttgagcctcactctctgcattttgtggtggaactaatatttgaagcttttcaaagtgaatgcaaagattaaataaaatcaggacacttttcacagagcctagaactctgcaggactcaatgcatggtggtggttattattcactgtacctgtctggggtgtcttactcagttttcccaaagttttcttggtaagtagagtagagagagagagtatgtatccttgaggagagatttggatctggcagtagtaggctggacctatctcttaccatcacatgccagcctatgagagagctaactattagaattttacaaatgttatgagtcagtttataaaaacaaccattattaaaattaaataatacaaacttacattcaatacattaaattaaaagcaaaagcaataaatacttaaaactcatcacttcctaattatttcactacattttactgctttcttttcatctgagtttatttgtatctgttgggtctgtatggtggaaatactgtataattgtatgctacattgcctcataatatcacataggcaccttaaaatcaatcatagtgtttatagtatggaaatcaagaaatgctgcaaatcaaggtgtttttatttttgtgttttctgtcagataactggttgtaaacatttaccactatacctctgagcctgtatgtggggagagggagaagagatgagtgcaactgaagcaccttaactattatcaggaaagacatcaataggttacgacttggaagattttcccaaaagttacctagaaaaccacatgggaagaaaaaacttctccccgtatctttttcaaaataggcaagatgctgaaaaagaaaatccagcaactagccagagtccatgctctattttctaaaggcaaaatcaggtctgttttcacaagtgacagtgaggccagaagattttgaaatcgcttgtgaaaatacgagaagacaaactttcccaattctgaaaattgaccttgtagaaaagatatgcatctgtaatgcttgtgttttatgaatttaatttcaaaggaaatgtattcaaatggtccaaaaaaccagaaggtatagaaagctatgaaatgaacacatctgtcctctttctgatacccacaccaccagtatcactgctgctctttttatatatccttccagtttctttttgcatatccaagtaaataaaatttggatttttaccaccatcatcctccccctctttacataaagtatagtgtaatatagttattgtcctttagcttggctcccccacccccacttagtaatggatttaagtgctgtccatgtaagtgcagagagcttttccattttttaagaattgggtaactgcccagaggccaaaaaaaaacctaaaaggtagaaagcaacttccaaactcatttctagccactttctctcctcctcctcctctcccaaccccctcctccccctcctcttcttcctctccctcctccctcccttcctgtcttcctccctttcaccttccctcctcccttctccctccctccttccttcctttctctctcttccttttgcttgctttctttcttttctctctctctccctccctccctccctcccttcctttcttcctttcttcctttctctccctctctcctttctttccttcctttcctttctctcctcctcttccttcttattcttcttcttcctttttttcttctcccttttcttctctctctctctctctctctctctctctctgtgtgtgtgtgtgtgtgtgtgtgtgtgtgtgtgtgtgtgtattttctccttccaccacactgaggcctcctcacctcacatgagccaactgggcttcctgctttctccagacctttctttgctgtgtatgctttttctgaaatgccctggatcacccagcaaactcaggtacgctggtgtttggtctatagctgtggtgtgtggcaagactaccagatctgtagttggatggtgcgtactcaaatcccagctcccttgcttacatgctccttcagtctcaattgacttaatctttaatttctctaagccccactctcctactcaataaaatgtggaagcagtatttcacagtggatattaatgtgggttttagagttagaaatatcagggttagaatccccattcatcttcctatgggttagttaactaggtaaattacttagtgattcttagctttgttatcacatttataaaatatgaaaaatactccatcaatttttcaaatttctgcatgtcttatgaataataaattcagcttttgtttcaaaactccatctttccaagaatatttatatagcacacactgtggaaaatagaggcaagtttctccttaaggggcagaggaaaatttgttttctgctcaggataataaaaataatgcccacattaaaaattgaagagttttgcatacagaccccttataaaataatgaggtttcctaaactcagggtttttcacgtgtaaaacaacctacaggttgtacagcatgcatctggacctttttcacaccctgtgggaattgagactttggaaaccaagacaaatgatgtgactggctattgctattcctgtgagtagtagactgtcctttgtctctgacctaggagtcttgtgtcttcttccaacattcatgagactgtgcaagctaacttgttagtgtacaagtagggtaaaatcccagatcctttacaattcttgacatttacttcatatatttgttgtaataaatataacatattaatatataaaattatatatatttttatatataaagcacatatgacaatgcttctgcctagtccataatagttgcacaataaatgagagctataaatatcaatttttcttattttttcctgggtcagaggattgcctgggaagtcaataaaagtataaatgtgaatgatattatcacagtgcctggtacatggtaggctcgtgtattagtccattttcttactgctataaagaactccctgagactgggtaatttattaaggaaagaagtttaattgactcactgagcaaggctggggaggcttcaggagacttacaatactgtcaaatggcaaagaggaagcaaggcatcttcttcacaaggtggcaggaaagagaagtgctgagtgaagtggggaagagccccttataaaaccatcacatctcatgagaacttgcccactatcatgagaacagcatgggagaaaccactcccataattcaattaactccacctgatctctcccttgaaaccttttgccaaaatgaaggggctacaggccccatgtaagtctgaaatccagccaggcagtcaaatcttaaagctccagaatgatctcttttgactccatgtctcacattcaggtcacactgatgcaagaagttggttctcacagtcttgggcagctccacccctgtagctttgtagggtacagccccactcctggttgctttcatcggctggtgttgagtgtctgtggcttttccaggcacacaatgcaaactgttggttgatctaccattctgggctctggaagacagcgatcctcttctcacagctccactgggcagtgccacaatggggactctgtgtgggggctctaaccccacatttctcttctgcactgccctagcagaggtcattcatgagggctccactcctatagcaaacttctgcctggacttccaggtgtttccatatatcctctgaaatctagatggaggatcccaaacctcagttcttgactaccatgcacccgcaggcccaacatcatgtggaagctgccaaggcttggggcttgcaccctctgaagcagcagtgtgagttgtacattggacccttttagtcacagctgggatgcagggcaccaagtcctgagactgtgcaaagcagcgaggcccggggcctagcccagaaaaccatttttcctcttaggcctctgggccagtgatgggagaagttgctgtgaagacctctgacacgccctggaaacattttccacattgtcttggtgatttacatttggcttctagttacttatgcaaatttctgcagctgccttgaatttctcctcagaaaatgggtttctctttccttgtaatcaggctgcaaatttttcaaacttttatgctctacttcccttttaaacataagttccaattccaaaccatctcttgaatgcatagaaccaaatgctttgaagcgcacccaagtcacgtcttgaatgctttgctgcttataaatttcttcttccggatactctaagtcatctctctcaagtgcaaaatttcacagatctctaggacaggggcaaaatgctcccagtctctttgctaaagcatagcaagggtcacctttgatccaattcccaacaagttcctcatctctatctgagaccacttgagcctggacttcattgtccatatcactgtcagcagatttgtcaaagctattcaacaagtctctaggaagttccaaactttcccacattttcctatcttctcctgagccctccaaactgttccaacctctgcctgttatccagttccaaagttgcttccacaatttcaagtgtctgtatagcagcaccccattcctggtaccaatttattgtattagttcattttcatatggccataaagaacttcccgagactgggtaatttatataggaaagaggcttaattgactcacagttcagcatggctggggaggcctcaagagacttacaattatggtggaaggtgaagagggagcacaaggcatcttcttcataaggtgtcagaaaggaaaagtgccaagagaaggggagaaaagcctcctataaaaccatcagatctcatgagaatgtacttactctcctgagaacagcatgggggaaatcaccctctgattcatttacctccacctggtctctcccttgacacgtgaggattatggggattattgggattacaattcgatatgagatttgaatggggacacaaagcctaacccatatcagttcttacctaggaaatctttcttttcatttattgtatcttcttgaagaagctgtgatagcaggaagggacatggacatattataaatgtagattaagttcccaatttgttttcaagaactcaactaatggggggtagctccatagggcaggggtaaagggtctcatgtctcagtgcagcgttctagtgccccaccctctgtgcaaagctatgaagcaaagctatgacgaagctatgcaaagtagaacgttgctagatccagaaacataatttggtcctgcattctaattccatagaaatacctatcatggagaagaatatatacagtccttgaacctaaagcttttatttaagaatatgcttgtagatgctggcactcctgattattgaacctaaaccctgtttaaagtagccacatcacactggggaggaaactctttgtgtatgcccattcactttgttgcattggcttccatcttcccaacaatcatgtaacaaatatcgctacacgggcacttcaggctggactcttgctagtcgcttgctatggtggtagatgaaacagactcagtcactccccttagaagcttacagttgagcaaatgtgacaacatcgaatgagtaatgtacaataaagtacaagtgtaattgtaatcagtgctatggaggaaaccaacagtgagaaattagctagggtaagtaatccaccgctaaatatcagccgcttagcctaataaaagttgatttatcactcatactcatgtcacagtctagtgtgggcagacagtagggattggggttggtgtgaggatggtaggtcctgggctccattcagtctttcaaggatccatactctcttcattagttggtgctgccattttgagggcctcctcccttctctataatcagcaggttgatagccataaggcaggatattgatggacaaagtcctatggatggcctgccagtggcccatgtcattactgcttacagcataaatacatgatgggcttggaaatgcagttcagctggatgtctaaaatagagtcccaagttgcctcctgccccaagggagagtggcagtggatagggagagtgatctcttagggtggtcagaaagggcatctcccaggaatcaacttagattagaagcacagatactgaagtcagacagccagggtctcctcctgactctgctccttaccagctgggtactttgggttaatttgcctggtttctccatgtctcattcttctcagttgtaaaatgtggatgacacttgtgagaaatcaaatgaaataactggtacaacccttaagcaacatttagtataggtctgattggttcactctaagtgtaccattactgttaaattattattgtggctgtcactagtaataataaggtgggatctgaaggaattagaattttaaaattttgaaacactgttgtctaagttctgttactattccccacaagccatctcaatgtaaaatttcacctgatcctttgttaactggctctatagaatctcttcccctaactttctggtttagggctcccatgacagcctacaaacaaggactccaatggggtagatacatgattttcattttaactcacattttgcaatagctgttgttgtttttctcttttgtcaaatgatgtgttcaactacaagctattcttcaatattctttttagtcctaacaattctgtgcacctttcaatggcaaattaaaacattgttacaactgcctgaattttaggatttgggtttggcagtaggaatcttgaattggcaaatatttttacccactgacacttatatttaaggcagatgcttacagttaaggagtaactcataaaacattactcataacagtagaacactcagcagcacctcaagtcattactctgctaactttttgcttgcatgtgcagtagtcccagctcatactcctgccatctgtatagctgtctcactatgcagtgagaagccaccatatctacttacttaaaagacaccctataggaagggccaaaagcattgctaatcttagtaaaacttattttttaactttaaagtttaaaggggaaccagcattttaggtgattagcatagattacactctcaattaacctgtcttatttgatttggggtgctgtaactaaacataaactgagtggcttataaacaacaggcatttatttctcacagaagtccaagatcaaggtgctggcagatttggagtctggtgaagactggcttcctagttcatacatgatgccttatccttgcatgctcacgtggtagaaaggacaaggcacctctcttgggccttttgtaataagggcagtaatttcactcatgagggctttgtcctcattatttaatcatccccaatggttctacctcctaataacatcatattggtgattgggtttcagcatgtgaattttaggggatataaacattcagaccatagtaacctctatgttttcatcattttcacctctgtaaaatggggcttaagagatattattacatctctttagtgcaaagactcattgtgagactgcatttttgcagtgcccaaaaaattgcatggcacatagtaaactatgctacctgctatgaggggtcattactaccctctgttgtaaatagccattattttggtatttatttgactgatacttattagttgtctgtttggtgccaggcattgtactaactgatgaggactcaactggtgaaccaaagcattgtccctgccctcactgaacgtggcacttagcaaggagaatagatgataatctaatgttctctcatgtacagtatgaaactgcatcattgacatcattgacaatcattgacaatgagactccattttaagggagtttcacctaaatcagagattaggaatggtatccttgaagaagtgactgaggcattgaaggctggaggatggaggaggagctaacttgggcaaaagaaagaaaagccatccatgagagagagcagaatatggctgtaaagctcagctatggtaaacctctggagaatgctcataggattgcagcatgtggcatgaggcataaaaagcaggtctttaggccatgccaagaattagggtttttaacttatgagcaatgaaaacccatctgatgaattttaaacagtgaagagtagggttactatgactagattagatgattagatctgccttctggaaagactgctgtgtctggaggatgaaatctagtggatgtgtgtggatcagaatggagggtcttccaagactctgggcctgccttaggaatccactgggctcaatctgtgggaggtaatggtgcaaaaggagaaatgtaggtggctatgctaggtgcttagaggataaaatcagtaagacttggtcatgagttagacatggaagatgacaagaggaaatgttaaaatagactctaaaattctgattttctaaatggcacatggagatattgacatatctgggaagaaacatcatgatgtagttttgcagtttgaatatattttgaaattaatgttaatttcaaattagaaagtatttgtcaagtgaaaaacatgtattgagcgaggaagaaaagaaaaataagttgccatgtatttatcatcctccatgttttgagtgcttttagattttcagggtttatccttctgatcaacttccaagtcagacactgtcctcatggatcacatcaaaaaatgattataaagatgtagtgactggcttaagaacatacaattgatgataaggaagatatgtatttcattacaggcttgtataaaacaaaaacctacctggcaattgtaaaaaacttaaactcattaacaatcttaatttataactaaaattattaaaaataaattctgaatggaggcacgaaaatgtaaatcccctccttgttctcttaagacagcctttccaaataaggcaggatcaccccacagaacttttgagttgagcaacttggggagtgaccctcagaaataagcaggatcaatattaaatcactgatgtttcaaatgccttggagctcttttatttcctcctgtctctcctcaagagagagtggagggagtgacattaaaattaacataagcaatgcaattagtgaagatgttgtcataaatgcattaaaacatgtatagaaaactggtaaaagcatttgcttttggataacttgtttgcaaggatgtaaaggaagctaattttccatgatatatgacaatgtatctcttgaaatcttataagatgtatgacttggatgcatcttttaaatttacatttaatgcttgagcctgggtttgctcattccaagttcaggggaataattcttaccttatgtagtttttaatgaggattagagatagtatatatttaatacctggcatagagtggatgttcaataattattattgaaaagcaaatccttttttgatatactacggtgaaataaaatgctatggctaagtttttagttctgaagaagttttccaagtaaaacactaacctagtattcaaaaaggaaaagaaaagacgggcctgtagatttgatgtagtgcttctaggctgtaggagaattctgcaagtgtagcaaatttatcccagtgtgagggaagggaacaaaataataaataataatggttcattattatgctcagaaagtttatttgacctaggcccatgccaatttcatttttatcccaatatatttaataagacaattaggggtccacatattttagtaaataatattgcctaaaagttattgacatagtctaggcattaaactcttatcattttcaagctctagattaagaaactaattataaggccttaatagttaaatcctagctgctaagtcttgtgaatattgtagtgctatccataaggctaaataattgtttgaactgttgacatggtaactgttttgttaaaagcaatctgtaaggttatattcaatcttcaaagcagttctcaagaattgtgttcaaatatggccattgaaatctgggaagcttgttattaaaagcataaccagcaaagtggctaattttcctgtgagaagatgtcaattaaccctaatagaattattttggtgttgattttgtttaatcaaacatcagaaaattattgagctctgaataaatggcttattacagaaatatgcaggttggcaagaaagattggagagtgcatttcaacaacacacatatattaacagtcgcttttttttttttttttcattgaaatgagtaattaccaaggggccttgcactgagggcatcaacaagatatgtggcccaagacagctgcttggcttcccatccaagataaagtcagatgctctagaaatgtgtgcatgttgaggactgaagggaggagaaactttgcttcttatttatcacctgtcaggtctggagaagcacagatgccaaggtgtgtaccctatatttatttacaagcacattatctactattgctgcctctagggtggccagaagtatctttcaaagcataatttcccccactgtttctcagccctgggtgcacataaaaaccacataggaaggttggaaacataccaatgcccgggcaccatcactgaccaataaaatgataacccttctgagagaatcttggtatggatgtgtttcaaagtctcccaacatgtttctaatatatatcctggccaaaagagcattgctttaagccatcaatcactctacagtattatttctcaactctgcgaaggcgaatgaacacaaagagtttgattgtcaaatctgatttatacaaatcagtggtcttacctagtacactgatcagctagggctgccataacagaatacctccgactgggtgacttaaacccagaaatttattttctcccagttctgaaggttagatgtccaacatcaaagtgccatcagtattggtatttggtgagggctctcctctgggcttgcagatggcctccttctcatgttgtccccacatggcctttcctatctcctcaccttcttttgtggacaccagttctattggattagggccccacctgtatgaacctcatttaaacttactcagctccttaaaggcgacatttccaaatacagtcatattgggggttagggatttaaccttatgactttgcggtaggaggacacaactgaatccataatccctactatcaggctttacccttaattacagagtttcagataattgtgagacacaggcaaagtagggagaggcatagaagtaccatatgacacctaggtctttacttcctttttggtctaacctggaataataaattagatctgtaagtaatgtatctgtctacatacaaaaaaggaaatgcaatcaagctacctttcttctgcttttctggaggatgctcccatatcctcctcactcccggcccctgtggaggaaaatgaattgcaagtctgttgataatcatatctttcccaaaggcatgtgtgatagttctcagctcacctttctttctctccactctcacgcagagtgttttatctttaccactgagttctggatgcattctctgatttttgtttctctaacactctgctattaaagtttgttccccagaccaacaacattacctgggagcttgataaaaattcagagtctcaagcccactccaggccaactgaattcaaatctgcattgtaacaaggttcacactagatttgttggtgcattcaagtttgagaagcactgttctaatacctggagcttttcctgcttcaggatctttgcatacatgccgtgttacttcccatgctcatgttttcacctttcagatcacagcttaagaatcacctttgctacttctctcatcttctattggaatggttgccttcatgtaattctatcagcacattatttatttcctgtttaacacttattataatacattttattaatttgttatattatttttgccttggccgtttcttctactctaagctcaggaagtcctatccaattcgttcaacaattttatcctaatggatatcatgtggcacatactgcatagatggcagatagcccttgaatgaataatgagcaaattgtttttccataatctgttgcctgcctgtgtcttagtctccaacattttttcttcctcccttgcttgcactttatattgcagttcaactgaaactacttacagaccttcatcctcatcaccatctgtgaatctagtgcattcatgctttcttgcgttttctcaagctattcactgtttctgaatgcgtttttgccatcttgtttcattaaagcactcatattcatcctcagagtctctgctccaatattctagaaaaggatgcttaaggaccaactgggtcacacttacatcttaaattacattgaatttagtgtgatttatacacaaatttatactgtgatgctgagatcctattgagggaaagaaaataggtgtttctcatgtctgtatttttattgtttaatacagtgcatggaacacagaagctgctcagtgaatggcctttgattatgagataggagaattacaagatgatgttagaaggatgggatagagaccatttgtgcctgctacagaatgttggcatggaaagtccttccaggacatcgtagtacccttagtagtgtaagcatatttttgtttgaggaaaaagctacttttcatatccctttagtcctccagcagtcttggaagataatgtgaatcagataagcactctatttgtctaattctctgaagttgacctaacttctcaatgcaaaaaaataagcagatatgcatgtttggtttagaagccacttctctcttagctttgtggacttataagtttgtgagatagtagattctgttgttaaatagtctaattgaatttttaaatatattcatgtaaaatagacatcagtatcaatgaacatacacttcaacagccttctgccaaactccacaaggcatgggacagaattcagtggcagtgggtggtgacttacatcgaagtgacatgaaagataccagaaagcctcttacccaaatatgtcactgccacatcccctgaactcgcaactgagtttgaaactccaactgcttgagttgtttcctcaggttatctgttaaagaactgattctccaattcatcattggatagcacatgcttgaatacaacgcttttgatttaggctttttgtaggaagcattaacccattgccctgtaagacagaggttgactttttagtttttcttgccagctattcaccaggaggaagtatttggctcagtcttgctaacttgagctggagaaacagtatgccagtcagcaggaggtgcatgaacaaaggcatggacacgatgtgccaggaaaaaaagctaaaacccaagtgaagtaatagttcactttcccccttatatttttttaaaaagaaaaaaaaaatactagttttaattgactattacccctctaaaatactctcaaatatagagtcatatttggtttttctgtaactccattaattgacctcacagaagttaagtgagtcgatcaagatgatctagccagaattgagagcgtttgcaacccagttcatgttctataagttttgcaatgaccctacgagttcttctagcccaagaacaaagaaagcctgaaagttgatgctagaatcccaaccaaagtattagttaagcaacatcactgttttctacagtgttattgaaagaatacagattccacagaatgttgagagatagatattacaggaaaaaaaagaatggtttgttctatactcaaatggattagaaagcactagattaaatcaaggaggcctcatttttccttaagagcaaaacatctcaaagtcttcagtacactaatacgcatcctgcctcccctgatgtgtctgtattggatagagtggtttctttttctcaaaagattatgttgcagggctagttttcattataatgaaatgtgagataactatcctaaataacctgtataaaaacagtttctatcctttagttcagaaaagggaaacaagagattcaaaacttataaaaatagaaagtaggggaataacagaaaaaataatcaaaagcctttcttgtcttagtaagccattcttctccatttacctggcagagagcatgactcaccccaggtgagtgggtgaaaagcaatttgcaagttgtcttgagtgtgaaaatctaagatgaatggctgagctggttagaaaagaagatttagtttcagtgatttaaggatttctattgttcttttttgtacagtttgttatatttaaagctagtcagatacagaaggctcaagcgcaaaagaagaatgacaagtgttcaaaggcataaaagaggacatttttttcctctaaggatttatccttttatatcctaatcctaaaagttctttcttaggatagaatctgccccaggttccatattacttttcagctctgtaggagattaaacaaaatagataatggccctacttttcaaagtgtaagtacagggaagagaaagatggcaaagatgaaatgctaagagatttcaaacaagagaaagaccatttcagcttgaaggcatcaggaaagatttgggacatttaagataatggcggaagaattagggggaaaaatgacagccgaaaggttaagtgtaaataaaataatataaatagggactctggtattaaagggaagcccaatcactgccctttgttagaagaggccaatgaaactggagtggaggttcgggggtctgctttggaatgacatgaacaatcaaatgaaaagtctgcactgtctcacgtgggcaatggagacatttcagtttttaatccaggatgcagtaaactcacacttgccttccaagaaggtactctgtcaacttcagacaaacagtcattgtgagctgctgtttttaggtagagatgaacattaggaaacaccactgatgtggtctctgacctcctgggcttacattcaggtggagggagatggacacagaagtcaacatccatatgtttaatttaagccagccattattatgaagagaaagcagagtaaaggaataagaaataaggaagggaagacccaaaatcagagagagcaattaagtggacccaacacggatgactttaatagatggtcatcactggggacaaagaagaaaagggtttatgggagaaaacaggaacgaactttcacaattgttactctccaatgggagcaaggtaaagagttaaagatgactgtattgtcactaataattgtaatagacagaactcatcaagttttaccatgtgtcagacaacatgcttccatacatgccctttttcagtaagtgtaggaggtaattattactgtctccatttcacagatgaaaaaaatgaggtttcaagagcttaaatgacttggccaagatcaccctgctaggatttgaacccgtgatcatctgattccaatgctcatgttattatctagtccatcaaaacaggctgaactgtgtgtggagagatctagaaaaaggaaaggaagttgatgtgttcactttacatctgcagggtctgaaaagccactatgacattaaatactggcaatgttcagctggaaaagttgaagctcgagggagaggaggactgggaatattcatcttaaagttctttgcatgaaatgtattgaccgttggagccataatatatatatatttttaaattaatcgttatttaggtaactgccatgtctcaggcatcatgctattccttacacgtgtcatcttatttagtcttcctacctaataaactaagggaactgagattccatatcctctacttgcttatggccatacttactagaggcgatgaagccaggctttgaacccaggacagcctgacttcctaactcatactctttctattttgagctgtacctaagcttactgaaggagagtgttcagagaagtcagggactactgaaatcatgttctgtccttggctgcagattgcacatgacttgtttttctcccgtctcataatgtgctaattgtgttcatttgtcctccacctagtaactgagtgctccatatttaattccctttcttcctttaagaaaatatcaaggacatttaagctgcaaacattcattatatacatagatatgcattaaatgaccagaaaactgatgagactcacaaaagtaattatggatcctttcatcatttctaattacactttaactcaaattttgagtatagaaaaatcacttctaaaggagaggtcagtctgttctttccttgacaccatcatttatccatttaatccagcaattcaattgcatttcttcccagatattgaattacaatagtggacaaagaggatggaggctgtgctctcatgaagcatacacatattagttgggaaaataaatagactttaatcgagtctcatttttgcataattacaaatcgtaattacaaagtgctgtgaagaggtatctttatgaataaaacaatgctcattccagtgggtatagggacttcctgaacaaaacttaggtaagcctaaaggttatttcatattgtgacatgaaagccactgtgggccaggaaacttcatagaattcagataaatccaggagagtgaagccagctgacggatatctctgccaaattgtgcacagttatatgggaggtatgagagcaatgaaaagtcattgatgatattaaccgaaaggatgacatgattagacctgcacattaaaaggattgtgctggatgttgtgcaataattggcttaggagaagaccagcaggaaagggaggtgaggaaactggacagaaagatttgctgaagagggtttggtagcaaagatcagaaaggatgattcaactctctaaggaagtaacctttatctgttttgctcctggcaagtcagccaggtccagaactcagtaagtactgcacatatagctttttggatgatataaataatttcctgcatgacataaactgacataagttgttggtaatttaaatatgtttggttaagggaaagggagatatcaaagatgacacctaacttctggcttatgaatagataaatccaccatgcactaaggatttgtatttctgttttctttggctctgaatcagctgtttttttttttttttttttttttttttttgtaaaagatcagagagtaaatactttaggcttttctggctatgcattgccaactactcatttctaccattgttttagcataaaagcagccataaataatatgtacatcaatgaatgtggatgtgtttcaataaaactttattttcagaataggcaacggacaggttttgacccataggccagcttgtcagcccctggtacagaatatgagtccagttttgaacaaatttaatttgaaataaatttaaaataacccaactcattctttctcattgagagattcatatgaattatgtttacattataatattattcttaaattcaggcttttaaaaaagtattttcaaatgtatttgataattggaataaaaatatctatctttgattgttaaacatcttttaggaaactatcacagagtgagaagaaataggaggtcatttgcagttagcaaataaattgtttacaaggagatggcttttctactggcagaactatttcagaaatggataatttgtgacactgaataaaaaaaaagatagctaactggtatcagtagatggatattgtttggcaatctaagaatatatggtattttttaaaaaggcatagaggttgttaaaaaaaaaaattctgaagatttcccgtaaggctgtcccgattcttccagggggaaaaaaaaaatggttctgaaatcaagtaaaatgggtctgttttacttaggggtatagaaaggtttcgcaaagacagacctagatttacttttgtggccaactattcaatttctctgggagttttgaattctgcaaatttaagataagaacctccctcataattttttgtttttgaggataatgcaagcattaaaatagtaaatacaggtcatttagggagaactacaatgaaatccgttcttgatgtataatttaacaaacttgtgttccattagacttggttgtttggggtggggaaaaatgtttcttacacccactcacttcatttgtttactctatatgtccagcttctgtaggcattttaagttgtttaaccaataacattatgaaacttaagcctagagaccctcctgactgtgaaaagttgtaattccactacaatattgtatgttcccattaaatcataatagagtataactaagcattttaggtgccccattcagacttttaaaaagaggcagtgttactgaaccaaacttggggctttccacccagtgcagcaaagccaaacaatgacattgtgatttgcatagaaagtaagatgtgtattgctgggcaccaagtgaggagaagtttcagcaaatgttttaagacccaaacttggccaggggcaggagctcatgcctgtaatcctagcactttgagaggccaaggtgggtggattgcatgaggccaggagtttgagaccagcctggccaacatggtgaaacccatctctcctaaaaatacaaaaattagctgggcatgatggagcatgcctgtaatcccagctactggggaaggctgaggcatgagaattgcttgaacccgggaggcagaggttgcagtgagcccagatcatgccacagcactccagcctgggtgacagagtgagactccatctcaaaaaaaaaaaaaaaaaaaaaaaaaaaaaaaaaaaaaagacacaactccaggatgacttatatgcaagggtttttaagggcaggggtgagagggttttcaaaatgagttgagggagggggcattcttggaacttccgcattcattttccagttccagtttgtgtgaggtctgcatgacagcagtcagcatttttcatctagcagggtgtcccagtttatgaaaacaactcaggaacgtatgtcaatatgttacctttagtttatatagggaaccaaacatctcatgaccctgacttacttgggtgattattgttatcttcttgcttagtaagttattcattcacttccttaattgctggtggcagggctagctaaggtgcctggaacttcccttgatggggctcagaacttttctttatttccatgcttgggaactggggagcctggcaggccccagaagggtccttgtgtactctcaatagtgcatcacaatatcaagaattaaagacaagatgtattagactgttttcacactgctgataaagacatacctgcactgggcaatttacagaagaaagagctttattggatttacacttccacgtggctgaggaggcttcacaatcatggcaaaaggtgaaaggcaaggaagagcaagtgacgtcttacaaaggtggtgagaggtgacagcgtgctgacagccctcactcgctctcggcgcctcctcggccttggcgcccactctggccacacttgaggagcccttcagcctgccgctgcactgtgggagcccttttctgggctggccaaggccggagccggctcccttagcttgcagggaggtgtggagggagaggcgcaagcgggaaccggggctgcccccggcgcttgcgggccagctggagttttggtgggtgtgggctcggcggcccagcactcagagcagcgggccggccctgccggccctgggcaatgaggggcttagcacccgggccagcggttgcggagggtgtactgggtcccccaacagtaccggcccactggcgctgcgcttgatttcttgccgggccttagctgcctccccgtggggagggctcgggacctgcagcccgccatgcctgagcgccccccctccatgggctcctgtgcggccccagcctcccggacgagcgccgccccctgctccaccggtgccctgtcccatcgaccacccaagggctgaggagtgcgggcgcacattggggaactggcaggcagctccacctgcgcccctgtgtgggatccactggatgaagccagctgggctcctgaccctggtggggacttacttggagaacctttatgtctagctaagggattgtaaatacacctatcagcactctgtatctagctcaaggtttagaaacacaccaatcagtaccctgtgtctagctcagggtttgtgaatgcaccaatctacactctgtatctaactactctggtggggacttggagaacctttatgtctagctaggggattgtaaacacaccaatcagtaccctatgtctagctcagggtttgtgaatgcaccaatggacactctgtatctagctccgctggtggggacttggagaacctttgtgtccacactctgtatctagctaatctagtggggacatggagaacctttgtgtctagctcagggaatgtaaacacaccaatcagcaccctgtcaaaacagaccactgggctctctgtaaaatggaccagtcagcagaatgtgggtggggccagataagaataaaagcaggctgccccagccagcagtggcaacctgctgaggtccccttccacgccgtggaagctttgttctttcgctctttgcaataaatcttgctgctcctcaccctttgggtccacactgcctttatgagctgtaacactcaccatgaaggtctacagcttcactcctgaagccagcgagaccatgaacccaccagaggaaggaacaactccagacacaccaccttaagagctgtaacactcaccgcgaaggtccgcagcttcactcctgagcccgtgagaccacaaaccccaccagaaggaagaaactctgaacacatccaaatatcagaaggaacaaactccggacacgccgcctttaagaactgcaacactcaccgcgagggtccgtggcttcattcttgaagtcagtgagaccaagaacccaccaattccggccacagtggtggcaggcaaagagagagcttgtgcaggggaagttccatttttaaaaccatcagatctcatgagactcattcactatcacaagaacagcgcaggaaagaaccgcccccataattcaatcacctcccaccaagtttctcccacaacacatggaaattgtggggtttacaattcaaaatgagatttgggtggggatacagccaaaccatatcattccacccctggcccctcccaaatctcatgtcctcacattccaaaaccaatcaagccttcccaacagtcccccaagttcttaaatcatttcagcattaactcaaaagtccacagtccagcgtctcatctgagacaagacaagtcccttctgcttatgagcctgtaaaataaaataaaaaagttagttacttcgtagatacaatgggggtacaggcattgggtaaatacagccattccacatgggagaaattggccaaaacgagggcctcatgcaagtccaaaatccagcagggcagtcaaatcttaagctccaaaatgagctccttttactccatgtctcacatccaggtcatgctgatgcaaaaggtgggttcccatggccttaggcagctccacccctgtggctttgcagggcacagccttccttctggctgctttcatgggctggcattgagggtctgtggcttttccacacacacgatacaagttgtcagtggatctaccattctggggtctgaaggatggtggcccttttctcacagccccactaggtggtgcctcagtagggactctgtttgggggctctcaccccacatttcccttccgcactgctctagcagatgttctccatgagagccctgccctgcagcaaacttctgtctggacatccaggagtttccatacatcctctgaaatccaggcagaggttcccaaacctcagttattgacttctgtgcatgcacaggctcaatactccatggaagctcccaaggcttggggcttgtaccctctgaagccatggcctgaactgtaccttggtcctttttagtcatggctggaaaagctgggaccgcagtgcaccaatttcctatgcttcacacagcacagggatcctgtccctggtccatgaaaccactttttccacctaggcctccagtcctgtgatgggatggtctgccaagaagacctctgacatgccctggagacattttccccattgtctcagggactaacatttggctcctcattacttatgaaaatttcttcagctggcttggaattttcctcagaaaatgggattttcttttttattgcattgccaggctgcagattttccatgcttctgtgctctgctttccttataaaactgaatgcctttaacagcacccaagtcacctcttaaatgctttgctgcttagaaatttcttctgccagataccctaaatcatctctctcaagttcaaagttccacaaatctctagggcagcggaaaaatgccaccaagtctctttgctaaaccataagaatcacccttgctccagttcccaacaagttcctcatctccatctgacacctccttagcctggatttcattgtccatatcattatcagcattttgatcaaagccattcaacaagtctttagagagttccaaactttcccacattttcctgtcttcttctgagccctccaaactgttccaacctctgcctattacccagttctgaagtcacttccacattttcaggtatcttttcagcagtgcccctctctactggtaccagtttactgtattagtttgttttcatgctactgatagagacatacccgagacttggcaatttataaaagaaagagatttattggactcacagttccacatgactggggaggcctcacaatcatggcagactgtgaaatgcaaagaggagtaagtcatgtcttacatggatggcagcaggcaaagagagagcttgtgcagggaaactcccatttttaaaaccatcagatctcatgagactcattcactatcatgagaacagtgcaggaaagcccaccccccataattcaatcacctcccatcacgttcctcccatgacacatgggaattgtgggagttacaattcatgatgagatttgggtggagagacaatcagaccatatcaccagagaagtggttttgtagtcattatttcacttaacagcacaaagattttcttctgcattccagccttttggagatcttagttcagtggttcccaactttgtccacatactgaaatcacctgagaaactttgaaacacactaatgcctatttcttgcccctcagagattgtgatttaatttatctggggtgtggtacaggctctggaatttttagaagatccccaagtaattcaaatgtgcaaacaaattaggaattactgcttcaattcaaagttgagcctcagaaaccttagggaagtctcatccatctaggatcccctggggctttgcagtgaaatacagttctggatccttctatggatgcccagggtctactgcagttaaaaaaattctaataatgctggctgggcacagtggctcacgcctgtaatcccagcgctttgggaggctgaagcgggcggatcacaaggtcaggagatcgagattatcctggctaacaccgtgaaaccccatctctacaaaaaaaatacaaaaaaattagccaggcatgggggcgggtgcctgtagtcctagctactcaggaggctgaggcaggagaatggtgtgaacctggaaggcggagcttgcagtgagccgagattgtgccactgcaccccagcctgggcgacagagtgagactctatctcaaatatatatatatatatatatatatatatatatatatatatatatatatatatatataaataatctttctacctataataattctttctatgtggagtacatttaaaaaaggttgacttttataagttttgaataagtggaatctgaattggcaatgttttttattgtaatatagtccctaaattctgttcgctgtctagtcatgctacttaatgttcagaaatagaggctgagtttaaaaatgtcttgaggtgttgcagaattccttaccaagcactcgctagctcctctacctcacccctcctcatcagaaccaaaacctggcgctttcctagtattgaaaattcaacatacctatgaattcttcctaaaaagccttttttttctatcaattagataggacaaatgtattttaatgaacaaatggcattttaataaaaaaagttcttttttttaaattagctgattctattaaggttctaacaagtaaaaataatattgcagagaattatgcaataaaagcaccagccagcttggtctatggagtaagctttggaaatatgcaaatggaatttcaccaagaaaaatatccctgaagtgataaaattttcttttagatagagtgtgtctgcgtggggaaaggaacagatctcttctccataaaaatggatgcactgaacagtgtttataacaattctatctctttggtttttgtgtttggcagtaagacagcaactaatttagttttattttaaaattccagtgattataaggtctgcacattccttgcggagtagctttgtctctctactagagccagacaccattttttcccccaacatgtgtgctagaaaactttagctggtggtgctttttctctgtttctgtctgagtcagaagcaatggagtcaaagctgattttctgaattcagtactttaccacacctttttctgagcattctcaggagacaaatagaaaaacttccatttctttctagagttgcctactatccacgtaagaatttgaattattggtgaatttttctgacacactaagaaggtttgcatgtaccaaatgcagagaaaatgtattagatagaatgcgtgactgcaattagtagatggccatggagaattggttagccattaaagacagtttatcatttcacgctcaaaattccagggtagagttttattagtgttagttaatttggtgacataattttgccttcaaagatgtaaattctttttaatctgtctttttgtcttctttatttttattttatttttattatttttttgccatcctcagcttgtgagctttgtgtcttaggcttgcttttttttttttttttgagatggagttttgctgtgttgcccaggctggagtgcagaggcacaataatggctcactgcaatctccgcctcccgggttcaagcaattctcctgcctcagcctcctgactagctgggattacaggtgcccacccccatgcctggctaatttttgtagtgttagtagaggcagggtttcactatgttggccaggctggtcttgaattcctgacctcgtgatccacctgcctcagcctcccaaagtgctgggattacaggcgtgagccactgtgcccaggtgccttgtctttttcttgttgaaaaatggctactatagctctaaccatcatgtatgcacaaatcaaagttcaaaggctgaaggcagtgtggaagtgagaagtacaaaatagagtcacgtgtcaaaacgctaaccaaaatagagttagtgagggccagaacaaagaagctgacgtacttgcatccttgaatgtcttgctcatagcttgcaaacagcaagaagagcttctcacaggaattttctctggcctgcagtatttcagataagaacctcagatcaggacagttgcctaccaatgactatctcccccagtgaactaatggcaactcctgcagtgagtttctgagaccagtgagctttctttcaaagcgatttgtgtgggtgtctttcctttgtcttaattttccttgggtgtgctgtacaccccgggttacaaccctttgctcttcccaaatgaaatcttttgttccagacagcctgtctgtctgagtttctttttttaagttaacaatggcatattcgttctttgttcctcttgtataagaatgaaaaacactttcctaggactctacaacaagcttatttttgctttctttgaccagaactgcataatttgctctttccctaaactactgatccatttatctatgcagtctatttgccatgtagagtgtcagtttttgctatgagatggagatgtaaagttctgttctcttgccaaaagctaggatctcagcccttccccaggagctacctactaagaccaggtaccccaaaaccataaaccttggatgtccagaaggaaaatgcatctttatggagaaatgtaaacttgcatcttctaatgaagatgatgataaacacatcagtctttttcttaatctttctgcaccttacatctggctttccagctaactgaaacagttttgttgcggagttcaggagaaacttgaaatttacattcctgttagccttcttgcaaagtaaattgacattagatttgatttttcatagcgttaaataattatcttcctttaaaatagatgtccatgggcattttcagctgattgtttcttatgaaacaaggcagcgtatctgtgtgggtgggtatagatatatacaaatgatatacatcacattaacaaaattctcatttactagagcatttaaatgttaatcagtaccttcatgggacacagattatattttcaataatgatttttgttagcaaaaggagtaaattagacttctgtccatctggagcaggaggaatctttgttggtttaacaaatacaaataaattgagttgaaacctgctttaaacgaaaattgaaaacaaattaagtgatcagtcaatgtgatgttcgtggttacagctcctgtatatatttggataagttaagaaaaaaaaagctgggcagcattgccaggtattttattttattccaaggggaaaaataatgagttggcagcattttaaactggctgtaaagtattacatatgatgataatttgtttatatatttgtatgagccctacatttattcctataaagtttaattatgtggcacgtgagtagccactaatgttgaaatcaagcgaatgtatttatttttgttgttgttattgttcatctttcctggtagccatgagtaagaccttttattctgatgtttgaaaacacttgtattaataccagcagttcttttaggttccaactcttgaaatttgacatttgtaaagttaatgcgatctttctctcttgtcataagttatttccctaattttatgactctgggatggcttccagtgacttattgtctcaaaaatgatgatactgagaaagagaagattgtgctttatagttagtgatttattagtgctgacttgggctttctgcttaggcaaataagagtcatctgaagatgcttggatctctggttaaagtttaaattcaaccattaaaaggttatgctattttaccaagtttaactcctgagccatttatttttccaagttagctacattcaattcagaatttgaatgtagttcacattcaagcgttgatgaaagaatcactctctgctatgcatttcattcagtatattaacacaacactgaaattccaatatgcaatatattatttttcttttgcctttatctcttaaaattatgcacttaaaaacatgtctcagactttccagtatctttctaatctattggttagttcaattgtattaaaaattcaattaactacatatggagaaaatcagccatcattgttaattggaattattctgtataataacttgcagacgtagtacatcttttgtgacttgtggatactaaaactatttcatgcatatattgctcaggactcttggtcgcaagtattaacaataaacttcaaagtattttaacatagataaatttactggcttacataatgtcatagtctaggaaaattcttgcttcagggatagctatatccaggagctcaaacaagctcaccagtgatctttgtctttccactcagcttccctctatgttggcttctttctctaataaattcctccttttagccatcagcactagccatcttttatcctggaaactctgagtccagtgaaaacaaatatttttatcctatgtgacctcagaaaaagtcaagaaattaaattctatgacctgggacataatgatgccatctctgacccaatatctgtggctaggaggttggaatgttatcagtagttgactaacatggttcctgaacaatcctcagcagcatcacctgggatcgtgttaaaaatgcatattctcagggcacacctcagatccaatgaatcagaaaatcttgcaaactctattgtaacaagtccatatgatggtgatgcactctcaattttgagaaccactacaatatactaattggttaggcctaggtcatgtgcacaacccaagagcttcagtgtaagttcaaccgcacagaaagcatatagaaaagaaatctgaggaactgataccggggaagagaaaagaaagagcagatgctgtgctggcaaagaggagagatgcctactctaaggagatttccacccaacagtaaagtttcccgttgtttctaatgccattatttctcagaacactgctgggtatgttcccctccagaaaaccaatgtttcaattaagcaaatacattcttctctaggatagtctaaatgtcatctgcaaatgggggatggccaaatggtttccagaccatattattttcttatcaaatacttcctgaattcataggaaatagtctaatacaattaaagccttcattagtaagccccacttctcccctgtgatagtagattcacattgctgcaaaagttctcagtgaaaatgacagtaatgcttagagaattttagagaaggtggccagcactgcagtattatccaaaataattttagaacatttttaaaaaataaaacacctaacaaaggagataagtgtagcttttcatactgtcctagttttttgtttgtttttgttttttacttgatttgggacatttatacttattacccggggggaagacagtagagtgcatgccagtttttctcaagttatctgctcacaagaatcctttgggcacttgttataaatacagcccctaaggttctttttcaggatattcatatttagaatgtcaggaatgggaagagggaatttgtattgcctcagggaattcttaagatctggcacgttgagaacactctaatggtgaagagtgaggatgctggaatcctatggtatgggctcaaatcatacttgtaactcttgcaagctgagggtaaactattcaacctcatgcctcatatgtcacttgccatgagtactgtttgctgctggtgttctttttctattctcttgaagaatctgcctgattcaccttcttatttcttatgttacagatagaagacatgcagtggggtaaaggagtccgagagatacccgcctcagtgtgcacactaccatgtaagccaggacagagaaagaagacacagaaaggaactccttgctgttggacctgtgagccttgcgatggttaccagtaccagtttgatgagatgacatgccagcattgcccctatgaccagaggcccaatgaaaatcgaaccggatgccaggatattcccatcatcaaactggagtggcactccccctgggctgtgattcctgtcttcctggcaatgttggggatcattgccaccatctttgtcatggccactttcatccgctacaatgacacgcccattgtccgggcatctgggcgggaactcagctatgttcttttgacgggcatctttctttgctacatcatcactttcctgatgattgccaaaccagatgtggcagtgtgttctttccggcgagttttcttgggcttgggtatgtgcatcagttatgcagccctcttgacgaaaacaaatcggatttatcgcatatttgagcagggcaagaaatcagtaacagctcccagactcataagcccaacatcacaactggcaatcacttccagtttaatatcagttcagcttctaggggtgttcatttggtttggtgttgatccacccaacatcatcatagactatgatgaacacaagacaatgaaccctgagcaagccagaggggttctcaagtgtgacattacagatctccaaatcatttgctccttgggatatagcattcttctcatggtcacatgtactgtgtatgccatcaagactcggggtgtacccgagaattttaacgaagccaagcccattggattcactatgtacacgacatgtatagtatggcttgccttcattccaattttttttggcaccgctcaatcagcggaaaaggtaagtgaaaatgcacatcataatatgttttttaaaaatgtgttcatttttgtaagtactgaaaccaaattgattgtataaagtaagaagtttcgtatatgcagaatggtatttccaagagtagagaactaattcaaggtctagtaggcttcaatgctacaagagtctaaaactgagccacgttcattccactggaaaccaaccagatgtagccttttcaaatcaattaaattatagaattattaaatgtaatgagagattatctagcataaaattatctatctaaaataacccttcatattcatttattcctcaacttctccacttacccacatattttttgggggtaggaaaagaggagcatagtaccttctccaggtgggagtgtgtgatggtcattactatcaccagtgtaaatgctctctcgctcttccaagtggctacctaggctattgctgtccattgcacttagtactcaagctttacaacagagtagagttgcccaattgtatatgcacaatatatacccaggtgggtgaatataggaaagatttggttagcatttcagcataggctccctacaactagatggacattaatcacatccagcaattcacagtgagatcagagatgcaactttctaaaagaggaagagtcaatatttggtgcagagctagtgtcatcaagctgtgaaactttgaggccaacatatttgctagttcacatgcaccttccaggtagttataagtcttgtgaatctttgatttagacaattctacggtgttgattctagacatgattcttatacatctgactcctatactcacccacgtggctatagtttcatgtaatatcaaccctaatatattgatagtgataagatatggtgtctttcactggatgtaggcagctctggcaggtcagtacaactgggatctagagttctaactgacatactctgcaaagagggcttagggatagcttgattagatgtgaggacattgggggtctagtctgattccacgttactttggacaaatctctgaaacattcagggactcaaatgggaaaaacagggattgatttagaatgtctaaaaatttacaacagcctgtgtatccaggaattagattactctagtttttctttgttacctctgttctccatataatcatacaaaggattaatggcatctagttttccagctgaaaagatgtattttacctaaattgtgtaattcagaggggctataattttgaactgtgtttttaaaaaagtaaatatttcatgaaaccacacagaattctaaaaccaaggagaatgaatggttccagattatggttttagtcataaagtattttagagaaagttcttctaaaatatacgctcaataagcatagcatgtttcaatttcataatctatgtttactgtctgtgaaaccaacttgaatatcattttatttcttctgtgtattcctgggccaagggaatagtaaaatatgagttagagtggtaaaatacaatagagagaagaaaaaaaaaatccccaaatatgtgctcgtaagttgataactattgaactttttatagggaatgatgagtatcttaaaagcctatggagataataattattttgttattaaaacaactcaatacctcatgcaacaggttgaagacattaaaacctttcccgtaagtttattcttggggaacataaaaaggaaaaataattataatggttttatagatgagtctgattgcaatgcctatttgacaatatatgtctctaccatttcatttttcatttctagtcatgactatggatcttttcaataaggtcacaggtataatttatgcattcatttaaaaacctgaaattgaaacaaggtttcaggaattgaattctagttgttctagagaacaatgtattggtagaattggagtgtggggaaatttaagctttcaagcagtgtgctttttataccagagttttagaaggcacgtaattttctttgtgtattctcaataggttatgaagttttacgtggttgattgacacaattaaaggcacaaaattgccaaatgggaacagtaaattattacatgaaaatgcacatccacttataggcatatggctagagaagcatgaacaaccaatgagaaaataccagcgtgtatacatgaaactatagcatttaaaatgtggaaagtggccaattatcaaatgtaacaaagagatcacatcagaagggatttttgccaagccagcaacctacagaatcacaagtttttcatttttgtttagctctaacaaacagtttaagtgttttaaatcaaagaattatattataacaggaaaaataagattaggcagtgagttcagtaataacaatttactgtttcaagaaattgaatttatattgagtatgctaggaatatctgtaaaaatttctgtcaaattcataagcacaacataaagagacagcagtgttcttttccttattttttttttgcaaaatattaacccccatgaagtttgtttttgcttttgttaaggaggatatgggagaccactgctatcttgttttatcattgttaatcccatgacttctagaatgagcatcttgccatgtggccagggatggaagtggtgaactttaaccacaagagaatgattctagcttcaggaattatatttaggtggcgtaatgatgcaagaacacactaaaactggtacatcaatagcacagtagaagctggctggcccagtttgatgtgataatataccattattttgttctggcactatctgttgaagactagaatgttttctataaaaagcaaaagcttgccttgtggttgtgtctattcagagagttgcacatctaggaaaagaagtatgcctcaggtagggaacatacaggctacccggtcaaaatctgaaaaattctataggtgatatgttcatctagagctttgtagccagttattgcctaaagagctttctaggtaagttaacatatctttatacacaggcagggagacatgctttgtgcaatgtgactctacaaagggaaaatgatcttgatacacaaggaatgggatcataagttctcaaaggtcttcctttgtgtataagtgtgtttctttagataggaggaccgtgagaagaggaaaaagaaaaagattgaggcaattgaagggcagagaaaattgctaaaaaggaaagtggcttgaagaaagaattgtgtcctctaaaatggcacccacaggccacttttctgtgcatattataacagaacaaggttatattacaaaacttaagtaatttgatttccacgggagccttcggtcactaaatgaccaaattggggcaactattggcaaactttgagccagttcaggattcttacctcagtggttcttcaaattgtgttcatggtcaccccctgaggaatttaacaaattattgcatgtctccccaaccctataatcccatactgcttcaacaggtctggaatgcggcatagaactattcacttttcaagtttgctggaaaaatgccagtggacacgatgccaaccatactttttaaaagccttactactttcttcccatttacagaagacatcctgtaaatatttacttgattcttaacttcagaacctttgggaatcaattaactgccatttcaagcaaaggggaggtccagaaatcaaggaaccaggagatcagaaagacactaatccacaaagacaaagtcaaggattagaatgtctaaatgaagcatcagtcccaaggcttgggccagagaccattaaaaagtcaggaccaagtccctggtcttgggaccagagatagcaatagaataggtagacagtggtgctccccagcggtatttttgtggggctgagaatatcgaccaagaatttttgatcttctgcatgtaacagatagcccctcagaatctgaacacaaagtaaaatctgcctagaactaatagagggatcagaaaatttggcaggtagataaatgtttctccatccacgcccaaggcagacatcactaatcaattatgacacacttcctctgtactctggtatagtcttgaaatctttctcaatacagttttaaagcaaggactattaacacatcagaactggaatgaatttgcaatccattgctatttctgatttagtttcggattcttgatacctcttcccattcagctgtttgctgtcattgtgtgaaaaccaatgatagttttcgtaaagattaatcgacttaaagaacagtcaaggaattggggtgtgctttaattcttgttggtttcgtctccaattacaaatcttttttgttaaattgccaaatgccatacagcaaggagcagccctggttctcttaggaagctatatattagtttatgcttctgtgctatttgatttgtttaaaattttctcatggtctttcagtaattaaacttacaatgcgtgtactgtgcccttggtactctgttaaggactgtgatgcagagataaaacagtgttcttttccattaggaactcatacactaatggtcaatgtaggtcttcaaacaaacattgaataagtgtgagaaatatgatagttgtcgcacaaagaatgaaggacaggaacatggagaaggagcttccacttaagcttcacagaaaatatgacaagtggactgaaatttagaggcagaaaaagtggcatgacaatgtagtaagaaattatattactcgttaaaaagtgagggacagtgttttcaacacatagcacatagagaagagacagattgcacttacacaactttgactcttgtaaaatgtgagattataatcagaattaatgaaacctcattctatctgcaaattttcgaacaatgtgaattccaaattaacttttggcaagagtcacatcttttccatatagtgggtcaagttaatttgaaatattgtagcttgtaagctgaaatgcctgttctaccttaagaggaaatattgacttatgtgcctgttgaattctgcatggtctttcctttaatgcaatgccaccaccctctcattttgtagggctggactctatagcagaggcaaagatatggcaaaaagcagcaaagccaaattgtgaagggctctgtttgaattttctccttgaacctatgaagagtcagcagaagtttctaaatgtgggagaaatgtgagcatagggtattttgaaatgggaattttggaaatagtgcttgagtgcgaaaagcagctagaggtaagaaaactagttgagtattacaataatttgacaaaagatggcactggtttgaagaaagcttaagggactggaaaagatggagcaggtttgaaagctattttggactttttaagcattaagaaaatatgcgagtagagtaagctttatcttttattttgtgttacgttgttttgttatttcaatagaaatacaattttcaaaatttgtttaatttagaaaataacattgccgactatttaatctattttatcaacaacaactaggcaaagaaagagaactctcattatcccacaccctaaagacaatgattgtccaatcatctggtggtaacttccagccatataaacatacacacatttacacacatacccaaacttattttaaaacaaaactccatattttctcttctagcatgcttagtaagaactttcaccttgctttggaacacaggagagagaggtgtcccagtgcatagtttttgctgatgccatttgtgcactcatgctgtgacaggaactcatactggttgttgaggtcttgcttctgctgtttggttttgtctgttcacgttcccatcagaagcctatgaaactatttcctttctgttgcctgctgtgaccttggtgataactgagtttctctctaaacagctgtcagaaaccagctgtttgcaaggctggtgttagctagtcgcttgggatggtgcagtcgtttttcttcctgccataatgaatcagctaatttcatatgcagtcacctaggataattggagtctcaaccatcttagacccttgctttagctagaatagctactttagcaggtaaatatcaagggcctgtataaaactgaactgagctaaaactaataagggaatagcttactacattaaaagaaaggctttaatcactggaagtttgaacagagtgatactcagaaagagaaattcctgctaaaagggaagactcaacaacagattttgaatcttcctgccacctcccgtggagagctccctggagctcacttttccccataggtgtcttgcgctttgagacctcagccactgagagacacagccacagggacccaggcctcaaactaggataaactgacacatctctgttccctagcttttctcaaagcatcagagaccatctctcattttcagaaagaatctttctcaaagcacaggaaaccataacagagcgtggtgtgctgatgggcagtcaggggactgccaaattctcggctccatagactataggtcacaatactggcccaattgtgaattctttccaacttcatttaccctctcttcttctggtcctagaagctggtttatttgggcattttcttctactccaccatcctatactgctttgagcctaatcattgtacattctggatgtatcacttaacttatttggtcttcacttctttcatcttcaccatgggtctaattattcctacctctaggtttaagagaaaatatttaaattgctcagcatacaaacttaaaagactgatgatgcaagatgctaatgaggataaagaacaactagaacactcatatactgccagtgggaatataaaacatggtacaactgctttggaaaacagcttggcaggtattttaaaaattaaacatatacctagcatactgctccagccattcctcttatatattttacccaagagaaaggaaatagtgtattcatgtaaagacttgtacatgaggggtttttttttttgtagctttatttctaatagccccaccctgaaaacaacccaagtgttcctgaaaaggtaaatggataaacaaactggggtgggtttatctacaaaatggaatattactctgcagtaaaaagcaatggaccaggctgggcgcagtggctcacgcctgtaattccagcacttcgggaggctgagatgggtggatcacttgaggtcaggagttcgagaccagcttggccaacatggtgaaatcctgtctctacctaaaatacaagaattagccaggcatggtggtgtgcatctgtaaacccagctacttgggaggtggaggcacgagaagtgcttgaacccaggaggcagaggttgcagtgggccaagattgcaccactgcactccagcctgggcaacagagccagactctgtctcaaaaaaaccgcaatggaccattgatgcattgagcagcatggataaatctcaaaataatgctgattaaaaggccccagacataaaagaatatatactgtatgattcaatttatatcaatttttaaatatccaaattaacctatagtgacagaaaagtaagttgttggctgtgaataagcagggaagggctgaagaattacaacgaggcatgagaaaatttggggggtaatatgtgttcactctcctgattgtggaggtggattcacagatatatataagtcaaaattgatcaatttgcatacttcaacatgaatagtttattatatattgattatatctccataaacccattacgaattgctttttacagaaacccttctctttctcccctcttcctctttttttcttgaaatgtaatcattaagcggccttatgccaactggcctatttgcacagtactgaacctagaaatatatttgtaatgatattacaattgtgcaaattagagtaagtaaagctctttaaacactctctaccacatggtaaatgctcagtaaaggataactttattcttctaccctaggttcctcttagcaaaatatgtctacctgggcattggcaggagggtccccagaaggtaaaatagtcacatatctgggggaactgtcaggagaggctgtaatataaattagcgggactataagagctgacactggagagacgggtagaggcaaagccccagaaggccctgtgtgccctattaaggagcatgcactttgttttttaaacaaggagagaagtgtttcaatggtttataggatagtggtgtgacacgcttgggcttatgctttaaaaaattactcattgcttataagtaatggattgcatgacagttaagacgtgaaattttaccctgggaagataggcactggctaccagtcgtgatttaaatggactttcctaatgctcatatttttagacccaggttagcacacaacctgaagggtgcagaagaatgagaagaatcccttagagcaaaagttggatcagagctggcagtcacctatggtacctttacttcccccttcagaaagaggccagtgaaccccttataccaaagaacgttagatgggaactcagcatatgattctcctcccatctctgcttcgtgggatgtttggtggggtggaaacttgaacactagcttcagtctataccctccctccccaagtaaagcatgagacattggaatgagactgcaacaccataataatggatgtatattatgggtaatcataagaattgttgttgaagagtatccgtatactagaaatactgcccatatacagccttccttgttttggtatattcttagcacgttaccacaacactagtttcttctgagtataatggatctctggctgttgaactgcaagcagttcctaatgaataaagctatcctcaaatgactggcacttggggcgtaagagttcagggcacatgccacctgctgtggagttatgcatcttcagatggctcagcttgttaccttttataatacatttggttgctctctacccacccagctcaggaccacattcggctctgttcgcctggctgggtttggccataaagttttcaggtcataaagcactgagaagtgagcaacctcaaataaataggtatctaattgcaggtttcaaggagggcccctgtggaatatcccaactcaacaaaagccacattttcccatctaagtctcatgtacatgatggtgttggggaagataacgggtcacaaatagtcaatagagagatcatagagcaaggtatactgtggcaaggaatgtaaaagacaagttcatgccactacactagcacttccttgaagctctcgatgtctctatatacctgaaggaggaaactcacactcagtaagtcatcggtagaaatgtattggtggacaaatgaatgactgaaacaaaacatcccattttccttctcatattgcacgctcttcgtcctcactttcaactgagatgtgatctcacgttagtgatttatcacttgcaaaggacttagattgtttccaaaaaaggcttgatttatatataaggagtcagttgttcacacctgggagattctggctaacagacccaaagccctagatcagattgtaatgattgggttttagcatcaaggccagatatttaggctggcgaaatctgccttccaattctatcaattccattgtgtttctctggtaaccttcccagttccctgtcaaagtgactagtttgaggcatcatggccaaattacattgttgatgaggtgaaggctgctgcctggtgttacaccaaatgccagatgaatggagcccttggttttaacccagcaatcagatcattgtcttttattttcatgttgcagatcttgaggtatggaagtaccttgtgcattatgtttttaaagacattaactgaggagtaaagaaccacatagatgtttctactgccataaactgaggttcaacttaaatgctgatctttttttcccaaatctttactgagtggactgcatagggataagtgttttataaggccttggaacctttgtattagtttctaaatttggacattacccagttacaatgtactaggaatgggtcagaatcttaagatgcttcattgttgacaatatggcaacagtgaataaacagtagaggcaagttaatggcacagtccttggactgaaatctctagaaatggccgtgtaagaggagacgtcccatattattccagggttgagagctgtgtggatgattggtaagcaagcttattgagttttagatcataatgaaggggtttgggaaatgaaaggaatcatcattggattttcccacagaaatccagcttcccactgcagttgttgggaaaagaaaatgtaaggaaatgatttcttaatggtgacactgacaatcagtctagctgatgcagaagcaccagtgtctataacaggtcctctgatgcctgaaattgaaaattgtctctctaatgtgcctgtgtgctcccattcagctttatgttccaattgattccttgacttataaccaacagtgatttttttgatccaaggcctcccttcatacaggtctaaaaaaaacctgactagtagatgtactgaaacagcaactaagaaaggtttttgttccctgtagtgatactatctttattccttcagtgtctaccaccccgagctagatattctaggagatcaagttttaaaataatttcctttttgttcagaatgtccccctgttatttaacaatcaattttaagtacctgtaacatgacctgtgacccccaaccagtgaggatccatcacttgctttttcaaaaaccttccagcagcttctcattgttactattattatcattgcctcctgccactattacaattacgacagtattcagactctttcttagagcccaggaggtttaactcaagatcacaaaatacagcccatggacctgtccaatgagtaacttgtttttataaataaggttaattggaacacagcctcatccattcatctacgtactgcctatggttgcttttattgctacaaagacagagttgaatagctgtgacagagattatatgacctgcaaagctaaaaatatttataaaccggaactttaccagtaaagcttgccggacctgccttagataatctattgccttcttagctttctgaccttcatttccaatttcttctcatccttgctgacttttcttcggtcttgctggtagtatttctgctcctgaaaaccccagggccatttccttcccaggacctttgttcaggatatgccttctttataggaggctgtcacgcagacctttccatgctgtgttcttctcaccactcgaagctcagcctacagacacatatcatggcttccttaactctcctctaccccagctaaagggagctccaccccagtcatgttctgtttgttcctattcctcagtaacttatgtcacttactggtttgttcacgtgtacctgtatctcctcattaaaatgaaagtaccttaaaggtaaggccctgctctgtctctagttctactttgtatccctagagctctaagcagtgactggtacctagtaagtgctcaataaatccctgtggattggatggaagaatgaaagaaggaatgaatgaatctgttgtggagtatgatacagtttctaccctcaatatattgtttagagagagccatgtacactaatgtctgtgaaaataagaaagtaggtttatagcaagaacagccttgagcgagatcaatcttgctgagggagtatgtcatgaagattgcgcagacaaagctaatagtcaaggatgaccaaccactgttaaacataaaaaagactttctaaagtgaaggaattgattttgaagttatttattgaaattgattatgaatgaatatattaaaatgtccaatctcatatataattttcagtcttcagaacagtaaagatgaaaaaaatacagtaatacacagtgatggtaaggatgtgggaaaacgaatatttttattgtttacaaatgaatgtccaaagtgatcaaatcttttaagaagggtagttttatgctgtatatcaaaagcttttagaatatgaataacttttcacccagtagttccatttctaggatttttggaaaggggagaaattagaaacttcctcaaagatagaggtaccagaatgttcacgagaatgtaagtagctaacaaaagggaggtgacagtgcattatagaacttctacataatatagtacttagaattgttaaaaatgatggtgcaaatcagagtccagaacaccaattgttgaacattctctgtgtatcaatcaccagtccaaacacttcatatagattacttctttgaaacgccacagcaaactctaaatagggactgatatcatccccatttacagagtagaaaatagagccttacaaaagttaagtgacttttctaaggtcccagagccagaaagggaaaaagaaagttgcttatcaggacctgactcacataatgctctgggatacggacaataaaaaggatcaattcttttaccctggacaaattacttgatctttctgggtttcagtttccttgtttataaaatgagattaacaatagtatttgtctcataaggttttcatgaggattgaatgagttaattcattctgtatgtatctatatgaaaatatgcatatatatatatgtgtgtgtagctatatcctagccactgttgtgtatgcagaagaggcatgagcaagcaaaagagataaattcctgagtctgcattctagtagccagagacagactttaaatgaataaatgaaatataaggagaatatcagactgtggcaaatataaaaaaaaaagcagataagagaagaaataccaggatggggcatacagtctgcaattaggaataggggctcagagcagggctcactgagaagacaacctttgaacaaagacataaagaagcaaaccatgaggagatctaagagaagagcattctgggtagagagaccagcaggtgctgaggcagaagcatgtcaaggctatttgggaaatgactagaagagtagtgtgagctaggatgggcatggtaggagatgagcctggaggacaggtggcagggcaccagcgcatgcagaatcagactggacgacatgcagagcctttaaggattctggatggaggcacagcatgatctgacagatttcaaaaggatcaagctgatcctcccaaatacattaatttcatgtaaagtactcaaaacagtgtctgctacctgacaagtgaccagtaaagattacacatttttatttgcagtattaatatcatcttcctctagcttcatactttttccacagtttcttcaggaaatatatatatggaaccgagaaaccttcactttccttcatacccttaacagacttgtgtatatgccatttgtccactgctggagagaagctagtttgtgttggaaaacatggggaaactgaattcaagcaccaaccctacccttgtactcagcctaggaacagtttaaaccttagaagacccgagtggactggtaacctcttccatggataagataatggggctcccacacataattacacaataatgtaacaatattccatgcatggaaatgctcttgctagttagagtatcttttcaaatgcatccttctatacagcactgactcaacaataatacttctgcatttaaaatactattttgatgagatcattgcttctggcaattgcctcaccaaatttctccttttggtatcgttaaagtacagttttatcaggtagcagatggtgaaagagtggccccatattcatagccttattttccagtgattttgtggttatatccagtttgcggggttttggcactttccagtttcaaacatttattgattcatcccactaatgtctacaaaaagccaccatgtgccaggtacatatttaggtgccagggatggaaaggggaacaagacaaattcgttgccctcatggaaatcacattctattgaaaagtgagacaatatgcaaacaaacaaatagaaaatgacaagaagacataggaaaggtagaggaagatgggagatagatcttacctggactcctgtattagatgtgaatggtcaggagggcttcttggaggaggtgctcttcaagcacaaacctgcatgaaatgaaatagcaaaaggaaaagcaagggaaaaggtgctcagaggagagtgtgagtggcgtgagaaacagacgctggagtgtagaggatggaggtagaaaatggaatggggtgggggtagccagtggctatttatgtagggctttggaattctgagcaagaagggaaaaatgggaagctttagaaactgatttatgttttagaacgaccacttggactgttggtaagaagaaaactgtggagaagcaagagtagggtcagggaggccagatagaagtttcccaagcacctgcacatttgatagagcttccaaaattacacccttgacacaatccacagaagggggaaaaaaaaaaacactgaaagtgatttactcacaaaataagcatcatactttcctagctttggggaactcattttatcaaatcaattatgtaggcaagggtctacaacttccaggaagtaagaaaatcttacaggtggtgtcctaaggctgctgaccccaattctttcctcctttcttctgaaatgatgtgactattccaagtctcattcacctgtccagtggccatctgagatagttcccagatagcaaattagcctcctaggctttttaaaaaaatccctcattgattcagcaaattttattcagcaccttgttgtgtccagatgccatgaatcatagccaaaatgtaggtccatgcagattgtattttgcatagtgtgtaatgccaggggctgctattcacataggttataagaatgccaccccatggagttgtacggtgtgttgcctgcataactgcaccctgtagccctgccagtctgctaggtactagggataggaacaagcaagacataatatttttggttaaccatgtgcccaggttagagtgattgcccttttacttggcatcctaatgagttcatttgtttttcaccatcctctatgtaaatacaaacgtggcattactgacagcagggtgcatttccaaaaatgcaaaacctccaaacctgtcttcccgacaggcctccgcagtattcattctggaaacccatcagaagcatttcagatcaaagcaggtaacagaggtgagctgcaaccagggatgatttgagattccagacacatcctgaccaccatctgggcctctgcaaaagcatctgcaggctcttcttaaagctcagggcccccacacagagagcaaggagagatatatggcctaggagaagccagcagatggtgagttacccaacttcttacaaggttgaaaatgtcaactcaccattgtggaagggtgtggtaaaagtgccttctattccctagtcttcctttctgtgtgtgtgtgtgtgtgtgtgtttgtacatgtgtatttctgaggcaatcctcattttcttatcctatgtcctcttgtgctttctattgcaaagaaatgatctattcagtcaattgttgattgattgattcattcattcaatatgtatttacaaatatcgactttgtgcctggcactatctaggccttggggacagtgaacaacattgacaaagttagtgcttcatgaaatctacatagtaattggataaagctacacatcattttggataatgatatgtgctctgaagagacaaagacaggtgcatgggaatagagaatgactggagggagcagggctacttctgattggttggtagtcatgaaaggcttcagtgaggaggtaatacatgagctgaagtagtaatgagaaggatgtagaagcaaacataattggttaaactcctttacaaggatctgctagatactttcctctttcttgtttttgtcaaatccttgttgaacatgtacattatgggataaagtaaacaattcaaatatgagtatgtaatatatcagttgcttgaatgctgtgatatgatgggagggagagtgagagagtggttaaattaatcaaatatgagtatgtaatatatcagttgcttaaatgctgtgatatggtgggaaggagagtgagagggcggtcagggatgccatcttggaggtgggagtattcttgaatagagaacaaagcaagagaaggagtcatgaatataactgggggtgggggtagggaagagtgcccaggccagagatgagcaaatgcaagggcaggtaggcgccaaggcaggggtaagaccggcaagaggagcagtaaggaggaccctgtgtctgcagtgaacaggcaggaaagagtccaggagggggcaggatcctgatcccttgacattgtataggccatgaggggaaatttcagttttattttgcattgtatgggatgtcattggatgattttgagcatgagctgactaaacattttaaaaagaccactctgtcttggagaagaacagactctaggggtgaaagtggaagcaggaagataagccagggcactgttcactgttacagtaatcaaggcaaaagaccatggtagcctgggctggaggaatgagttagaggtgttgcaaaatggtttgattagggagatgtgaagatgagctagacagaatctggtgattgatgctatataaggtacaaacaaaagggacaaatccaaatgactccacacgtgttgtgcggacagctgtgtcaacagtagagttatttctgaaaaggcaagactagaggagagggaaggttggcaggaaagaggcaacttcggacacagtaacactgagatgcttatgaacggtggtgaagatgtcagctaggagttgaatacacaattctggaattcaagagagatgctgggaattatcagactgcaaatgatacaggaaacctggagactagatgagatcatgtaggcataattgtagatcgaaaagtaagaatgatgcccaagatactccaatatttgaactagggaagaagaggaagtagcaaaggagctgaaaatgaatatcataatagagaagagggtaaatgggagggaacagttacccaaaaagtgattgaggaaagggtgaggagaaagagggaatgaaccattgtttttcaaatgctgcttagaagtactagagcatccaattgagcaatggggtcactactggaaaattcaagagtgatttgatggactggtatcagtgaaagcctggctagagtggtgctagggagaatgggaggagagagagcttctgtgagcataataaaggctctcaaggggttttactgtcatgatttcgtaaagcccatgcacagctgtgaggacccaggtagtaggtggagagggttataggatcaagggagggggcctttaaatgtttgtctggtgaagacagtaacctccaagaagaggaaacttaaaagttcagaagagtgaggagatcattattacagtgatgtgctcgttgtttgtttgcttgtttggttttgtgacattttctgtcttaggccattattattcggctataaagaaatacctgagactgggtaatttataaagaaaagaggcttaattggctcatggttctgtaggctttccaggaagcatggcaacatttgcttctggggaggtctcaggaagttttcaatcacagtggaagacgagggggacgtaggcatctcacatggcaggaggaggagcaaaagagagagtggggggaggtgccatgcacttttaaatgaccagatcttgtgagaacccactagctattgcaaagacagcaccaagccatgagggatctgcctctgtgacccaaacacctctcaccaggccccatctcccacactggggattacacttcaacatgagatttgggaggagacaaatatccaaactatagcaccttttaaaaatgtggaagccattcttagcttgtagaccacacaaaaaccggctataaattgcccatgggccatagtttgctgacccctgcagtccagcagactgttccatgatcttccattaccagactcaaatatactggatttagcacatcaatcctggggtcattgtgcacgtgaagggtatgaggtttccatctattagatagtgcacataaaaaggcttctgatccagagtccctttgtttcttggtgtggctcatttttggtttgtttgtttccatgaggataagatcttaaagtatgtttttttgctaggaccatggatgacaattagaagttagaattacaagtttcaacaaatagatcctatagtgctggcagataccaagaatgcaagaaggcttggctaggaaatagcatagtcccgggttgaccaagacacatcataaatgaggaataagggaagttggtgatggacaacagatctcttgttacatttgaggcagttttctctcctcatcctacttccactttctctcctacatttcctacttccataagcagagaatgagggaaagcttcattctcaggaagacaaaaggaccaaattccttgaccctaggatacaggtatttgtttcctggcaaacagtgaaatttgcatgcaaattagaagcatctctggatcttaggactcttcttcagtcatcataatctgacatattgcagataaggaatatagagatgcataggtatgaggcagtaagagataaatccccacatcccagtggtgggtaacaaagtaaagtttcatgaaagttgggtagctcttctctatcctctagctgtgctatttggacacatgtcctttgctttgcaggagcaggggaacagttagagaatacctgggggaggttgaggagcacatggatatctggtgagcactctctttgccacagtgaacgctgacaccaacaacctgtcctttgataacacaggcagactcagctttcatatctaacccatttatccagcattctccccagcaaagatacaatgactgactcggaaccatataatacagcaaagaaactttctttaaaatatttatcagttatcatgaaagaaatctcttgcttgtgagggttgattgcaagggtcttgaagttgtcctttataagaaaataaagtaggactttataattcttggaacaattataacattaattttttaaaaattgccatctttgcttaagcttttgaaaatcctattggcaattctgtgtttaatgaggtacacttcaaagtgggctgggtacagatacttcttgacagcacagaagggcttctccatgatgaaaaaataagtgtttgcgtcaatagtgaaataatcagtaattgactttggtggattaaaaatggaccattgatgacttgacacatgaatttctttccagaaggactacaagcttgaatataatgatataaagatatcttgatatctatagttaatgagaccaaagggcaaggataaagggacttgaatccttttcttaaatctccataaattcctcttgaaagagaatttctactcagatatttcaactggaagagactgtagaaatgatgtagttaagcccttttattatacagatctgagaacagagacttctatctcagtgaccttcctaggggcctgtcatcagtggcagcaactgatttcatttaatgggatatatgcaaattatgtttcccataatgcactgagagtaccctgatgtctttacatattgacgtttccattatttttagttcttgattttttattgtaaaattaatgtttgccatacaaaattcaacactgtgaattttaaatatctttttgttagtctgtttcttttcttttcataaaactgaaatacatttacttcaccctggctattgtaggtccccaaaaaggttcagaagatcacttgatgatatattgtggaaatatttttaagctttagtccctgtatcccgagtgatgagaaatcctagtcctcaaaacatttgtattcagttttcacattaacacctgggatgtgggtttcagaagtaggtgtttgtctccggtcttatatccagagcttgacatagggacatctgtgcctgcttcagcatccaaacaaagatgtccactctatagctagtaaaacattgcagaaagaggcagtgtttatatgactgataaagtattttacagctttattacggaggggggattgtcagaaagacagataagattaactgacaaagaatcttatactcctgaaaatcaggtggcttaatgacaacctgatatcatgaagccctaattaaggctgtcaattacctgctgttgattcgggagcacaaaatggaacgcttggttttcagactcagatgtacacggtcgtggggggtggggttactagtgaggacataggctattgaggccctttgaaagatgctcttttttgagtgatacagtggtttatttcattagctatcttatcaccttagcaacaattgaaccaaacaggtcatttagcatcattctgcaaaatatctgagagactgaagtttttactgaagctactaaactgtccaaagatgttgccatcatagacacaattgctatctgcaggataggcatccattttcatagctaaattgttcaaaaggcacacagaggcaccatgatttttatgtttcttattgtttttttgtttgtttgttttcggtggttacttaaaaatcaatttatttttattctggtgtgtaccaggggtatagtgtttgttaggaagaaaaagcaattttaatttagagggaaacagattttctttatcacagagaaatgtggaataaatgagacacacaccaaataaaattctcattttagatcccaggggttgaggtggtgagatggggctggcagagggacaagtttagaatttgataattctatttggatttctccttagagctcttagttgtcaataaaaacctcttggtaagcaacacaaatgacctagttatgcctgtgctgttgaacggggtatttagaagccacagagtatagtgaaatagagttaaagagccagggctgcggttaagttctgcctgtctacctgtgtgccctctggtgttcttctcctcctctctgggcatcagtttccccatcataaaatggatttttaacagttcttccttaatgtatgcctttaaattacctgttaaaatgccttatagtttgcccatatcatcttaaccaaagtttattataattgagtgtacagcatctctggggaaatttatgtttaactgaattgatggataggcacattcatttcaaaagccacatctgtgatttctcttgcacagttattttattgctattttgtatgcaaatctcttgctaaagttattttagggttgggaggtgtgtgagagagaaagacagacagaaatagatagcaatgtctaccagtgcaactttattcatattcctcattgccactctctgtgatacagccacacaggcttcaatccctaatacttgccgtgatttgccctgccatggagtctttgcacatgttgaaactcacagattcccatcacattatgcttgttgtggctatctcaaaatatcatttatgttcatcattataattatgctggttattaaacctgctgccttgatcttgttatttaaggcattaatagagaagcatgtatatataactgtcaacattcttaaagcattttgattactgtcattcaccttctgacttctgacttcctttgtaatgctgtgcattttgtcttatgcatccaaaggcattctaagaaggggtgcacagctttcaccacatttccaaagaggtctttggcaccacaaaccttaagaacctctacattagaccataagtgagagagacaggggttctatctggctgtgttcatcaaggttcttggtaaacttcaggtagtaaataagtacatgttgaatgaataaatgaaaaaaactccacaagattggaatagataacccttcaatcagagatctggttactcgacataaccttctgaggctcaatgcttagaagaaaagatgcagcaaatcttgtatctatttaaaatgttttgggctgcaaagaacaaaaacctggctcagggtggcttgaataccaaggagatgtgtgtgttctcgtgtataggaagtcaggattcaggttctatgtggtcagtgtctccaggagtcatcaagaattcatgctcaaaatatgctactggagcaactggggccatgtacctctttgttttggtctgataggaaagagagaccctaactctcaagcatggggaaataaatttatcctgtcagtttccttgagacgaattggaagaagtgtcattccttgaccaatagtagttgccagggtaatgccatgtgttcattggataggactaatcaatcagtgtccatctctgcagccgaggagaggaagaatcatgaacaataagccatgcggaaaagaaggaagggcgaaatgttgtgaagaaaaccagcagagtgaatggcacaacaacttttcaggaaggctcaccagggaacgcatattaccaggacaaaaaaaaaaaaaaaaaaaaaggcattctgtttgttaaacaaacacttatctttggaaaacaggataaggggagagcttgtaaataaagggatgatgcttatgagcagccctggctttggtgcccttggaatggaattgcacacggaagaggcagggaaagtagaggcatcccattcttctgaagaaagcttccccatccctcccctagtcaggtgacacttgtgaatcaggttttacaacctgtgaaataaaggctgtagaatgaacaccaaaatttaacacagctcttttctgttttctcatgttttgttcttcatattaatttagtatccatctctctgattatcatctactgagatgaaagaactgaaagtcagaatgcttctctctgtaattacttacagatgcatatgcctaccaccaaaaggagagataccatctcacagaggaaacaatccacatctcttccgtgctctcccctgtgcccaggctttcagcatcagcgactacttgggcataattagccttccattgatttccagaaaatgtagttctcagaatagaaatctttctttatgaagatgtgattgtaggtaatttgcctgttactgtttcataataaagaaagttatttcagaagaaattacctttttggaagttagaattctctaaggtaggctggtagtcaatgaggaattctttgaagcttgcaagttttgtgctttgatgcgtcttgtataaaatcaggagattctgccatcactaccactgattagtaattattttagccatttacactatttccagaggctttctggcatgtggggaatgagttgagttggtaagttaagcttttaaaagttgtaggttattctggttggcaaagcatctactgacagaatgagtcatattttataaactcattttattaggagaaatggtaaagaaaatcacaggcctctgatttcctacaaatatgtaatgtagacggtacttaaaaaataaattctgcccagttagttagagccaccaccattgaatattgcactaatgcccatatacatgcccttcgatcaaacttgcctattttcagttgatacagtgagcttagatttctttcccaaagagctaggcaaacatggtgaagtataaacctttactcatttaatgaagaaaaaaaaatcagtccatcaaataagcactcaagtccacatgcctgaggctgtcttttgtaacctaaggggaggaaggtgatcactagttggtacagtatgtaatttattgaaagaagttgttgctgttgtcttagtacccccagaccccagatttctactgttttatgacaagtcacagagatcaggacccttgataggccataaatagcactgaggatttccaagggttattgttctaggttttgttacatcccagagaaaaattgtgcaagctagttaaatttccagaacagcagctcacagagttggtgacttatatttatctctataacactatcaccttcaaatacactgtatgacttatgtacttattttttccatcatttttctcctaacatctggagtgttaggatttttgttttgtttgttttcctcctacagttgtatttgtcataggtttcaatcatatggggaggtgagactcaagttaatttgacaatttggaaagaaactttggaggtaatttttaaaaaatgttaatacatgtttaagattttattatataactaactaatttttaatgagaacacaggaggatgttacagccaattcaaaggagaaataaaagcagcacacatttgtatggaataaagaacgctgaaatggatgtgtaaatagacacaaaagttggcttttgccttgggataggggacagagaagtcaattggactttctaaatatactgggtagaatttatctttttgtctatagacaggacttatttttcattactgtaaattagtcgcaagttacagagtcataaaattgttgaaagtaatgaaagagaacagattagataacttagaagggtttgttcttaaaaaaaaaaaaaagcataactttccattggagatactagtaattagtattatgcttattacagtcttgctccttttgaccaaaaataatctcaaaaaaggttatttgtgatcataaaataagactggtcttaggcctagcctgattatttacataggtggaacaagcattcatttactatagaggatagcttaagtttgctttgctggaagttttcatgaggattctcagattggatttttaagggctctgtcatttgctattcaaaggccaggaggccaagcccaacaaattttaccaggtttcccctgcattatctatgaatttgggcaaatttctcccttctcaaggttcccaaattacctcaacactcttgacctgccagaaaatgacattccatacccataatgctcagaccccgtaaagccaggtacctggtcagttttcttgcaaaggtttcctaaaaggccatcttactttcttacatgtggcttagtatacctgattaacagaacatcatcctaaaatatgatataccaggcaaggctttggaggcataccaatatttcctattacgttctggtagaaaaggaagacagatacattgaaaccatacaaatacatattctgtcatgtaaagtaaagggactcaataagagtttctgaattgaaggtaggagagtccaggtaaaagtagaaatcagacgtcctttgcaaatgtctcatttcagtttacaacaacagcctaccaaattgttttatgaattatcaaaagcttaagaaaatagaaaagtgcttccttatctaatcaaaacataggatattaggctaacatcaataaatattgcaaacaaataatgcaataaaatctctttcattagttcattcagtcctaggtaattaattcttgctccactggacttttgggtagcaatatcatggagtagagtttttgattaaaaagaaatctgaaaattttggtatcatctgaaaaactgcccagatgatgccttctgattcaatccttttcctcagggccataagagggtttatacctgattgcagagctttcagggaagagtcacagaaaaacaaaagctctctgtagatgacagagactcaaaaggctgtggttattttattattggcaatttgcaaatgtgaaagatctaatgagagtttatgtcaagaataatccagttgacaaggaaatgtagttgtttctgtggcatgcaaaacgagataataaagacaatcaaaaatgtttttgataaaatgtcttttagaataatgattaaggctattttcaaagaacagagggaatgctatatacgatttatacaaatagtgaacataattttcacagcagaaaaaaatcttgatacatagcacgtaataatcctggggcataatatacctagcatactaagaatacagcaagaatgtcaagtagagagattacataagtctgcagtagattctagataactgccgttttataaaactccataggtaacattgatgtgcatccccagttgaaatctattggcctaaaaaatgctagatttaaattttaaaagtgaggttgtagccaagtaagcattttaataataactaaaattatgtatgataacactgtatggggcatcaacaaaatgtttctgtaaaaggccaattagtaaatattttaggcttgtgaggtataacatctccatcacagctactgaactttgctattgtagtgcaaatgcagccatagataatatgtaaatctatgggcttctccgtgttccaataacactttataaaaacaggtaatcggccttattatttggctgatgggccatgttgaccgatgtctgaggtatactgttgttgcctgtatcatcagacaaagcataaccaagactctgacaaatagaaacacgttatgtgcagtgaagacagtgacagatctcttggaacttcccctaaggaatataatttctgaatatttacattaattaatattcttcaatgcaaattttatctagggaagcctgagcaactcttctaatttgacttttcccataaaactcatagtagtaacagagcaaatgaaccagatgacttctagctcctctttttttttataagactaaagaacaaatccttgtgattttccaggaaccctctatgaaacttcaaagatagttttaggtgtaacagatgtcctgaaagccttatggttttttatacattaaaaatctgattaggtgaaaggaaaattttttaaaaaatcagaggtgggtgatttggactgttaagatatgacaataaaacacacaaataagcatagaaagtcatacaattgtggaacaccttatctgttttataagtgaggaaactttgcttgttttctttttctttttggggggacaaggtctctctttgtcacccaggctggagtgtgcagtggcgcaatctcggctcactgcaacctctgcctcctgggttaaagcgattctcctgcctcagcctcctgagtagctgggatcacaggcgtgcacaaccacacctagctaatttttgtatttttagtagagacagggttttgccatgttggtcaggctggtctcgaactcctgacctcaggtgattcaccagccttgacctcccaaagtgctgcaattacaggtgtgagcctcctgcacccggcattgttttcttaataatcaaggacataatgatgtcaatgtaaagcattgaagtcactctggtgaaaagaaaatctttattatctagacagattacacacaacaaaaatggtaacactttatattgcagatgaagatattagtcagtaaacaaagaaaataagctcatcaaaattgagaaagctttgctagtatcttaacaggttttatagatttccagattcaggcattataaaaaccaaggcagatgagttttactttccaagttgtgtctgtggttctgctctttcatatgtggaacaaaatgacacttgattttcggacaggtctcagggctgtttctgaggccagaaataacttcatcctattaccgagatgttattaatatgcaatgcttttatctttgctatcttccttggcatcattaaataagcattgtagtggttctgtttcagtttcaataagcattgtagtggttctgtttcagtttccaacagtgagtactgacatttacaacctagaagtaaaacctctttggagtcttcaataagttttcatagtacaagagagtaaggtatgtgaaaagtaaaaagtagttaaagagtataaagaaaaccaaaacaaaacaaaagcaaaaaatactgattactgttgtcttaggacaaaactactcttggccttggaaaaaacatggaaatatatatagtttcatttttttctgaaactagtgcccctaagtctaggctcaaccacttacataaattttatcttgtaaccaaagtaaatagccactgttgcacagagaaaattggctggggagcggggggcgaatgattgaggacagcttgtcgtctaccatcatttcagcagactcacagagctcgtaagcacactttcctttttttttttttttttttttaggtttgggggtatatgtgaaacttttgtacatacataaacaagtgttacagggctttgctgtgtgtgttatttcatcacccaagtattaagcccagtaaccaatagttacctttcctgctcctctccttcctctcaccctcccccaagtaggccccagtgtcttttgttcccttttttgtgttcataagttcttattatttagcttccacttataagtgagaacacaccatattctgttttctgtttcagcatcagtttgctaaggataacagcctccagctccatctatgttcctgcaaaagacatgactcatgcttttttatggctgtacagtattccatggtgtgtatgtaccacattttctttatccactctgtcactgatgggcattcaggttgactccatgtctttgctattgtgaatagtgctgcaatgaatattcacgtacatgtgtctttatggtaaaatgatttatattcctccatgtataaacccagtaatgagattgctgggtcaagtagtaattccacttttagctttttgaggaatcgctttccactaaggttgagctaatttacactcccaccaacagtatataagcattcctttattcctgcaaccttgccagcatctgttattttttgacttttttaataatagccattctgactgctgtgagatggtatctcattgtggttttgatttgcatttctctaatgatcagtgatattgagctttttttcatatgcttgttggttgtatttaggtcttcttttgagaagtgtctgttcatgtcctttgtccactttataatagggttttttcttgtaaatttaagttccttgtaggagctggatattagacttttgtcacattcatggtttgcaaatattttcttccattttgtaggttttctctttactctgttgatagtttcttttgctgtgtagaagcttttcagtttaattaggtcccaattgtcagtttttgcttttgtcgtgattgctttcggagtctttgtcattaaatctttgccagttcctatgtccgggatagtaatgcctaggttgtcttccagggtttttatagtttggagttttacatttaagtcattaatctatcttgagttgatttttctgtatgatgtaagaaaggggtccagcttcaattttctgcacgtggctagccagttattccagcaccatttattaaataggaagtctttttcccattccttgtttttgtcagctttgtcaaagattagatggtcatacatgtgcagccttatttctgggctctctattctgtttcattggtctatgtgcctgtttttgtaccagtatcatgctgttttagttactgtagcattttatacacttaactttctactgctgcatgcatccctcatacaactcctcaaagtggcaagaaagaacatttacagggaccaaagatagagcctctaaatgaggaacaaaagcacttaagtcagtaattcactgttcttagaaatgatgtagacatccaacactacagagaagcagggaagtcacattttagatcatgaggaaagtggggtccataaatgaaattcaatgctgggagaaataacagcacattagtatatagatagggatatccagtagagagggacaaatgttgctgcagggtgggcttggagattgctggaacgatattcttgaacagggcagagtagaggagctctagaccacaagtgaaacttgcagagctcgtggaacagaagatgagcctttcctccacattagcaggaggaaaaaacagagcaggcacaggtatgggtaggtgggtgaatgtggggttagaagctggtggagaaacttctgttctatgagatataaatggagtaaatgaaggccagggaaggagatgttgagcttttgaggagaggggacagtggatgatggatgaaatcatcacctagagaataaaagcatgcagggctagaaatatagtatgatcatggagtgacatcagaagcccacttggagtgagtggtaaatttaaagtaaaaccagccaacattagaaacctactttgacaaccactcctttaaagaaggaaaaataaaacaagtgacaccagacagaattaagtgacaccagacagaattaagttctggatatagccatcccattcatagctgggtacttctgacaaatagattcccaaggttttgctgctggttcttggttgacgtggttttacttaaacagacttgagtgccttcctatgctggatgtttacattttaactttcttattttccattttggaaagaggggtggtcattcaacaagtacttttgagcatctgtcttattgaaggtagggcgcttggaagaattcttggttaactgccttggactaaaaggcacttaaactttaagtctacagcagcataggactttaatccttagcggtccagttatctcttggaatcaattctttaaaaatgtgcaaagccactcatgaattgtctgctgagtaaagaattagccataatagagatgctttttaaagtaattggaccccccaacactaattgatgtgacagctcattaccaggcattgccagcagccctgctgtcattggttccagactagttaaacaaagtaattaattactctttcgatgaaacaaccagatagataggattttttaattgctgtggtgtcataaggtatttttcatttatgttttcatttctattaaaatacgtagctatggccctgaaatcactacttagaatttaacaattttggagggaatttttagttttccatggataattcacctaacaaaaagaagtacaccaggaaaaacatcagctattgcaaaggtggcaaaatggattaggtatgaggtatatccaaaggaagcatcttgggattttgtttcttattttcatgatccagggcattatatccaaattttaggcttccacggcctcccgatagtacccaaggccacatgttcttagaggtgaaagatgtttgtttttagttttggttttcccgtagtcatcacactatgcactggagtgaaaaactacaaccaacaggatgtggttagcgaaaacattactttggccatcctgggctgaccaactgaaaaacaagaacaaataacaacaaaacgatagttaatgtataatattttttttggttccctaggcatagctgagccagtagtattctgtctgtccttaaatatttaggtagcatttataggctgtgatgcgagagaatatattgaatagccttgtgtcttacctcatggatcacatccaatttaattctaatgtatatgagtatttcagaccttctgcacattagttaagtttgctgagcctcatattcctcacctgttaaatggagatgctaatagtacttatcttcttggattattgcgaaagatttaaggaatctgtcccctaaataccttggaacagtgcctggccaatagtgagtgctaataattattatatgaaaccgttgccgtagtgtatcaaggggcctataatttggtagagaaataaactatgtgcagtgagaaacaaggaatttagggaagaaacatggggatgcagaagactccttatgaaacaagaaatggctttgtatcaagtgcttcctccaagatacctgtcatccctccgttctccctgtctccactgctgccacctatcatcatcatgcctaacaatcagccaagaaggtatagaagacagaggccagagagaaacagggacagctgtcatagacctactggagctgaaatggacctttgtgatgttgaggtcaagcttcccaagaactggataaggaaactggagcccaactagaatagctctgttcttgctcataaaagttgcccgatggattgaatgcattagcatcaactgggagcattgtagaaatgcagactttcaggccccacccagacctaccagatcagaatctgcatattagcaagatcccaggtgacctacatatgcccattaaaggtagaaatggacagctccatcttgcaaagagaaatctggagacgtggaacattgaagttaattcatagtatgagaatacaaaaatcatacatgtttttaagaatctatgaacaaatctgtaaaaattcacaattctcatgaagaatataataggaaaagctatggacttaaaaccaatagtccagaattttgattctgacttttgttaccttgaggtcctttaacctctcagatttctcctgtatctctatggttttactagatgccttctcacacccttctgaaagtcttggttagtaattctgttgtcatggtattaataatatagcatggtagaatggctagaaagtagcccagcagttaggagcatggatgccagagccagattccaaaggcatcaataccagctcatcacttttgggttacgtgcccttagtcacttttctttaacctccctgtctcatctataagataggtgtggcaacaatagtaactacttcctggagtttatgttcagaattaaattgagatgtcataaagtgcttaaaaccactggacaacatgtatttcctatgccaggccctgggctaagatgtggagaagtcaaagatgagtccctgcctttgaggaggaaactctgagctgaacctcctaggaatgagtggaatcagggtaggtctggatttacagtgcccagccatgtttaggcggatcaggaaaatactaagctctaacttacagaggacatgggatatattttacttggagaagataaggaagctaaagagacctaatagctgtgttcaaacactgggctggcatgaagttgaggttcagacttctccgcgtggcatcagagggaagaattagcatgaaggttaaaaggaattttggaaggataactagtaaagatttgggaaatggccatccatatttgttaatatctgggaagaattagattttagaggagaaaaagtgatttgggcaccaaggaaagaattcttggaaacagcttcagtaaaactgcatgaatttgaattagtttgtaaagaggaccaattagattcagtgaaagatccattgcttatctttaaagaagcaggatttcatttctttcaactctgcagagtaacttgaaccaattacttttgcagagtaaactaatgagctgctttaatgagcagataatatgaacatataattatcagcaacatgaatatatagtgtttccaagtctttttttttttaacatatttatgttatgtaaagacagtaaaaactatctcccaacatatttacccttcgagttttcctgggaaacacttttcatgagttaagttaaattctacttgtctcacttagtctcaatggacatgaatttggggtcagtggctaccagattaataaggttttacttagatagtaaacatataaatagtgaaagtgtttggtttattttatcaataagagatttccctccatagctgttctcaaactgctagataggatttagtctatgcattcaaaattccagccctaacgtacatatgtcatgcatatttcaacaagattcaattatagctgacaaaacatttgtaaaggcggctagattctagcccagatggtggctgggcttttgatgaacactctaaatatgtggcattattcatccctgacgctcagaaaaataaacataaggtaccacttctcccagggcagggaagtggagaagaaaatgctcacatcttcccaacgtacagagttgttttcccctagaagtttcagaatgctgacattttgctttaacaacaagggaagatatctctgagcattctcctgaacacatatgaccccttcctgtggaagttagataatctgggccttaatttcctctctaaggccccttccagatgatcatcttatgatagccttttctgaactatttccaaagatactaagtctcaatttctgacatcaagacctcacattttaatattttgacagatatacatactgtatcttgtaagttgtggtatagggaaactctgcgaaaacatttttagtagaagttttgataccactgttgtttaacttgggtcaaatgttaatttaaaaattagttgttgaatgaaagtgcctgaacctaaaggcagtcattggattttttaaaaataaaaatgtcagctgggtgcagtggctcgcacttgtaatcctagtactttgggaggccaaggcgagctgatcatctgaggtaaggagttggagactagcctggccaacatggtgaaactccgtctctactaagaactacaaaaattagccgggcatggtggtgcgtacctgtaatcgcagctactcaggaggccgaggctggagaattgcttgaacccgtgaggcagaggttgcagtgagctgagttcatgccactgcactgcagctttggtgacagagtgagactctgtctctaaataaataaataaataaattgtaatatcctgataaacagcacccaggtaaataatcagaacatcactaacatcccagaggtgcccttttcccccacttccagtcaccatccctctgtagtttggagaagaatgcacgtgcaaggaacaacccagaatcttcaatcttggcccattcctcaaatggatttacaggaaatggccaagttcaagaagaatatctttctagcattttcctttcaactgtgttcttctacttaaaacatatagttgggtttgattttataatctagtcagtaaacttaatattttactttggttttgagtttgttattcttgatcaatccaatagaatgcaagaaggaaacagtcagcaaatatataatttgttcatttttctcttccacattaacctgttagacaatttttttagttactctgacaattacaatatacaggcattcttgagttaaattctaataaaaattattactttcatcaattttctgataatgctagtattttgaaagagtaatttagtcaacccccttccttatttttatgtcattgtgccatatgctttaaaccccaaagtcagtattattgcaaaatagattcatttgtattaacccacctatttattctttctgactctccacatttcctcttgaatctctgaactgtgatctgacttcagtttttattctatctgtgtcataccctttgggcagtgtttgtaaatttagttacattttaaaggtggcatcttgcggtctttgactacattgtttttactgagaattcagtttcttttttatttgaaagtaatatgcctttttttctttacctattttcaatgtttcatcttcttttgtatgcatacatgagtatatatgtacatatgcatgatatgtgtgtatatgtgtgtattcttcctcccttagagtttgtaacactttttaaatctgtgtgtcactgtctttcatcatctcttatgagttttggaaattctcagccattatctatttaaatattacttctccattcccactttcagtttctactgggactcgaagtttaggtaaattaaaatggcttacttatttttcccttacagttccatacatttctggttttggtcattttctcttgaagtctgtttactctgccattaaaacctctacactaaattctaaatttgttgccgtttctttttaatcacatcaccttgaataccttataaaataggttatatggataatttgaatatggataatttgaggtagtggataatatttttcctatggaaaactgacttctgcttctgagtaaggctggtttttatgagggtgggtatatttctatgtagtcttcctaggttatggccctttgaggtttcaaaccaaagcctgaattttataaggttttccagaataagcagatggctcttagggaaaaataaaatagaaaggggaggaggagggactactcaaaataccaggcttgcctctctctgatttttcttttggcttggtaccttttccctgtaattcttttctgtcttgttaactcctcaatgccttgaagaaggttttatgtgtgtatgagtgtatatgtatatatagtatatattacatataagcatataacgtatttatatatacttgaatacttataagtgtattacatatataaacacacacacatatatagtagataagtagatacatagtgatatatttttaattttattcaggtttctagttgtactcagtagaaaggttgatctgaagtaggtagcaggctactaggagaagtgtcctgaattaccatgttcaataatgctctatttagaaattattttatttgaaggtcaaatgaaaaaacaagtttcctttccaagtagacaaaacaatgtctcatgctaatagactttactgccggcatcatttcgcacatatttttgaagcttcttaaatgaaaactacacaattctttaaacactaaatgcacccttctgccccccgacaaagaagttttctttaccgttagaataatttcaagtgcataaatctatgcttcgtgtgcttcctacacctaacttagacttatccttcatgaaatgttaaatctcaggacgctaatctggaatgcatgttgtgtctggtccaactaatatttagatggtttcactcactgctcaaaactttccctaggtccatcaggatccagctaatttcctcattgtctatgcagctatctttcatgactccagacacactgagctttcctgctacaaccctcaagtgtttgttcattcactagtgaatcatgcagttgttttctgtatgtatgttttgcttttttaaaacaatcaaatatgtatagctgatcttttctttggatttataataaacttcttaaaaagtaggtaagatatataaaaagtcctcaatcttttgatcacaatggaaaatcctaaaattacaaactaatgaaaagaaactccacctcagataatagatttacttcagttttactgtgataaatgacttcaggatgaaaaacctgaaaatttttaattaagtgaaagttgtgctttctggatggaaagattactagctctaaattaatacgtagattcaatgtaattctgataagaattgtaatggaattaaactaagtctaaagttaaccgggaagaagaaaataataaagacaagtttgaaaaaacagtgttagtgacttactgtattgcatggcaagatatatcaaagctagcataattagaatgctagtgatgttggtgtaaggatggataaatggctttacccatttatgctggaggttgcaattctttgtgtgtgtgtgaaaaatcagaccttggcaatgaccttgagcagtaggatataaataactgccacaagcttaacgttccaataatgaaacactaggcataaataggttaacgggacagaatatatggtatagaaacagactcatgcatatgagaaagtttggtttataataaaagtgtcttagcaaatcatgaggataagatgtttttcttattttcacgcataatgttgggtgtgctagatatccattatggaagagagaaaaatttcaacccatacttcatgtcttgcagaaaagggaaactacagctagataaaacagctaaaagtaaagagaaaaatcccataaatataacacaaatttggaaaagcattggaatcagaagaactttctaagtaaaacaataacccagaagccataaagcaaaagatcgacagaatcaacaaaaatattgttagcaaacaaagaaacaagaaaatacaaagaattcctgcaaggaaaggaagcaaaatgcagtacggaaggtaaataaatgaaacagaaaactctgagacagagtgaacagaattgatatagccttatgaataaaacaacagcgcaagtatcaagacatttaatatcttaccagagataggaaagagtttggaggggacttggggaagtctctccaacaaactattccaaatgtcgacctttattaaagaataaggtttgtttttaagtcaatcaaaacaatttcaacccatcaatcaataaatagctcaggacaatgtggaggaaggggctgcaaatgttgcaattaaaagtgccagtcctggattcttgtgcctggatgcaaatttagactctgggcaaatctcttaaaccctcttgtgccttagagttttcatacacagttggaggagcagtggttagaaatacctatagcacagaattattgaagataagagctaacaaggcttagctcagaggcaggcaaacaagtgcgtaataactgttggctgatataattattactttcattttttatttcattttacttagagccaagagccaaaactcctcctgcataaagaagctgggggttttagtaaaccacttcatcattctgggcttcagtttcttcatttgtaacatggagaaataatgttaggtagggttagtgtgatcattaaattagttaatatttagtaagttcttttacctttggaatttgcatggtattcagtaagtgccattacatgtttgttaaaagaaaaatattgtgtctagttagccaaaaatatttcaagcaatcaaaaatatgagcttaaatgccaaaatgaacatttagtaaatgtgaccactctcaaagtgcttaaagaaaaggaataggacaacttgggtttttttaattattgttattatttgtgtttaatggtagtttattttctgttgccatttgtgactttaaggaacccaatcatcacaaattgagtgagagtggactctattaaactgagtctggatgaatgtccttttgcaaagtctcttttcactgtaacctaaaattccccttatgacgagccaacacaaaggcacatctctttcccagaagctgtcaagcaattgctcaatctgctcactcctttaggagaacacaccttgaagggtgacaattacagtgggctggaggtgctgacaactgcttcctgatgataatacagaaggtccagtgctgttgaccttaggcattgacctgcatgtagaaactgccaactgctagactgttagaagaatgtaaatatttaatgagtgatgctttgtaaaagtgcctatcaccagaggttcggagatcaaaaaaagaatttattttcagaaaatagttctatctttctgtggagggtgtataggtggcttttcctttgaccatcatgctagagaggacaaggatagacacagatgggacaggaaaggaagggagcctgagatgttcaggaaattagatgcactagacttattttagtcggcccattttgcaaatatgtgtcacgaaatgctgtagtccttaatgaaggtaattaaatgtaatttgaagacaagtttctcctctctagtggtgacacagctcctgccaacaatttaggttatcaacataaggtgaagactaaattggccctaactgatgaaatggaagaattgggatgttactcaaatgccaggtgtcaataaatgtttaaattggacagcacagtggctgcaagtcagactgtgtacacttacaagttaaggagaaatgggcggatttcagaaaaaggtcagccttggcatagaaggatctgcctcatctcgggggattaagcaaaggcccaaaccaagacattccgggcctatatactaaactgtagaatgttaacagttgatttttcgaacaaaatgcaaactttagaggtgacttcaaaagctgtagaggggacggtcctgcaaggatagttgttaactgccctgttttcctcatgtcttctgaggaagatcagtgaacgtggaagtatccagagatctattttgaaggaagcaaatctacttatggctagattcagtgtggggtgcttactgaaggctgacttaaagaaaccaatggaatgcatatctgataaagaagttgggacaaggaaggcttattgaagctttgtgttttgtcaacagtcccacaaccttttgtgccttctattctaagttcaccttcctcagtagtcatgggatctggccttaattcggcatgatgactgagagagctcttggcaaaatacttctgcagtccaatgacgtttttcttaaaattctgcctttgccttattttagaaatgacagcctgtgaactgaatatagaccaaaaatcctgaccactccttagactttctttaccaagtctaactgtccatgtgcttacttgcctggcctctggggaacgctgagtattcaccaatcgtatgaataattagaagataagaaagatggttagaaagatggttaagactcattagcagtgtttcaggactgaaagaaacattatctgaacaaaaattttgcttccattgccagatttagcaaataaaactataaaaaatgttttagtgtaaaatatgcactatttggggcacacttatactaaaaattcatccattgtttatctggaatttaatttaatggattgtccactattttatctggcaaataaaataagaattttatctatttgctcaactaaatacaatttatgttggggacagagagttatgttttaggattttagaaagattaaatattaagtgaatgtcttggtgaattatgacttatagccatagctatattactttcagaaagaaagctacactgaggagagtgaaatgagaagaacagcagtcctcattttatatttgaagcagtcttaatttatagttacaccataccaggcagtgcggcacttgggcacagaaccaatattatatatgtggaatagataaatacatatgtgtgggtttatttccaaaatgacttttatatgctggtggagatgtggcatgtgttacttttctcttcatttttatgtctggttatagagtacagaaattgctttaaaatgacccaaattataaactaccattagcaactcttgtttgggagcaccaagctccatcttcttgcctgttacgctagagcagccttgtccagaatttcaatagtgtacctcttttttccagtgatggagcagaccctggtgatggtaaaaaccacaattacttttgcaccaacctaactaatattcttgccacaggagagtggggagaaaagcctgccatagaggagggggtgaataattaatttccagggtgtcgtagtcttagcccaacacagattttcatctcctcctttttatactgtagaaacgggatgcatttcccaccccacatgaattcatacctatttttatagactgtaatgtctccctgattgaacataactaccagggatatgggaatgattggaacttggcaaacatcagtgaaatggcagaatccttataatgacatttgtttgaaatgaggagctacacattacattccaaagtgaccaaatctcaatttagcaataaccgtaaatgtatgctgtggagagtcgagaatttcatgggctcagaagtaagccatgcttgttttaggaattatgatgaagccagtggtttccatggctaccatttgcactaattgtgatatattagtagcaacaagaattggatgtctcaagtcatttagttaattaaacacaaacgtggaccctgccaaaagaattatggatgaaattagcatctaccggaatgcacctgtaaaatgtgacttgcattagtcctgtcagctgggggaggggacgcacgatggagttgaaatgcttgtgtattctaaacatgtctttcttacccatatccagttacagaaccactttataatttatttttaagatgcatcctcaaatgaaatacaacagcagtgatcaaagggacatgtttttttgttgctgctatgaccagtaaaatatatgaaatttcacatggagggaggtggtagctcacagcaattacagaaaacgatgaaacaacagatttgccactaacacactgagatcctgaaaataggagtttataatggaaaaagctgacacaggcataactgtggcagccagctatgttttgacatcattgaaagcctggtgagctttacatcaagagtagcaagaatatgatagattggattgagatacatgaagatgggattgttaaattctacttgtgaatctgggcaaatgctagaacaacaactctatcctcatcagactttctaagtgtacgtctacatccattatctctcagcattcgcagtcctgggaaaaaagttgtcacgggctcaatttttcagatggcggagctgagacttggaaaggcaaaatgatttacccaaatcgccattccagggctattcctgtcccaaaagctgcagaccagagtttgtaaagagccaggggttgatagtagatgtgtcagtttgttcagtcattcaacaaacttttgcattaagcacccactctttggtaggcacatgggataaaaaggcaagcaaaactccactcctgagccttcccttcatattgtctctatgttgtgatgccttttctttcaaaatgcaacagactgccttggctgtgaacaaatctgctttcagtgttcaaacattttacagatatcagttagatgcattatcatgtgggaaggctacaatgatgagtgaaatagacatggccctcatttcaagaagctgtggtcagatgggggagacagctgttctttatataatcccacaaatagaaaattgcaactgtgttaagtgccataaaggagaggcgagaggcatgtgacactgtggcatagagaatacggtggaattgacatattttcaagcagggatggagctgaaatcccaaagaaggcttagctagggttcagtaagggaggcagaacctgtaggtggttgcaggaactggttaaacagtatgtgtaaggctgcctcggtgtctcacactggaacttgaagcccacaagtcagccagtgaagtttagaagagggatgtaaagtgaaagagagcatggacaaaccagagtccatgagggcagactgaaacccgtgtccgtgttatttcctctgaccctgatggtatgtcatggtgctaaccacacaccctgctgcctataagtcaaagaagctgaaggaggttccaggggaaagtggggggttgcaggcccagaagataaggtaactatgggcgtcaactaagaaacggtgaatgcttcactcctgctctccaaatgccatgtggcagtctttcttgtgatctaccttaactggaaacatccaggaaagggaaatctgggaaatataattcagcctagctaagttgacatgttataaaggcacacacgagaagtagaggtgatgacttgttcaagactctgtcctgaaggatgatgtgcatccatggaaggaatgaaggagaccagtctgcagaattaaagagggatggagactgaaggatgatgtgcagccatggagggaatgaaggagaacagtgtgcagaattgaagagggacagagactgctggtcctcataagtagtttcttctaccaatccaatgtctcttcattgaagattttggagaatgaactctgcttcatgtatcttaaattttttaactacaaacaaaatactgcaatttattcagttgctgtcttagaatccctctagcaaaattttcataaagctaggccaaagtgaaattgaatcagcactcatgtaagctgaatggcaccaaattcacatttactgaatgcacacaaagaagcaatgaagtttgacactgagaccagtgagtctgtctgatgagctcaacctgcccacttggctgactgcagatcaggccaaccatctgtcttgaagcatctcctacaaccaggacatccatgggaggggacaccaagcatgacatgggagttcagccttcaaggtgttagttatcaacttgccagcataatcagatgtgcactagtgaaactattacacacagtacagtatctatgataaaataacatacataatccacaagtcccaacagaactgagggtcctacaagatggacaggagtttattctacagagaaaagaaggggaaacctcatgacctagaagggcaatgtacaaaatttcctaggtgggtatgtgcagctccagtcaagaacctggctagcattccggagagtagagcctgttgacttttcaaagtgtcatatggtacaatggatgaacatctgtggcctagtttatcagactgagcttagaattggcacaagtcactaaaacgcattgaacttaggtcctctataatatacaggaactaatttctatctgataaggttgttttgagaattagatataaaaattaaccaaagtcaatagtgttagaggttacattcaaaatatgatgtagaaggtaagctgatgacttatgaataaaaataaaccaggctggaggatcagaatggggtggttacagtttcatacatggagttgggaaggcctctccaaaaagatgctatcttagcatgagggatgccatgtggacatcaggggttaaggatttgaagtaggattctacagagaaaaccataatagcacctctaacatactgagaaactccaaaactacaggtcacttacatttgactttgcgttaactacgtaattatacatacatataaataatcaagtacctgataatacaggaatttccaatacttttacaaaacccatatattgcttccaggatgcacaacccttcccagacactacaaaattgtaatgtaatggcacatgctagaacagattatgaattctacaaatttagttatcataattttctgtcataactctgataaaatctaccatctccgagttgttatgaaaatttaataatatatgggaagtgcctaaatcagggtatgaagcatgttaggggttcaataaacattagtttatcttagaaattttactgtaggtgagcttagtgttaatctcctggcttctggctgttcctctgtgtcttttcaaaggttagacgttacctggttggaaacatgagaaggatttgagcaggaaaggaaagcaaagctttagaaagagctgtttacacatatcaagccttcctggaggaggcggcatttgagagtcatctccaagaataaatgagagttgggagaggggcactgttggcagtgaaaggataacaagtaatagcaatgctaatatgcttccagaacttggcccaggtctcagcagccgcgttggtatttgaacccaagacttctcacctccaggaaaatgcagaggcaatattcacactatgcaatgactgcttagctgtgtatcacaattggccccttagatcgctggtaatggaatcaaggagagaaactctttagaacactctggtagctgtcatattgtactgaggccagcaatgcggtggtgcatttggaatgttgaggccaatgcatgcaaagggcctttcaaagcagtaacaaacaagattcgcttgaggaagcagcaatgggaataatttaaagttcacagtctagagggcaagaaaaaagggtgaaatgctaacaaaaagcaagcaactcgtacaggggatatatttttttaatgaaaaaattttacaagcccttctacactatttgcttattgcatagatggggaaattgagtctcagaagtggtttgctaagaattgcccaactcatgagtcaaaaaacagggacattggctgggcttggtggccccatctgtaatcctagctacgtgggaggctgaggcaggaggatcctttgagcccaggaattggaagctgcagtaagctgtgatggtgctattgcattccagcctggatgacagagcaagacctgcctctaagataagtaaattttgaaaagaatcagggacagaagaatattccctgtctgcttctgccctgacttctgcacagcctggctttataggtgcaggttgcagtgacgatgagatatccaagtagaaatgtaacatgtgcagttcaaaggtaggacttctaaagagaggcaatggctggagaagggcatttgtatcaaggcattttgctgaagatatcagcaaagggagaaattacagaaaagggtgagaaaggactcagagttaaaagagaacaaccattgaggcaagaaaggagtaaacattcaagttacagattgtccttatagctgagaaaggagctgtttcaaaaacatgggaggcatgttcttaggcatcagagagccatttttctgggagagggggagctgttttagcacattagtatgtccggaggccagactgcaaaaggtaaagacagaatatcaggaactggttcctgcaggcagcacttcctactctgagggtcatccagcctgagccctcgtccctcccctcccagaacctcactttgacaacgtggctcactaattgctactgggtagaagctagccattctagaaatagcagttctatggagtaagtagatacattaaactttctaacatgaaacgtccagaaggcaactagagttactcagtcacaggctggacgattctctgtaggctctgaaatcgccatgtgggcatcctctctaaagactgtattcatttgctagggctactgtggcaaaataccacaaaaccgggtggcataaacaacagaaatgtattttctcacagttctggaggctggaagtctgaaattcaggtgtcagcagggttggctccttctgagagctgtgaaaaagagcatgtgccatgcctctgccaagctgcagacagcaatgcttggtgtttcttatgaaaagcatgactctaacatctgccatcgcatagtggtgatccttctgtatgtgtccaaagttttcctttgtgtaaggatactagccatagtggattagagacccaccctaatcatctcattttaaccaattacatattcaatggccctatttataaataaggtcacattctgtagcacaaggggttaggactttaaaatatgaatttggggcaacacaattcaacccataaaaaagatcaaatattttgtcatgtcaagaccgaacattattaatgtttgcaatagcccaggtccaaaagcctacatgagcacctctttttttttttttttcattttctagaaacatttacataatgactatattgccttcttttggccaccttaaaagggctgatggttgggtagaaaagaaatatcactgaagccttaattcagccataataaggctgttgagctttgggtcacagcttccacatctatacattggaaattcttccttccaactcaaaagtattgtggtgcaaaccaaataaaatgcaaacagagattggaagagctataaagcaatgtgttttttaaatcactttgagtttacaaatacaaaagcaagaagaaactttgtgatttttatttctcctcttattgatcagcacatgtttgagatcatgctcatgccttaggtggcaaattaatctcaaaaatgttacctggagtacaaattagcactctatctttctgcagatgtagaacagagatcatgtcccctgtttcagaggttctcattagcttattaaagttagaaattttcagaaataatgactcttatatgaaatagtaacatttcatattcctagaaaatggtaaggaattttcctttgtaggtgcagaaaggtcagcatgacagacattcgcatggtattaaaaccacgaactctcaactagccagagttgaaagcttattgtagttcactggaaaacacttgaacttgaatctcaaagtatattttccttgttatattagtttgctagggctgccttcacaaagtattacgaactgggtggtggaaacaacagaaatttatttgctcacagttctggaagctggaagtctgagatctaggtgttagcagaattggtttcttctgaggttgctctccttggcttgcagatggctgcctccacctgtgtttttacgtggtctttctcctatgtgtatctgcgtccaaatttctttttataaggctaccagttatattagatgagggcccatcctagtgattttaactcaattaccttttaaaaatttcagtcaccaaatacaatggcattctggtgaggtactagtggttaggacttcaacctatgaattgtgtgagagacaagagagacaaatcagcctgggacactccatcccctgccacccgtgcaaactcatgcccctttcctcttcacagacaaaataatttaccatttactttgaacttcaaagcacagctctcaaaatctttaaaaaacttgaggcatttttttcttagaaataaagatatttagagtcttcttctcttccacttaaaatgggtagcacacactttaattatattattaatagtagctaattgatttgacacacttttcctgagggcctactgtgtgcccagcctggggagtgcagcactgtcctcaggtaaaatctttgttctaacagccttcattatatttcacagcttgcccaggtcacgacttcagaaagaactggaaccatttctcattcatctctgtatcctcagtgcctggaatttacttagcaatcattgcaaactagtctcctgccttctctcaattacatatttaaaactattttggatgtaattatttcaatgtattgagagaaagaacatgttgaactgtgagtcctggttctatattatattgccaacatcatcacttatctttgtttcttcattgtaaaataatatgatttgggccagaaatccctaaggttacttccaattcaataattatacgtctaactcaggtttgggagtccaaaaagccttcctagatgaggaggcatttgagagtcatctccgagaataggtgagagttgagagaggggcactgtttgcagtggaaggataagaagtgaaagcaatgctagtgagctcccagcacttggcccaggtctcagcagccatattggtatttgaacataagactgctcacctccaggaaaatgcagaggtaacactgaacaatgactgcttagctgcgtatcacaattggccctgtagatcactggccttaggtggtcctcattgtttttgttcactctctactgctatcctggttagagtaggcatgaggatacatattgcaaatctctacctactccatcctcaaactttgcaataatctagaaaaggcacaataattctaatagcctaacaggtaatattatttatgaaggctctgtaaaaaaaaggagataacttgactgctgcagcttaaaatgcatgggctttgggatagctgtattcatcatttaatattgggttttcctgatagattaaattgcccaaggaaatgatcatatacatgagattttactgtaatagatagtactatataaccaaagcaaagaggtaggtagagttgtatattagtcagctcagtctgacatagaaaatatcacagactggatggcttaaacagtaggcatttatttttcttgcacttttggaggctggaagctcaaaatgaggatgccagcagggttggtttctggtgaggactctcctcctggcttgcaaatagctgccttctcactatgtcctcacatgacctttccccagtgcagaaagagagagcactctggtatctcctccttttcttatgtggacaccagccatattggatcagggccctacccttttgaccccattgatccccttataggctctatgttcaaatatacgtgcattgggggttagggctgcctcatacaaatggtatggggacaacttcatccatagcaatttgatacaaagctttaagaactgccttacgctaagtatcacacggaccaggtagccagagcttgccgtctaaaacctaacacagtgtcttaaaagcaagcacaattctgaaaatgtaaccaagtttcttaattttgtttcaaagataagaaacttgttttacattccaagttttttttaaatctcccagcctagtacatttaaaaatagatttgaaacccaggaaattagcaccttcgatttattcccagaacagatagctaataagtagggaaaattaaaatttttcagccagcttgctttcatattttgtaacacatacctctttggctttggagtagtttaatatgaattaatcactaggctctcttcagagttggaaacgaggtggtatttaaagcaagttacattgttagtaaaatccgacatctaaaatttagcctgaggctctcagccatacataagtttgatactctgcatatattttttattaaaacttcagatgacaagaatgatttccaagctcaaggttaaataatttgggctggggatggtgatggtggtggggtactcatgaaagaaggcccccttaggagacagactacaggatagaagaagaatttctgcccattctattaagctaaggaatcttccctgagttgtctgattagatgcaaacaagcatgacgaaagaatcatcccagctgtcacagtattttcaacacctggcaacaatgttgtgcaaatggacaaatgactgtgattgtcaattcaggtgtcagtggtgacctgtatctctgttgagctcaacccctaagttgtcatccctgccagacgcacctcttccttgatcagaggaaagataacaaggggaaagggactgctactaccccaaaaggttttctctcacttgggcttctggaaatcacttggaatggggaagacaggtttggcttgtcctgaggacccattagaaggtgacatcatactgcctctgtttcccatgagagcatttaacgttatcagcaaaaccaagtcatctctttatcagaggaaagcatgacactgtctcaaaaaccgttaagcatgtgacacacttccctagatcatagacaaatggatttgggagaaaacagttgacccccaggaagtaggtacaaaatgagcattagtcagcattcagaggaatttggtggatgttacatagtttaaatttgtgtctggtaatcttcattgctgttaagtgttaagcccgatgaacccagtgaatacaggatgaattttttcaatgatgatgtgatctttttaaaagtgccaactgtaattatcactgtaacccttggatgttaacaaaagaaaattactgtgaagccatcacttcagtcctctctggatctgtgttctgattcctagcagactgcttgccaaacaccgtggccgcagggtcaaagaacatttgtcatttcagctgtggggaccagacagcaggagtacaatcacccttccagtgatactgctgctccagaccaccagtgggcagtcagccagctgggctctttgtactttctctttatgccttgcagtttcactttaggggaagcctgtttctgctgcaaatctttgtaaaagataaagattccaacagagggacacttggtgcctcgggtagaagtagcccggcagtagggagtattcaggagccgcacagaaggatgtttatttcaacagagaccaccacaggagaatggaagccatggtggactctgaggcccctagagatccttgagatgttaaggacgttacttactttatatatttttcctcctttatcccattcactcattcattcagtagattcttttctaggttctggaaccatgctgtttaaggaaccagtgaagagatacctgccttcatgaagctttaagtataatgggggaagtggtaaaataaacaaggctttttcaacttttgcactattgacattttgctccagataattcatgggagggaaggagaaccatcctgtgcattgtaggatatataacaacatcccaggtcttcacctactagatgctggtagcaacccccgtttcccgggtgtgtcaactaaaaatgcctccaggctttgccaaatgttccccagggtgagaatagggtcaaaattgccctgggttgacctaggccgtaatacagagaaactaacaaacagaatgtgtgtgtctgtgtgtgtatctgtaacttataacaagtatcactagggaaacaagaaaataggtgagagagagtcagagagtggaactaatatacgttaggtggttagaaataatctctttaagaggatgatatttaaaaggaggcctaagggaagacaactgaatataggcgtgttccagaacaaagaaagaacaatacacaggccctgaaggaggacagagtttgatccactcaggacagtaatgcaggcttgtgtaagtggaggtgctagaggcaggtgaagatcatatcatgcagggccttagaaactgtgatagggagtgtggattttatcagaagtatcttgggaaggcactggacaatttcaagcaagaaagatacatgacttgatttacatttcccccgtggtatagagactatattggcgagaatggaatggagtgggcatgagtagccattactattctcagtctcttgtgtgatggtgctttgcatgtttgcatatgtactaagaacccttaggggaacacaaaaagtaaaggaataaagaataatgttgaagagccccatcaatatggggaaattaatgtgcaggaaaatctaatcttaaataccattatttaaaaggaaatgctgatgatacaaaatcaaaatggcaaagtgataagagccatctgaatattgccttggggctgttttccaatctgtaaaatgaagatcaaaatagaatgtattacatgtggattaatgaagactgagataattgagtgaagccttattgtaatgatgggagcaaatccctaaaaaggtagttatgaatatagttattttaattgttttcatccataacaatagcataaacttcttacatgtaaatatcacatttcacttcctatatgtcttcctgagcactgtcatcctacaatctatttcccagctgcattttgcaatgaaaatttgcatttaattattttacacattaaaaaaagatttcagtgcatctttaaaaagtagtcataaagcaaagaatcccttcaatggaataattttacttaatataacgtatagtgttgatagccagttttaaagaaccataaaagaaaacatgattatatttttgatagaaacagaacctaaaggaaatgtgtccgaagcagtcattgatccacaaatgtggattgatgcttactctgaagaaggtacatatttggtgctgggatgtaatgggtataaaactctaaaaatggcctgggccagtgcgagagtagaggaggcataccttcttataatcatcacaggacaaaaacgtgaatttgtggccaggtgctgccaagcattactgaagacattttgctaataatggtagacactcttaaggcacttaccatgtgccaggaactagtcatgatactaactcattccatgctcataatgaggtaggtattattatcctcactttatagtgagaaactgaggaactagagaagtttagtaacttgtcccaaaacacatagctagcaagtgatggagccagagtttgaaatgaggaacttttttttccagagtctggaccttaaccattaacatacactgccgcaaaagaggaaaataggagcgagacgaacaaactgggactgtaagaagccgagtggggctggtgtgcatagcggggtgtgtgtggacaagcaggggtatttaggaggagggaggaattaaactggaattagggtagccctaaatactgaagcccttctatcctccactactcctgcagcttctaattccaagccaaaatggttccattttgtctgctatgaacaatagcctcttagaagataataacaaaaatttccaaagtgatcattgatgttccttccccgcaatgcattaccgttaatttctttgtatgtaatgtctgatttgtcaacaaatcagacccgttcaagctgatcttttaatttttttcttctttggttacttctcattttcattaacttaattacatcccaacagatagggatttttcttaaccttgaccttggggtgtacaaataacaacagacattgttcagcagtttcagaggaaatatcccaatttatcttgtgtgttatgctttccttttgttcacaagatgcttctattaatttagtattcaaaaagcattgcagttctcatttcatctggaataaaatctcatatgtggaaattctaacattgtgcttagcacatggtatttcgcccaaatgtccatttcctgcttcccttctttccatgctcagaattatgcttggatgacttggctgataaagtaattcaaaagtgagtttgaactcagaacagtgtaactaatattatcctagtaaagttagctaaagcaagtagtttgctaaaactcctcatctatttaccctgaccaactgcttgttgatcaactaaattgtcacatatcatctcattcttttctaactcaattaggagcctatttcttgaagaaacagcaacaaaaacattgacaagtgtttttcccattgcaaactgaaagcgtataccattaaacacattgtcaaatttccactaagggttgaatgatggaaatccaactttgcactttttttccaaaaaaaaaaaaaaaaaaaaaaagggctgggctccatggctcacgcctgtaaccccagcactttgggaggccgaggcgggtggatcacaagatcaaggagatcaggagatctagaccatcctagctaacagagtgaaacaccatctgtactaaaaatacataaaattagccgggcgtggcggtgtgcgcctgtagtccaagctactcgggaggctgaggcaggagaatggcgtgaacccgggaggcagagcttgcagtgagccgagatcgcgccactgcactccagcctgggcgacagagtgagactctgtctcaaaaaaaaaaaaagaaaaagaaaaagaaaaaagaaatccgcagatctttcaaggctatggtactttggccagattttgaatattttacccacaaaagccaacagaagatataaaggctttctcaaagatcatcaaataatgataccaaaaacctattcttacatatggacaggtagtattaaccacagggtacatggatcagcactgcccgatagaattttctgtaatgatggaaatgtcctctgaattgcctcatgtggcagccatagcctcatatgggtattgagcacttgaagtgagattggtggggctgaagaatgaggtacttaattttaatcaatttaaacttgaacagcaacatgcggctaatggccgccatctggaacagcacagctataaatagtttcctggaataaaagtaagaggaagaaatgaggaacttcgaactttaaggcaataactaccagagagtagatgggactttgaaaaatctcaaaaagtggatttggaagatgaacgtggattaaatctctcctatgactaaagaacacttaggctgaaggcaagtagaacttgagggatgttcaacaacgtgtccatttcattaagaactttgaagcatggagttgtcaaaccaacctaactccttaataaaatggcatctttaattaactgttcaagatgatgccactttgcttgtttaagatgaaattcaccatttgtccactgaaagcaatagtctgccctgttgcctttgcatgtagtctcttcagtagataattacttcagcccttgttgggagttgttccactgatctgaggcccgcagtcctctatcgaacacttctctgagccaaagccaaagtggctgcaaatcttttttataattttattttttagggacaaggtcttgctgtgttgcccaggctagagtgcagtggcacaatcatagttcactgcaacctcaaacctggggactcaagcgatcttcctgcctcaccttcctgagtatctgggactacagacatatgccaccacaaacagctaactttttagaatattttatacagatagggtctcactatgttgcccaggcttgtctcagactcccggcctcaagcgatcctcctgcctcagcctccaaaagaactgagattacaggtgtgcgccattgcagctggctgtttcaaatctttacaagctaatttactttgcttcaaaaaagcacatctaaattattaatcactttgaaaatatgttatattatcaaaactagccaattttagaacagaaatttctttaaaataggtttatggtgaattctacctagaggttgttcattttgatgcatgtttatcttttgcctaaactgtgtccactaggctaacttctactcattcttcaagatttaacttgagcctcaatttctttgtaatgtcttctcttaccccacttcccaggtctcaggctttccctgaatcattgtaagataatggagacgcagcaatgactgttcttgttatcctccccgaccggactaaatgaagacggggcctctgtcctatttattttcctgagcatctaatggtgcctggacacacactgtcattgtttgaaaaatgagtacatgttcactctaaagttacaagaacatcggttgagaataattccatgagaacatggtagaaaaattccaagggtcaggtaataaggagagttctattagtctacataaggaaagtgacttgggagatagaccatgcaggttcctataaatcttattcaagaatttttattttaaaaatgtaattgatcattggcattcaagacagaaatgttcagatgctttagagaatcctcggatcacaggcacttttgtagtatgaaattcttccccataaagcaagtgggtgtagatgcagagagaaccctagggttgtagtgttttgagtgctgggtaaaagctcagctcatgccctaactgatcatgcccaaagctctcagtgcccaagattcaatgttgcatggtggcaaaatgacaagccccatctcgtgttgcagacctgtcagggttactggcaaattatagaaacaccaggcattctgtttactaacatcagtggtttcataagatgcaattatttcctcaaaaagcataccgtgaaatggtcttccctctttattatggaaatagcctttaacttcgtggtcatggcatgagaatactccagatgatttgaggcattctaaatttttgccccattttttaaaagagtggttggtagaaatgcatggggagatgttgcaattaggaagaagaaaatttgaagacatgtcccctttattttttatttacttatttaattttagagacaaagtctcatactgacacccaggctacagtgcagtggcacaatcatagctcactataaccttaaattcctggggtcaaatgatcctcccttgttggcctcacaaagtgttgggactttagacatgagccaccatgctcactttaaacagcatccaaactcctgaaagatgtgtattagaaggtggcttgatcatatgtttccttacaaaagaatgaatcacgtcaagccagccattgagtcaaaggaacaaatgatgtttttgttgttgtcattcaggacggatcgcaatcctgagatgccaggcacaaccctctattaaaaaatccatcagacacgaagaattcctaaatttccagaagaaatcaatagaaaaataaaatttggtttacagaaattctctccaacatggctttgcaggagcctatcgcctgttaggtaaagaggaggcacacctgtttgaaacatgacatggagtcattttacacaaacacacctacctgcggacacgctcatggcagaccactggccgtagtgacaggttggtcaacctgaacaatggtgttgccctgtcactgagtcatgtgaacttgatgcaagaatgacagcaacagctagtgcaatattagcactgaaatgcaaagacacagactggcaggctgtgtttctgagcagcctctcccacaggagcctcttcggcattctttagtcacaggcggcagtcacagaatctgatctgacaattctgacatcgatctcagcagactcagtaagctgtgtttgcccacaacaggaacggcagtgtccaggtactgagtattcccttgagcaaagttctataatttctataatttctctctggcatatccaagagaattgagacaccagataagaatccaggagaaagaaaatcttcctgggttatgagttcaacaattatctacttcttcttcatttatttccacacttcctttaataggcccacagtgtttgaggggagggtaaggtcaagttccagaatcataaattaatctttgcaaagattaatctgtctttgaaatgtcctgggaatgcatccaatgatgaaagtagaagctccataatatataaggactgcatcattataaaacagaatacccactattcaattttactcagtaatttagtttgcaatgcattttgacatcaattaatttacttgatactcaaaataactctctaaggaagacatcagtatccccttttatgaaagaggaagctaaatcattgactgtaaaagattgctctagatccagtttgatgataataaaagtgggatgcccactaaggtctccacattcctactgtcagtcacacccactcaccctaatgcaacaaagccttcctgtaagatcacctcttttctttctaaatgaaaaatggatctagtgtttggatttgtccatattttttctgaaattggcatgctgttgccatgagtttgggctgttgccataatccaaatggaaggccatttcagggtatgctcttagaagaaacatttgcattgccctgaagcatttgaaagatggtcataatatcaacagggatcacagcacaaagaagacaatgtggaaacgaagacaccactactgtgtgctccctgcattagttgtatctaaaggctcagtcaaggattggaagtcaagagaaatcaaggggaagagagagctaatgatttggcagaatctcccaaatgcttttggtctgagcttctcagctttgccagctgttgaatatgtgtccaaaatgtgcttgtcttcccaggttttcctctaatttgggatgtccaacaccctctcatagacctgttattattttccatttcctaatttgcttgaccccctcttgacagccaaacttaaaaccttccacctctgtctccctcacctccaacatccagacaactcgaagacaatcctacatggtgtgtattaaatgtgtcacatctccccatttctccactatcattcaatatgtccagcaccaattttgcttctttagaaactccagcacctctctagagtttaatacatttctgtcactcccctctctctctgtgagttatctgtggacacagtgtggccagacccatcttgcccatgcgcagccgcaagcacacttctcccttacccaaaaacatttactggctcccatttacctgatgatctaagtgtaattccccaagctgcccttctatctctcccattaatatattgcaagtatttcctttcacaactgccctgaaagtgcaaggcttacagagttattgaccctgcagtgaacactctctagtttgttttctttcttcccatagatctcctctatattaagtgttattcactcttcaaggcccattttaatattatcaccttttttaagtctttacaactttccctaaaatttctccttcctttaaactcctactacctttttaaattagtgatgctacataagcagcatcactaatgaaaaatacatgtaatatatgtatgcagtatacatataattttatatatgtcataaagcagtgaaatgtacaagtcttaaatgtgtttgggatacattttgacaaatgtgtacacttatgtaactgtcgcccacaacaagatatagatttccatcactcagaaagttttttatgtccctttctagtcaggacccatcttcagataaccattattccgatttgatcatcatagattagttctgtttgtgcttgaacatcatatgaatgaaatcattcagtatatactcttttgtgtctgtataattatactcaatttattttttgagattcaatcatgtcatagtatatatacagccctgtattcctgaaatgctttgtttccacattttataagacatccttgcctaacaaatgacctcttttgggcaaggttccacactaatttatcttcctatccgccacaatgccctacacagggttttacatatagttgatgaccaacgcatgttgggcaaatgatcaatttcattcttagctcactagatgacttcagctagaaagatcacatggaagcaagatagcatgatctgtgtaaaactacatgccactgggacaggtgttctatagcaatgagggtttattaagcatgatgcgaagagaaagacagtgcaatatctatggcactttatattctgtgagaattaatagcaaaggctcagtgccttgtgtgatgaaattctgcattttgacatgcccacatgcctggaattggctaccatgctctgaattctgtggattttataagcacaaattttaaactaaaatgtcaaaaattctacttgttctccaataataatggaatgtgatccatgttgaaaatttaaaatctgaatgatgccagtcaagcatatagaaggaaaatatattccattttctctttgagtttgtgtgtaaagagaatctaaggaaagtctgagaaatactatttatagcaatagctatagcctagtactttactttaagcttgtaaagtcttagaactgagtggcaatctaatgggacttggaaaactataaaaattatgaaaatgatgtgaagctttctggagtgatatcatctgcatttttgggtaaaggacaaattgctttgtctcctaactgaagtcaagatgatataatgcaatgtcaagacctctgactttcaactaagccatgacaatgactaaccactagatatgtctgcctctgacagctattttttccattcacaaaccactcagtagaggtgtcataattatagagcaactgttaaagagtaaagttttagagccccagaagtttccattttatctctctggtgattactgttaagatggttgttgactcaatctaaactgaataaattaatcattaaccaatttagttagtgaaaggaaaaatttcctagtgattgtttgcaaatgaagcagtaaactcaatttcttcctacttcttccaaaaactctgactccagaaacctctagaactttttacttctggaatgttactttctgaccctctgccattgtagtaataagtcatctgaaatttaattttgagaccaattatctgctggaactaaaaggaaaagataaaataggaattacagacagaaagaagaactgacaatatattattcaaatgtgtcctgggtttaatccaaatccatattatatgacaaactaagaaacaggtgaagaataaaaccatggaatatttagaagcacttgtggctgaatattatctaatcttgctatagagaaggactttctagggcagtggtttttaaccctggtggcacaataccatcactttgggaacatgtgaaaatctttatacccatgtaggacaccaaattaatcaaattgggatgtccaggggaggggagaatggggagaatccaagcatcaatggttttcaaagctcccagatgattctaatgtacagccaaggctaataattattgatcttaaaagaagagataataaggaaaataatacgcaatgatgtgactacataacaacatgaaattctgataaacattacaaacaaaacaaaaacagggacaatactgcaaatacatataaaagacaaggacttaatgtctaatacataagaaatccttgtaaattcttaagatcacattttctacattgtcgttttgttttgttttggtattttctatgagctcacactctcctaccatgtttactttgaaatcaagatggggaaaaccgtcattaaaaaaaaaatcaacatattccagaccattcagtgagtaaatacatcgtaccacctgtttcctactgcatagcttttctgcatctaatagtccttctaaaataaggctatataccaaaacaaccacatctagtgaactgttaacaaggaacttaaccaagggcttgcttttctgactttagtgtacatagaaattacctgagagtcttcgtaaatgtacatttttgcctaggaatatacattcctagcaaacttcccggagctaccaacataccttgtcctgggactacattttgagtaccaaatacttagtcaaatttcaaaactttagagaggggtagagtttgtatttgccttttattttcctaagaatctcaaaaaaaaagtggtagagggagaggtaagacataatttagacatgcatatcgtgcactctcatagacgaaatatttcaactattctcaatctcatacaaacaaatgaaatattgatggttaaaacctggtgttttgagtgggttcctgctttcatcatgccttgcctagaaaatgaaatacttacattgcttttgtaaaagacatttggtcaagtaagtctaaatacagtggccaccaggaaagaaataaggtcacgggactgtattaaccacgtgagttccatgcacgctttaaataaggctgtgcttaccaaggtaagtgaagtatcaaagtacttttggggtaatccaggctcagtctcacttgaatttattcgttggagaactcaaacaatcacgtcttaactggcatgttgatcctcacagccaaacataatgcaaattacaaggtagacattcagtaaatatttgatgaataaatcagaaaaatctgtttctcatgtatgagaacatgaaaacaaatgagcacatggtatgcactcattttatagatcatgaatggatctatggtccctaacaattgttatctacaagcagagaacacagaactctgtaagtgcccaaatacttgatgattcaacactgagagacaggctagtttagtaagagaatcaaggagattcccaagtctcctgagtccttaagacggggctttttgcagtttgtcacagactgcaaggattttaatcacatcacgtgctgggtgattgttcaacatgcagatccctatacgccatacttgggatttcagcatccaattcaagtcattctctttgagagccactgtcagagacagaagcctggtaccagagctctggcttcaatttctccttctgccatttattggctgcatgatcttaagcatatttcttacgctttctgagaactggttgcaacttcagtattcacaagggctacgcagggagcccaatgaaaaacaaacaaaaaaaacaaaacagggcactaatgggtgatagggcacagtgggactctggaaaactgaagtactcatgccctactttaaaagagtcattcctctaaaataaaggtggccaggccttgagaattttaaagagaagttggaaatccagagttttacataaaaagttgagactttaaaatgctagtcatttatccacaatttttaaaacactgtacatattgttgtataggtcagaagctttccactggccaacaggttagggactctatcttaaatccttgctttttgtttcttttaaatgtcaaatgaggctaacaacacctacaatacaggattgtgtggcaggggtcagagacaatgtcagagaaaagcactttataaatcatcaagcatccaaataagaggttattaatatcactatcatcatcacaattattgtcccacagtgcctaagtgttttacatgtggagaaggagagaaaggaggatatttctttctaaaatccatttacccattcacagtagaagcagcatgttctttcccttaacatgtcttttgtatgtgagatatgaataatggttatctaaggggctgggccattccatggtcttgcttttctacatgtggtcttggagagaagatcatcagattgtgtatgtatgtgtgtgcaccatgtatatatatatatacacacacacacacaccatatataaaatatgtatatatttttatatatacttatatatttaccttgtcatttatctgcaatttttaaaacactgtgcatgttgtgtgtgtgtgtgtgtatatatatgtctgtacgtatatatatatatgtctgtacatatatatatgtctgtacgtatatatatatgtctgtacatatatatgtgtgtgtctgtacatatatatgtgtgtgtctgtacatatatatatggcatgatttaaagtgtgtgattaacaagatgccaaaagaacacaaaaaagaatggagaggaagttgtggacatgcataaacatatttctacaaccacagaccttctgataatataatttgcagaaatagttagttttaacggcacaggcctaattcctcagttatctcctggttgccatttgatgtatattatgttagagagtaacatgatttttctttattctgtcaagttacttaaataattcaattccctctcagataattcaaagatgcagaaactgaggaaaaaatgttattcctcaatctttattcctcaccatgctgaagactgtaacatggtatctcagttctcagtctttgaaagggtagtcctgggaatgttagctggggaaaataagaatgtgaaccattattctgacaaattaccatagaaaatgttttagcctcaattatctggatttttccatatagatttttaaggccaactttatctggaaagttgtccccaagactttggtaatctacagtcttaggggcaattttccagactgtctggacagtctatataaattctgcattgacttcactctccatttccaggtcaggaccagagcatagagtcctctgcttggtcctagtggagcctccctgcccatcagcctcctggctggttctccactgagactcacagactgcccttgaagcttcattgaccaggaacatctttctgcagatgccctttcagcttgtgtgttgagcatgcaaacaggagatggaaaagaactaggtttcacatccctacccaaaagctctggctgtcctgcccattttccccaaaatgagccttgcctaccaccagacaggaggaataactaagaccttgcctcagaaaccactaattacttccctatacctcacattttcctaaactgaggtagatggatcaaagaggtcatggaaagcaaacttcaaagaagctgaattttctactgtcagttggctgggcacagtggctcacgcctgtaatcccagcactttgggaggccaaggcgggcagaccacaaggtcaggagattgagaccatcctggccaacatggtgaaaccccgtcactactaaaaatacaaaaattagctgggtgtggtggtgcgcgcctgtaatcccagctactcgggaggctaaggcatgagaatcacttgaacccaggagtcagaggttgcagtgagccgaggttgccccactacactctagcctgggtgacagagcaagactccatcttaaaaaaaaaaaaaaaaaaaaaaaaagaaaagaaaaaagcctacattccctatctccctaaacccaccaaacctaattgacaagctaatctctatgagccacagagtcataagacagaaaatcttaacttggctcctggagtgcagtgttggaagcagcagtgtggttctgtgtgctactgggagaaagtgttgaaaataagctcttgtggacctgtttacgactgagctatcagcctttgcatttagcccccacaggtggtcatcttccccaatctgaccccaattttcctttccatgtccaaagtctcctgggagtacactgagacagaacttatcacacccagtccttgcataaataagctattttattttgtcattacttggggagcgtctgtttggttgttttaatcagaaggactttttgctaagccctcattaacaagtttaaagatctatcagaatattacatctcttcatttctctttctcttggttttgaacttaaatctaacgagcagctcacgatctaatgcaaaagagaagtcttgtgtccatgcagggcccatgcaccatggcggtcacgccggttttttcccttcttctaatgtgtttgcctgggtggaccacagtcaattattattgttattattattattattatttgagatggagtctcactctgttgcccaggctggagtaaagtggtgcaatctcggctcactgcagcctctgcctcccaggttcaagcaattatcctgcctcagcctcctgagtagttgggattacaggtgcatgccaccacactcggctaatttttttgtatttttagtagagagggggtttcaccatgttggtcaggctggtctcgaactcctgacctgatgatccacctgcctcagcctcccaaagtgcttggattacagacgtgagccgccatgccccgctgaccacagtcaatttttaagccatcatggtgcagttagtcctgtcaggtccaatactgaacttcttgatggtccttgttagtgccatgcagtacacataggcccaaagatatgcttgtaattttttgtcaacagcttttgcctggtttctcatgtccaaaaaaagacagccacaaaccttcctgtgcttcatggtgattttgggggggaaggttatatgtatatgtgtgcatgtatgagaagttggaggatggagttagcatctttgatgataatgaatggctctggattgcaattcctcttcaggccaaaaaaccctttcctagtctaaaggaagtaattccacagctgggctgtttcattaatcagaatagcatttcctcaggtagccatgtaaagtctgtattctggaggtcattctcaggggctgaggcacgaacagggtctgtgtcacaaggctgcattaccaggtacacttgtagaggtgaactgggtcaagggccaaagttcaatccatttgtatccattctgtcctaataatgttcccttggcattttatcctgctgggccgtagtccatgcttgatgaaatttgctaaatagataatggatgattacgtagatggaaggaaagaacccgtgtgggtatgaggatgtgggtgtggaccctcagccagtaaaaattagcctggaaaacctctttttcctcatgcttccgagccaaagaattagagcttaactctggcttcctctttggttagcttcacagtggcccctgccttgctcttacaaagaatgggtacagacacttcccttttcttcccaatcctgagaaagcagctttcttttttgctgtagcccaccttgcccacaaatgaaacacatttaccttgaccaactaactcaactgggaaaggaactgaattgttgaagaaactacaaggaggctggtatactaggacagagcaggtacaagggcacccaaagaggctaaggtcagattgtgcagaagcaaagtggactatattgaggaggctggaatttaaggcaaatacaatagaaagccaatggggagttggaagtatgagggctacataattttatttaaagaaagaaaaaaatcactctgaattatagaggggacaagagtaataatagagaccactaggagtcttctaggtgactagcgatggtggcagtgaaggttaagtaggcagactcaagagatgtggatttggaatcaacagtcaacagacaacaaatgtgctacaggctggggtagggagaggaatggaggatggaaagagtcacttgagcagatggtcttgctttttaaaggagggggtagaccaagggagaaatggatttgaggttagcaggaaagaaaataaaaagtgcccaagtctacttgagatgctatccacttccattattaatattatctgtattttcattgttgttgtttgtttttacatagccctacaaacagagtatttccaccagagaagagtcttttgcctttgaagctcactcggcctaactgcattttacaacaatgcccccagtgctcagtagaggccctagatgtaaaccaggacacaacttatttgtgtggcagtgacttccagagcagtatctaaagctttcattcttctttaagagttttgggggctcccaaaaaagattctgagaaagaaatgagtaccccttaacttctttctcttaatatggctattattttaattagtgctataaatagttttttttttatgtttttaaaagaaaaaaaaaaattggccatgagggggaaggaaaataaaaaacatattgataattgaagcaagacttgaagatctgggacacaagaaggatcaaggccgggtgcagtggctcacatctgtaatcctagcactttaggaggctgaggcgggcggatcacctgaggtcaggagttcgagaccagcctggccaacatagtaaaaccccatctctactaaaaaatacaaaaagttagctgggcatggtggcaggtgcctgtaaccctagctactcaggaggctgaggcaggagaatcgcttgaacctaggaggtggaggctgcagtgagctgaaattgcaccactgcactccagcttgggtgacagagtgatactccgtctcaaaaagaaaaaaaaaaaaaggatcaagaagaggccaacttcccctaggacctgggcagagaagtctaatgttgtgaaaatatcaaaaggacttcagatgcagcaaagccaaagattacataaagtgtgctgtcttccaaggtgacagccacggtaagactacaaaaataggtcttctaggacttggcgaaagtcagacgttgtggcgttccttttgactagtggatttagtcaagtacggcttgctaatattcaggccattgtctcctacatttcagtcagagtggcctgagactttggttaaaggagcaaactgaaggaagcactcattgtttccccccaggccccttagcactgtgtgtctgccagatagtaccaagttcatgccgcagggaaaatgacagcctcagatgaaattcagattttctttttttttttttgagatggagtctcgctctgttgcccaggctggagtgcagtggtgcgatctcggctcactgctagctccgcctcccgggttcacgccattctcctgcctcagcctcccgagtagctgggactacaggcacccactaccacgcccggctaattttatgtatttttagtagagacggggtttcaccgtgttagccaggatagtcccgatctcctgacctcgtgatcctcctgcctcggcctcccaaagtgctgggattacagcaaagtgctgggattacaggtgtgagccaccgcgcccagccgaaattcaaattttctttaagttactgtatgtttcattcagccaggatggtaaaataaacctttttgatgaaggtttcaaaaaatattaaatttcttgacttcttgttgatagtggttatttttgtctcttgcgattttttgttgtttttgctcagtggttcaacgtggcagagacatatgaataacactggtatatatgacagtgtcacacatacccccttgctaacttgcgtgagttgactatttttacaccatcatcacctttgtaacacagtccctttgtctttcggcaggggatttattgatatttaggtaaagaatgattgttggctgacttcaactatttaccatcctcctccctaaaactattcctaatcatataacatggcctatataattttccacccaaatttatttctactgctggcaaaagaaaaaaaaaataggaaacaggtttgggcgggggggtacttctttaacaagaagagatgttcaaagccaatatgagttctgtaataacagctaatttcatagtggtgataatagattgttatttttataataattacagtacatcattatctaggcttcaaatggaaaatttgaggatttaattatagggtgacttatttgtttttatgttcttttctacattatttgtatttgaatgcttgtgtctagatatccagcttattccacaaaggaagaaaaccttttatcctacgcaaggaaaatatggtgatttaaaaaatgacttaatgatgtttcgaggttaatgctattaagtaacattagtgtttctcaaaagcttgcttgctataagcccatgagctacagagtgaaaacactctcaggtatgaattctggctctgccccttcccagctttatagccttgaatgaggatgtaagtcctctgagcctccctttctgatctgaacccgggtgatagtaatggtacccatctacccgtctcttatgctgtgcaggaattaagtgagatgctgtgtataagccactgtgtacagaacccactactagttactatactaaaaagatggtactttgtgtcaggccaaatggaagtttctaaataattcttgctgctggttcaaaaggtaaaaaaagtgttgtttttgttttttaatttaccttgcagaaggaattctgttagctgttgaggctctggttctaattctgtttcagatgaggttaattattgattacaatagcactatgaagtgtggaattcctttctgtctacagagggcaagcaaaggtcattttctaggaatagattgagaaaattcaaagtccataacaatattttgcttttatttatttatttagagatggagtctccctctgttgcccaggctggagtgcagtggcacaatctcggctgactgcaaccttagcctcctggctccaagagattctcctgcctcagcctcctgagtagctgggattacaggcatgagccactgcatccggcttgcctcattctaaaaaagaaagagtcagagggttcttaaaacattatagtgagggcactaatgaaaaatcatgaagactgcctcctgatcctacccccaaaccccagctctgactgtaactttttgatttgaaggaaaattgtggggaaagaaggcagcctctttttcttattcaacacatgaagcttaaatagcacagggtgttcatacagttcacgtcttctcctgataactgacaggatcccagagttcagggacccaaagggtttctttctcctttctcatgtttagcatcagcatctcaaagagagaaaccaagctgtggaccttatcctggaaaagaattaaagccacaagataggtgggagtgaaggggaattgcttttgatcctccttggggaaaaaaagtgctgcttttacttccaaatgcatcctgtaagcttcctccttcagtattcatttgagttgtctatgaactgccagttcatttgtttgcagtaccagcctccctgctgttgcagagatgtgagaataagatgattatttataggcttcttaatgcctgttttgctggaccgaagaggtaaatttctagaactcgggcaaactggcaaagctcttgctctataattgaggaggctgaaggcagaaagaacaagaaggggagagctatttacatacatctcattatatctccttggcaaagaatcctcagtcctggctctgtgagaagaattgctgctcagttccatgcaggaaatttcaactaaatctcaacatttggtccaaagaggtcctcttctctgtcttgctgcaattgttaagtaagcagcactgtggggttttgagataacagagtcccatccctcattttgcagaagaaatagcaattcatagacaggaggaagcttaatggatgtggtccgaagtccatagcaaaaagctccagccagcaggagaaagattggaggtggggagtggaatttcttccttcccccagccaagcctagctgcacacatacagctcaagctctcagcccctgccaaggttggcaaatatcttgaatattgtccctgccttctcctacctcttattcctttggaattgaacaagttcttaacaggacattttgaccaacatttggggggaaaaaatggaacattcaatcctgaagggtagtccatttacctgagcaaaccatgctttaaaccaaggcaccaaatcagtgaatggcagctggcttgttctgaatagtatacagatattttatccagaatgactatgaagttagtcttccaaactggtacatgtttgagagtgaagggggaaaccagtaataatcaagccaagacacaggtaaaaacaggaccgtccatggcaaaaagggacatgtggtcattctacttatgttccatgaatctaattgctcaggccaaggactggttaggggagaagggatagggaaagttctcagaaggaaagagagggccactttgggtgggtttagagcagtacccggcaaagagcatttgttcaataaacagactcatggaaggactctgggtagaagatgtgtgtttgcttagctctgcccctttctagtggggcaagtcaatcccttcacctctgtcagcgtcagtttcctcatttgtccagtgaggggaacaaacatggctcccttcacaaggctgttgttagccatcagaaatcctcagtgctgaacctagatgggactccacccagcctgcagtttgcaccccatggctcttttgcaggaatacgctttcacaaggaattaagttgactgaaaccacccattatggttggccatgccagtcaaaataagcaaaacccatttcagtaaatttacagaaattataagatgacaataaggcccagatcattaaaaattagagtgttttctgagaccagctgtatgcataacatctaattctttttgaaacctttccataaggcaaggaccagggctaagtatgtagcatttatgatcccatttcatcctcaccacaggacaatggagtttttcacatcaggcacatccctggttcaggctgaactcaccatccctgttgaaccatagggtctctctggaatgtcctgcttccagctccccgcctggctaacaatctcaccgccacatcattgctcacatttcccctttgcaatgagctcctactcttactgaataccgcaaaccactcctctgccctccagcatctccttagcctgctttgtgttatattctatagcactttccattgtaacatactatatccttttttttttttttttttttttttgctttacatctttctcccctcttactctacctaactgtaaatgcttttaggacaagcactcaataaatggcatcatttatgactagtattattaattttttaaaagcctctctactagtcttcagaaaatgtataattctgatgttgagatccaggtaagaatattgtgttcagatgtggtccagggtcagatacttgtgaaatccacaaagtaacagatctgagaagccattggatttctctgaggaaggtctgtttctgagggtcatgtctactcttgcctagcactttaggctatctcaaagtccagtccccagaaccagccttcctctaacccctgcccctcaagtctctccatggccaccagatgtaaacaggttaatgtgctcatattacatggctggttagtctcattaaaccaagggttttgagtccacaagctaaaattcctgaagcagcaggatgtaaaatgagatgagtactgaatattaagtggatggtgcatgttccaaagaaaggcattcaaatttgaatttacagactgcattggccaaataaaacctgcctgagagcagggctttcacaaatactgactcctttgagcgtcaccttgattctgtggagtagacagggtaggtaaagttacacccattttacagatgtagaaagaaacaggacaaataattcacctaaaagatggggccagggttctaagaccagtgctgcttccaaatcctgctggcacccctgctactcccttgcccccttccttaaatcatcttgatgtgacagcacttttgccttctctcattttttgccagaaaacttataatcatgccctaatgctgatagctaatagctgtcctaccttaggttcctcttcaaattctcccctcacttcctctatattgctgatttctggtctctttctctgagctcatagagtcttatggcaagccccttcaaaacagctttgaaaaagacctttgcgcaagtagagagggttcataaataagttgcaaggtaattgatactgtgaaaatgccacagaacctggacatgagtttgtcctttcagtaaacttgtctcctcaacataacaatgacaaagcacagtgtaactagcctcatctgtcactcccacttctgttgggtgacatctttagcccctgtgctatctctataattaaagcatcacccactccagtcaccattctaccttactttgtcttttgtttataaatgaatggccctagaaactcctcaaatggagggaatcagaagctgtccttcctggatttgttactactgctgcactgtttcataaagaacacttctattttattactttgactgtttccagtccagtgaagagcttaagacataggctttggaactaggaagctctgggtttgaagcccagcttctccactaatcagctctgtgaacttctaaatctatgggtctatctgaaaaaatgagaatcacctgaggttgatatcacagcactgaaattagctactctataaagtacattatacaaagcacagtgtcttatacatagtaaatgttaagcatagtagccacaaatttttgttcttacgaaatactatccataacttaactcccaattctgtattaggaaataattgcttggggtggcccacacatatattttacttctgatcagctctactacctaagaagactggaaatttacccttttttcttaccttcctctcttccctttccctcttacactgggaagtcaatgcacttacatgaggactctcttaacggtgtcctcaattgtccgtggttctagttctgtgaacagacccattttaacaagagaagtcagctaagtacaagcccagctcaggcctggttgtgacctgccaaccacagggacatctgtggtgggttatttcaaagaaaagtagaaaaacaggtaaattgatgtcaaaattccaccaggaaatggaatttgctttaccttgttgtcaaaggcctaaatgagatgtatagttgaatttgtggcagaagagaaaacaatttcttgcaaaatcttcaaagctagaaagagcaactttgtattggccatcaagctagccatgtctaacaacccaaggttcaaagttatcaactcttcacccaataacaagatgaagcatgtggctctatcctttaggatggctatggaggattagagttataaaacccatcccagaaatgcaaattaaaaccatgaatccaaatcatatctgcaaagccccttttcccaataaggtcactttcaaagattcaggattgaagttgagggtcactatttaatccactatactggccagcctccaaatgacttcttggtttgagaatgcacttatatgccttggaggtatctttgcaaaagtgcattgcccatagagagggatctgagggtgaggcatctatctcccttactaccaccttcacataggtttgtcaaatgtcatggctcctagacgctgagggtttcataacaggaaagaaaccccctatgatcttctgcttccccagagcaccatttggcttctaactggagaaaaaacttctcaccctgaatggaaatctgtttacccatgcacttttcaggaattttggacgtgtggaaaaacccaaaataaatgcatccattttcataatttctttatgaaggaaccatgtgtaagaaagatctaggtcctaccacttacatgctatgtgatcatattcacataatacaaagaacctcagcatcccaacccataaaatgagaataatgatgttatttcaggagattaagagtaataataaatgtaaatgcatctggcactgtgcttggcatataatagcaacttgaagagagatcttttgggggttctgtctagtgcatgggtatgtatctttacttcagatgttctttctatcctgtccataaatcaaaacctgtgggtgagtgtgtgtggttaaatgtgcatttcctggctgggcgcgatggctcactcctgtaagcccagcatttgggaggccaaggcaggtggatcacccgaggtcaaaagttcaagaccagcctggccaatatggcaaaaccctgtctctaccaaaaatatagctattaaatattagccgggcatggtggcgtgcacctgtagtcccagctacttgggaggctgaggcagaagaatcacttgaacccaggaggtggagattgcagtgagctgagatcatgccactgtactccagtctgggcgacagagcaagactctgtctcaaaaaacaaacaaacaaataaaaaaaaatatatatatatatatacgcgcgcgcacacacacacacacacacacacacacacaaagtgtgctgtggcagacagaggaaaagcaggtcgtgttttatgtccccaggggtagggaggttaaagtctctctgggaacatcagcattcatttgtacctgagtcaagatactcgatggccccacttaaaagtgtcaattaccacctacctcaggaatgtcacttgaaaagtgaagcactttttaaaatatggtcaaagagaggttctagaaaaacaaataaaataattggagttttcacactgtgcctttaaatatcaggatatttttatcaactgaagtatgagatcctaaaatggtcataattccttagcaatgggggaggtaagtgaattcacattgacgattgccacttgaacacttatgctactgaaaacatagtatttactttgagtgaagtacaaacatatttttaaatcaacagaggaaaatctacagtgtttttctacacactcatatgactaataactagaaaatgagtgccaagagaatggcaagtttgtgcctaggaaagaaaagccaattttccacaatcccgatgttcttcagcagaaatgatgacctgagtattgttgcagaacccaaaatacccttgttgtagtggtggtgttattctagagttcctgccttctaatatcattgtcattccccaagtgagaaaaaaatgttaagtagaaacagtctaaattggggaaaaataaaaagataaatggtaattatttgagtcatgcctgtcatgccataacacgctggttagaaaccaaaggaaattgtattatcagatacaaaccctgatatgaacatctggacagggttcacgtgtgatgtgcatgtgttactatttacccaatccaattaattcaaccccaaaaaatgtactgaagcagctacaacatgttattggaagaggagaaagagtttcatttaatcttagttaccactgaagaagaaaagagttatgaaatatagcaaagagaacaagaattcccttctttttttttccagtaggaatttatttccattttttaaaaataaacatttagtccccatcactttgctagtcatgaatgtggaagggttgagctctcagaacgaatcacacgtttttggagagcctcatagttaagtgtagtggtggctgggaggggagcagaaacagatacatcaattatgaattctggaaatgataatagagggaaaaccttactcttcctgggaaagtcaagaaaatgtgacctttagctggcttttaagtttcagtcctggccaatgagagttggagcactggtctcaatatactgaccaggctggcagctaaaggaaacactcacttctccaggaatctctctaagcaattaagtgaggcttagagagagcattctgctcctgggtatgagtctccactcttactgaatcactaaagaccataaccatagattaattactaaaccagaattgataagaatgaagaacactattgtgaattattccctctttaattcccaagtttaggtgcatcaaaaggtattccttatggctgcatggaggaagaatggggatgtgtgtatacatccatgtaaacactctaaagtctaaatgaatctttgaagcatcaagtcttgatggatatcatggttaattttataagacaaattcaatacactgctaatgaatttagagcatacagtattaaaactccaaataaatgctcactgtatagcttttgagtacagaatgttctaaaaagtcagagagggaaaatagatgattgcgtgaaacttgaaccatttagttttgggaaaatgaaaattggttccattgccattttttggtagcctttcgcctagataaaagttggcaataattttagtttgcctcatcttatctttcccactcatgcaatctctgacatttaatgaaagctagctgcagcaagaattcccaggagcaagcatgtacaaaatccagtgaaactgactcacagtcaatttttagagagatagctgatgtaaagcaagttaacgataccctctgtgaaaaatgctgtttaggcaatttaaagggattatttggggggaataaagattctgtaagtaggaataacatatcttaggaaaatccataccattgtttatagaatagtccacagaatgtcaaacaccaaataaaatgaaatcatcagatagtgactataaatgcatgatctatattgaatttgaatctttgaactcttccaacaattttccacccatttcttgtttatatgcttttcagctttttttacatttgcaattctaatttataaaaagataataaaacatgaacgtttttgaaaggtgaatactatcattttacataaatataatattgagaatttatataccaaagatttctttgcatttttcacaaagattttaagatttctgcaaaccaaagttttaaaatagtggaagcaattcctatttatcaactcagtaactgaatattcgtttgtctgaattgctcatatttctgttgagctgtctcccttcaagacctgctctgatttaagccaaatgaaatgaacattagctgtaacttactgaatcttgaaaatgttccccatgagcagaaatgaatattactgcttccatacaatttgcagaatactggtttactcctgttttcaaggacactgagggatggggacacaatgcatcatgcagtacaggagatagcctgtgagttggagggaatgttattgtacagaaatatggtctatagctatgagagatgagctactgggaaagagaaagaggcttccattggattaatctagtaggggcccagtgatcatttaaaggcatctcttttaacttcggtaatggtcagactattttaaagcaatcacatatgtaaatcaacagcaccaagcctgacacatagtagaatctcaatagatatgaattctcctcataggttataaaatacatcctgtgtgaaaagaaaaagtaatcacccattggaagccccatctgttcacaggtagcacacaccattatgtaagtgagacatctggttttgtttaatgttgattgaaggcctgtaaacagattggttcatagcttataaatctataaaactgatcaaactctggctggctccacagcaacaaggtctcactgagataggaagagagtgtggattttcaacacggtaagatgttttaaaaagggtgaggattttgttttcctattctagtctcttgggagctcatcccacatttccttcagactaaccccaccattaatagtataatcactgggcgtttggtactagggctaggcaaacatttcctagtggcatattatttctagtggtacattatttcatgggagtgagggttagggaagtagtagcatctgctttctaatctacagagaaaactgaagttctgtttaccaagacagaatagatgaaaaccaaataggtagataaaatataggatgtaagctaaaaagcaaagtattaaataaaaccttatggtttaacttttcaaaatatattttgtctgaatgtatcagccctagattatttcccagttgcaaaggtaaactgtaatttttttaatggtgacatctggcagtcaccgctttaaccacatgatcaaatttagcatcaccagtagcagggcagcctaacaattggtgcctcttgacaggagatgcattcacatgcctatagtaccacccatgaagctttcttggcaaaaacatctgacttgaatttaattaggaaagaacaaagggatgcagaaggcaggacattttataagacattgcatgggcctgggatcttccaaaaagtcaaatgtcttgagaaacaacaaaatattatagatgtatacatatgaaaaattataaaatatttgtgaaataaattaaagtagacctaaataaatagagaaatatgctttgttgatggtttggaagattcaatattgttaagatatcaattctccaaattataatataaattcaaatcaataccaatcaaaatcccaacaggcttcttatagaaactgacacactttttctaaaatttatacaaaaatacagaaaacctagctaaaacaactctgaagaaaatggaaggctaatataatctgatttcaagaattattataaggctctagaaatcggaacaacagagtataagaaaaacagatcattagaactgagtagagtccagaactaaacccacaaatgtgtgaacaactggtcttggcaaaggcagaagggcaatacaatgaataagaatagctttttcaacaaatgattctagagtaatagtaatatccaaaataaacaaacatgcacagacccatgcctagtgccatatataaaaatcaacatagattatagatttaaacataaaacctaaactataaaacttccagaatagaagaaaatcttcgtgacactgggttaggcaaatatttcttaggtatcatgccgaacacacaatttatacgtgaacagattaactggacttcatcgaaattagaaacttctgtttttcaaaagatagtgttaagtgaatgaaaagacaagatacagactaggagaaaattttttgcgaagcatgtgtctgataaagggcctatatttgaatcaaaaaaccctcaaattttagcaagaggccaacaacgcagtaaaaaacaactgggcaaaaatatttgaacagatatgtcaccaaagaagataccacaaatagcaacagggaattttctcaacatcaccagtcgttagaaaaacaaaaattaaaaccacaattgaattttcctgcacacctattagaaaggctgaagttaaaaaagattgaccatatcaaatgttagaagggatttggaggaactgaaactctcatacactgctgataagaatataaaatgctggccgggcgcggtggctcacgcctgtaatcccagcactttgggacgccatggcaggcagatcacgaggtcaggagatccagaccatcctggcttacacggtgaaaccccgtctctactaaaaatacaaaaaattagccgggcgtcgtggcgggcgcctgtggtcccagctactccgaaggctgaggcagaagaatggggtgaactcgggaggcagagctggcagtgagccgagatcgtgccactgcactccagcctgggccacagagcgaggtctccgtctcaaaaaaaaaaaaaaaaaaaaaaaaaatgtaaaatgctactatcagtttggaaaatactttggcaattttttaacaagttcagcatatacctaccacatgatccagccattcctctccaaagtatttatcccccccaatgaaaaatatgtatatagtcctacacatgaatattagtgacagtagttgccaaaactggaagcaacccaaatgtctgtaacagatgaaaggaaaaacaaatcatagtatatccttgcaatggaaaactacccagcaatagaaattaatgaaatattgatacatgcaataatatggttgaatgtcagaataattatgctgaatgaaagatgcgagacaaaaaatagtagttatcatagaattttatttatataaaactctagaaaacagaaaagaatttgcagtgagcaaaagcgaattatgggggaggttgaaaggagtgagggagaaatacaaagaggaataaggaacttttggaggtgatgctgataactatcttgactatagtgatttctctggtgtacatctgtcaaaatgtatcagattctagtctttaaatatgcacagtttattgagcatgcttcaacaaatctgtttaaaaaccaaaggcagggagagtgttctaaattataagtctgataagacataaccgaatgcaatgtatgaaccttgattgtattttggattgaggaaaaatcatatgagacatttttgggacaaatggagaaatttgactttgtatcatatgttagatgatagaaattactgttaaatttcttaggtgtgacaatgatactgtggttatgcacaagtgtctatttcttaggtgacgcttacagaaataaagtgcgaagtattataatgtacatgacttttaaatagtttagcaaaaagcgtaaagagaaaacaataagcaggaaatgaacagatggtgaatctgcatgcagagtgtacagatgttctttgtcctatgtcaaattttctgaaaaatttttaagtattcaaaataaaaatttggggaaaatatatgtattgtatatgcttacatgtatctaggcacaaaaagtaagatggggatgtttcaattcatagtcataggaatgcagaaacaagttctggggagaggatgtgtcttttctgagagatgctgatgtgacttagtacttgctataaatgttgtagggtgctcaggtgatcattgaggtaagtgcttggaagaggagttatagaataaattacatttagaatagtcttgattttaattggaactgagatgcccatgagggttctaagtgatactctgattatggctgaactcccagggaacacaagtgcaggaggtgtatttggaaacgcccttagtatcagcaccagtgggcagaagggagagaatcaggattgggctgatggagaagttgggctgggatgcagactcaactggtctcagctggcatcgctcagggagctcagaagctgccttatggagctgtcccactcggcacaaggaactgggcctttatctaccagtatatcctagtcattatttgcaggatgcccaggggaagggggcataaacgtaagcaagctaaatctctttagtcaaggcaattcccaaagagagctgtcagctggtgaactttccagcatctgcaccaatagatccctcggtcctcaaggtggaatgcctctggagggtgcagcacaacattcataacacactgcttctgtgtttccttcatatattgttcatgctttttatacaaggcatgcataaataattgcctataatgattgacatataatcatttataaatgttatacattgttaacacattatttcaaaattctaattttcttcagcatgtgtcttaactttcttcaattcatggcatgttatggagaccatggattttatcaaaaagaaataagttaacttgagaaagaagacatatgcttctgagactcaaaggcaaggtgaagataatacattggcacataaggatttataaacagcctttatacgaattcccacaaatattaagtgaaagaggaaactagaatttagaatttctgacacctgagtccagtggtttcatccctacaccagagacatgtctgttaacactgcgccttaatgcaaactttggactcgcttttatgaccacaggacaagaaaagcttgtctcaaacatctctaatgcgtgcaaagcctgtgctacagggttacagtggaagaaacagaatggatagttcattattagacaccctataattaccctgccaaactttccagaatctacaagggtatgtaaaatggtcatttctttaaggttacagccacaattctcaacccaagatgagagtcctctttcctatggagttcagtgttcctcccccaagatcaactcactccctcaattgctggacatgcctgggtcttttcatttgaggccacccctcaggcttccacttttgttgtaatcgtggaataaattatcttttgtcctctccataatccccttgactgcacttcccaggattccactccttgtcctcattctgatatgggtatttcatgattcagatcaattctttatgtcggtaaaggggtcagacttttctcactggagatctggggtacctttccgagtatctcatgtgttactatgggcaaagtctgtgctttggaattgccaaatgtcttctacttttttattatgctttaagttctaaggtacatatgcagaacgtgcaggtgtgttacataggtatacacgtgcaatggtggtttactgcacccatcaacccgtcatctacattaggtatttctcctaatgctatccctccccaacccccatgccttctatttttattccatcttatatgtaagctaaatagctagaaaatgaataaagacaggtagtctctgctctaccatagaaagaaaattataaagatactggggcactcaatgcttacttgaaactcagataattccaattcattttccttatgtggcttaagctcctccctcctgctttatggctggttttcttagtctactcttgatctcaaattagtaaatttcatattataaccacacatcagcagaatcagacattgcaacctgttcatgtttcagacaatatttatatttaatttgtatattatttatttttcattcttttttctttctgcctgctcaagcacaccttttatcatttgggacatctgcctgggtgtgtttgcactattggtggaaaagatagcaatgacacattctcttgacaaaaggttgtatttggtaagggaattggacacagtttcaactgcatacggagaatgtttgcccatgattctttttttttttttttttttttgagacggagtctcactctgtggcccaggcgggagtgcagtggcgcaatctcggctcactgcaagatccgcctcccgggttcacgccattctcctgcctcagcctcccgagtagctgggactacaggtgcccgccaccgcacccggctaattttttttttgtatttttagtagagacggggtttcaccgtgttagccaggatggtctcgatctcctgacctcgtgatccacccgcctcggcctcccaaagtgctgggattacaagcgtgagccaccgcgcccggccttgcccatgattcttaataggaaatatgaatttaaatataaaacacataggcaaatatgcactccatggtaaagaatcagaattttcttgtcagttccctttagaaatacttagagctgtttgtttttccaagtactggcaattaaaactgtggagaatgaaaaattaaacagctttacaatctactctttcattaaataagtttttaattgaaagtgagtatctgtgcagtagagtgagctttagagtcccaaagacctcaactttcttcttagctttgctcctgattactgtgtctcttcccaagtcatgtaacctttctgcaaacttaggatttttaatgtatattctctatgtgtatttaagactctaaatccacccgttatatatttacacctcaaaaagagggtccgttttactcattaggacttttatatgtgcaccatactttggaattattatactccttattcattcaaaaattattttttgaaggcttcatttttgataggtgttcccctggccatcacagagcttaaattctagtgggagagtaggacttgagataactgaatctatgaccgcaatgataattactgatgattatatatactgtgaatgaaaagagcaggctgctcttagggagcatcacggaaggagaaaattcaaattggtggggtggtgtgtctgtcgtcattcgagttacatttcttcatcagagaaaatgcaagaaggttgaacctgaagaatgagttaggagaactgaagcaaaacaaacaaacagaaaatattctgggcagagagaataatatacactaagtcctttcactggaattaagtttggattccccaagaatgccaggatagataagtcatattcaagagagactagctaaaaaattcaaaacatagccaggccagatactatagggccatgggaagtctttgaaggatgtcttacatcagaccacataatctgctttgcagcttctacaaagatcgttctggttgctccgtgcagaattatttggagggaggcaaaaaatggatgtggcgaaaccagttgagatgctaccatggcatcctctgcacgatgcaagtccattagaacaataataacaatgataacggccaaaacgttagaacttaaaaatggtagccactggtctttgtgctttaggtgttattaactggttaaacatatctgagacaggtgagggcattgggatgagaagggaacaaattacagaaatattaccggtattattaattttattattattacttcttattacatatattatatattgcattacttatattacaggtaagattagccaaccagaaaacaaacctgatacgaagtataaaaagtgagggaaatacaagtattaaagaataacacttaaggttccaatttgtgcaaccaggtagataaatagttcccaagaaaaggaaaatttgtggagaggcatgttgcacagcgaatgccctatttttgacattgagatgcctgtttgattgtctcagcagacctatgaggttggagatgatcatccctacactagagatgataaacatcagagtttgaagtcatctgggcaacacagcaagactctgtctctacaaaaaacaaacaaaaaaaatagccagaggtggtggcacatgcctgtagttgcactacttgggaggctgagacaagaggactacttgagcccaaaagttcaagactgaagtgatctatgatcctaccactgcactccagcctgggtgacagagtgagaccctgtctgttaaaaaaaaaaaagagagagagagagagagaaaagataagcatctagttgcatggaaatgagaataacattttcaggcacttctgcaggcactcggatgggtgggcctgacatccctatagacatttctgagtacactatgtaggagacttcggtattttatttctcttcctgctccaaccaccaacacacaaaaagtatggtgatcccataagctaaacttgaatagagaaattgccattaaaattacttattttaaaaaattcatccatcaattttttaataattatatcaaagtttcatatagtttcatttcagaagtcagatgaagcaatagaacattttctaagaatttttttttcctaaattataaacatggtcctagatattatggagagatctgagttgtggaaagacagcaatttactcacattcttattaattattttgtagatcacttttatactatctaaagaagggtaggttttaaaaatatttattgataatttctttaaaactctaggagaaattagcattacaaaaacaaaacacatatagggtctcagttaagtcaaagtcagcagatttatgtcaaaaaaaaaaaaaaaaaacttcaacgcctgaactcatcactgagttgtcatggcaaccatttcatttttctattgtgaggagacaattaggtgctaacctgggtgttagcacaagctgtttgaaagataagctcccatctttacaaaagaggcagagttgttggattttcattgttgccacaggctctataggagttattattgacaattatgctttatggtttagtgaatatatcaaagatgggttagagaaaatgtaggtggccaccctcaggacagcagagtccactcctcctctcttgagccagtttaggaaatacttactgcagggaaagtgtgtgccctgggagcctcaggctctttccccttcccaccgagtaccttttgcctttctgttttctgtgattatgccaggcatggagccaaagattggaaatggaatctctatctttgtgtgtccaagacttccttatttaacatcaccaattaagtcccctctatttgccacccacagtggcagacactggagatacaatggtgagctaactagctatgcttcctggaggaggagatacactactctctctcctcctcctccctttctctctctctcttttacgcacatgtacacatttaaatatggaggcaaaagttgctttgagaacttgcctaacagaacagtattccctagtcttggttagaaaagtctttgctgagaaagtgaagcttaagtggctctctgaaggatgaatagaagataacacactgggtggggtagaagaacatactaggggaagaagaaagcacaggcaaaggccttgtgacagaaggaaatacagcatatttaggaatatgaaagaagacagagtggctgtggggaccatcatgaactgagagatagaagttgagtgacttcgaattttgcatggatttctcaaatgagtgaggaccacttcattcatcaaacatacattgaacttgtttcttgctccaggtactaagatgcaagataatgtaaatatggcccatgcctttgatttcattacttctagatgctccctcaatccctgattcccacagtgtattctggttctctacctattatatgttactacttttcattttgtattcaaactcagacttacaggattaaataaaatgttgcagatgacacagttagcaagtggcataagcccgcatccaaatccagcatgcttgacgccaattctattgcacttgtcatatcttttgctgtacaatatatagaacatatggaatgttaagtctagcaaggggacacgtataaaagaaatatgcagcgaataatcacaaattgtgattagtgaaacaaaggaaaataatacatcctataagcgagtaaaacaagatgggcataatttagacttgaaggccagaaaaggcttccccaaggaagtaaggcagagtcctgaaagacaagtaggaggtagctaggtaaagatgggtgggaatagcatctaaggcagaaggaacaacatgtgcaaagggcttaaggatggatggagcatggctcattttagagatttagagaaggtaagggaagtcagaaggaggaccccacagagttctttgggccatgtgaaggaatattatcttcatccaaagtgtggtagaaatttgagctaatgcagcaggacagagttttaaagaagaaaagaatgagacctagaagaatcctgcctctcagggtctggcaaggagtcgaagaacatgtggaagacaaattcagaggaggtcaggggatagaagcctgacgacaggccctaaagagtgagtggtcaggaaataggactttttagatccctcagccaacaccttggtaacaagaggaaagggaaatgggtcttgggaaggcaagatcaaagtcataaactgctcagctcctacgcctggccaggcttactctcactgcatctgccttggcaggatgggcatcattttcctgcccaatctcaaagctctcactgttccatttagaggcatggactgaatgactacttgtttacacttttgtcaacagtgcaacagtgtcatttcaattatttgctcttcttgggcttaaaccattaaatagcagaggggcgtaatgaggggttttgagtgcacagtcaccccaatgggcaattcaactagcctaggttccagctgttgaagtgatttgcccatcatccagagacaacacacggcacattacctagatgtgcttcagtgtgccaggcgctcagggtggagaatgggggagcctgcctctacccacaaccatgttgccacagtggtgatcatggaaaggcaggaaaacaaagacatatacagagaaaagtgtggactagtgcaaggtgaaaagaggaagctgaagggcaggaagggagctatcatagcttggtggcaggacaggaaagatgcagtccaacagcaacagaggaagatcagcaaacataagagccagtattaacaagaggaaagagaaggctgggatgaatccgatcatcaaaacctgtcaaagttcatcagaaagccattgtcgatggctttgaaaactgagataagaacatactttgtttctgtgagaatctgacattgtcttcttgtcgatgacactgttggatctagttttaatgaaccctttacaagttgaataggcccaagaaatgcttaggacatttgctttttaactatttatttgacatcagtgttttccacttgattcttctctttttatgttcattagaactatgaagattactttaaaatttggcaagattgacagcattgtactatacaatggatatttcacatctttagaaactgataagctcagattaattctttaaactactgggtgacttgtaaagtaacacagaacttcatggtgtattacccaatatattccccagtgaggtacaagacagcattttcacattataagacagaatctgacatagcttcctacaaaaaggctagtagttccgttttgatgaatatggcagaggattaaagggagcccatggattctggcaggagtcgtctctccaggataactatagggaaaatgctgtgcttttgtacattaaatcactgcaaggcagagatctaacatttttagtgctctcaaaccagcaggaatggtcaataaccttttagataacacaacagggcaaatagtacctggtattggctacataagagagtaaaattcctaccttgcaattggagagggaaaacatcttgaaatcaaaattgaggagtcagagagctgctagggaagagaaattctgtgtaccactgaatgtgtaggctgtgcttgcacatgcccagcaaaatcagtagtgactttcctggaagacttggccaccaagacggtctgcagcttattaggatggcatgggttggggatgaactctaaacttttccaaggatgtggtcaattggaataacagcatttctctgattacactatttgggaatagacactgcatcaggcttccagtcaggagagcacagcactgagatgcaggtgattccaagcatgaacataatcacttatctcatgctccagaaactgatttgcattcacctggagcgctcgccttacgtctatccaaataaagaatgcagttgtgtgtagccttaatatcatgtctgcctggagatgttaaatgagaaaaacaaaacacagtgaaactaggtcttgtccaatactcatctagttgcctccattatttataattctatgaccagatgcctgtcccacgctatttggtgtgtgagtgtatctctatctgtctatctggcatctattcaaagttaagagatctaagtagaatagcataaaaattatctgcagagtatgaggccatctaataatgacacttgcaatttctggcaccagtatgtgacagggactgtgttacctactctttacacatgatttcttttcatattcagaactgtgaggaagtctttgtggtaatggtaaatgaggtaggagtttatatcagacattctagtaacaaacttcttggcattgaatcttgattttatcatttgcctgaggtaaagaaacttgcccaaagtcacccactaataatccaaggccaaagtctgaaatcagttttaacaacaaaaatatttttcctcccttgaatcctctttctaaaggatgcaaactccctcccctgccccggggggagggaaacagtattttttttttccattatatactgggttcttccatcatcatgtattatttcatactttagcaaaaaccctcagagtactgaccttcaggatggctgaaagaatcccaattgcaaacattctgtctcattctcagctatgtgacatttacttcacaaatatgtgagcactccaattaggaagcaatggttacaggtagtgaagacagaaaacactggtcttaactgccaggaactttcattgcaatgtaataatgtgaatgtttcaaacatctgtcagataataatgtacccttcctctttactgtgacaacattggctacatttttcatttttattacatagtcactgggatttcataagaattgtgaaacttctctgatcccatccatagactccattaaagcctttttgtcttaattctcaactgtcacctgggaacatacaaaactggtttatttctcataaaatagtcaatgacagatgaaataggagttttaatatactttttttttttttttttttttgagacggagtctcgctctgtcacccaggctggagtgcagtggtgcaatctcagctcactgcaagctccgcctcctgggttcatgccattctcctgcctcagcctcccaagtagctgggactacaggcgcccgctatggcgcccggctaattttttttgtattttttagtagagatggggtttcaccgtggtctcgatctcctgacctcatgatccgcctgcctcggcctcccaaagtgctgggattacaggtgtgagccaccgcgcccagccttgaatatactttcaaacaaaatggaagcaaactaaacgagatgttccccctaaaacaggctgttgtttttcagtggatttcataagaagaaaatcattttaaaatgtattaagattgaatgaaaaataacagtgtagaaaataaattatttcatgttatagccaataaataaatcaataactctaacatccttgatgagtggttgttacatgctagtaactgttctgtgtatttacagagaccatcatttgatcccaacagcgttatgagataggtattactgtcatcctcgctccagtaatgaggaaacagaagcacacaaatagaaaaaatgctactaatagactacaaataatagcttttcttgaaacagtgctaaatgccaagaatattgatcatacctaatacttgcttcaagtgtcgaactttctgattcaccagaatttcataagtgcatactctgcagcagacatcgtgtttattttccagtcatttcttctgtaacatgacataggttcttaaaaggtcaccttgccattcaaaagtttcccatgaaaaaacacaggacttacaggaaaccgggttagagatacaacactaagaaacatcatcagtgacagttaaaaaaaaaaaaaaagaccagaacctaataaaaatagtggcatgattttacatatgtttaatagctaagaaacccatgaatactacaataaatgtatcactttacctgataaaaagtgacctgaaatttttttcatggaagtggatgccagcaggattgctgcaggaggttgattgtaaaactgtggaagaggcaggcttacaggcagatgctggaatcatgggtgtgagtgtgcattttgtgtattcccacatagctgacttctgcaagcagcagcttaccgtgttcacctagtgtttcttgcagaagaaatcacatgtttacaaacatgaactttgtggtatactcaaattgcttcctaatagatcaatttcttcaggatgaatttgcagtttcaaagcaactacacagcacacactgacctctcctaagcagaccaggttaagtactgtatgagccataacttcagaaaggggcaaataaaggaattatcctgactggggagatggggaatggtttatgcagaggatgcctgtggattgagcatcaaatataacaatagtatcaggggcagagcagtgagcagaggaaggaaaagcaagagacaatatacactatgaagaaatgattttgtgggcaaataatgcatcatgaattctttagtagttgaatttttttcttttttttttttgagatggggtttcactcttgtcacccaggctggaatacagtgacgcgatcttggctcactgcaacctctgccttctggattcaagcaattctcctgcctcagcctcccgagtagctgggattacaggcacccaccaccccacctagctaaccgttgtatttttaatagagatggggttttgccacattggccaggctggtcttgaactcctgacctcaggtgatctgcctgcctcggccttccaaagtgctgggattacaggagtgagctacagtgcccggatgaatatttattttttaattgacaaatacaaattgtataatatgtatacattatgggatggctaaatcaagctaattaacatactcatttatctcacatatttttgtgtgtgtggtaaggaaacttaaaaatggctctcttagcaatttgcaaatatagaatgcattgttattaattatagtcaccatgttgtgcaacagatgtctttcttgccttcctcctgcaactagaatggagctttctgatggcgggaagcatgcctggcgtgtcacccttgtgtgcacagcacatacgccagtccaggcacttgtatctcaataaaaatggcgaacttagtgtgctttaagtttgatcagatttaaaaagataaaagtaccaaaactaaaaaataggtaaacccataaatggatgactgtacaagtagtggaagagtaaggtttttcatatacagcctatctgaaaactacagctaacagtgatttgccaaacatggtcaagcattaacatcccctaaaccaatggtttgacaccacgaaatagccgcataacacttttctgagtaaattaaatttttatatagataaaagtggtgattcattagtattcatatattgttacatcatttttatggaattattaaagacatcaatagtaataagatgatttctcaaaaatgtgaaattgggtttttcctgatagttctagtcttatatctatccctgtgccctgtgaattatttttcttgacttccttttgtgtttttgaacagtactgagaatattctggttttcaaagttgaagacccatcattattacaactattaacagctttccttgaaatctatcagaatattcttcaattaaactgattttgaaacctacacaggagagctggcaaattccagagttggttgtgagcactatgtaacaagttttcaaatttcttaacatcctagcaattgaaaattagacacggaactcagttagcactaaatgttatatgatcttataaggcaataaaggcatcttgtgatatgcattcatattttatccaacaatgaactatttaggccaagatgagaaaatggcatggagcatgttcaactgagctttgcctggcattgaattcaccacatatttatgcactttaatagaatatttgctggtacatttctatctgactagacatgaataggagtgggctttataaacactattacttaatcaacaacctatacataaagagtttaaaatatataaagtggttacagtgaaagccgtatccttagatctaaaccccagaaacctaacctggcagaaaataaatattaacagataacatttcctgggtacttattttccaggctttctgctaaaccattttcatatattaattggttacttcttcgtaatgaccacatgaggtacaaactattatgattttgattttacagttcagaaaactgaaagacagagagaatagttatagctatgggttctgcacatcggacttttttttttgtcgcccaggctggagtgcagtggcgtgatcgtgatcttggctcagtgcaaactccgcctcctgggttacaaataaaggaaagtgatgtgaaatacctaaccttaaacagggcagtgcattatacaataagcatcaggtaaaataataaccatgggactaaatatagatatgctagaatttactaaagaatgtactaaagaagatggtggggtgaaaactcataacttcagtgtgagcctcctacctcaccaaaagccaaagagtcagtagcctagcttccctgctaggcttagtgggagcaggtccctggggaccaatacctctgagatctctgtggactgaagccttcttagccttcatacctacatatagtcatgtgccacataatgacattttgataaacagattatatttttatcatgcttattctttgttttaattaattaattaattaattatttttgagatggagtctcactctgtctcccaggctgggaatgcagtgatgtgatctccgctctctgcaacctgtgcctcccagattcaagtgattctcttggctcagcctcctgagttactgggattacaggcacccgccaccacacctggtggggttttgccatgttggccaggctggtcttgaatgcctgacctcaggtgatctgcccgcctcggcctcccaaagtgctaggattacaggtgtgagcctatgtttaactatatttagatacataaataccactgtgttacaattgcccacagtattcagtattgtaacatgctgtaaaggtttgtagcctaggagcaataggttaaaccgtttagcctaggactttagtagactatgccaccaagatttgtgtcagtacattatgatggttgcacaataacaaattacctaataatgcatttcttagaacacatttctgtcattaagtgatgcatgactgtacttattaaaaaataaggctgggcatggtggctcacgcctgtaatcccagcactttgggaggccgaggcaggaggatcacgaggtcaggagatcaagaccatcctggctaacacggtgaaaccccgtctctactaaaaatacaaaaaaattagccgggcgcggtggcacgtgcctgtagtcccagctactcagcagactgaggcaggagactcgcttgaacccgtgaggcagaggttgcagtgagctgagatcgcaccactgctctccaacctgggcaatagagggagactctgtctttaaaaaaaaaaaaaaaaaaaaaaaaaaaaaaaacttacatattacttattaatactatgtgctaggccctacactaaacactttacaaatacttatttaaccatcaagcaagacaacattatgaggtaggtactatttttatgctcattttgcagataccgaagctgaggagaagtaatttgtccaaggtcacaaaactagtaaatgggaattgaactcagatagactagctctagaatctgcattcttatccactgtgctatgtcaagaggattcagggatggaggggctgtagaaaaaatatgattagtgaagtttatttcagttttcacatactttcgaagtgtcaccagagactgcaaaattttttaaatgaaaatcaaagtcttgatggtctctagtttaaaaatgatgaaactaaacacttcataaaataaacatgatagttgtagagtcctaaattgctaagtagtctttgttaagaaaaagtatgtatgttactgggtacatagtcaaaagacaacaaattgttccaccaaaagacgcatgtactcacagcacttttcacaatagcaaagacatggaatcaacctaggtgcatcgacagtgggctggataaagaaaatgtggtacatatataccatgaaatattatgcatccataaaaaagaacaaaccatgttgaactgtaggccatttttctaggtgaattaacacagaaacagaaaatcaaatacctcatgttcttacttataaggtgcagcttaacattgggtagtcatggagataaagatgacagtagacactggggcctaatagaagagtgggcaagggttgaaaaaataaatattaggtactatcttcagtacctgagtgtggaattattcataccccaaacctcagcatcatgcaatatacccatgtaataaacctgcacatgtacccctgaatctaaaagttgaaaaaagaaaacatatgtgtacacacatacaaatatacataagcatatatgcatgtataatttataattataaataataaaacaagaagtctgaataatttcatcaactgcaaaattcactcataagcagagaaacagaaacaaaacctaagatcccataggtttgttgacatccttttcctttttgaactaagccatggtttgcaaatctctcataagtacggtgacagtggtgacaaaaattgtctatgtctataaagccctgtgaccatgtaaagcctttcttgaacagtgtaggctggcaaggtggaatgacattaaaagtctaaaggtatgctagtagggaaatatgaactttaaaaatatgaactaatttacactttaaagagtcattaattcaacattgttttgtctttctatgttacattcattatgtattatagtcagcagctggtagctccttttaaccgtttggagacatacatattcaaattaatgttggctagaaaactgtattatttccagacgagatggcaaagttgtctttgatttcactagggcctctgtttgaagaattaagatcagaaatgtccaggcagccaatatgtctgatggaaatttttgtatagcgataggctgtttaaccagtgagttataggtaggaaaaaggtgtccattagacaaacacatgagcctatccattgtatgtttatcaagtgccttctttgcagacaataataatgtcccagaaagacagatcctgccttcatggaacttaaggcctagcaggaaaatgggcagaaaaatgatcaagatactgagtgcataattacaacagagacaaatgatctaaagaagtcctttgagagtgtatcagtaaagaagctggcctagacttgaggctgtgagtgcgggcagcctgggatgggcatgctaagaagaaaaggaggaacgttccatacgtaggaaaacaaaaataaagaaaaggggcatggagaaaagttctgtgattgaatgagtacagttcattcatgatctaaaggacagcccaaatggacggaaccctgggaaggcaagacaggggatcagggggtcagggagttgggaaatagtggacaattagtctaaaacagtaggcaagcacaaaccatccaaactgcaaataacacaactccagaataaggcgttgcatctcattagtaatttgacaatatagagtagacaagccaacatcactagatcttgttcacttgtcacttgtgttttataagacagaattaagcaagaagatcttagttttcagagaaagtcaactcactattcagcagatagggaaaaggcgtgcctttctagaaaacaatataaaaagagacatacattaagataaagacttctcaaaaggccccagaatctcaatgtaggaagaaatcatggagtgtgaaccctcttttacatgtatgaaagataaaacctaaccacaccttaatcaagattacagatttctatggtcttcatgtctttatatttagctgccacttcaattagaagtccttcaaatatgattaaaggtttactctgaactttaatataagagacttctgtagggcaagcatgtgcatggattgacccaatagcattcaatcaattaatacatgcatatgctctccaataactgtgcagagttattgtgctttcctttatttatcaaaatgccctgaagattgctttatctcctagccatagtcgttcttgacatcgctttaagtgttcagacccctactgcagtcattttatttgtaatagtgccttgtgtgttgtgtctcctagctctacatacaaactaccacgcttacaatctccatgaacctaagtgcatcagtggcgctggggatgctatacatgccgaaagtgtacatcatcattttccaccctgaactcaatgtccagaaacggaagcgaagcttcaaggcggtagtcacagcagccaccatgtcatcgaggctgtcacacaaacccagtgacagacccaacggtgaggcaaagaccgagctctgtgaaaacgtagacccaaacagtaagtaactctccgtttctttcatcttcccaccctgcatcaggaagctctagaagatgtggggtgtgcttgcctctctggagaaatactgtgatcgttcttgtcttatgggctgggttgccttggtgaatgccagcttctgctcttttgagtttgactcattcctgccaccattttctttttgttccttgttggaaagaagcttttggaggctctgcttcagaagtgtgaagcctcccccttcccttgcttcttgtcctctggtactgaatcctccaactgacaaatgcacctatcaggttgttcttttcttgcacccttcctgctaaggcaacaactttttgtcagggaaacttccatacttaatgaactgtatcggtgggaattaattaggattttggaagcgaaacttttttcctctagcatgtgaatgttgaaaaagttattttgtactaatcaggtcttctagaaacatataaaatattggaaaaagttgtcaaatccaggtacacagggccagacactaccatgataacggcatcatactgtggggaaaaacatatctaccataccactggagaagagttttattctatgcaagacaaaccttagggaagaaatcaaggaaaaaaaacattggatttaagatgctattatatggcatatctgcaaaactctaggagcctttagtcatgcatgcaaatgtccccaggtaaaatgggcatatagctatcactttgtaagtaacacaagaccagctcaaaggttaaatgcttagaattcccaattgctaactttactaacaatatggtggtaagagtaaatttcagatttaaaatactagttttaagatttgttttccaggaatattttggctagttgcatttagaatgaggcagattcaaatatttgtgatacttcctgttgtttaaggcagaagggatttcaggttatccattaagtcattcacgacatactgtatttcagttagaagctgatcttggtgtcaaatgcttaatgccaaatagaaggaagtctcaattttaagtactcttgaagaaatcctttttgctctgcaaataagagagatatctttaataaaaaccaagaagccaactgggtttgatcctgacaaacactacacaaagaactgtgattttggcctgtctctatttatgaatagttgagtgaatgtcgtgaaatactttgaaaatatgtagacaaagtaacaaggttaattaacaacattgtgggctccagtttgactttgtgacagaagtcctaggacaagtctaaaggaacatactgagaagggaggaacagaatgaatgatataggctctgttgtgtctccagagcaagtggccaattgagaggagggcaagtggatggtgacttgctgtggcattcagtgtgatgtaggaagaggctttgggttgagacatacctgggttcaaatgtaaaccactccatttaccagccatgtggcattaagaatcactgagcttttctaaaactcaacataattatgtataaaagagataataactatgtcataagtgtatcacaaaatactatattgagaaaatactatatcaactaaatgtcaacgtctttcccttcctgaagaggcaaaaagctttgcttagaaataagtttcagcataatttattaagatatagtagctaaaaagatgcagttaagtgtagattaaacaccacagggtagataaaactcaatcctcaaaagaagaatttatggctgggcgtggtggctcacgcctgtaatcccagcactttgggaggacgaggtgggcggatcacctgaggttaggagttggtgaccagcctgaccaacatggagaaaccccgtctctactaaaaatacaaaattagccgggcatggttgcgcgtgcctgtaatcccagctacttgggaggctgaggcaggagaatcgcttgaacccaggagggcagaggttgcagtgagctgagatcgtgccattgcactccagcctgggcaacaagagcaaaactccatctcaaaaaaaaaaaaaaaaaaaagaaaaagaaaaaaaagagaagaatttatatgaacatatgtgtgcatctattatacctatacctgtattgataaacatatatgtatatttataattagtggctttttattataggttgtcttgtcaaatttgcatttcataaaaccttttcttgcaaatattccaataacagctttatttttgtacacacacacacacacacacacacacacacacatttaactagatactgttcaaagtcaataagcagaaaacataattggagggctatatttactggggaaaaagacgaaattagaagttttgagtttagacaattcaatactatgctacttaagaattgttaactttcaaaaaacattactactgttgctatttaatgatgaggtgcaatccttgttgaggcttttttgggtatgacattggttgttaaaatgctaacactgacattaatgctaatgcttgcataaggtactcattgaaataggcattatgcggaatgctttgtgtggaatgtcccacttactcctcacagtagatctatagaatagatattgttattcttattttactgaggaaaccttggcttcccaagattaagtaacattatcaaagccacacatgtggttaacagcagaggttggactaaagcccaggtctgactcttcaacccacgcttgttcctctttgctcctctgtttcttagaatatgaatggcatgtcgaaattccaatgcaggaactatgcttttggtttccttatttggtaatatcatttgtatatgcagaatataatgatgtttggtgggagattctttaaacatactgtaacgtattattgcttgttttgtctacaaagacaggagtaacctgagctcaaagaaggctgcccaggtagaggcctcatttgattaatttaaaaattgtattccaatgatttcatttggtatctctttccttgcaaaagtttcactgggtctttgttgttgttctagtgtctacatagagccaaggtaaacaattcagaaaaataaaataaaatagagtctttttctcaccaccagctggaaagatttttttaaattgctttagctctttggttattgtgtagacacaccctaaaacaccatgaaaacttaactagatattggctaaaccataggaggagattcatgtacctccaaacattggggtttctgatgacccaactctcaaaagtcccaaaaaagaatccaaagagcttatctgcacaaaagctgtccaacagtactttctgcagtgacgatcatgttttatgtgtgtgctgtctaatagagtaagcactagcacatgtggctattgaacatttgaaatatagctactcaactgaagaaatacatttgttattttacttagtttttaattaagtaaactttatttacattgtatttaaatttaagcacacacttttgactgaggctactgtattggacagtgtagctctagaaattgacaaggattttattctaggaaactcaatttgagtccacattggatatagctcccaaagttttagcattgatactgatctaggacaaagtcaaaactcaaagaaataaaacatttgagatgagacaaacatacaaatagtcatttaaaatgatctcaaaacgagccactaatagggaaaaagtaacatcatagacagcaatgacatttgaaaaaccagtccgcagcaatgcaaaaatgcatgtatataggaaaagaacgatagtgaaaaattcaattaataaaaacagatatgactatgctatactaggtaacattataatattctgtttaatgccaaatatagctaaaattatctctaatatcttaacttttgtaacagagataaatgacattattttctgaatttaagctgactggttaaaaacaaacaaaaacgtagctcatgcacttgaaaaaggaatttgtctctccagtgggcaaattctgtacaatattttctgagggagggtgtctgagaggaagtagagtttacactatgagctacaaagtaaatagtggaacagaaatgtcctcttattcattgttgctctaaacacttagtctcaatgtatttcaatcttcagtgttttcacttttaacagctctgctccatcactgcagtttgccatctggtgcatgcatgcttctactcatccaactccacactgcagctacatgtctacataaaaatgaatttgcttgctgacttaatatgggaagacatttatactaccatattttttcctcaagaaatataattatcctcttagtttgcttccttagctaacagtccattgtatgaaagaaaaactccattatgtgtggaataaacaaaaagtaaatctcaaaatttcaatttatctgcgcactgctggcatattagatattcagagttgggccaatgcttgctagtctctgcacttagattgaaaaatagcaagctcagagggcatagggctgtagctcagctacttactaaattttatttatgcaaataagacttccattgctaaaagtgtaaaagaacctggcctcgtttgaatagctttatatctggccatgatgatgccttctcacattcctgtctaagaagaagggcacctcaaactgtttctcccacctgcatcctgaatttggcatgtttccctgtactttctacagttcacttggcagatgtatgttcatggcaaacttgtagatgccagataaacaagatgccatggttgtgcttgggctatggcttattgatggccatgacgatccttttcaagttggatggataatattaactaagaggcagcatggctttattgggatgggcggataagaactgcagccttcttcacctggactggtatcaaccagaagatgttctgtaaattgtctttggctctcatgctttctttagtaaaagatcacagtgaagagaggcctggccctaagctacctttctcttaagctaccatccattttctaagctaatgcccgcaagccgtgcagagaaatacttcaaggaccttagctagatatagagagtttactctggcaggtcagcagcaactagagatggcaggcgggtggacagcgagggacacacccttttttttggatgtggagatgtatgactgatgaactcactctgggatagagactggacatagactacctaaaagactggtttaagccaattaacacattgtatgatgaaccacatgttagaagaataacaatttgtacctgaaatacaaaataagatatggaattgtattctgatggtgtttttcttgtgctaccatatttgcatctacaataaggaaaatacataaataacaacttgtgctgttctcaacaaaataaatttgttacataaactaggactgtcaatataaggaggtatgttatttaaaaaaaaaaaaagaaagaaaaagaattcagactgctggaaaatggatgtgggcaccaaaactctacacaaataatggtgcctagaaaattctagaacacacttctgtgctgtgttaatttgttatggttcttgttttgttttgcttctccatttgtttggatccctaacattctcaacattatgttacttgtttcatcctcttggactaaccacacaggctggacagcatgactggactagggtgagaaaaaagggctggcaagaagaagaaaataatgctctgagcagatagataaattatgtttgggctggttccctcagctgttctaactcaagcaagtaaaacccaactcccttaactcaagaggcaccagtactcccatgttcagaggtacctgaattgaggtgacctggtctaccaaaggatattgaacccaccaaaagagtgggcatgatgtgtatggtctctatcgcagccttttcccaaaaggaaaataataataataaaaagtaatattgtgtgcacatttattttatacatacctatatatttacttttcctgtagactgtataccaccagtaagaaagagtgtacaaaagtctgttacttggtacactatcccaccaacagtatagcttttgactgctttcccaaaggtaagaaaacaatctaattcttatttatttatgtgttcttgtctccaatgagaattagaaatgtttccatggaaactgtgcatgattacctgaaaatatatctataggaagaaatgaattttcaaagatgatcgatttgataagcttagtgccagcagctgccattggtcatatgcctgcttaattttctaaggaacacgtttatgagtatatacacatttgtcttcctgaacagctagccagtaattgcagagaactgttgctggtcattccgacacatgctctactttaaaactaccagtggtgaaaaactatttctcagtatttctcaatgtatgttttcctactgtgggcttagaaggcagtgtggaaaacctacaaggagagaagggggatgcttagtaaatgcagacctagtaaattgtttgttctaatttatttttagtaaatacattcaaagaagtgtacacattcctaaaaaagtatccattgaaatagcaacaaatggcctttccatctgtaattcaaagttgtcttggttccttctctgcagaaaataaatcggtttactggccgggattgataatatgttgatgatgatttgtggctcatagttctgcctttgagaaacactgaaccaactttagtcatcaagtcatcacacaaaagcagaaaaagggtcaatgaaagaccacaagggtctaaagattagtttgaacattggttatacccaagaaataccaataaatgccaaaggtgttcaaataaatagattagagaaaatgatgtattgtgtgatgtgtgaactggccacatgagtgggctggcataagaataataatggattcaccacagatgcttttatattgctttaggctctcactaaagaaaatatactctgaaaggatattatcatcacgctgtttcagcctaagcaatattacacgacagtggaaaacaacacttgctatggcaagcatcctcatccacgtggaacagggcattccaaactatggaaaaatatgcagtagagaacatggaataagttattaaagtcatgtggtggctttgagtaaaatgttctcttttgattttctctgaacctcctattgtactcatataatagagagacctgtctctagagagattccaagagagtaagcagtgaggtcataccgcaggaggggaaaaatattgcttaatgatgtagactggcctttctctttcctacactgataacatgggacttttatcagatcactgttctggttcttcccatccttgtttgtgtaatagtattccgaatataaataaaatctttctctctctctcttttatccatttagtatggtaaaacagcataagagtacttccaaagagtaatgacattttctgttgactttagatggatgccagtaactcggtctttaatttagggtatattgttcacatagttatttcctttttccctatcaacatgatctgtcctagtttttaaataggccattctttctcccagtgaatatgtaactgtattcccgtgagatttcaagttttttttgtagtacaagtgctagtcaaaacactggagctcaacactttaatagtctttttacgtgagactgactgagaataaataagaaggaattttcctgggtaaaaatgatagatttaatctcaatccattaaaaatccttttgctcctgtctaagttgacgcctttgggtttaaagggagtcagatgaaaatattttaagtcaatcttttggttaaaaaacacttttaggatatacagattagaagtaaattcaaacttgtagctagaattgtcttacttcaaagattttgatgagataaagcaatgaggtcacatcatgagaggggaataattgcttaataatgtggactggtctgtttcctatgtcaatatcatagggcttttattagtttattattctatttcttcccatctttattttcgcaatggtattccaaatacaaataataattatatttggttcccttttctgaccaatttaaatgtgactttaaacattaatgataaacattttgtagaactgcttcaaaataattggggatataagttggtttaagttacattaactcaaggaacacgtgatttacttgttcaggtcagtaatgggactagtaaacttgggagggcaatgaaagaagtctcttaaggttatgcgttcaaatccatttctaagtgattgcttttggggagacaagacagtaaaaagaaaaccacagattcaagagtaaattttcatattactgtgctattaaaacttagtgtcaggcatcatgttccaacaaagccacactgtttacagcaaatcaaatatttgcttacagggatttgaaggaagtaggttcaaattcagatggaacataacctaagcctggtttgaaaatgcattctgtaacatgccactgtttaaaagcactctcaggtgacaaacactctcagccaggcatcagcagaatcaatactttctgcatcctttacatgaatatttataaattttaaaactctgcaaagtgttatcaacctaatgacatttatgtcgaaatgcaattaggtacaaaataaaaagcacaattaatctggcatcatcaccatgactgggtcaggaaataagttttgttaggaggtaaattttcacaccctaggatggtatttggatgaaaaaactttgagagtataattaagccttgcgagaatgccaaacacatgaattgtattattgacatccattattgaatgatattataaaaatcatattggtttattgtaatgaatgggattatttggcaattttaagctttttggaactgtgcagtgcaagttttcgtatcatgttgggactctccctctttaacattcaatgtgttatctctgctgtaactggagaccacctccacttaaaattcactttgaaacagtataaatacagcaaagaatatatgttatctgacctttgacactaaatcaccttgggaataaatgcagctataaatctttttggcatatttctctctgcctaagaggtctgtgagacaccatcatttctctcgccaaggcttgatatctcagcatatcttcaaaatccaattaatatctgccgtcttggttctgcaactgccgtcttaagttcaacttaaagaactggatgaatgtttacatggctactacttctctcattccttgcataaaagaaatgtacacatcatatctcaaagtcacaaaaactatgtcaagttttacatatatgcattgcactgccctatctggtcaagattttttactgagtatccttaaattgggtcaatcaaagaaatatttgccaagcacctctcctctaggccatccatgaactgactaggagtgggggacaggaggggacaatgccttcagggagctcagatctgatggaagactcaaaggtaagtaatagactcaaaggtgacaagggctcttcctcaaggtatgtgccaagtgtcaccaagctacaggtggagaccatcacccgggatgttttgcttgagttgctcttaaaagataaagggctccaggcagccataaacggaaaggcactcaaggtaggggaaagtatacacaaagaacctgcagtacaagagaatgtgacatgttctggtactagaaagcagttacgtgaggctattgggctttgaagcataccgttttcgggaatgaaatgcaggaagcagcctgagggtagaaagactgagtttccttcgtctttgtgcctttaagtacaaaggctagtaagtactaggctgtgagaaaatgtgcttggaatgagtagcgcacaatacttcccataccaaaggctcctgttacctagaactcggtagatgcacgggaaacatttataagtgaatatttgttagcaataataataaatattataaaaataaaaacaataataagtctacagcctcagcaggtgaaattatattcttccagataaagcctctaaggtcacaaagcccaccctaaaaatacaatgtataaacgtgatgtcacaggtttcaaaaatatggtgtagttgtaatgtacagctcctgaaatgggtgtcagtgccacatctcagcttgtgtaattaatttcttttcttgtgctaaacccatttataaaccaacgaagttttatgcctattttatttcatgggccacagatatctatactttcaaagtgcacatgaacttgaaagattccactggacatggatcctaaggacttgctttaaatagttatagattctaatttggtaaacacaaaaacataagcaatcaaattggtggttttctgactgttgagtgcatttccttagagactgtcattcaggacagattttgtctttatcatgataccaaatatcatttgtatttaaaaaacactgtgtatcctaaaccaaggtcagttaatctccaaaatctttctttcccccaatcattgtgaatgagcatcttcccaatattcaagagaggtgacccttgtgactcgtttccatctactaaagatgtatctcaactttgcagatttttttttttggctgtacagtggaacttggattacactttaaattaactttctctaggaatcaaaggtaatcattatttctctctatgatctaaatgactattctcatgttttttttcaagttgaagattagttttcaattccctttatatctctgccctttttcatagtaacctctgaggacctcagcttgcacaaagaggattgagataacatttccaaagcttgttcttcttgagctgacccaacacttaggaaaacatgacatggatcagcaactccattttctgtaagtgttggtccaagtattggttataacctggcatgtgctatctttttctctggtcaagaaaaagaaaaactggactgggagtcccatcctggctctgatacttggggtagcataagcttcatcacttaatggatctctgattgtggataagtttcaatcctcagtttcctctttaataagatggaaataagctaatcttgatgaggtaccatggaggtggcatgagattctgtatatgaaagccctgttttgaagggctgactgtgcatatgtcagggtacataagataacattgttggtctctgctcatctggtttttttattctgttttgtttatttatttatttgagatggaggctcgccctgtcacccagccaggagtgcaatggcatgatctccgctcactgcaacgtctgcctcctgggttcaagtgattctcctgcctcagcctcccgagtagctgggattacaggcatgtgccaccatgcctggctaatttttgtatttttagtggatatggggtttcaccatgtttgtcaggctggtctcgaactcctgacctcatgatccgcccacctcagcctcccaaagtgctgggattacaggtgtgagccactgtggccggccctgtgttttattttaactggctttcctttctcttttttgttttcgttacatttttgtctatcataaactctcagagttggaagtcatgatatctaggattgccaataaagtcaggcaaccttttctctaggtacaacaatctctattttcaagatagtttactgtggccttttgatgcatcattagtagtcttttggcttggtgaaattgagagagaaggctatcagtcactcagcaaagctgctatgggacagataggctcataccacctgatatatgaaccactacatgtgattaacttcgacaggtagctcctggccggctggcaagctgaagagcattttaagtacaaataatagttctggggtatgtcttgagtgatagaatgatgactgagtggaacagattcccttaattttagctcatgaaaacacatttggtttccttcagaagctgggatcctaccaaaaaatcaattaacaaaacttctcagagatcttccttgatacttggaagtttggcttttattgcacttatattaaatatgggaccaccctggggggccagactcattcatctcagtcttcaaagggcctatcatgatcatttgcaacaatttaataataatattagaaattttcaccatattttcactattgctgcaaagtttagaatgtactcaactatccattgaagcaggtcttattgacaggtggcaaaactgacttagagcagtgaattaactttctagtaacacacaccaatgagtggcagagtagacacctgtactcaggtctcatgaccagaggtctttctaatgaatttttctgaaatgggattgaatagggtaaaatgtctcagtctacatcatccatctcatcatcatttcttcttctcgtaagttgattctagaggccctcagtttgctaaagattagataggtcctccagggtttcaaggagggaaacataatctaacttcagggccactgtggagtgagatgcatctttctttctttctttttttttttttcttttcgatattgcaaagaccactggatataatttcacttcctcttggattttttttgatggtctaaaaatttaaatactgtacttcctgttatacaaagaacatggtctgctagaacggaaatgtttaattctcagaattcattgaaatccattgatgatcatatttgacatctactggtcatcctgagtgaagtttagccattcagagttcaaacgatgagtcttcatatacagatggttataaaaagactcacctctgcttaaggtaatcaagtttggcatggaaacatgagcaaaggtaattaaactcagaagatttgctaacattaaaaaatggcaatttcctggaacaaaaatgtgaaaagctaattccccccaccccctcatcacctgctcctctctctgcttttgccatagcaaagccctataaagaaactggccaccagggtcattatcagtctgagctgaaaatttgattaagctggcctcctagggttagtatgaaaaatgctacatttttgttcttggaccttaattcctctttccctcatttttgtcatgtttgcaaatttcatttgcatttaatttcctgtggtttgccaaagtccagactgagacttgagctgttgtttttattcaggtgagaagtgcaactgctactgaccatctgcactggcatctagtcaagcgattgtctgaggcaagtatctgtccttctaagtgtcctaaggaagctttgctacccagcccaccaatgaacttaatgatgagtgaaagagaccttatcctgtttgcatgagtttagtcgggggtagttctcatcacatgccagcaacatcctcttaaaagtccaacataattaaggaaattgcactaaagatgtcttgagatcatggcccactagaatattgtctaggagctttatgtaaggaagacatccatggtaccaaatgatgaagagatccctactgtgatctattgttctactgtgatgcaatactgaaaagccagtctctttctgagtactggattctcagttttttctgggtcaagaatgcaggaagagtagcattcatggggggttctgacccattcccatttacaggaaaagaaaatcaaataagggatcagtaggtgaaactttatcattaatgccaagcaagaaaatgctgactctttagaaaagatcatctctctgtgtctaaatttcctcatctgcaaaatagaacctcatatggtagtagtgagaaataaataaaggtaaagggcttagatcagaatttggcacaacagccgttcaaatgttaaccatcagtgttgtgatggcgtcatctcaaattaactggattttctgtttctgtttcctctaggaaaggattttggagattcccatctgatattcttctatttggtctcttgtacccattgtcatcctgtaccacacataataaagtttaagaatgtcaagcaatccatctgcatctaatttttgtttggaacaacctgcaggattttacatcttgaaatatcaacacatctcctgtcttgtcttcaacctatttagtactgatcatttttggagcaatgatgccttaaagccaaaatttcactgtattgtcaaatgagctatctgggaaatcacatttaaacacactcagttttcatttaatttcataacacaacgcatgtttcctgactctaggcataaatacattcaacattttcaccatcatggtttaaaaattagtacctgttagtactcagatatttaaggaaacaccaatgaccaattttaaaaagtcctatgtatggcagaaaatttgccaaaaacaaaccttctaaagtacatttcagtttatacttcggtctaatttaaatcatttgttcccctaacctggtgggcatcaaaaggtcacctgtatttaacaagcttcccagtgattctgatgcacatccaggtttgggaaacagtcttattttttaaattgtccttgataagaaacacatgcaatacggcattgaagtgatggtgatcacttacagagcaaagtgtttttcatggtattaaaatgattgatttttgaaaagttatttgggtttattgcacaagtggcatctaccatgtccccaagaagtcacccctctgtaggctagcactgtgagaagctatgtcaaggtcctctctcaagagactctccagactggtgttgcagactaaataaagctgaagttaattgctgagctctgttactggagcagaaaaacatagcatcacctttgtttaaagctgaatctccatgacaacactcaataagaagctgggtcaatattccttttttctgcactcagtcagccacaaggcctggccttttgtaggcaaagtgtgttgatacatcttatgcaatcatttcaaggcactcagccgaggaagtctacatttttttttagccctgaagtcctcaaagagattatgatttttaaatcttcatttatgctttctatgcgtttctgcccaatcaagtagtgaaaatggtcaggatagtcttccataactgttgctgttaataaatcagccatgatcttgtggagaagcagtctagtgcccaggttaagacttaagatgctggagcccatatacctggattctaaatccaactttgtcgttctccagattgtgatgtggccatgttgcctactctgcacatcagttttctcatctgtaaaattggtataatcttagtaactaccgcatggggcagttattaggattagattagttaatatatatgacatgatgcttaaaacagtgattggcataaaatagaatgctaaataatttgttgtttctccttaatgactatcatcaactgacatatagttgtcaatccatacagtagccactggatacctgtggctatttaaattaatgagaattaaataatcttaaacattcggcttctcagttgcactagttagatttcaggttctcaacaggcacatgtagctagcagctcccatattggaccacaaagttagagaagatttccattatcacaaaaaattaaatagcactgagccacagcttagagaaggtaaaaagagggataagaacgtcctttacagaagagttcctgttgttcttaatactccccattgcttatgagaattgtctataggtctctcaggagtgtttggacccatttcttttgtagcttctagtaaaaagccatttacattgtagagtgtacgacatatattgtgagctaacaaaaatagtttgccagaaatgatgttctcttagttgagaaggtttccccaattcctttcacaagctatgtttaatgctttctattcattcattctatagttgaacctaattcttgaaaaggaggcaagatggcaagtttgtttgtggtcagtacatggataatgactacagtaaggccctgtatctaagggaggatggttttcttagtcaccacccaaatggaagtaatgtgcatattcactcatcatgccatgtttccttagtaacagaaaagccaaattaaatattcaaggatatgaacagaggcttcacccaaccttaaacagaacacttccaagcacttttcacttggattggccaactttgagattcggttgtcagctggaaaattctctttttctaaaaagtcaaattgacgtgtcttatttttttctgtgcatggttagcccttggcaacattgtctgacagttgctttgtaaatgtttcagaaggaaaaaacagtacaggcaaaggactgaagatggctatttttcagcgatcagaagttttatgtgaatcgtgaacagttaataatgttttacattagctagaggagtttctgctgtcaatttatatattgggagagcttttatttaaaactagcatggaaagctagtaagaagagccagcaaaagatatttaatcccagttccaggccagttctatcaatcgggttgagtacactacagctaaagataaacctccctcagcatctcaggtgctcattccagacagaactcaagctgttaaatggccagataagggattgagaaagaaagaaccatgtctttctttctatgaacttgcatacaagctatacatttttaaaaatattgacttctcaatcttctcaataaaatagcatcaatgagtttgtgtccagaagtataaaataggcaaaaaagaaaaatatacctaatttttaaaaattacatcatcatcaattaactattgtaatcaacttgcccttatgtaacattttatagttttgttttattatgtgcttgcaaattcagcatcttttttttatcttcagggtatctcactgaggtaggtgtcattatcctcatttatagaaagcctgaagtaaggctcagagaggctaagaaaatgatccaaggtattagtgacagaagttttagaacccgttctgatccctttatacctcagcatttcttcattaaagagctgtaatatttttgaactaaaaaatttaattttaagccaaggagagaacaacaaaagttatctcatgatagaagattcagatttacaatgcagtgtacaaaatcattttagtttcttctactcatagatgatgagcagtgagtcgccacttgtcaccttatctagctcaagccagaatggaaaatcaatcaagacagacagctttaaaaggaggagtgaattattagcgctacatagcagttcatggtgcatatctccccaaggccagaaggctggcatagctgaagatgagtgtctgtcttgtgtctgagggaggagacagcattccactctgcactttcactcagcttttggctttcagtgccaactattaaggaggttccaccattactgtaggggttataaagacactgcaaatgcccaatttaaaaccaggcttcttgtgttcgaacaaatcgtcttgtgaggtttactaaaaaggttatattaagtctgaaaagaaagaaaagtttgctattaatttacagagtggttactcttgttagggactctgcatggaaggctgagatagagcaagccgtagctcctccaagagtttgcaattaaaaggagaaaggagaacaaattactctttgccaggcattatacattgacttatgccagatgtatgtaaagaggactgaagggggccatttgcaaggggaaagtctgactatggcttaaagatgaggcaatatgggagatagtgttctgggcagagggatcgtcctcaataaagtccaaatgcataaagtggcagcagcagtggcagccatgctgtgtggcacatattgggttcttcccatgcaccagccactattctgtgtacttaatatgtattagctcatttaattatacaactgtatgtgatagacatcattaggctccttttacagataagcaaactgaggtacagatattttaaataattttctctaagtcacacagctgataagtagaggatcttggagataagcccaggccatttgggcccagagatcatgctctaaccaatggactacctcccagtggtaggtaaatacatggtgtgtttgtggaaggtctgttttccagtacagctaaaccacaggccttttcaaccatggcactactgacatgtgggcctggacaattcttgttgcagtgggctgtcctctgcatctgaggatgtttagcaacatctttgacttccaccccaatgctgaccatcaaagacatcgccagaaattgcctaatgttttctgagggcacaattactctcagttaagtacccccgggctactacatgatgggtaagcctggagaagagcagaaaaaacaactagaacttagctgtgaatattcccaaattctcttctgaaagctatgggaatgtactctatatagagaaagatgtcaattgaggttttacaaccaaggagtagcagaaaagataatatgcagaaacactggggcgggaagtattgtcagagaccctacatgctttcggcatcttagcttaggaacaggatatatctgcagactttataaaaatctatgctcaaaaatctcaaagctacagatggcaaagggtaatctctcagaacagtgcaaaagttgaccttagtggtctctgggttacagtcaatcctgacctgaaagttcaaaactcaaagtttgatttcaggtaagaaagattctacatctagggaaaaactgactacctagttttctgaaaaagctctgtcatcagaccccaggtcacctgtaaatgtgaacataattacataaactttagagaggacatctctacaggaatatttactagacagttggtgacaatgggaaaaaatagaagtattcttccttcaactctctacatacacatttcaaaccaggggatatgtatttagagtagttcttataatcaggaaaggaaaagcctatgtactttctaaattctataacaaacaagttacttttatgaaacaattttttaaatttgaaaatgtatggttcgaatggatctaatttgaactgcacctctgttggtgagtagacaacactgatctaatcataaaattcatccattttcaaaaattagcgaattttttttcttttctgctacttattttggctcctactgggttttttttatcatgtcattgggaaggattacaaagaattattttcttagccctctttataagactgctatgagcattttgaatctagtgcagttccaagcttctaaccaactttatagttttgaagatacaagtttttctttaaaaaaataacctgattgcctaacaaaagttatctgatcccagaagaagtgaggcatctttgactggagagccagtctagggtcagagttacaggctctggagttggacctggcataactctgaaacaaacatcttcccatctaagctgcctcgtctgtcaacacagggatacagtaccctctgtaagcaagttatttcaagactgggtgagatggcacaagctaacgtcccaggatgtgatctgatacatagctgatactcagaaattggtgtcccttctcaactagcatttagcagaatcatctaggacttttgggagatcagatctcctttggaacctctcagaaatttcttctgtattcagataagacaacaacctgctttcaacaagggcacatccccgcgactcagtggatgtccctgaactcaagtcagaaacctgcctccctctcccaacaacacatctctctggtctcaatgacagccagaaggacagtggaagctggaattgtaggatccaagcatctcagcatcagcagttctcctgggaacgccaccaagctcttagcttgcattgtagtaaagaaaatacataacagagaaaactgtcttcaacagctttgttttaaaaaagatactcaaatagagtgcctcagtctagatcggtcattctgctaaggatttgaaatctcaaacagctggagattttttcaagcttgacagtttgtctttgaaggagattgctaagcttttagattcttcataaatagtaaatagatttagtcataaatatcctgtaatatgtgctttgttccctttattcagaagcaagttgtaatttctgattaaacacaataaatcattatacaacagccattgtatggggataacagccaccaggaaatgcagtttctgcactgatgaaaggcattgaaagacatgaaaccccaaacatctgccacgcattgttagggaaaaaaaggacacttacaagtatcttgcggcattttaaggacagccagcagctggcaggaatgtaaatagttttaagaggtaagaaagaaattcagatcataggattaggtgatcagtcctcatctcacaggtcattctttccttcccttcataagtgaaaagctttcttcttcaagacagttgttaacagaaagcaagcatccagaaggtggaatcaataaaatcctatgagggcagtgaaaaatgaagccctttttaccctttcccccaggggaacagatgcatgaaattgtttagaatatttggagactgccgatatatgatgtggaattggcaccgccagcatcctgagacatgcttgggattgggcatgagtgagaagctctggcataacgatacaggggaccttgttggcaggctgcccagtctgtctccaaagatgcttttctttcccaatgccattaattctccttggccactggaggcctggttttggaagctcatacagaagatacctgtggttgcattttttttttttttttttttgagacggaatctcactctgtcacacaggctgaagtgcagtggcacgatctcggctcactacaagctccgtctcctgggttcatgccattctcctgcctcagcctcctgagtagctgggactacaggcgcacaccaccacacccaggtgatttttgttgtatgttttagtagagacagggtttcaccatgttagccaggatggtctcgatctcctgacctcgtgatccactcgcctcggccccccaaagtgcgggattacaggtgtgagccaccatgcccagctgcctttatttcaagtcatcccttcaggcctcagtaagaattgaaggagggtaattaaacgggtggtaggatggtaggagcttcactcagaaaactccctgtggatggtcagttcacagggattcctaagagaagatgttcttcactagagatttggaaactgaacactaagttcaacagaacacagtatccttcatgcattgaaagcctgctaatcactgatgatcttcaattagacatttttagacactaagctccatgacagtgggaaccgttgtttcctctttgccattgcatcttcgtcaccaagcctatggtagataggcaatccattttttacactatcatataaaatacaatggagtttcaatgcatgcattttcagctaacatgcattggaccacatgaagtctatatagaagaaaagggagggagcagggaaggaagtaaagaaaaaaattcttcttcctactttccttcttcaacctagaggcaggcccccacttcagaaggaaaaatgaagcctcaacaaaactgcaaagagaaactgagtaaataattgtgggctcttcagctactgaagtctcaggccttagtgattaatgaataatttaaggcaatgcttctcaaattttaatgtccataccatcacccaagaatcttgttagactgtgggtgtagattcagtaagttgtggagactccacatttttcacagtctcctgggtgatgcccatgttgctggtctttggagcacagtctggataatgtagatttaaaggattctgaaagaaaattttgactatgtacaacctttgccatgcatgctgatttaaaaacctaacccctatggcagatatgagtccactagtcataaacattttaatctggcttcaaagagccattatataactacactaaaatttaaatatgaaaacttgatgcaattcaattggctattgttatctaaaggtgtttctgtcttagaaaacaaaatatactgcaagttataatttcacttaaaagatgctttaagttattcttataagtacaatgatttgaaacacttaaacacgtaaataataaaatattcaaactccatttgcactgtcatatatactgatcctaattacaggctacagattttcatctaattgcgaacagtaagtcagctcttgaataattaggaagaggatgggatgcaacttattggaacagtctcagagtacaaaaacacttttttcaaatgtcactatgacattttaaaaaatacactgaaatacagaggagatagtcataacaaaaactaatgaaaaaattaatccaacattaggatctagtagcaagatgatcactagctaaaatatggatattctatctctatggttctcagtactgactgctcatctgaatcacttggacaccttttaacatacacccgtgcctgggatctgtcacccaggattctatgtaattggtttagggtaagtttccatatagctataagtttaaatatctccccaggtgaatctaatgtcagctagaactgagaagcattgctgcaatgtagcattgctctaatgttctccactctgatcttaggaccagaagcatcggcaatgtctagaaacttattaataatgcaaattttgggaccccactccagacctgctgaatcagaaactctggggtttagatccattaatctgtgttttaacaacccccccaagtaagtccgatgcatgctactgtaagttctttcttaagaaagacaagggtcctcatcgatgttcttactaaaaaattcttatgagggttcattgaaagatttcacattaagacttttttttttaatctggtggatggcctacaccctgggctgtggtgtttattctagagatggctctgccacttccaatccgggagtttcagctatacaggggatcttagggttattaaagattttattttaattgtgccaatctaaaaatgtgatcttccataatatgcttgaatacttctagtgatagggaaactactaccatctggcccagtctttcccatttgcttactaggcataggtgctatactgagcattttacaaagataattcattcatgcttgacaattatccttgagctagttgttataatatacatttgatacctgcagaaatggaggcttagagagactgtgtaagttactaagttcacatggcttttcataaagcttgcaccaagttctgtatcttgaggccacatacaaaattcattttcaaaaatgattacctataagctgttgtcagaatgaaactgtcccttcatactatcttgtctccaaaataagaagcccttgttccttgcagccaatttctaaacccatccatcatttctgctgggttccattgaccagcacacaaaatagacttaatagattgtccattctatgcatccattcaaacagtgatttttcatgtcttagtgcatataaaacatgataacattggtaaagcacactgggtaaactggagaggatttagggaaatgtatgtaaagcttgctgaaaaaaatcacttgttatttaagtatgattactaaattcaaaagttttaaagcggttgaatgtttattttgtatcaaacttcaaaacctagtattttcaacgttttaaaataaaactcaggcttgctttcatgaacagctatttcacatcaatttatatgcataaaagagttataaaaaaattcctggtcaagactttttgatgatactctcttcaaattctttatagagaacataaatgaaaaacactgagtgaatgataaaaagtttgagagtatttttttctataattcagaaatgtgtaacagttgaatttatatttgaacaatccaatagcttctcttttattgaaaaaaatgtaatattaaaatgtcttttgataatatgaattaatttttaatcctatccaagctttaagtttttaaaataacgatattttaatttgttgaatacactgcactgttgtcatgcagctagccaggatgctaccaaaagggtacatcagttacaatagaaagaagtattcaatatatacgtgaacacaaatatatggactggcagctggacctagacctgccagaatgcccatccagccatctttccctgatgtccccaaatgcctggctctctgggcatatcctggagctccacagggctcttgtccaccctgggcagtggaacatatgtactgaacctcatgttcaggtggatagagaacctccttggccatgctttacggcagaatggcaagagctggatatcattaattgttcgcttaactatagaaaacctgggacaaatcaccagttccttctctgttcgagaagccttcaagactccagacaaggcttgtgctggctagacatgataagcaagattaccccccaggtcttgacttgctgtgccaaggtctagagggtgatccctctagagtatctcatatactctacacatttctgaagccctgaagcccaaaatagcttcaccttggccaactctcctacccatgtcatccttgaatgtgaaggcctttttgaaagaaacgttcaggacaaatcaaccagggcacaaaacatctgaaagaacttcttagatacaaatgattattctgggtggcaatgtttactctacaattactcattcgaattaaaatttcagagtggcagctgctagcatcctaccccacaatcattatctaaacaaagtccagtctgaagcctacctgcatcaaaatggcatgaggtcattgtgaaaagtgcaggactatggatccacccaaatccaaaccactcattccagctagggacacaggttaccaattgataacaaatacaaaactgcaactgtgaaaaacctctgaataagaagtagagggaattatgaaacaaagctacagagatcaaaagcagctttcttaaaggtttgtgtgaacaatgtgtaggcattaataaacacaaaatggatgggaaagctaggcaaagagaacttgtgcaatggccatgctttgggagtatggtaaatgtaaaagatcgaagaaaggccagtgtgactagagataagagagcctcaggaagtgtggttcaagaaaaagcctgggaaattaatatacatcaagtggcaccaatatttgcagaccagttcaggaatgttttgactttattctaagagcattgggaggacatttaagagttttaatcacagaaggtaagaagataaagagtaccatgatctaaattatgtatctaaaataaatcactctagctgccacatggaacaattcagcttggaaatatttcataagttgaggtatcaatgttggctttgagtacagaggtggtggtagagcaggaaagaagtggaaggagacaatgtatcagaggtaaaaacaacaacactggagatgaattaactttcaattccacttcaccacccataataaatcccactgacttgaacttcagagcttacctacatactcagattgacttctatagccctagacatagaaaaaacaagtaggttgattgcatctttatagagccatattgcccaaattcacttgattgtatttttgatcacttatccatactatggagtagagtgaaatttctccaatacacaaggccaattattttgagatctttacaaagatatctctatctgtctatatattatatgtatgaccctatgcagaatgttgtagtttgtatgtgtgtgaagaatttaggcaagctgcaaactttaaaaggaacactccctaagaccatccccaactgcaagtttggagggaagatttttcgaaactaccctaagttttggtaatttgcttagaaggactccgaaaattcaatgaaagctgttatactaacaatacaatttactacagggaaaggatatagattaaaatctaccaagggaagtgcatgggacagggtccaagcgaagtgtcaaatgtggagtcctgtccacatgcagtcatagacatgttactttcctgtatctttgtgtgacaatatgcagagtattgctaatcagggaagctcactgggcctcagtgttctgaatgtttactggtgctccattatgtttgcatgactgattaattgcctatgtggttgaactcagtctttagtttgactgacaccatgtgacccaaagcctctgccataactcacaatgtggtattttttgcatgaccaaccaccaccctaaatcgcatggtcactatctggctaggaggaggcacccagaccagcaaagatcgtctccaaggagccagacctctctttgggaaaggttaaattctttatgtataatataccagtaacatcaaaaaaaatgatttatgtgactagtagtggaaatgaagttaaaaatcaatactgcattgaaatgagagtataagcttatagaaaaatatgctacttttctcataataagcagcttaaattaactgaggttacattctaccttgcgcagaagtaagttttgcacctcttagatagaaaacggctttctctatctttcctcccttgctagcttcaaaaatcctacttcctgtgaccaactaggagaaaaatgcatttcttgagaagactgacaaaaaaggaagttgggctacatttcagcattttaacctttctccatagtctgagtttcttggtttagtcatttcttgcccactgagtcagttaatgggccagattctaaggccttcccttcctgtatctgaggaaaagtcacaagggaactgagaggcaggatgacttcctgtttagcatgactgcccacgtgtgctttgccattaattacaatcgggcagtttccatggaggccgccacttgaataatgcttaagtgacagcacaatcaccaagagcaccatgttaagtgggcacagtcattggcctggcatctattttttttaataattaaaccatttattttaaaggaaaatgaaaatactatttacaaaacaccagaagatggtggagcctttaggatcaccagaaatttccaaaatctcttaggccagatgcctccaaaacagccccaggaactagtctactactcgctgtctctgccacaaaaattccaagctccctttgtcttttctttaactatggcctctctggccaagccagaaccattgcacatgtctacttactgtgctgtatgctcatagtttgccccatttgccatttaacttcattcttatcagagttcacttttgtggtaccacaatagaacatattgctgtgaagctttcaattttttttttttttttttttttttacttcccatgccctataaagcaagcctttttttaacttccaaactcagagactgaattttgagtgcttataaaattgggaatatcatggaacactcatcttggttaatttcctataattataggattttacaggatataaactggtttctgtcattttatttgcctctccaaatcttttttttttctctttttactttcaaaccttcagtcccaacaccatctagctaggttttggctttgtgaggtttttgtctcatttattttatttttgaacacgtgctttcatgtactttgttatatagagtaaagcctagtttccttaaaaatatgagttgatgtaaggttaatatacagaaaacaatcatcaaataatagtatagaaaagcaaacatggcaaaaaaaaaaaatcacaaatgtggtagactggccggttgcacagaaagcacagagtgctgtaggcacaagaagaaaagtcctcattctgcctaaggcagtcagaggaggcttcctgagagaggtgacgtctgatccatgtcttgaagtgatcgggggttgccagagaggaaggtcatggtctgttggacaacataaagtataaggtgcatttaactttatacaggtacagggacaggaaggtaatagggtttgaagagcgagcctaaactttcattcataagagcaaaggagttttccaggaagagggacagaaagagtttgaaggcagtagtagaggttggaaaccagtcactcgtaatagcatgacatcccaacatcctacggttgatcttccctagctctcccagcagccgggtaggatcccagggaagtacctccgatgagatgtgagttggcttggggttagggtggaatttctttatcagaaaaaataaatgtaatttatacataaatataaacaaatataaaaatagaaatatagaatatatgtattatatataatttaaaaattgtgtgtatgcacacacaactgagactttgaagactagaaaagtggaattgaaagtcaattcaatcaccaggtcttgttgcttttacccgatacattgtttatctcctaccacttccttccaccacctctgtagtcaaagtcaacatccatcctctgaaaaaatctcaacttttttgtggttgtcctatttcacttattgaacccatcttcagcaagcggtccctaagtattagacaggatagtatccatgataaatccttactcatgtggcatttatgttttagtcaaaattaaacaatgtataaacaaatataagaatataattctataaaatatgttacatataattttaaaattgtgtgtatgcatgcatgtatttcttgtttacaaactttgatagaaaaatggcatagtttggaacagagagtttgggtcaatatattctacacagtgaaggaaagagcccagcatcttctggtttgtgaagtttactggggcaggactaatgccccaactttgctccactctgtcatttcttaggtagaagctgagaaatgagtgtcagtggagacagacaatcaggctgtattttcagaatacagaaagtggagcctcagagagtgaggggatgtgggtggctcagtgggctcctcctctctgtgtcaaccacaagttccccatcattcgttgtatattttgggtttcccagtaggactcatttgagtaagatttccaaacaagtgtgaagatttctgctttcaataagcagttcagtgttctcaaactcaaggaaaaataaacacagcccaaaactccttgcattggtttggaagaacttgtgtttctggagttggggagcagagaatgtgcccgattatttctagactccttatctccattacaggaagctgccttccacagaagacaatgagtgccagtggagacagatgattaggctacccaggtccacctttcattccccatacgtcagccttggaatgcacattaggcgccctcctgacccaagctcccttttttcctgtgacttgtggttgctccaagaattcggacaggtcatgggtgggacttctggaatctgaatgctgccccacttcttgggattataaatatagtacataagtactatgcataagtatgtatattatgtgtgtatatattattatatataaacaatactataaaaggtatactgttcttaatagtataagaattatactattgctttcattttaacttgggtttatatttttaaagacttacatatctcttcaaaaagtacattagatatctgtaatcagactcattatgaaggcaaaagaatgcgtaatgcaaaagatctgaagctattttccttaaaaacaaaaccccaaaaacctcaacatgaaaatgccacgggacctgtttttgctgtagcaaaagattttgcacaaagtgcagccctgtcactcacaaacacagtaatcgctggagattaccagtcattttcattataggtaatttcagggtgccttgttttgccttgtcactcacattcctggaaccttgccagatggtgtaaaaggagcattatcaggaaaccaacctgagccccataccagaggataaatctgaggctccactgagtatttctgaaaatacagcctgattgtctgtctccactgacactcatttctcagcttctacctaagaaatgacagggtggagcaaagttggggcattagtccttccccggtaaacttcacaagccagaagatgctgggctctttccttcactgtgtagaatatattgacccaaactcatcagcacagggtataaaactcttgaaagatcttgccctagtcttatctccccaattctcaatgccataatcttcaccccatcatgtgaaatagcatttatccctgcaaatgtaccactgtctctgccaagatcctccccacctttttcacctgtctcaacctcacgttgccttcagcacttcgcttagagtcacgttttctgggcatgtctctgatcttaactgcctaagacaggaatgtccctcctatgtactcccacagccctgaaactgcctctgtcacactgtttttctggttgctctgtttcatttattcaacccatcattggcaagttgtccctaagtattagacacagtggtatccacgataaatctttacccaagtggcacttatgttttaatgaaaaagaaagataaagaatatgtatgcagaaaatcataagggcagtatatcaagatagagtgtggctgggggttgctattttagataagatgtccccaaggaagtgacatttgagatgagactaaatgatgagaaggcacaaaccatgggaagatacctgggaaggtatttcaggcagtgaagatatgattcacgtacagcaagttcaaaggccctgaggcaggtacagatttagtgggcacccaaatggcaaggaggctagtgtagtgagcgagcaggaaagtggaacagaatgaggtcagaattgcagttagaaactggtccactggtccagtgagaagctggcagtgagaagaattcagtctctgtttcaaagattaaagggaagccattggagtctcgtaatcaagactgtaacatgacctaagccacctctaactcccgttatagcatttctcaaaggcatgctgcctggaactcggacggcaccaaagctttgtactctgaatcaatgaatcaaccaccgatcttgggccatgactccctatccgcgttcttttagttctctcgatgcctcgcctgtgtgttacacacgcggcaccattggcgcctttcaaagatcagctccttccaaaggggaaatgtctgtgaagagcagaaactgacaagccactccaaggtgtttcatatgctcccaaaacagtgagcacaaacacagtcggcttacctcctgttctttctgtacccacttgagctacactgtaactaaaccaatgaatagcccaagaagatatttcaagatttttgcagttagtgactgtcataaaatgagcatttctgtcatcatgacatatgactgagccacagcagactgcgctgtacccatcacagctcttttgtctttgacttatgagcactccaggagaaactcaatctccttagcggggcatgccttcctgttccccgtgccagcggcagtggagggaagtgccagacagaagggacccagctccatcttctgccatttgggaggctttgagcaagtaaacctttctaggcctcacttttcacaattataaaaatgaatgaaagtaaaccacacctttctcataatgtgtatgatatgaataaggcctatgaagtatatgccatagatacactgttaacataggttgggtgggggctgtaggactgtgctggggctctgacctggtggcatcctcagctgcacccagcccaaaggcctattgtggaaagatgactttctctctctcttcctcctccctctccttctctctcttacccttgcacttttttgttggatccttccctctcctcccaccctcacatctaaattttctttccttccctctttcctgaattacagtagatctaagtaccttttcacttaataacaggccccaccaccactggtttccttaaatctcacctttgttaagtatttggttttgatttttattttttctttgttcttttttttgtttgtttgttttgttttgtggtaagaacacttaagctaagatctacacacttagcaaagtttcaagtgtataatcctggcctatgttactttccctgtgttacctaaagaaagtataatgaactggatatagttctgaaggctagaagtctgaaatcaaggtggcagcagggccatgcctcctctgaagcctgtagtagaggtccttcatgttctttcagcttctggcagccccaggtgattcttgacttgtagctccatcattcccatctctgcttctgtcttcattcatgtggccttccccctctgtgtctacctgcctgtgtccaagttttcttcttcttataaggatgccaatcactagattagggcccaccctcatccagtatgatttcattctaacttggttatatctgcaaagatccgacttctgaataaggtcatattcacagatagagaggattcgaattttgttttgttttttttttttttttttttttttttttgagacaatcttgctttgtcacccaggctggagtgcagtggagtggtgagatcttggctcactgcaacctctgcctccaggttcaagcgattcttcttcctcaacctcctgagtagctgagattacaggcacccactaccatgcctggctaattttcatatttttagtagagatggagtttgaccacgttggccaggctggtctcgaactcctgacctcaagtgatcccacccgcctcagtctcccaaagtgctgagattacaggtgtgagccaccgtgcctggccaggatttcactatatcttttcaggggacacaatccaatctataatgtggcccctgtcaaactccaagtagtattaagagttcggagctctagagcagatatgagtgtaaatccaggttctacctccactttctacagcacccttgaatgagttctctgatcagaatttgagttttctcatcttaaaacagggaaaataatagccagctcagagagtagttcaaggattagtaccaaaaaaaattatttgaataatgcatgttaacagcataataattgtaaaactgcaacagaaagaaaggtataaaacagaatttgctcctgggatgctctcaattggaagagccacggatgctttctttttttttttttttttttttttttttttaaagcaatgggtagagtttgccttgagacatccacccactcattgcctgggaagtggaaacacacatttagttaagtagctgatgggaacaaaaacaagggcattcctaagagccatccgcagagtctcttctttactgaaagtaagcagagagagccacttgcatcaggccttgtgatgcaaaattgaaaggcaaaaccaatctcagctaagcatgcatttctgtttttgtttttgagtttttaaaatcccatttcaatgaatatgtattgccaaggttatctagtgaaagaaactgggatggagaacaaaacactctacagagctgtgccatccagaaggcttggaattaacctgaaggctttattaaacaaatcaaactgggggaggagatatttgcacaaggccttttcacacatatctagtaaagagtaggacaactgaggcaactctttccatatctcaaaacaaagaataaaatccaactgggtctcttcagttatctcaacttcccagatttaaacagtcatgtgaaaagtgccagttatcttctaaactgtgtgtgtgccaacaaggccaagagtgataaacagaacttgacaaagacgtgaatttctagaaatgtcccctattaccttgctacattgaatgtttggattgtcgaccagcagcatcattgtcaccaggggcttgttagaaatgcattcacttaggttccattgcagattgagtcagaatctgcattctagcaagatccccaggtgattcctctacacattacagtttgaaacatgctctttggcacaagtttgctctcccaatctgcctaatgctgactttgtgtgcatatatctactcagcagcctggttgtaccagccaagagcccaccagcacgtaatttcctctgtggataaatcctctatccaagaacagtttgggtcctgtaacagagtccatttccttgcgagaccaaaggacaccatcaaaaaccagaggtctattggtgcaacagtgttgaactggaacatagctttgttcccacctatgaaggtttgcaggtgcaaaatgctaaattgatcttgttctcatgccaatggcaatgaacagtcacccatctggtagcttctcttcccagccaaagcaatggctgaaccaaggcttctccttgccaaaatcatggcattcaaggctcttgcaggaacatagacatgccttcgatttgggagataaatagccgattcttctcactttcagctttagtaaggattgaaggaattctcactgcatgacccaataggaaattatctgtatcacatcttctactctatctatgacaaaaggaaagcaatggtggctgggtgcagtggctcacacctgcaatcccaatacttcaggggggcaagggtggaggattacttgaggccaagagttcaaaaccagcctggtcaacatagcaagaccccatctctacaaaaataaaaaataaatgaataaaaatttagtcagacatggtgacatgtgcctgtagtcccaactacttaggaggctgaggcaaaaggatcacttgaacccaggagttcaaggctttagtgagcgaccatcatgccactgcactccacgccatagcatgaccctgtctcaaaacaaataaagcaatggaggaaagagatggtaacatatatttactaaggactgacatactaatagtgagtgcttactaaatgtctactaagtgtctgtgtttactaagtactttacttatataatcctcagaaccactaagtaggttccattgttgttcttattaaagagctaaacaaactcttattgaatagtacagagagtttaaccagcctgccaaagtcacacagtaaatcacagaacagggattcagaccccgcacacttgggttcctgaatctcacatatgaacactccactcatgtatctggcatacacagagagaaataagtgcaacataaaggtttccaattcagccttctttagtttttgaatcatttgtctccttcctatttcttcttcacttgctactgcaggtatttgtctcttctcccactctgctcatttccacctcctcctaaaaagaggctgcagggattcagcagcccttccctaacccaagccaggttctcctccccagtgttattctcacccccttctaattccttaccagcctcctctcctgcaccaccaggctctcctctcccaaggaacctatcacctgtcttgaatgcaggggtatctgagaaaacccaacatctaattcaaaggtctggagctttggccaatagagagctttctaatcatgctgtgggggggtgttttcctagttcagagacatatgggatggatgtatccatgtccatttgcattctgctaatggcacacaagctgtctccttcttacaatccattctaaagcatctactcctttggccagcaattccccacactcgttccataactaacttgttccacaacctaagggctgggatacaattagtgccctcatttccctttctttctgcctacagggaaaataatacttttcagaatatagattagagtttgtaaattgaacattatccaatactatttccagcaaaagtgataccaatatttagtacttgtcaacatttcaaagccaggggcatatattaacaaatgggaaagcatctataggtttctatgagaaagaaaatatggcatggacaaaacagtgactgagttttttcatacagtgtcacagaggatgcaaaaatagaatgaaattaacagccccagtctagcctgaatacctaacatttggacatcctactcccatgggttgaatgatgctgctgattgattttgtttttatggttggctctgttacagaaattgacatttgggctgtatttacaggacatcagtacagtcagttgaaaagtaagcagattcatgcaaaccaattccaataacattttgattaagtagtgagcaagggaaattgtgtgcttgagatttattgaattttctggttgacctggggttacctgaatcctccctttgtttcatttcacaggattgaaatccttattttcaaaaatatatcactgtactctgtttacttgatgaggcaggctgagtgttatctatttttgctcaggtgggaattctgaaagggcctctggttcacttttctgaccactggtgctaattgtacaaagactgtaagtgtggaaggatagaatactgcacatcttcctgggattgtcttaatttcttcaaactagatagtttttcccttccttttttttcaaaatggtgattttgacacactttcttctttcccatctaaaaatggatgaattatagatgggtcaattttagttttcattttgaaatcaccaaaaaacagacagaaaagacttccaaaacttacttcttaaaaaaaattaaatcacacaaagttattttccagtagacagaaccacagcacaaccctattgctgactgaagttttagaaagctaaaatcaggttgatttaaaaaaaaaattgcacaggtggttgcggaaggtctagaaaatgctggtatatattttttctccaccagaaaacagagtcagccatcctgccacagggctttcaaatacatcatctctgtgagctggtccttagggaggcaatggatatactattttgaaagcagaaattagaaattataaccagctaaacggaaacctggattcaaatacaaagtggccaaagataaatcaaactcctgtcccatcaactgatatgtctttgtttcttgatatctgttggcaacctctagcttagccaggtgcaatggcccaccagcaacaggaagggagagtctccagtactagacagaaatgagattctatgccccagtatgagatctttcagaggcagggaggaaggagagagtattcaagatagacaattctgccagagatgcttactatggacaaactctgttctctgcttttcaaacccatacctgtgtgttatcagaatcactcactgtggcatcagaggtatggtagtacatttcagaagaaaggaccttacatgtcattaaatctgctcagttccttcacccttctgccttacaatatttccattttccaagatgatgcggactagcaagagtgacatcgcctattaaaagaagaggtttgcagggttcacatgaactctggagtcagatggcctagctcagccaaccctggggccttgggagttatacttaacctctctgtgcctctcttttcccatctgcaaaatgggagaatgaaagcatcttctcagggagttgatgaggcagtctgtgcatagcacttagtaccatgtctgagcataggacacgctctgtaaatgttaaccatcactattgttaagcaaacgctctttcatcaaccatgcaatataatcccttcccttcccattttaaatagtccttgagaacagtccagcttcatcccattcttccttcccctgtatatttttctcacaataaacaaatgaaccctataactcactgactgtttataaagggtttaggtataacaaaagagaaggccttgaacccaggcaacactaaaaagactgcagaaaaataatccctgcctccaggagagctcagacttggaaatacggcattaatagaatatagccaaaaaagagaaaattattcacttagatagcagggagttggaaattgagacacctcacccacagcacaccaagagtacaatcagacataaaaatagaaatttaaaaagccagaagccacccagtcagaagaccaggcctacctggggaggagacttatccaaagaccatctgccaagtcaacagtctagacttcctagttgggaggtggttgacatattggcctccaggtctgcttcaggaaacaactccctgggcataaggtcatgcaggactgatttttcagacgtcactgcctctagaacagcagggtctttggtgatgatcttgctgacattggagactttggtatattcataagtggtttagttcttgtcccagcttagaagtctcttgaaggctggtgcaatgtctcatatgtttgtgcatctatcacagcactagaacctggtatgattcatattggagatttggtaaatatttattgcctgatattttacctcattctcccaatgagatgggtggttgtggtaatggtgtgaattttatgatggcttgaggtgacagacccaagggtatggtgactaccccagggaacgctatttggaagtacttgtcagaaaatacagtgtttttctccctagtaacacaacaaccctgcttgtcctagacagcctggatattaagaattatccatgttgctgccaccaaaaactggaagtgtctccaaaagtaaaatatttctttatccaaactcaataatctagagatagatggccattctctgaagtgatatgaagatctactatctaattgtgcccctgcgttttctttgcaaaaatatagtcttcttacatactatcacagttttggaaagctcctcactaaaggcctaagggattgtattgaagatcaatttcagagtttagacctctctagtaaggaatagcaaaggctggcaatcccatgtcttgcatcaatttcatgttgaaatggtaacctacagctgggcgcggtggctcatgcctgtaatcccagcactttgggaggccgaggctggcggatcatgaggtcaggagatcgagaccatcctggctaacacagtgaaaccccatctctactaaaagtgcaaaaaattagcctggcgtggtggcaggcacatgtagtcccagctactcgggaggctgagacaggagaatggcataaacctgagaggcggagcttgcagtgagccaagattgcaccactgggcaacacacacacacacacacacacacacacacacacacacacacacacagaaatgataacctacaaaaggagttcagcctataaaacaaggacttccagttgagtttttatacggtcacccttctgaatttcattgtctcatacagatgactagcttttgataataattatgatggtggaatcataaagtaaatgaagataatggttgtagtagtggtggtggtgatgatggtcataataagagtatattcttaaatgtccagcactgtgctacacacttcacatacagcatcacactggatcctcccaacaatcactattatcattttcctcatcttatagacagtttaaaggcaagaaacctgaaacttgacaatctctcacaagatcacagcaaagctgggatttaaatccaggaactttgacatgagcagcctcaccttaactatgacttcatactgcctctcacattgtgacctgggcaataccatctcctttttttgaggaatgtaaaagttaggcaatcttcaacttttttttttcctccagccataaccatttctcaaaatttcaagagaaatgtaaaattggcctgtgattacattctttatttcagatcttccctccaagcccaaacaaatcctgcatttatgtttcaaagcgtgtcctgcactggtcccctcaggaagaaggaaggtgatgttgaatagtggaatcttacctgccaggctttgctgccagggggtatcactgcctaaaagggggctcctcagtctcccagaatccaaatatccgtgctaacaattcccctgaatgagtgctccctgagcactttacagcatttgcagcttcctgcaacaacttgaacattcatggaagctggggagatagaatttcagaaaagaaatcaagaggtgataggtgctaaagataaaaagaactgagcaacaatgatgttgtccataactttttggtacttactatccagccatgtctggcacatagtagacagctggaaaatgtttgttgaatgagaattacctctggctcctgatgtcagcccctcctctcatagccctctcttgtcttaccaaaaccatgattcagaaaaggcggggatatctgaaattgcactggatgtgttccttaacctctcttagcctcagatctactttggtaaagtagagataatgctggtacctacttcatagagcttgctggaaggattaaaagggcccatgaatatgaaatgcttagcactatttctagcacatagtaaatgctcaacagatgctactacattcagagcacaagtgtttgtactgtttattgcatcatctaggactcatgcttaagttcttaacaggatccatatttaacctcttaatttctaggaacaaaaactatcaagagaaaattttgttggtattccttattttggcaatattggttttttcataaagattcatcccacacagttttcagtttttggtcaaattgtataaggtagacccctctttgagatgtaacaagttgttttgggtgttggatacataacgtttctgggggaatgtgggattctcagtgataactgctgagtctgtttgataaccaacctgggccatatgggctcaatgtgtatgtacagacatacgccagagatgtgcatggatagctttggttgtagtctttttgacagcatcagcttggtagttctcccagtcttcacttgatcagtgcagacatagatcaattcttcactgcaaaattgagtagtgaataaataaacttacttcagctaacctaactgacattcttctagcactaatcagtagatatccaatttattaaaccaaaatgaataaaatatataaataaatgctcatttatagtctccagtgactgattttgcaaatggtgtcacatcactacaatgaggttctcaaactcaatgattcccagttccagtattgcacagagttgacatggttgtatgcaagactagcggggccattgattatgtgcacacacaatactattctatagaataagaaactgtcatttttggcaattccctgctttcccctttgagtccacttgaatcatacaacctctcaaagcacaagatttcgaggtcacactttcacagaggtggaacagtggctaatgatgacagtatgcgtggatggaagtggaaatatgttgacaaacatttgacagattcctttttcaatcaatggatggaatgtactaggtgctctgacatctccttaaacctctcaaggacagttgctggcaccctaacagtgtcaaaaaaccaaacaacgaatttagtttcattttataggcaggctgacctgctttggaaggacccctttctgtcgagagaaaagtacttgaaaacacgtatcagtgttatatgtgtgtgcagagaaattttccatatgcattcagaagattaagcatagctaaaatatattgagtacaaattttaccaagtcctgttctagttcgttaaatacagtaactccttcaatccttagaaaaaccttagagttgttatactatagtactattactttgtccatttttcagatgagaaaatcaaggcatgaagagataaagtaacttggccagggtcatacagctgaatggtgacaatccttgtgtcttttttttttttttttgagacagtcttgctctgttgcctaggctgaagtgcagtggcgatctcagctcactgcaatctctgcctcctggatttaagagattgttctgccttagactcccgagtagctgggaccacagccatgtaccaccatgcccggctaagttttgtaattttagtagagacaggggttcaccacgttggccaggctggtctcaaactcctgagctcaagtgatccaccacctcggcctcccaaaatgttgggattacaggtgtgagccaccacgcccggccccttgtgtttttcccactgctctgtttttcatgctggtggctattttgatgatcactcctgaattagagacagggtctcactctgtcacccaggctggagtgcagtggcactctgaaatacatagagaagactgacttgacagtattaattcttggtggtagatgttaggagataaaagtgagacaagctccagaaaagttgtgaagcataaattttgctttggagacaggaggcttcaaatttttttatcataagacttcaaacattcagaaaagtagaaagaacagtagtatcatccaccacaaagatttaactgttaaggttttaccatgtttgcttcatctatacctatgtatttttgtctttaaacattttagagttacctacagacaccagtactccaaattattttagcttatcacaaaatacagcaattctccaacataatcataataccattatcatgtccaacctaattaacagtaattctctgacatcacttaatacccagcttgtgctctcatcttcgagatccctttattgctcctaatggaaggaactcctgagcttcctcaatctagtctctccagactcaacaccttccagctaagtgctcacctctgtaagacccctgctaaattctagtgatgggaattccaggctcttgttagatcccctcaaattacatcacaagttgtctggtctaagtgcaaacaggaatggacagtgtgtgcaggtccactagacatcaccacagcaagcagaatgtgtttaaggaaaggctataaccccatcaatctgaaataaggaatttaggtagggcacaatggcacacttggctcacaccagtaatcccagcactttgggaggctgacatgggaggatgacttgaggccaagatttcaacacgagcctcggtaacataataagacccccatctctacaacaaatttaaaaatgagtcaggcatggtggcgtgcacctgtagtcccagctatttgggaagctgtggtggaatggctagaacccaggagtttgaggttgcagtgagctataattgggccactgcactccagcctgggcaacagagtgagagcaccccaccccaaaaacatttttttaataaaaaataaggaacttgatatatatccctaaaataatttaagtagtctgaaactccttgaatctaatatacttgttggagagccagtatccatccaccatctcctacctggattctaagctagcttcaaagcaacggactggcagtgtgcatgagaaacgaagacaacagaaagcacgtccacagagaatagtgaagatggaaaatacggagctgttgtgagcctgatatgtctgggcacaggctgtgttgctctgatcagccataggtgcccagaaccatgcctgcctgtaatacggaaccatgcctgcctgtattaaccactcaaattccctatccatgagaaagcaacaatgaagcaaggacattttggttagtgaggcccatgccacagatgccctcaatttcttccctcaactcaccatgcttgaaacatccacagccataaccgatttctagtgtactctttcatttattcagtagaagccactctcctaattcaggcatggaattcttagggacctgttccatccatactttgtcagaatacagtcccttttctatttcccacattcaataagtttagatactcttcattattccctgcaataaataactactttttcccgattaggtaactagaagaactgctcaacagctaggaggatcagaggctgttcctactcatggaagcagataaggacaacactgtcagtttcctcaccactttgcatctatctcaaaaagaaggtgaaaataccagctgaaagcatacagtcaaaggcaccagttttaaggaatacaagtcagaacgttgagttggggcctgtttgtcattatttcctactaatcccaaaccaaggacctctcaccatttacccattccattatttttgtctttttgtttctttagagacagggtctcactctgttgccaggctagagtgcagtggcacaatcatagctcactcactgcagccttgaatccctgagctcactcgatcctcctgcctcagcttccccaagtagctgggaccacaggcgcttgacaccaggcccagctgttgttttattattattttttttttattttttacagagatggggtcttactttagtgcccatgctattctcaaactcctagcttcaagcaataatacacagttctaagtcctgtggatataattttcatcaagacatgagcagtttacattccagagggcagacaagaaaatacattgaaatataaacaaattggaacacttcgagagtgacagtgatatgacaaaaaataagctgtagttaactagggagcaactgggggttggcaagtgctgtttcacagaggggatgaaggagggcctctccaaggaagagaaatttaatcctgaagaaagagaaacagccatctttgggaatatcttgggaaaaaaaattctggaacagatagttagagggtatcactgcctccacagcctcttttcctctcctgtggatacttttggcctgggttttatgtagaagtaactctgtatgagctttggggccagactcagaattctttccccacttcttccttccatttctatattttctccatcctttgaataaatcaactcctgagacatcacacaggcacacacacacacacagaagtaaaggccttggtttggaagagccaggaaaggtcataggcattatccttctgacccagggcatggtgtttacattttcgcttctacttatcactgcatctcaatgatactcctctgtgggagggaagccaaccctctgtagacaggtgttcccaccggggtttcttctgaggataagctgacaagttccagtgcattgagagatgcatgacttagtccagattagtccattacctggctggggctgtccactttctactttcaacagacattatcaatccattccagcactttctccttctaggacatgacatcatgatttacatagtttaaaagctaaagttataaaacagctaaatagagatactttattgaaaaaaaaattccactccaacgttagggggagaagtctctcataggtgtattcaacatatgaatgcctcaggaaatattttaggaggccatttattacataaggtaggtacacattgtgtgggggaaaaatgaagactagacaaaattcttagggctattttcccaaaagcctggaagaaagggtcattttgtaattaataatgagtcagaatctataacagtggttttaaattattggtcaatctaacaaaaaatatgacagaagacaaaatgggggtattagattgcgtaggagagtcaccccttagaggcctcttcagagactattttgcaggagctcacaggacaaaactggcagaacaagaaattcccttcatcctaaagagacccttgaaaaagaagaaaagggatgtggctactcaggcctgagagacggtcactgtcatctacctatatcttgttgttaaaaataactaatttactttcaatataaaaagatagcattatagaaaatgtagcttaaaaagtaaaatgtacaaagtaaaatgtaaaaaacatttaattcaactaccctaatagagctttataaatcatttctccctacattttattttgaaaagtttaaaacttacgaatacattgaaatgaggaccaacaatatgtaatcaccactcactaacatgttgccatattcattttctccgtctctctctccctctatatatatatatatatatatatatatatatatatatatatatatatatataggttttccccattagctgtttataagcaagttgcacacatcatgactgtaatactcctgaataattcagcatgtacctcctaagaacaactttgttctacaaaacctcaatatcatttctcatccaataaatttaatattgatgtattattatttactataaagtcaagatacgattttcccaacatggctgtttcctttaaaaaaaaaatctatgttgtaatcaaggatcatgcatttttaatctttttgtttcttcagtctccggtaatctaaaacagtctcatcacattttgttttgtcttttacagcgttgaaatatttgaaaaggtcaccagttttcttatggcttttaaaattttgatttattttctttcatatttttgatgcagttttaattacagaatactcacaattttcaaacatgtccttttgtactaaatattattaacaatatagcacataagcattttctatgttgctccataatcttaatcatcattatcacctttgacaggtttaaaatgccccatcaaaagaatgtattagaatttaatcaccctttaatgttaggcatttgggttatttaaaattgcaaattatattgtacatcatcatgaacatcttaatgcagttaacagggtccttttttcacattcttaatacatactgcttttcaaatgcatgttgcttgtactaaatcatagattgactaaatttttaaaaatgattattgttcacattaaaacaaaaaacaataagacaccctgaaattcactggtgttttaattttagtttctttgactcagaggagttgctattaaataaattaacaaatgtatatgaaatataagcagaacacaaaaggaactgtaactccagagttctagtgttgagactgacacattatgtcccagtctgagtgtgagctggtcagcttcatacacacgagaagcctatgtatgagaagtgacttacattctcaagcttcacagtcaatgccgacccaatttaaccacataggcttctggtctgttaaatctttgaggacaaagacatcttactccctctgtatccccagcaacctgtgcttaaaacttagtagatatttgttttatattggtcgagctttgtctcacttctcctatctatcctaggtcccaacctttccatctcccatggccaagatcccaacatacacagtccttgggacattctagccatctttaatcctagacagagctgcagctctgcgattctgtcttttgcctgtcaggctaagcctagttggattccaagaaaggaaaaaatagttaagtttcccttcatctcttctcttttcctagccaggaatctttctggtttcctctcctttgagccctcttggtcctctgagatccgcagtcaaaacaagaagccactgaacttaacaggacttgactgtgatggcacacacgtacccttctcacattaaaaacaaagaaaagaaaaagtagctccagcctcaaggatgctttcataagaggacattgttcccagaccgaaccgggtctggctgtgtgttcttgtggcccaataacaagatgcagacaaactggaaaagaagagagtttatgtctgtaaccaggtaaagggagaaggtcagagataattcaccagaccaactcacaattgtaaagtttttccagtgcttatatatgtttcaaactatatacctacatgtagtaacatacttgccgatctctatgcctgattaattttgttgtaactgaaaggtaagaggccagaattatcccctaaatctacttgacctatgagggccctggtactggagtgattacttctatcttatcttacctacaatttgggtatggaaagttacttcaaaccccccagaaatttactcaacccaagatgggtcccaaggagcacaggactatctttattatcttgacttaccccaggtttcaggagaagcctgagcaaggctcttatggaacatgtttcatttctggctttggtgccagggcatcaatttccctaggtttaattattaacttaatgtgaaggcagatgctgtggaagtttgcctgtataactggagtgctatggaggcctgtctgtgtgactgttaggaagaactggtctgccacaccacatggtgttggtgaaagcagcggcatctctatttgcttgttcgtttagaatcccactgtagtactgacttggaattccactaacacatagtgctaattattccatcaattcctagctggtcttctttcttgtaattggcacctcctacctatggagataagtaagaaacaagtcatcctctctgcaccttggacagcaacctcagcataatgccctcaggctttttttttttttttttccccatagttttggggattccatgacattgtaatacagttgattctcagtatcagtaaattttatatttgcaaattcacccacacgctgaaattgattggtaaccccaacatcaatacttatggcgttttcacagtcattcacaggaatatacagtgcaccaaactatttgaatcacccaatgcacgcatttgcagctgaggtcaaaaagggtgatgccctaccttctggtttcagctctcatatttgaacgtgtccttttctcagactatttaacacctgtacttttggttggtggttttgcagtttaaaataactcctatacatattactaaagtgctgtgtcatattcctaagtgcaagaaggctatgatgtgtcagccttcaggagaaagtacatgtgttagagacgctttttacaggcatttgtcagctctgatttcaatattactgagtcaacaatatgtaataataaagtgtttttaaccaaacatatacacaaaataaggttatgttgtgactggaggggtataggtaactaacgctgtattttgctctagaagcagtggttcagtattcagtaattcagtgtttgtggtgattttatagaatataagtgccgtgaataaagagaattggctgcatctacttttgttttttgtttttgagacggagtctcactctgttgccaggctggagtgcaatggcgcaatctcggctcactgcaacctccgcctcctgggttcaagggattctcctgcgtcagcctcctgagtagctgggattacaggtgcatgccaccacctccggctttttttttttttttttttttttgagatgaagtcttgctctgtcgcccaggctggagtacagtggcacgatctcagctcactgaaacctccacctcctgggttcaagcaattctcctgcctcagtctcccaagtagctgggattgcaggcgcccaccatcacacctggctaatttttgtatttttagtagagacagggtttcaccatgttggacaggctggtttcgatctgttgaccttatgatctgcccaccttggcctcccaaagtgctgggattacaggcgcccaccaccacacctggctaatttttgtatttttagtagatacagggtttcaccatgttggccaggatggtctcaatctcttgaccttgtgatccgcccaccttggcctcccaaagtgctgggattacaagcgtgagccactgcacctggcctgtttttttgtttgtttgtttgtttgttttaagatctgtctttccaagtagaatttaagctctgtgaaagcagggactgaacctgcacagtaacatggctacatccctattgcctaaaacagtatctgacaaatagtaggtgctcaacagatacatgttgaattgtactgaaccagaaactgttcgaggatatggactatttttccttgcttctgtgccactggtttatagccaggctatactagtacactgtgagttcttagtaaaagttcaataaatgtataaaggaatgaatgaagagactatgaatgtcttatccaaaaatagcaagacctggatttcagcaggagcttttcatccaggaacactaagtactactctgctgctattttgtcactattgccttgtttgtaacattagccttaagacagactttggttcacagcttcgatctttgatgtatgattgcactgcattcataatatgctccagattgcttgcatctataatatattgaaattataaaatgcacaaaagcttttcagtgcccaaagtgcataagaaaaagtagaaatctgatgtggtaatttaatgcatatctatttttttccaaagtaaaacatatacaccatcaaagtacctagattttaacttagccaagcttaaagatgttttaagacagagactttgtctgtttgtttcaaatatgccatttaagaacgacgtaaacctctgtttgatgctttacatcttaaagtacaaattagttttttcttttgtttttttttttaagagacactagaacgttcatgtactcttttcatgacagaactgaaaattgatttctcaatttagccaggctgttttggccatgtttagatgcaaaaagagggggaaaaaaagaatgctgtggctgaaaagttacaaaggaaatctgatgagttataataagggttagctttaaatacagtaacccataggagaatactgaaaaaagggatggaaaaaaaggatggcaaagctcatgaagttcccacatatttttcttttgttctattcatctctaagaccctcctagagctgacaatgacttcagagagcaaagtgaaactgcatttgcaaaagttatatcagtgagaaaattctaacagtaagcgagctaactcaacccccatcttgtctttcccttaattattgctgggctattgggccaagctaactttggaagacatttaggctacaatttaaatgataataggccttgcccaaaactcaaccacttttgtaaagctaaagggaggccaccaggctaggaggaggagagggagaggaggctgagtcctgctaaggctcagacatgcatgattgtcagccattattccagagattctaagacatgcaatttccccaattacacctgcaaataacaccacaattgtagactggccttttgagatagcttttctgtttgttttgcatgtctgacactcatggctccccgtggatcgccagcgcccccactcttgtggccccacccagaagcaatttagtcctcaggaagacagctttggcccactatttcatctctgtcccaaccaatcagcagcaagcatctgttacctggccactcccaccccttcccttaaactgtctttgaaaaacccctaacttgtgagctttgaacgagataatatgagtgcaaactccatcttccacgtggtatggccggcctcgtgtctattaagcttttttttgtttgagacagagtctcgctttgtcgcccaggctggagtgcagtggcgtgatcttggctcactgcaagctccgcctcccaggttcacgccattctcctgcctcagcctcccgtattaagctctttctctatgacaatgctgtggtctttctttatgcagtgggcaggaagggcaattacaaaaggcttctctatggtaacacatcccaaaaatattgagtgccaactatacattgcacacttcccaagcactagaaaaaaactgtctctgccatcctgatacttaaagttctaatgtcagaaacacacatgagaaattagtgcttcaccctggttgtgtatgaggagggaatagtagagaggtcatgagagggtgcagcaggaacatctcacttgtctggagggataggaaggccacttggagcaagtgactagaaactaaaaccaaccagagcaaagaacaggaaaccagttaaggaaaaaaggcaaagaaggacattaccgagagggaaaaactagtgtgaggatcctcttcaaaactgtgaatatttccctgtggcttctcaagtacgactgctttagcattaaaggctttttatgagaacgttcattagaaagctaaataatcatagacattctgacttgttcattcttctgtttctggtactgttactgaaccacactggtactggtactctctgatccagaccccaagaaagggttcttggctcttgcagaagaaagaattcagggttagtccacagtgcaaagcgaaagcaagtttattaagaaagtaaaataaagaatggctattccataggcagagcaccccaagggccgctggttgcccatttttatggttatttcttaactatctgctaaacaaggagtggattattcattcctcccctttttagaccatatagagtaacctcctgatgtggctatggcatttgtaaactggtgggagggtagcagcgaggatgaccagaggtcactttcatcactgtctttgttttggtgggatttggccttactgcatgctattttatcagcaaggtctttatgacctgtatcttgtgccaacctcctctctcatcctgtgacttaggctgagtagtcatcctaagtagtgatgtaggatttttactccttatttcagttaaatccaggttcttatctcacaaccaggaagaattaggcacatgaacacactgaagagtgaggagggcagaatttattaagcgaaaggaaagctctcagcaaagacagggatcctgcaagcaggtttccacctcacaaactgaataccagggtcaccacacaggagccaaagatgccaggctcttcccctgaataagatgtttgtttctggtggctccaccccattcccccagtgcatgtgggcctccagtccactgcccccttgtctgcacaaaacatctgttgtaaacacttgtggggtgggtcagattttccggggacccttccctatctgcctagccatttctctgcctcctgcctctatcattagagtaccttaacctcctgggaatgcagctcagaaggtctcagccttattttacccagtccctattcaagatggagttgccctggttcaaatgcctctgacactaccctgaatttgttatgacaatctgcaggtttattgaagttttatttattgaagtaatttatgtggccctgcctacctttccagccttgacttccagcactgtctgaccctcctctccacgcacctttggaaacaaagtatacctttatattgccctgccctcttcttaaattgtctcacactgcatggtccaaatcaatgccccttccactgaaaagccttcccaggcttagcacagtacatcctcttccaagacaaaattagtctttgtaaaatatctttaagcactcatcacagatatgtaatagtttttttgcattataagttctataacaataaagattgtatctgactcatttccctgttcctggcacaaatggggcaaacacttcacacattttctctaaggttatctaggctgatgcttctccattctcttgaagtggatcactattttctccaaatatggtaacaggtttgctgcctcaccatccactgacctacctcccttattcaccattaggaaggggtgccaatttgctttggcaggggcggggggggggtttcctctcaatgtgagtttagtttataaattcatgctttatcttcatctcactgagtagaaaaaaaggatatgccaatcccttgctgatgacacatggcagctttaatatatttgttaaaaaatgtgaatatacaatgaatgagaagtgagtaaatgttaaagtgaacagcttacagattcccatgtctgctttcaatgttagcatgtagtaaagttcctggtgtttaatatgtgttaagtaatattttgttagatgaatggctgagtagtcaacagaaatccagatttgggagtttttgccactggattggaaattatggtgatttgaaatactgagttatttttctgactgatcatgtttttacccctgccaagtttcttgtgtcaacaaatccaggtaccaaacatatgagcaatagcctcacattctcctgggagatggagaaagtctccattgttttatagttcagaattgaactggtataattgggaatgtctccatttttttggtagtcatgttcttcattctttagctttgtatcttctcaagttgaggaatgtgctaaactgagtagtaaatttaaaaaaggatttaagagagatcattataaaatgaattgcttcttctttgtaagatacaggaagtttagtagctttcttgaagtctcaaatgagaattgagatgttgaagagaacatctactcttttgctatttagtgatgggctaagggcaatttactaatgaaatgaacaggcaggaaacaggccattgactacagaagtaattacaaaaaaaagtacttctttttattttagtaactgcaaaccataatataaagaatccctcccagttgaaatagttataagtaaacaacaactgtgaatcatgtttaatagggaagcattagttggcagagttggtgggggaagaggcacagacagtgctttgaatggtttcatacaaaagttagtttggacaaagttgtatcaggcaataatccaacatgcagaagtttggtgagatttacaaatgactaaagtgataggcagggttaaggtttaagaaatatccccatgtacttccaaaagtatgttcttacataatgcaaaatgatccactaaaaaggggagcaggagagggtgcagacaggattacagagttgaaaacaagcagcctagagatgctatctagcctctggtctctatttcttttttgatttgctaaatggttttaatatgctcttaaaacttttattgaaaactgaggtatttctaatgctcagaatatagcccaacacataatacatgctcaataaatatttgttagatggctgagtgaaaaaatgaacttttacataaaattatacagtcaagctcctcctcaaaaaatgtactataaagtcctattgtggtaacatcccacataattatgccttttagatggggcaggtgatttctagttcactatggtctgtatccttccttaatatcttacacctggctcactttgcacctttatgtgcctagcctctgtaagagaattttttcttggagaatcacacagaaaattattatattaaaggcttttgaaatcctaagcatgtctatgtgtacatatgaaagtatctcaggtctagatctagaagtgaaattgctgattcagtggtatgcatagctttaggttttctagatatttccaaatggctctcccatataaatttaccaacttatatttataccttagtgttgtctgagagttctcactttttcacacccaccaatgcttggtattagttcattttttcttttgtaatggtacaggcattaaatgctatcttattaatgttttaatttccacttctctagttgatgaggttgaacaattttcatttatttgatttcttcatctacaaattgtctattcatcttgaatctatgtttttaaaaattagattgtttcttatttattcctttgcataagttaaaaaaatttagatatcaatcttttgtcagttaaatacatgacaaatgttttatcctgccctatagcattgtcattcaactttgttaaaaatattgttttgtaggtatcatctactgcagcattgcttatttcaaaaacattagaaagcagagtctatcaataggaaaagagttacagaaaatctgttatgctaacattaatatatagaaagctatatagttactatgattattaaatcaatgtaagtaaatcttaaaaacacaatgttatatgaaaccagatttcaagtggatatgcaaggaataatttgcacaacttaaaacacagaaatccatatagctatagtttatggacaacactgtagtagcaagagcacacatcccaagttcaggatagtagatactatggggggatggggaagaacatggagtgtaaagggctttgattgcatcttatttcctatgagtggatggaggggcacctgaatcaagatgtcagtatgtcaaagtgttatattcagggcttatataatattttgttatattttgtttttatcctttttggatgtttaaatcacttcatgtatgttcttattcacatacacatctatacacacattcttcaaaaagagctgaggagaacacatggtatatagttaataagctacagtatttcttatcacttaaaatataaagaaattaaatatggggtggcaacaggaaagagtactgtttaatatcacttattcagtgtttctcaacataatatctatgaggctctcttttctatatttttcttcacttccttgaatctgggttacgcgtgttccatagaatgcactttgaggaatgaaatttttgtaagacaaaaaagctcagagaaaagcaaagataaagtaagaagctcaataaagttaatgtcaaattgagtgttgattttgacaagacatcaagaatgagttggaatatcttacctttcttaagtagcaatggtgtattaataattcatttcataaaccagtattcttaacactacctcactgtaaacattgactcttcaggataccttgttttgagaactacttatgtagataagtagatataactttaaaaagttaatagggacaatgccatatactattattctttaaaatctgtaactttataagagaaaaacatactattttaaaataaaaagtatatttccttagcaagtgcttcattgcgcaactattttgagctcagtaattttctttcctgaccataaactacatttctagtgaaataaatggaattatcagacaccacaggcacttattttatttactcacaggactagaatggtttaaaaataaacctaatacattggacattgctgtgaaaagtacacaaattgcccttctaggacctgcataaacttcattataattttggggcaatgttcctagcaattctgcaaagaaagcatgtactaagccttatcatttgcatagaactctgtaatttaaaaatacatttatacattatattcccagatgagaaacgggtattttgtacattggtgatatcaacagtgcaccaggtaaaaattattctcccaatttttttttttttttttttttgacacaaagtttcgctcttgttgtgcaggctggagcgcaatggtgcaatctcagctcactgcaacctctgcctcacgggttcaagtgattctcctgcctcagcctcccgagtagctgggattacaggcgcccgccaccacgcctggctaattttatgtatatttagtagagatggggtttcaccatgttgaccaggctggtcttaaacttctgacctctgatgatccacccgtctcggcctcccaaagtgctgggatgacaggcatgagcaaccatacccggcctctcccaattttacaaaggctacaacgagttcattatcaagacactgggcaaggtcacattcaagtaagtgacagagctgaatcagaacccaggtcaggtgagtccaactgcagtattgtcttcctattatagcatggagacagaaataaagattcaaccatcaggcagcctagttctggattgcttgttcctctgagcctcagacccctcctatgtaaaatggagatcataaacagtgctcatctcaaggccacagagaacacaagaagataatctaagtaaagcatcaacggaatgccattatttttatatccaatttttttaaacataacctcatcgtgattttaacttaatcccagccaatgctcagctttacaatttggggatcatattttctaacctacttattcttttggtaaaaactcttcctgagaaattagtgttttatagtaatcaatttaaggaaattcatttttgtttttactagacagttatgctacagaaaacagtcttaattaatcacacagtaaaggtggtctcaggtatttaggtcagtacaagcttctgggttttctttttttttttttttccccttcttttgtcctgaggataattagtgtgttgatatttgacaaggcaagctgtgactattgcttgcaactgtcagctgagatcttctagctatgacactgaaaataagattcagagtcaagaaacatcttttgaaagttttcctccttgtacccaaaccaagcgtattgttgaagacaacactgggataatgggaaacttcctggaagatttgggcattattgaggccatgtgttcatcaaatgaggacatacggtgactcagttctcatcaccagattttccaggaggccctgaatttcataaaattctattcttatttacctttttgtattttagttaataaattcagtatggtttaatatagaaataagtttcaaacaaaaatgaggcttcaagtcaaagtttgtcagagaatcccaatttttaatccagaaaagaagaccaggcttgttgtatagtgtacagtaccctgtgtaagatctataatcatgtatgtacctgtaacgtactacttgtattattcaaagtttaaatacaaactctcagtatgttaatatgacttctccgttcctccaaaattgtatatgaatccctgcttaagagttcttgaagagctcttgacatttctctgtcttgagtgaacacttctatttagaatctaaaaacagtaagcaaaataagccatcagtaaatgctacacaaaagttactctgtgcccaatagaaactgatgcaaaactaccaagatttagtgaataaagaatatatcacatcattgcaacagtatgacttggtattgaggactagaacctaaaccaaaggcacactctgggatcctggtgtctttgtttccagcatgaggacatgaaatctgctgtgctcattggctggtcttcagtgcctagccctgtggctgcaatacagtagatacatatttactgcctgagtgagtgagtgaaggtgagtcctgaaatcactgtaccaagtagaaaaataatttctacatttagggaaaacaaatgtagagtgtgtatgtgtcagacacctgacaggtttaagtgagctttacatcttaatggaaatagttctgcaaatgaccatttataacttacagttaacactatacaagtcaatctgtagtcttttgattgtgtgaatcagcactaaagaagacactctgacctaatctgcattcaacctcaactaatgtcagtgacccaggacagaccttttccaagcaaaggccagttattattaaaaggtctgtgagaagagcacacaacgaaatataccacagtgtgagtgaaccctttaagttaagggttgattgattagaaagcataacaaccactgataaatttattaatagagtataaagagggaagctggagacatctcagagaagagaacgcaattgatttgagaatcactgggaaccacagattttggtggccaaagccttagagtcagaggaatccaaagttgtctgtgtgtgttcttcagagctgtatcacctcactttgactttgcacctcaagtgaaaagttctaattctatttctacctttgcaaacagggttattactgcaactgacactttctaatttttctttcaggccctgctgcaaaaaagaagtatgtcagttataataacctggttatctaacctgttccattccatggaaccatggaggaggaagaccctcagttattttgtcacccaacctggcataggactctttggtcctacccgcttcccatcaccggaggagcttccccggccgggagaccagtgttagaggatccaagcgacctaaacagctgctttatgaaatatccttactttatctgggcttaataagtcactgacatcagcactgccaactcggctgcaattgtggaccttccctaccaaagggagtgttgaaactcaagtcccgccctggctctttagaatggaccactgagagccacaggaccgttttggggctgacctgtcttattacgtatgtacttctaggttgcaaggttttgaaattttctgtacagtttgtgaggacctttgcactttgccatctgatgtcgtacctcggttcactgtttgttttcgaatgccttgttttcatagagccctattctctcagacggtggaatatttggaaaaattttaaaacaattaaaattttaaagcaatcttggcagactaaaacaagtacatctgtacatgactgtataattacgattatagtaccactgcacatcatgtttttttttttaagacaaaaaagatgtttaaagaccaaaaactgtgctgagaaagtatgccccacctatctttggtatatgataggttacataaaaggaaggtattggctgaactgaatagaggtcttgatctttggaatgcatgccagtaatgtattttacagtacatgtttattatgttcaatatttgtatttgtgttctcttttgttatttttaattagggtatatgaatattttgcaataattttaataattattaagctgtttgaaggaaagaatatggatttttcatgtcttgaggttttgttcatgccccctttgactgatcagtgtgataaggactttaggaaaaaaagcatgtatgttttttactgtttgtaataagtactttcgttaatcttgctgcttatgtgccaatttagtggaaaaaaacaacccttgctgaaaaattccctctttccattctctttcaattctgtgatattgtccaagaatgtatcaataaaatactttggttaacttttttattttctgcaataaatatttttagttgtttttcccattagttacagtttatttcataaagtcctaagttagagagccatatggacagcccaactttttcaagtaacatgctttagctcacgactacagccatttctgaaaggcatattaaaaacccagaggtgctatgttgtctcatagaaaaagtcctatcacaaagtccatgcaatttttttcttcgtaattgaagttgagacctgataactccagatgtctactcagcaagtgggaagggaagaggaaatattagcttaagcaaataatagtctgggggcaatttagtgaagagataaatatttctgcaaaatttatccaaaggacataagtaaaaatagctactatgttgtctttgtatttgcaaacaaatatggtggccatattatcagtagtgagattaagacttgggattctcaaaactcaactgcaggaagtatcatcaggatgaattcatagcaccttggcccatcaggaactcagaagattgtctacttgcagaggggaacattggttcctagtactcagggccgggccccaaacagtaaaatgtatttaaaggttctatggtggagctaactgtgacttattttctgctgtgactaataaaactcatacctgcatctcatctttggcatctgcagaactcttcctactgtgccttagctcccacagcccaagcaatgtgcttagagacactagaaattatttcttttcaatatccgactaaagaaaatcaaatgtatttccccatttttccctactccttaaatacccttcaaccagtagaccataggaaaatacaaatcaaagcagaaatgagttttgggtgatccacatttccaagtcataaggccaaagtggtataaaacctggctcctcctcctgctaactctccttggagaagttacataaacattctgaattctccatttcctcaggcagatgacaggttaatcgtgctaccagtctcatagtgttatgagggctaagagaaaatccatgcgtaggacataacaacagtgcctggcaaatggctaactctccatacatgttagctattatgaccacatggctatgaccaccagcatcaacatcatcatggttgctatattttcttttaaaaataaaatcaagtgtgctatgctttccattccagacatggaaagagaaacttaaaaagtacatgggcaagccagactgtgttgtggcatgtggtagaaatcatttctttcaaaagaaattatgtaagagtctttcccgagtactcaaatgtacaaccatgcattcagggaagtagcaaaagcaattccatctagaattggaaagagctactttcaaagacctttgcttttcctctggattcccaggggcaaattgagataatgatctggatagcgacaatgataaaaagtaaaacttttgcagcacaatttttaagaaattgttactcatatatataatatactttacatactttatgcatactacatatattacaatgtataccttatatatcaatttatttagtcctcaaaatgcagttctaatcatcttccacaatgctaatctccaacccagtagttaaggtgtggctgtagccatagaacagatagattgggtaacattatcaataccaggcagcacaatgaatactcacttccctcaggtatgcaggtctccttgctcttcacctgtaccaggtataccccacctcaaagtcttggcatttcatgattctcttcctaacacactctccccgaaatagctgcatgattctaaatcctcatttatttccagtttctgctaaaacatcatgtctaaggtctttcctgaccatatctaaaagtacagtcctccacccagccccccagtgaatccattaacctgcttcatttttctttacaacacttatgattatctgacttttcagatttgctttcttgttttcatcagcctccttctgcagtattcaccaggagatcagatattctgttttgctcaccgtaatatcctagcacttacaacaatgcttgacaagtgttaggggtggaaggtatctgaattaccagcagcaaattcatacatgtctgcagcaacctcagttcttacctcctcagaataaagaattcgactaaggggcataaggtagagaaagagaccaagacaactttcagagcagaaatggacatttatttttaaaagctttagagcaggaaagaaaggaaagtacacttggaaaaagacaccatgaaggtcaagtgcagcctttaacctggatgacccactcccagtgtcttgagaccctttcccataattcttcccttaagatgggctccctgtatgcacagtgccctctttgcccacgggaagtgagcatgtgcactgggttagaaagttgtatgcatgcccttctgaggctttcttcccttttctggtggagtgccctcagaaggttatactccaacattttgtcttttaatttgcatgcctgggaagttgcctctccctggtgtctgcatttaattaacactttactgtgacagctgcggaccttcaggagataagtctttccctggtgccggctggctaccaaattatcatttttagagaggcaatgtgatacctattgaaccataacctgataattgcctgacattattcctggtaggtcgggggaaagccctctcctgccccctctccttcagcccatgcctgtctaactacctgtaacacaagtagtaggcactccataaatatttacaaataaatcagtgcaagcaagaatgaatagatgaagtgaaagagctcaagaatatcgaaggagggctgagggagcctgtgctgccaaatagttgtagccagccccacatcaggaaggactagagttgggacattaagggccaacaagactcaggtaaccaagaggaaagaaaaggtgtacacattttacactcagcctcagtagtaagggagaagctactgctgttggatggggtttcttttaattggaaaatgaacttcttgagaagtgcagtgggaacttgatagatatgctgaatcacaaacactttcatctgaaggaagaagggagaggacagggaggtgttacagtaggaaggcactggattcaggatgagaatgcctgcgttagagcactaagctccactacttactagctctgcagtatcaggtaatccatgcatccctgggattctctgtatattcacctctacaatggcagtaggacatgaattcaagtactttcgttaaccagctgactctatatggacttgttccagaatgctagctttgctttcaatgtgtgctaatctagactgaacataataatgtaaagcatgttggaggcaggaactggagccccatgtagagagaagaatcactctattgctgtgaacacagttaaggcagcctaaggtatccatcagtgcacttggcagctgtacaaacaaaacaaccaggatccaatggactaaaatcccacaatccctctgccaattgttactgccatatcattctccatttgacattttccctttataatttatcctcttgtaaaatttgctttatcatgctctgtctgcagtgtctgtttagatcctaatatgcatatatactttctactcttccaacctctgttccagtgataaacccaccttgccaatcatcagctaaggtactgataacattctggaaaatgatggtgcctagaatagggccctggaagtttctaccagagaccagtgactttggtgcattcatcatcattagataagtataggtttagttattttgccatttacaatacccaaaatactacaggaacaaccagtctattattttcttttgcacataataatagtaaaatatgccaagacaaggggcatctatcatgcgttgtgaaaatgaagacactggtatctacaacatttctctgattttccatcacaaacgggaagaaatcagaccaataatattatcaattaaccttgaaaggctcagggttcccttttattctctccaagtgttgacaggataatctgcctgatactcttcactggaatcctgccagagaatcaaatcaagttcatagattattcccaaggcctttcccctttgaagtcttgtacccacctccagactgagcaaagctcccattctccaagacttctgaaggggaaaggacttatcttcatacttacaaacttaccaatgcctgaaatcacaaattggttgctggctctgaattttacctggtgcgtttattttgtttgcatattgcttagctatctggtaatgtgagtaatggccaaagagctgtaggcaattccagtgactaagtcagttgtacagagcacccagttctctctttcatgtgctctacctgctacttgcctttctttgacctggaaccttcactgctttgtgacttatacaccattgagtttgtctttccttttcctgtctagtacctttcctctttaaaagaagtcagtaaatccaccaataaagagaaggtggagggaaaatacaaattctaatttcttccctataacttttatctatacaaatgcttttgaaactttaatgtgtctgtgaattacctggagatcttggtaaaaatgtagattctgatgcagcaagaagggcccgggattttgcatttttagtaagctctccggggatgatcacactgcttctccccgaactagagtttggcttttgacctagattgtacattagattcaccttgaagttttaaaatatacctatggctagaccttactccaaagaatccatttaattggtctgggataaggccaggacatttttttctctgaaagcttcccaggtgattgtaatgtgtagagggatgaggattaatattccacacgagtgggtctcaaacttcagtgagcattaagatttcccagggggttgataacaatacagtgttggtcccattcccagagtttgactcaattggtctaggatggggctgataatttgcattcctaacaatctcccagatgatggtgatgctgcttgtggtccatagaccatactttggaaaaatccaagcaaccaaactgctcttccaacatctaccttgcacacaaggtttaaaaaatcaagaaaaaaaaaaaagaaaaccaaaacccaaacctagtactttcattgactcaaacatcttgcaaacctccactccgggactttaggcttcctgatactacccctgtagtctctcgtcactgtttcacaggagtctgcatttaccacccaccacccaccagcttttgtaggatgtggttccatggaaagtttgctatgtattcacatttatctctttaaattatttctctgctcttcttccctggggtcatgactagagattgagaattctactcctatgtgccttctctttcccttggctctgccatcttcctgcttctggtctcaagttcattaagaaagttacttttgcctttttgaaatctgtctctccaaagcatcacctgtccatttggctatgtccaggccactatcccctggctaaggagctctgatgacattgatcttttcctccaagattcctcctctctaggtcctccttgctggctcaagtaagattcagaaaagcaattattttctcttaactggcccttgggtataataacagacagtggaaggatatttaatcaacaaatgtgttgagcacttacaatataccaggcaccattcttcatccctgaagacacagcggttacataagaaaccaaatcccctgccataggggagctggcattctaaaggacatgggcagcatttctcacattctccacttttatccagaggttactgctgcaagatgcacaatcagatccactgaagaacactccaactcagagttgtactttccttactgtatttcttctgtttctctactgtgccctcacttctctctactgtgccctcacttctatttaaaaaacttggatgttccaatgctttattttgtttgctattactttatgctttagcccaccatcctgagggctccaaaaagatatgaagatccaagcaggcaaatccccagctgtctacacacctggctccatagttgagaaattgctttgtctctcaactgcagaaaactattcactatgagaaagggaactagtgttttcctagggagcaattattctaactttgagtcagccagccagctagcagcatccattgttggagtaattggcatatttttttaaccttgttcttctaacaaacagggctctcctgcaaaatctgcatctggctattgagctgaacaatgaccgagtgcatcttagtaatggccatcctcccagtgaacatttataactaagtaaaattgggtcaggcaaatcagactggtctttgagccaatggggcagagctgccttcggaactacccagacatttggttcatagagacagtatagagacaaatgtactcagcactgtgccaaacaattcatatccatcaccccatttaaacctgaaagaaaacagctctatttggggactattatcctaattttaataaaaggacagattggcataataattttcatgtcacacagttgataaatggcaaagctggaatttgaactcatatatcattggcccagaactctatactattaatcactaaattagaatgcccagaacatgatttcttatttgcccaagaacagcaatcacagacaacatatataaagtaataaacccctaaccagaatgaaataagatttttttttacaagagaagcaaatgtgtggacagaacataataattatactaagattgactattaaacagcactgaaagtgattcagaagaatgaatgttatagagaagtgctcagttattttcaagatgatctcaactacataaatgcacatatacatgccaagaaaaagcatgaaagaaatatacaaaatggtttacgcaattatgaattattatttactccattaaattattatttactccaaaacaacagaaaattttgattacattaaaatcaaggctagtgttcatcaaaaaacattttggagaaagtggaaataaagatacaacccatgagaagatgatatagtttggctgtgtccccacccgaatctcatctcgaattgtaatcctcataattcccacgtgtgaagggaggaacctggtgggaggtgattggatcatgggggcagttcccccatgctgttctcatgatagtgagttctcacgagatctaatggttttataaggggttcttctctgttgactcttttttctcctgccaccatatgagaagctccaagcttgcttctgccatgattgccttctgccatgattgtaagtttcctgaggcccccgagtcattcagaaccgtgaatcaattaaacctctttccttcataaattacccagcctcaggtatttctttacagccatatgaaaatggactaatacaggagatatttgcaatacctctatcaataaaggattacattagggatatatgctaggactaaacatacatatgctcatggaacatatgctttaggagtgtgtgttgcatatgtgtgtgtgtgtgtgtgtgtgtgtgtgtatatatatatatgtatatatatatgtgtatatatatggactgaatatgtatgcccgcctaaaattcatgtgttgaacctctaccctccaacgtgatgttattaggaggcaggttgtctgggacatgattaggattagatgcagtcatgagggtcctttagatatcacagagcttgcttgctctgttctgctctctgccatgtgagggtacaataagtaggcagtctgcatctgggaagaggtcctcaccagaacccctccatgtcgacagcctaatggcagactaactgtctctagaactgtgaaaaataaatttctgttgtttataagtcaccctgtttatgcaccttgttatagcaccccccaggctaaaaagacactatgtgtgtatatggaatgcacacatacacacacacacacatatgcaaataaaatattagaaatacatatgtgtatatcccctacaaatcgggaagataaagacaaataactcaatagaaaaaaggacaggcacttcacagaaaaggaaattatatgatcaatgaacatataaagagatgctcaacttcattagaaatcagggaaatgtaaatcaagaccacagtaaaagagtatttgatactagtttaactggcaatgttaaaaaaaaaaaaaaaaaaaaaaaaaagagaccaggcacagtggctcacacctgtaatcccagcactttgggaggccaaggagatcacttgaggccagcagttcaagactagccgggccgacatagggaaactctgtatctattaaaacacacacaaaaaaaattagctgggtttggtggcacttgcttgtaatcccagctacttgagacgctgaggtggaaaaatctctggaatccaggaggcaaaggttgcagtgagccaagatcgcatcactgcactctagcctgggtaacagagcaagctccatctcaaataaataaataaagtcaaaggaatgtcatatagtgcttatctgagtattcattagtaccaccactggcaaacaatttccatctcataaagttgaacattcatgttctctaagtcccagcaactcagctctcctgctcaatattgacccaagagatgctttttctaagtgccccagcagacatgtatgagtgtatttgcagtagtactgttcataatgacaaaaacctgcaaacagcccaaaattcattgacaggaaaatggataagccacagtgcagtcatacaatagaatactatgcagcagtggaacaatgcaatcattgtataaatcatagtaacatagtattgggtgaaatccagtactatcaattggatttcctaaaagactatctgtaagtcctaaaagactgtctataaaattcaggagcatagttatctcttgggaaaaaaaagaagatggtataagaaagaagtacatagacagatatgaattactggtactattatagttcttgggctggggataggttagcaagttctaattatattattaaaacataaagagtgcgagtgtgtgtggaccaatcatgacagtccttcgcataagaaatgtctacctcaaatgcctttgaggcaacacacaaaatacatacataataattacaactaagattctcattttcctcctctacatctataaataatgattattgtgcttcttggatcatttactgagccattctcctataaatgacttaagagttaacaaatctccatcacagccactgtctctgtctcatcaattctgttaaaaatgtggttctattcccatttgatcagaagagaaaactgaggaacactggagttaattatgccaatccccctagatttacagcttgtaagtagaagagtcaaagcttgaatgtaggacttgcaaatcaaaataaactctcttttctaaggcatcccagaagctctgggggcgtgggggagggttgctcgaaggagtctatgtgtatttatgaaagagtatcagagtcaccaggtcaacaataggcagatcacctggacctattttatctttagtatcattttcactctcatgattaagaagccatgaatagtgaaagctatagcttttctccatgaaagagaaaattatgaccctttataagcctcagtcctttctgtttcattagcctgacattctgctttgtcctatatagaaacatgaatcctgtgcttctatctggtgatccctaaaagattaaaattatgagattgtggagaaaaaggaacacttatacactgttgttgagattgcaaattagttcagccattgtggaagac

SEQ ID NO: 286 - DNA, 45011 bp, Homo sapiens
agctgcaatgtccagtccatggatggcttatttcacacagcttctggtgtaggttccattagctgggaaaacttttcaggtgggagtaacatgaagcacatttctttctgtttgtgtgtgtgttttttgtttttttattttttttgtttttttgagatgtagtcttgctctgtcgcccaggctggagtgcagtggcacaatctcagttcactgcaaactccacctcccggatttaaatgattctccttcctcagcctccccagtagctgggattacaggtacctgccaccacgcctggctaatttttgtatttttagtagagatggggtttcaccatgttgcccaggctggtcacgaactcttgacgtcaagtgatccaccctcctcaggctcccaaagtgctgggattacaggcgtgagccacctcacccggccagtctttaaggtcttgagctaggtctggacccataggcaggttggatctggatgctgggctctgaaaggtcacacttagtggtggagacagacataagaacaaataatgaagatgaagcccatgcaggctgtgttcatccaggcacaaatgtttagtggatgcagattggtgccaggcactgtgctgggtacatgcagtaaacagagatgtcacctctgccctcttcgagcttgcaacctagtggaggaagtgagttaacaggtgagtaaacaaatatgtctgtgtacgcatgggtaatggtacaaagtctggtgaatactctgaagggcaagaacaggatgcagcgatggagaacaccaggcgtggaggggtgctgcttacatttggtggccagggaagacctctcccgtcacgtagcacagttattggcatgcagtccccacccttcagcgttcactgttggtggcttccgactgcatgtccctgtgattcagcctgtgggcttcctctggcttcaggggcgtgcctggccagtgtgaggcaaatcagaattgtgggggtttaacatccctggcagtagccctcagcaaatgatggacaggagttagaggatgaatattccagccaccggagccctgcgcacccacagctgtcttctgctcgttgacataccttgtactggctcccttctgtccctttcttaccccctctcactcgctcaccagtacttctggaatcaccttccaaatgaaccatttgcatcaaatctgtgtctcagggcctcattgttggggagctcacactaagacagaggtgacatttaccccaaggcctgaaggataagaaggagctggttagctagagtgttgcagggacagctgtggtggctggaagagcatatgtgaagaccccatttgaatctaccatttcccagaaactgagaaagctattaaaacctcccccaaaaagttccaggcccacatagttttgtgggagaattgtttctaacttcaaagagcaaaaaatgcagatgttatttaagcttttccagaacactaaatgatttaatttatttttataaatccaatattaacactgataccaaaattctaccaacataggatacaaattaaaggtagagacctatctcatatacattgccaaaatccaaaataaaatattggcaaattgaattcggtagttctttaaatggcctcacggagttcaccttaagaaggtaaaaagagctcactagatgacatctattactataatatgtcatattaaataatcaaagggagaaaactattatctcaacagattaaaacaaagttatttgacaaaatccaacatcctttccttgattaaagaaagtccttagtagaaccagaatagacacatatttccttaacatgaagaaatgtatgtgtatcaatatacacatataaacatattcacgtatcttttttgtctctttttgttttttttttttcctttttgtgcagtacaagatctcgctgtgtttcctgggtagatcttgaacttctgggcttaagcgatcttcatacctctgcctccctaagtgctgggattacaagcgtgaaccattgcggctggcaaacatactcatatttatctcaacttgtgggactagaaaggtctgtatgtgaatgaattcctgctttgagaagtgtgtgtccacaggtcataaactgcaggctctagggtgctcattatcttaaatggctacatgtcatcttttcacaaacgtcctctggtatggaaaaagtagtgattaaagatgaatttcaggataggttacctgagatatgcttcaccataggggccagaggtgggaatggaagaagatacagatcaaacagttttgctgtgagttcatcattatttttttacattttttttttttattgatacggagtctcgctctgtcgccaggctggagtgcagtggcacgatctcggctcactgcaacctccccctcccaggttcaagtgattctcctgcctcagcctcccaagtagctggcattacaggtgcgcaccaccacgcccagctaattttttgtgtttttaatagagacggggcctcaccattttggccaagctggttgcgatctcctgacctcaaatgatccacctgccttggccccccaaagtgctgggattacaggtgtgagccaccacgcccagccaagctgatcattattgagctgatcaatactgaggccagatgatgggtacacaaggctcacttatactcttccctctacatttgcatatgtttggaattttccataataaaaagaagggggaaaaaaccccttaaagtcatgctaaccctgcaggaccaggaagcagtgcccagtcaccctgctgggacccagctgaggttagggaagatgacacaggacataaagtcagccccattcctccctcacagcaggcaagcttgggcaggcatttgaccaggaaggttgaatgggggtggagagctagacatcaagttctgctctgtgggccttctgtgcccaatcgcatagcagtgtgtgaaccaccaaggctccaggcaccgggcgctccaaccacagcagctcctgtgcccctttgctcccagaaaaggccacatattatacaattgcatttatgcgaaacgtccagaataggcacatctatagatccaaaatgtggattaatggcttccagtggatgccgggagggaggaaatgggtaatgactgctaaaaggtatagggtttcctttgggggcaatcgaaatgttctaaaattgatggtgatagttgcacaactctatactaaaaaccattgaatggtgaattgtatagtatgtgaatcatatcacaataaacctgttaaaaacactgagatgggacttttcacaccttagattggcaaaattgattaaaagtctagggacacaaattcataattgttgctaaaagtgtgaatgaatgccatctttttgaagagcattttggcaatctctactagaatttttatttatttatttattttagacggagttttgctcttgtcgcccaggctggagtgcaatggcgcgatcttggctcactgcaacctccgcctcctgggttcaagcaattctcctgcctcagcctcccaagtagctgggactacaggcgcaggccatcatgcctggctaatttttgcatttttagtagaggtggggtttcaccgtgttggccagactggttttgaactcctgatctcatgtgatctacctgcctctgcctcctaaagtgctggggttacagacgtgagccaagagcccctccaagaattaaaaatgcacatactctttgacccggcgcctctgctcgtgcctagccctgtggaaatatttgcagtatattcaggtacctcggggatctgctggcacattgtaagagcaaagaaactggaaatacggtaaatacacacccacggaaaacacaatcgtacaacagggtacagcacagccgttagaaagaaggaggcggattagcagcgtggatgtgaaaagatctgccgagatgtgttttaggtgaaaaaaatggcaaggtccaaaacagtgggcagagtgattttctttttataggtaaaaaatgctggcatgccaatgtcttcaggaaggaaacaaagagacatcgtttctggggagagcgactgtgatggaaaaagttttagttttcattttataatcctttggtatggtttgaattttgcaaacgtgggcattcgttaactttattttaaaaataccactgggattatctgtgtggcagcattacgggccattttcatctttatgcttttctgtattaaaaaagaaaaccttttaaaatatcctgcggtccagaaaaatgtgtgttggttctctgtgtgcatgtgatgaggtactgctgtcgtcccagaggactcaaattaaagctcatgccctccctctctgggcctcagtttcccctcctcaggagaaggcagcaggatgaggtaggggtgtgagtgcaggggggtgttgctggctctgaggtccagaggctgactccttagtgagtgttgggcagctccccctcctcctgctcatcttgtcctggggccggaggtgaagggtgagaaagctggagtggggagcagggttggctcctctgtaacaacaaaatgcagggtctcagaagatgcctgtggctgtagaagcagctgggggaagcctaagatctaagccagggctgcaggggcctctctgaaggttggtgcacagaggcctccctagactgccctgagagcgcctgaggcgcggagcatgtgtgcgcatgcatgccggtgtctgtgcgtgttagtgtgtggcttgaagagcctggggtgcctgtgtttgtgctcccacgtgtatttgtagggttatctctctgtttcctgcgtgcgacagaagctgatttcttgttaagctctggggctcctctcttagttgggctccttcccaggtctctagttttgtattcacagttttaatctttttttttgagacagagtttcgctcttgtcacccaggctggagtgcaatggcgcgatctcagctcactgcaacctccgcctcccaggttcaagcgattctcctgcctcagcctcctgagtagctgggattacaggcagctgccaccaaacacagctaaaattttttttgtatttttagtagagacggtgtttcaccatgttggccaggctggtcttgaactcctgacctcgggtgatccacccaccttggcctcccaaagtgctgggattacaggcatgtgccaccacacctggcctttgtttaaaaagaactgtccctccctcattgtatgaacatcaggcctgacaaaccctgactctgtccttggcatatgtatatctagattcacatctatatctgtgccttcctttcatatctgtgctccaggaacgtccctttctggggaggggacacggcagtgaagacactcagtgttttggggtgtcccaactttatcctgggacaatcaggaagacggagactaggagattggcaggggtagccaggcatggggctgggtgtggcagcactcactataagggtgcatctctgtctgtgcctgtgtgtgcatctgaatctggcaccgtgggtgtgtgcctgtagctgtgggctgtgtctcccttcatctgtgcagctgaggtaacaccccagagtgtgtgtgctgggtttgtcattggcaatggtgtggactaatgagttcccttggggccagtcctggtagttggagcaaatgacttgttgccaggagcctagagcagggagtgatgatttcacccacccagggtgtccagatatcccagctggtctccagaggccctgctcaactcatctggttgagaccaagactggggcctctcacaggggctctagcagtgcagtgatttctcatccccttggccatcacccggtcaccagtttggtatagatggtaggcagagatagccaagagtgagtatcaggtttccatgttgacaggatatgtgagtgtcccaggtcaacaagacctttgcaggcagtactggggacaggaggcagggttatttttcaagcccgctcactcctgttacagagctggctcacgaggctggaggaatctccaaggttgctcagaacatcagtggtcattctctgcttacccccaacctgcagacccactcaccagggtttcccaccctgctcggtgctccccgacgaagtggaccctcatggatgccatcacagaggattccttgatcttggggttccagttcgatccagccaatgggaagtgccagcagggcatcagaggctgggagaagagctaatttggggtattttccccatgtacccctagttttggcagtgactgtgtggcctcaaacctcctctcaggcttccccgtggcccataactagctattctcactggttccaggaaaccactccctctcctggacccttcaggtttaggggtgagagctccctcccctctgttgccaaccccaggtgctgcaccatctcctgttggtcccctcaacctcacccacatctcaggtaaatggcctgttcattaaacttttttcagaaatccctgtggagtgagacctctctttcttgctggggccctcctggtgcatagagttacatagaaatacaacttatatttccttgagaaaatatattttcttatttgaatgcaagctccttctggcctccgggactttgaacctgcagtatcttctggttgtttaagaactcatctcttcaccaataaaacaaacaaaacatgttttacatatttagctgagcttggcactcattaagggcataacaaatactagctagcattactgttattgttaccgttgtgttaaatgtgtatgaaatcacagggtcttggaatggaaatagaggtgctcacttgaattgaaaggggcatggttttaatgttgtaataggatgtctcaatctaatattagttagtgttttgaaatattgtatctgtgccaataattcatgtttggtgcatttctgtaatatcctttgcgtgcctgtatttttctttttttgtgtgacagtcttgctcttgttgcccaggctggagcgcagtagcgtgatctcagctcactgcaacttccgcccctggattcaagctcctcctgccttggcctcctgagtagctgggattacaggcacctgccaccacacctggctaatttttgtactttttagtagagatgggatttcgccatgttggccaggctggtcttgacctcctgacctcaggtgatccgcccatcttggcctcccaaagtgctgggattacaggcgtgagccaccgcgcccagccgtgcctgtatttttcaaaagaagtgttatatttgggactttcttatttgttttaagttgaaatatatttcaatattgcatgaaaggggaaaaacagttaagtatacaatgttcaataagtcagtgtcttgtttcattaaatgccatttaaaaataaaatacatatggttaaaaagtgaaaaaatgtatttcttcaaaggggccttccctgaccactgtccaaatcagggaccccattattctctctctcacagtctcagcctatgcctttcacagcagttaccacattttgtaatcacaattttccttcctaggttaaggcttgtctctcccactaaactattagcttgacaaaggctttctgaactcatctgctctgtgcagctgtgtccccagtgctgtgtcttagtgagcagacacactaggatactgcaacaaagaggcccccaaacacagcagcgtgcataacacttatttcttccccacgtgataatgcggccggttggcccaggctttcatggtggtttgaaggtgttcacaagctccagggcctccgcagaccacttaactctttagctaccaggacacaattttaaaaacccttggccaggcattgtgactcatgcctgtaatcccaacactttggaaggccaaggtgggaggatcgcttgagcccaggagttagacaccagccttagcaatatagtgaggctgtgtctcttaaaaaataatttaaaaattaaaaaaatttaaaaacccacttattcagaccaatcccactctctttggcctcagcttcaggtccaggctgcccagatcctcattctcccaaccagaggatcatctgtgtggcttcccaaactacagagcaagttccctgaggggaagtcggtctctcacaaatgccacagggccactgcatgcactctgtcactttataaaatagtacttattccttctgtggtttacatctgcccacatccctgacctttgagtgagttacttcaccattctgtgcctcaatttctttatctataaaatggggatgacaatagtttgcctcctaggactgtcagaagagttcgacaagcaaaaagcatttggacttcaacttagcacatgacagatggtctctgaataataatcaacattattgtctcttgattccctggacttgcccatgaaatccagagaatgaagtgcaaccagaacttcattttcttccttttttttttttttgagatggagtctcactcttgtcgcccaggctggattgcaatggcgcggcctcaccgcaacctcccctccccggttcaagcgattctcctgccccagcctcccgagtagctgggattacaggcgcccttcatcacgcccagctaattttttgtatttttagtagagacggggtttcaccatgttggtcaggatggtctcgaactcctgacctcaggtgattcacccgcctcggcctcccaaagtgctgggattacaggcgtgagccaccgcacccggcccagtacttcattttcagatgcagacatgaaggaccagaaggctgaagcaacctgcccaaagccactatgctggcgggtggccgagtttgggtttaatccaggcccgaacctcagttccctcaagataaagttggggtgattatggcacctttctcaggattaggttgtgaggctcagatgccatcatgcaatcatggcaggcacacgggggcccctcttcaaacgtctgtgcgcttcccttgtgccccgccctggcacacagccgcccccgcggagcccagggatcccagcccggcagtcctccgtcagctgcttctgtttggatggcggggacggctgggccgacagagaggcccattgtctccgtcctctggggctctattgttggggcctcctcctgggttgcagccccacggacaaccccagctgtcgcttgggcctggctcagcttaccccggcggtgagggtgcgggtcggggacggagacgcgtgcaccctgaagacagtaactaggcctgctctacagagggaaacgcaggctctgagagcctacatgtcttcgccgggagtgcttgtcccggagctgctcgcagactgggccgggggtgggctcgggtcggagaggtcacggggctccttaggtcacaggcggcagggccagagaaactcccccgcccctacgtttaactcgcggaaacaagggcccagagagcccagacgccagcccaaggtcacacagcgaagccccggcacagcccgccgggaacctgtcgtttctaacccccagcctctcgccgtttctacccagcttgggaagcgcaggaacaggacatacggtggtcgcgccccttccgcgaggccggggtgaaacccgcttggccctcccgccagggggcggagcttccgaaccaggcgggattccaccgggtatttgcctgcggaggcgggacttcgggcttgatgggcgttgggggtggccttcctgcgggcaggctctctgtgtcgcaacactggcggggcgggccaaatcggccagagctctgcccccagaggacgcggctaagcccgggggcgtgtcctgggctggccccacccgcgccccgccccgccccgcccggtcgcggagctgcggccagctttgggagggccggccccgggatgtgagtgccgcggggcgagggcgggggtgggctcccaggggtcccggtgggcgggcgcgctagggcgagggcggggacggccgggcgggcgcgccaggtaagggcccagatttgctggtgaggggtgagggacgctcgggacgggtgtttccaggccctcccggcgcgccaggccagccccgcgcccctgctcggtggcccgagggacgcgcgccggccgcgggcctgggcccggacccggagcggtcgggcgatgtgcgcgggtctgacgtctgcgctgcccagccccctggctacgcggacgcccccacggaggcagccactggggcggatttctgtctctgggtgacgactgccagggtgtgatgggaagggttagcagcgcagcggggtcaggggatccccgccccccgccctggctcaggttgggtcccgacttgggtttctgagtgcttactgtgctcagctcctcagttgcattctctgagtcctcacaacagccacacattttgcagccgaagccttgtgccacacagctgtgggggcatttattacggtgcagaggtgatgcgcggaggccttgcagccagacacacctgagtgcacgcctgcttctccacagacctgcactgtgaccttgggcacacctggtctgctctctgagcctctggtgcgattgtggtgcctacccccagggctgctgtgaggactggattggaattgggttccgggaaaggcagccagtttaagcagctgttgttgaggggcccttgtctgcggctgaggggctagtggtgctgggcaatggctggtgggtcagtccaggcgggctcgggagggagctgctttctgccgaggctgccccagctgtgcgtctgtctttttccacacggtaggctacacacaacccagctgtaccagcatgtgccagagacacgctggccaatcgtgtactcgccgcgctacaacatcaccttcatgggcctggagaagctgcatccctttgatgccggaaaatggggcaaagtgatcaatttcctaaaaggtatggaaggtcccccttggactctcatctgcttcctccaacccacctgtcctctccgtcctcatccccaacataagcctcaggctctctcccatcttcagtttcagccctcggatggccttccacccatgcttccgcccaaaatgatttttccaacacagactcctaatcacgatatgatgtccctgactcagactctccctggctccccatcctgtgggcctaagtcctgcctctgcccaagaggcctagtggaaaggtagctgattactgatgggcacagggaaggtgaagcttggaggagtccatttcctaaggttcagagagtcaggaggtagagcacctccaccgcacctctcttgattacagatgggggaaattgtgtcctagaatgattaggaaacatgtgcacccaattccagtccagtcctcacagcagccctcggggtaggcaccacaatcgcagcagaggctcaggagctcactgtaacctccgcctttcaggttcaaacaatttttctgcctcagcctcccaagtagctggaattacaggcgtgagccaccacacccggccctgatttcttaatatggcactcattataagattgtaaaagcccacctgtagaccgaactgggcacactggctgcctgcttgtgacctctttccagggaaggacacagctcccattagtggctgaagtaacacagttacaagaggcggagttgggtttggaactcagagctccaggcgccctacctttagggctcatccccttgagcaaaatgatgcttcgaagagcatatcgttttaactgtggtttgtaatcaaggggcctgatttaggtgggaaattcacttaaacttgttttaaaaggaaacattatgtcatcaaaatgggaaaaggcagtttcacttgccataaataggtcatggtaaaaaagtaaatgcaatgaaaacaacagtataattcaatccaggctggttactattgcctgcaggctgtgagactgattagtggtttgaacggaagatgagcaaagcacaggcaggtgttgcgaggccatgccacactgagcctcctgtaatatcatcagaaggtggagggaggccgggcgcagtggctcgtgcctgtaatcccagcactctgggaggccaaggctaggagaacacttgaggccgggagtttgagaccagcttgggcaacatagcaagatcctgtctctacaaaataaaaataaaaaacttagctgggggtggtggtatgcacctatagtcctagctacttgaaatgctgaggcaggaggatcacttgagcccagaagttcgagggtgcagtgagctatggttgtgccactgcactccagcctgggctacagagcaagaccttgtcttgcatttatttatttgtttatttatttattgagacagggtctcactcccatcacccaggctagagtgcagtggcggaatcaaggctcattgccacctcaacctccctggcttaagtgatcctcccacctcatgtttttgatattttgtagagatgcggtctcactatgttgtctaggctggtcttgaactcctgggctcaagcaatccacctgcctcaacctcccaaagtgctgggattacaggcgtgaaccaccacacctggccaagaccctgtctctttaaatgaattaaaaaaaaaaaaagggcggggggaaggtggagggggaattcctaagaagagtttttctcactctgagggtcaacatccctgacccttgtgccacctgctcctgaaggttgtctagcacacctgagctctccttgtgactatcagtggcttgggaaacatggggattgctgtgtgtacgatgttcattgctccctggccagagggactggccactgtccacagtggctggggaggctaccccttctcagaaggcccacaagccagcagtgcctacctacccctggggcaggggctgccacaggccaagtctgcagcctgtgggagggtctggggctggccctggccttgaggtcagtggggaagcaggatgctccctctgtggtttcagaagagaagcttctgtctgacagcatgctggtggaggcgcgggaggcctcggaggaggacctgctggtggtgcacacgaggcgctatcttaatgagctcaaggtacaggatgtcgggcctggggggctgcgggcctggggcagggggctgctggccaggagtggccagaggcaggaggtgactcagcctggggaagccaagtctcacagggcacccattcatgtccctagtgttggaggaacatgggagtctgtggtccccaagagaaggagagaggtcataaaaaggcagacctcagtttgggccaggccactctgagggtggtgtcctccccttctccagggcgtatgaaagccttcatagaattttaggcttctacattatgactttcaagctgtgctctgtcgacacgcctccgagaccccagcccctgtcctccaaccatacatagctctttcactttggtctattttgtttgtttgtttgttcatttttttgttggtttttgttcttgaaatggagtctcactctgtcgcccaggctggagtgcagtgatgtgatctcggctcattgcaacctccgccttccgggttcaagcaattatcctgtctcaccctcctgagtgagtagctaggattacaggcgcgtgccaccatgcctggctaattttttttgtattttagtagagatgtggtttcgccgtgttggccaagctggtctcgaactcctgaactcaggtcatctgcccacctcggcctcccaaagtgctggggttacaggcgtgagccaccgcacccaccctattttttatattgggctgaagtttaagactctggtctaagtacttctgctgaagttttgttgaaaattgttggtctaaaaactaatttgaaaccctcagggctcagcagagaagagaaacaagtgggagggccggtggtagagtctgaggtgaactcctgccccttcccaaggggcggctcctcagctccactgtgggcccggcatggccagagcacctggtcttcaaagagaagccaggaatccagattattaagtgacatttcctgattttttttttgagactgagtctcgctcttgttgagcaggctgaagtgcagtggcacgatctcagctcactgtaacctccgcctcccgggttcaaacaatttttctgcctcagcctccgaagtagctggaattataggggtgagccaccacacccggccctgatttcttaatgtggcactcattataagattgtaaaagcccacctgtagaccaaactgggcacactggctgcctgcttgtgacctctttccagagaaggacacagctcctattagtggctgaagttctgagggctgaggcattcagttcagtgctctttgtaggaacagaggggaggttggggcgggggcttgcattggaatctggtactgccagcctgccttggtgggggtggggtcagggatgcctcaggttatctgccccaagagtgtgggagccctgacccccaggctccctggctgagctcaccttagactcagagccacagtggatgcctgaggccagcaggcccctctgctccacaggtggaaaagcctaggtccagaaagaggctgtgctcaaggtcacctgggaagttggccgggccttggggagacccctggcaggtcatccagtccagtcttctaggttcccagtcagggctgctgcctccctgctccccaaccgcagcctgaggtgtgagaattctagatagggccacgacagtgtgagcacatgaaagattaccaggaagaggttgaaacctggctcctgggagagagaggggtgtgaggccttggcaggaagcccagtgcttggctgccctggtttcctggggcccaggcatgcgtggtcacagtccacagcctagggctgggccaggaggacatgcctgccagagtcccgagggtgaggggaaggaagggacaggaggcgctcagctggggcagggagaaaccaaaacagaatggtgtgattgaaccaggctgggggtggggggcctaggttccagggccccacccatttgaggggccttcaggggaactgtgttgggcaggctgcatgcctggccttggtcccccaaaagcctgaaagcagcttactatgtgatatataataatacaaaatagctgggtgtagtggcatgcacttgtagtcctagctacttgggagcctgaggcaggagaccttgagcccaggagtttgaagctgtagtgagctatgattgcaccactgcactccagctggtatgacagagtgagactgtctcttaaaaaaaataataaaagtattaacaggtagagtcccaagtagaaaactgaggttgagggtaggaggagaattcaggtatgtccactgaaaaagttaaccaagatggtgatccagctgcatatttggcttggagctccctggcagtcagaacaaaaggagaaacatgatggtttctacggcacctattaagatgaagaagtaggccgggtgcagtgactcatgcctgtaatcccagcactttgggagaacgaggcgggcggatcacttgaggtcgggagtttgagatcagcctggccaacatggagaaaccctgtctctactaaaactacaaaattagccaggcatggtagtgcatgcctgtaatcccagctacctgggaggctgaggcaggaaaatcacttgaacctgggaggtagaggttgcagtgagccgagattgcgccattgcactccagcttgggcaataagagtgaaactccatctcaaaaaaaaaaaaaaaaaaaaaagaaaaagatgaagaagtagtcagtcattcaacacatctgtattgaatgccaactgtacagagagaataagacagcagggctctctgccaccatggatttgcatttgagtcgtggaagattaaaattaaggaagcaaccacccaagagcattttagagagcaccaagggctatgaagaaagtgaaaaatagagggtaattggatggtcagggagggcctcacagaggaggtgatgtttgagttgagactaaacaaaggagcaggtgatactcatgtagaggtgttttttttttttttttttttttttggagaaggaatctcgctttgttgcccaggctcgagtacagtggtgcgatctcagctcacagcaacctctgcctcttggttcaagcgattctcctgcctcagcctcccaagtagctaggattacaggcacctgccaccatgcccggctaatttttgtatttttagtagagacggagttttcaccatgttggccaggctggtctcgaactcctgacctcaagcaatccatctgcctcggcctcccaaagtgctgggattacaggcatgagccactgctcctggccctcatgtatagctttgaaggaagaatgtttcagaatcccaggcctggagggtggaggggacttgatcttccaaaggggagaagaatgcttgggaggccggatggaagggaataaaacattgtggctcgtacacggtgcagttagggaggccagagccccaggccacacaaggtcttgcaggccgtgggaggagtgtatatgttgttccagggaccttggacagtcacgagggggttttcagcaggagggtgatatggtgtgacatgcccttgctgcccaggtgggacccaagcccgtttcagacatcatctggcacctaaggctgcagctcaggaacatctcccacctccctgcagatgtctgcaatgtttcttttctccttcctctgctgtgggcgcccagagagtgccctagagagtccttcaggtttctcaggctgcttttccctggtcattctgtgtgtgctgtgtaacatccaccgtctcccctgcctcatcccattctacccccaacccctgcctggggctcatgcctgactctgcactggtgtggcctttgatacttaataaacagggcactgaaggagaagcaggagctggacgtttgcaagatgtcaattcagggaaacccatgtttatcaagctcctgctgtgtgcaaggtccagggttggcccctctgagggtagctgttgagctccccagtgccccagcactgggctcttgcctttggttgattctcgggtgacagtttgccatggagtgtcggttagtgctgggcagcatctgacatcctgcccctgtgcactctgcactggacagtgctcagaacacgtggatccagcaagtgctcagagggcaccactctgtgatctaggtgctgcagggatgggatggagcaaaagaccacatccctttcctgctggagctggcatttaggtgggagagtcagacaataaatgtaataattaagtaatgagataatatgttagatggtgctgagtgtcgtgaagaaaggaagggacagcagaaaaggggtggggagagctggtgagaggatggcagttttaaatcaggagtcaggaaagggcttactacctgtgatcacaggtgacatgtgggaagggagtgagggagtgggtgatgtggtcatctggggaagggcattccaagcagaagaaacagcaagtgcaaagatcccagggcagaactatctgtcatgagttccagtatagtgtggagagaaggagacacagaccatagctccatggagcacctggagggaccctggagagtctctaggggagtgagctcctcttggtctccaactctctcttctcttccctgaggggctcctctctcctttaaaaaaaaattttttttaattgtggtaaaatttacataacaaaattcgccattaaccactttaaactgtacagttcagtggcctttagtccattcacaaagtgctgcaaccatcatctctagttccaaacattttcatcactccaaaaggaaaccctgtgtcctttaaacacttgctccccatttatccccccaagtccccttggtaatcactcacctgcattctctctctatggatttgcctatcctggatatttcatataaatggaatcatacaatatgtgaccttttgtgtctggcttatctcactaagcacagcgttttcaacattcatctgtgttgtgttgtagcatgtatcagtacttcattccttttcacagcagaatgatattccattgtaaaacactacattttttttatccattcattagtttataggccttttggctattgtgagtagtgttgctgtggacatgtgcatacgagtatttattagaatacctgttttcagttatttggggtatacacctaggagtagaattactgggtcacatggtaattctgtttaattttctgaagaaccatcaaggtgatctccacgggggctgcaccatttccaccagtaatgtaccagggtcccaatttctctacatccttttcaatgcttgttattttctggtgtttttttttttcccccccagtgtggccatcttactggatgtgaagtggtatctcatggttttaatttgcatttacctaatggctaattaacactgaggatcttttcatgtgctgattggctatttgtatatgtcatttggagaaatgtttattcaagtcctttgtccatttttaaaattggcttgtctttttgttgagttgtagggttctttatatattctggatattatttaatttgtaaataactcctcccattctgtgggttgtcttttttttgatagtgtcctttgatgcacaaaaattttagttttgctgaagtccaatttatctttttttccttttctttaggtgtcatatctaagaatccattgccaaacccaaggtcatgaaggtttaccgcatgtgttttcttctaagagttttatagttttcacttatatttaggccttgataaattttgagttaatttttgtatatgtgtgaggcaagtccaacttcattgttttgtactcagatatccagttatcccagcaccatttgttaggctgtttttcccctgttgaatggtcttggtacctttgtagaaaatcaactggccatagatgtatggatttatttctagactctcaattctattcatttttttggtttgtttgtttaagaaagggttgcattctttcgacagcccaggctggagtacggtggctccatcttggctcactgcaacctccgtctcctgggttcaagcaattctcccatctcagcctcccaggtagctgggactacaggcgtgtgctaccatgcctggctaatttttgtgtttcttggtagagatggggtttcaccatgttggctaggctggtcctgaattcgtgacctcaagtgatttgctcacctcggcctctcaaagtactgggattacaggcatgtgtgagccactgcgcccagccaattctattcatttgatctatatgtcaataccacactattttggtactgttactgtggcttactgtggttattgtggctttggagcaaattttgaaattccagattgtgaggcctccaactttgttctttttttttttttgagacgcagtctcgctttgtcgcctatgctggagtgcaatggcgcgatctcggctcactgcaacctccgccttctggtttcaggtgattctcctgcctcagcctcccgagtagctgggattacaggcgcccggcaccacgcctagctaatttttctatttttagtagagatgaggtctcaccatgttggtcaggttggtctcaaactcctgacctcatgatctgcctgcctctgcctcccaaagtgctgggattacaggcatgagccaccgtgcccagccaactttgttcttttttaagatcgttttggctgtttgaggtcccttgagattccatgtgaattatagcatcaacttccattttttgcaaaaaaggccattgggattttgacaggaattgcattgagtaaattgctttggggagttttgccatcttaacaatattcggtctttcaatccatgaacatgggatgtctttccgtttatttatgtctttaatttctttcagcaatgttttgtagctttcaatggacaaatcttgcacctcttggttaaatctattcccatgcattttattcttttcgatgttattataaatgaaattgtttgaatttccttttaagattgttcattgctggtatatacaataatcagttgtatagaaatacaactgatttttttgtgttgatcttgtatcctacaactttgctgaatttgtttcttagcatttttttcttttttttttttttttttttttttttagacagagtctctctctgttaccaggctggagtgcagtggcatgatctcggctcactgcaacctccgcctcccaggttcaagcgatttttctgcctcagcctcccaagtagctgggactgcaggtgcatgccaccatgcccagctaatttttgtatttttagtagagatggggtttcgccatgttggccagtgtggtctcgatctcttgacctcgtgatctgcccacctcggcctctcaaagtgctggtattacaggcatgagccactgcgcctggcctgtttcttagctttaatagttgtgtgtgtgtgtgtgtgtgtgtgtgtgtgtgtgtgtgtgtgtgtattctttaggatcctctatatataacatcataccgtctgtgaagagaggtagcttcctttccaatttggatggcttttatttatttttcttgcctaattcctctgattggaacttccagtactatgttaaatagcagtagtggagcaggcatctttgtcttgttcctgatcttagacagagggctttcaatattttaccattgagtataatgtcagctgtggggttaaattttttaacgccttttatcatgttgagggagttcccttctgttcctagtttgttgagtgattttatcacaaaaggctattgaattttgtcaaaggctttttgtgcatcaactgagagatcgtgttttccccttctctgcttttgctccccttctactggtagaaaggacccacctaaagcaagcagtgggcgccctagaggggttacagcctagctcttccctgagagcagttcttggtttgaacctgagggcagcgggtccgcctgaggaaaccaggtgtctggaaggtgaaggcttgtggagctgagtagatggggcagtaggtcccagagatatggccagccccagtcatgtcctgctctctgtggagtcccacagaggctgacgaggtatgggggccctgatagctggctacatgcaggccatgccctttggcgggtggtggcgtcagtctggggcagacctcccatgctcacatagtgtgctcattcacccagcactgccttaggttgggctccctagaatggtggctcttaaaccccagcaagtatctgaaacactggagggcttgttccagcagatggctgggcccctcccagagtttctgatccatgttgtcttgggtagagactgggaatctgcatttctaatacattctcaagtgttgtggatgctgctggtctgagaaccacatccctagaagcagagtctgagatggtgcaggcgatttcagatgaaccctgcaagaggcacaggcagtggggagcgggcagagtgagcagctgagcacagatgtggatttggaagtgtggcctcagcctgattccatggagatctctggggcgtgaatgtcaccacagggttgccctgcccagaagcatgtggcctggctgttacaggcccttgtcagtcatggctctcctgggatgatgcaggtgaggtggcttctgtcaggagaagggctctggtgcaccagccagaaaaggggatcaacggcatgcatggccagcacctactgtgtgccaggcatggcctcagcactgtctgcacagcagtgagcagacgcgtgctgtcctcctggagctggcatccttttgagggagatagatgctaatcgggacagtctgtagcctcagggagagaagtgctatctgggaagatgaagccaaggtgtgggctccagggggccccaggtgggagtattttattttatttttttgagacagagtttcactctgtcacccaggctggagtgcagtggtgcgatcttggctcactgcaacctccaccccttgggttgaagagattctcctccctcgcctcctgagtagctgggattacaggcacctgccaccatgcccggctaatttttgtgtttttaatggacaccagatttcaccatgttggccaggctggtcgtgaactctggacctcaagtaatccgcctacctcagcctcccaaagttctgggattacagatgtaagccaccaagcctggctgggtgtggggattttagattagatgaggaggacaggcctctctgactggtttccacctctaagtcctcatccaaagccttgttttatagatgagacagaggcacagagaagtgaattctaaattcacatagccagtggcagaacccagacttggaccagtttggggaacttctgagcctgtccaccccagtcctagcctcacccacagtgcccttgcccagggcgagactatcagggagcctgacctgctggatctgggcagtcccaccgtggcatgctgcatgtcccagagaaggtatctgtcagcagtgcagcaccccccacctgccccacccacagctccctcgggggctatccctggaagtgttggtcagaaagtgaatctccagatgtcacctggtggtgccctgagctcctcctacctgccacctcctctgaccacatagagcctgctctagcccaggccctcttccctctcctcccctcacccagggacccgccactagtccgccccacccactctgtttatttctcaccttggccactgatgggtggtttctcctagagcggtgctgccctgtggaaccttctgcaatgatggaaatgctcagacctgctctgtgcagtccagtcgccactggccgcatgtggctcttgaaatatggagagtgtaactgaggaaccaaacttgaatttttaaaattttgatgaatttacaatcactcgtaagtagccacctgtggctggcagccactggattggatggtgctggtctagggtgttggcaaccacatcactgccttgtgcagaaaccactgctgcaccaggagaaggcccaagtgccagcctcctcttcactgcccgaagcctgctgctccgctgaggggctcgtctcgccaacgttggcacagcaaacacacatactttctcctgtgggggctggtcctgctggccaagtcccgtgcatgctcctgggtggctgcacctggcccctgcaccaggtcaggtccaatctgtggaggataccaaggaacctctttgaggttcccaagtgtgtcccatgccactgcagttttgcagaaggttagtgtgtgtgacttaaaaggcaaagagggcaggcagatcttctgacatctggggggagcaaagttagaatggaatatttgctgcagaacttctcagagcctttagcatgctaggatgtgctgcaaatctccaggaggcaggcggcataagccatgcttcccaaacgacttgccggtggaagcctccttgaggagtgctgtgcgagacccgtggctgtggagcacacgagagaatgcctttctcgtggtttgtgtccatgctgggctctcggctgcattgtcttccagtctgtgtcccctgctggcttcccagggagggagggaggctgtgactccatgtgctccttcagcggctcgtttgtttgctcattcgttcatggaaaaccatggttccatgccagccacacgcggggcctctgccgggcagtgggatgagtgtggtgaacaagaggagctgatgacctcaggcagggaccttcctttctctgggtctgtcccgcaacatacacacacgcacacacgcacacggacatacctgtgcacacatgtatacacaagacacatacacacacatacatacactcatgggtgtgtcctgcagctgtctggctgtgctggtcccagctcttacactcccaccccttcccaggccctgtgatgcctccatgttaccgccagagggcctgggcttgtggaagtggtgccccgtgggcacctctccttcccgaccatgagtgggaccctgctcactgccttctctaccagagtgagggagtgatgccagcttcccccgccttcagccgcccttgccggcctgggctggtggccatgggcattccccagcagtgtgggcaggctgggtgcctggcacccccaggactatgacagaagcctcccctggtggccagggcctaagccatgaggcccctgctggggcctgacttagggtgtgtcctgccttttgtccggccctgagtggcctggctacagcacctcttggccctctgaggttcgtcacccctctgccatcacacccatccctggccaccctctccctgcctgctgcctgctgtctgtcattgaacatgctcgtgtttctcccatcctaaaactcctcctcctggttggtgaacgcaatggccacacttcccactttcctctcatggaatgtctgcagcttggtgcctccctccacctgctccttccagccaccctctctccacctggcctcctgagcactgcaccttaggtctttccacatctcaccctgtcccagggaagcccttgatcgtccccaggggttctctctctgggccttgcccttcagcatgggaagcctgcagtcccaacccagcccttcacctcccactctcccacccctgttctgagctccagtctcacttaaacctcagctgtctcacctggctgccccaggggctgacttggcccatagagagcagaacctagtgccgcctctgtaccctgcttcaggttcacctccaagtgccattaccctcacaggccccagacccgacacctgggccctctaccccttgtccctgcatgctgcctgctaatacctgctcctcttaccaccccagacccttcttatctcatgcttcctctctagggctgctacttctctattcctgttcccctaattggttctccttgctgcagctagtgcagcttgggacagcaccatctatggttccctactgccctgacgacaatgtgtgagcctgtgctaggagaccaggccctgtgtgataagctcagcctgccctgttccagctgcacccaccttctctagatcatggactcacttctctgcccacagatacctttttcccttgacctctgcatctggataactcctattcactcttcacctcctgcaaatgccatcacccccagaaagcctctctaataacccccacccagttctcctcttcatcaccacactcatcacactgcaaataagtgtctgcaagtgtcctggcatgagaatgggccctccagtgcccacctggggcacctagcaggcacttagtaaatatttacaaagtgagtggctctgcctcgcgtgggtggggagcagggatgcgttttcagccaggagatggcttggggtttgggttcagctgggcagccagtgccatggatatttacctggtgcacttggaggtcacagggcacactctgtcctgatcttagtgcagatacctttcaggtaccgtagacccccccagcctcagcagctggagatgagggcagtgcatcccttttgccaggaaggtccgattcccaatggacaaagaggcaatgcagtgcgagggagccagaggccagggctcccgtcccagctctgtcagtgactcattgtgtggccttgggaagatcctcgctgcctaggcctcagtgtccccttctgtacagtgggtggtctagactaatttgttatcccaaagcagtcctagacctgcactgctgacttggagccctctgcacctcctgttctgggcacaagagggcagccaagggcctcagaacgctgaggaaccctggccaactagctttaagaaatgcattgtgtaaactgctctttactgagcccagagcttgccaggagcctggtagggttgtggctctggctctcatttctaccaaaggaagtgtgcttgaccagggagttcatccaagggcacctggaaactgtcctcaaggcatttcccggggaaccaatttctcacgggttgcctcagggtggggaagcggaggccaacagcccctgtctttttccgcagtggtcctttgctgttgctaccatcacagaaatcccccccgttatcttcctccccaacttccttgtgcagaggaaggtgctgaggccccttcggacccagacaggaggaaccataatggtaggtggggtgggggggcatggctgggctgggggcccccacaccccagggtccttctcacctcctttgccctggaatgccctcctcccacttagtagttgaacagaatcctaaatattcctcaaggctcggcaacaatgaccctttctccaaaagccttttttccccatcttgggacatcagaattctcttctcatcgttccttctcctatgacctcctatttgttaccgtaattgctagtatataatatacctctccacccaccaaagcggatatcctagcactatggctttaaggcacaccccctcaccagttttttctttctttctttcttttttttttttgagtagagtctcgttctgtcgcccaggctggagtgcagtggtgtgatcttggctcactgcaacctctgcctcctaggttcaagcgattctcttgcctcaggctcctgagtagctgggactacaggtgttcgccaccatgcctggctaatttttgtatttttagtagagacggggttttaccatgttggccaggctggtcttgaactcctgacctcaaatgatccactcaccttggcctcccaaagtactgggattacaggctttgagccaccatgcccagccctaatgcacccaaaattaagatggagaactgatcctccatgacttcagtgatgaataagcctccacgtctcccccactgcgggtgtggcaacaaagaatccccacagcaaaattaggtttcacattgtgtgtgtggtttttttaaaaaaatgtgccacacactgcctagttatttggagatagaggaatgtttcacatgcaaatgtatgaggatctaacccagccctggatcactacctactgatcccctacagttctgttatgtttgtaaatttgtactttttcctttagcttagtagaatattactgcccatccccaaaactatgatttcctggaagatttcagtatttagtctactatatttctttttttgctttttttttttttttttttgagacagagtctcactctgtcctccaggctggagtgcaggggtgtgaccttggctcactgcaacctctgcctcctgggttcaagtgattctcctgcctcagcctcccgagtagctgggattacaggcacacgccactctgcctggctaatttttgtatttttagtagagacggggtttcaccatgttggcgaggctggtcttgaactcctgacctcaagtgatccgcctgcctcggcctcccaaagtgctgggattacaggcgtgagccactgcgcctggcccagtctactgtatttctgtgagcaaaactttgcctattttccctttgaaagccatatcaaaattattgtcagctcatatgtgatggatgataagtacttttattttttccagtttccttgcacaatttcaaaggtgcttatgcactgtacatctcatatgccagccaagctggcacttacttcctggactgttgcttggggtagggagttccttctatacccctgccttgtagctcagctcatccttcccccagagctggctagaagcagtgtttatggaatgagtgcatgaatcagtgaatgaatgactggtggatcggctgcctgcgccccctcaccctctgcttgtctccaaaggcggggaagctggctgtggagcgaggctgggccatcaacgtgggtgagtgctgggaatgtcctcgggaatgtccagcccggcttggtggaactggcctgaaagggggctgggggagggcgggaggatcctggaggtggcagctgtgaattcagaagctctggttttcccaagtcaccctagcctccttgtggagtggcctggaggttgatgtgtagcctcctaggtacctgggagagactgaccagtgcctccatctgacgtgggatccttgtctaaggaggtccccgggtggttccccagccccctctttgcgtacttccggtggcagggagcttcctcccttccagagagcgtgtgccatccttgggcagctcagcatggtctgaagcctgccttgtgtcttccctgaaggactccacctgtgtcctggggcccaggacagcccacagaggcttggtcatgttgggttgggtgggcacatcctgggtcaataccaccaccttctcaagggtccagagggcccgtgctccccagcccccttgaatctcccacaagattggctcatgggagggctgcacgggagtctcccttgtccctgtcattgtccctcctggaggcacagcacttgacaatttacaaagctctttttcaccaggctctttttttctttttcgagacgtagtttcactcttgttgcccaggctggagtgcaatggcgcgatctcggctcaccgcaacctccgcctcccaggttcaaacaattctcctgcctcagcctcctgagtagctgagattacaggcatgcaccaccatgcccggctaattttgtatttttagtagagacagggtttctccatgttggtcaggctgggtcttgaactcccgacctcaggtgatacgcccacctcgctcggcctcccaaagtgctaagattacagacatgagccaccacgcccggccttcacccagactcttatttgagctgggcataattgtcaggcctgtctcactgatgaggaaatggccatggaaagatgcgtactggatcgtgtagagccctaaagcagggtcccccagcctttggctctgaactctgcaggggagagtccaccttgggccactgcacagttgaggggagccccactctgcaggggctgggtctcttccatcttggtattaccaggtgcctagcattcagtctggcatagtaatgatgttatggtactctgctgcacaaacccgggagtgatctgtgccctgcgtgtctacagcagggttccgaggagggcctggatggccctccccatggcaggtgttactgcctggtagaggttaagagcctggatcctgatccaccctgggtttgatcctggttctgccattacctggctgtgtgaccctgggcaagttgctgacctcctctgtgggtcagtctcctcatctgtaaaatggggatggtgatgctaatgcccctcctcgggctggagggagtcttcagcaagctcagttgctcagtcaggtgttcactgtggctgtcttctcatcattaggagccaacagtagcctcctggggggtgggagaggcaagttcctggtatccatggggccagctgcacactgtctgacggagcagttgttgggctcaatttcagagggcctctgcaattcaggccatcccaggggctgcaggggagggggtatctatgggccctagggctctgaggctgtgtctcagggttgaggggtgatggatcccgggctctagggccctcctcgtggctgtaggcagtcatgaccagcagagggtgcccttcctgaccacccgctttggccactggcagaatccgtgtggcccccataccaccactccttcctggagtggggagccacatggagccaggcccagcttggtggggacaaggagcagctttctgcttctggaatgatgagctatctgttgcttaggggtgtgagtggcactgaggacttgctggggacaccctgaagatgtggctgccttctggcctggggatggtgacatgccccagcactcagcttagtttgccaacccagagtccgaggcacaggttcctgagagctgagcagggaggatgctgggggaggtgaagggatggaggagctcctggactgagcctgggagcctggctctgagcagcaccgctctctgcccttccgcagggggtggcttccaccactgctccagcgaccgtggcgggggcttctgtgcctatgcggacatcacgctcgccatcaaggtgtgtctatgagcaagtggggtctcgcctccaagagccctcctggaatcctccccatagctccaaattaactgttctcaccctgaattatagacaaggggcctatgctggagcagggagggggcttgtttgggttgctcagccaggctggaactgaatccagatctgacacttgctcctcttccatgttgcttagaagggttgcctgtggtggaagggagttattccagcctcccacagagccaggggactagagagggtcaggatctgctgtatagccacatattaagttgtaggaagaagggcatggctggcaaagggagtagggagtggaaagaatgatggtgctgatagcacctggcagttctgcatgctccaacccgcgctgtgctccaggacttactccctgaatcctcgcagacagacaggggcccacagaggtgagggcatgcaaatagcaggggcagaattggcgctggcctctggtctgtggggccccacaactcccctgccactctgtgcctggccttgtgctgggcatcaggaactgactgacctgttcctatgtgtgcctgctctcatggggcacatagactgatggggggaagcaggccattaggagaagggggaagcacaggagaccttcctggggaggagggaatgaaggcttcctggaagagggggcatttaggacttggccttgtaggataaggcagaggttggggactgaagtcccagggctgtggggattctctccttaacccctacacatttcctagggaatctgggaaaatccagggcctgagtgacccacttacctcctgacctatgacccttcagggcacaggacatgccccctcctccagggagccttccctgaccacctcctgcatgcacacatggagccccacagctggagctgcacagctctccctggcaagtgacatctttgctgggtggcctgattacccacaagcattaggcccccctccccgcccctcgccagccagctgggagttgctgtagggctgggtcctctgtccgccccagatcctcatgtctaccctctcctccctggcagtttctgtttgagcgtgtggagggcatctccagggctaccatcattgatcttgatgcccatcaggtgagtgccctgcaggggctggactcttaggggacctgccacccccagttccagaatcttcccggggcaggagagtctccctcctcatgtccccacggctctcacggcttctgtcttctgtctctcgggctacaaatgcagggtctgtctttgtcactctgtccaggacagcgggtcctcctcattgctcccgagggtcctccctccctcctcctgactgcccccacatgaggctcttcctgaagcccactctgatgggactgctctcgtgtgcagagctctgctgtgggtccccattgcttatgaataatttggggcactgccccctgcccagagctgctgagcactggccacctgcccctcaggcggatgcccacacacatggcttggctcgggcacctggggtcaccatttaagaactcggcgcctagggagtaaagtgtcaaagcagagggttacctcctcctcaggacccctaatgaggccagtgcctctggtcagacagggaggggacccagtgggctccggaaggcacccccctgcaccattactgctgtggctttgtgctagttggggccctgccttgggttcttgcgaccccgaactcctgagccaggtcacatgtggacagtcctttacagtttgcttttcacatccctgatcccaaccagtcccaccacagacttgagagggtggcagagcgggatttcttcctctgatagggaacctaagagcactgggcttgctcaagcccatgctagaaggtgtcggggcctggttttaaggttgaatcccagctctgccccttaacagtcatgagacctgctgcccccgagagcaggccgtgctgccctggcaaatggggagtttcctgaggggtgggtgggtggcagagccccagccttgcctagggcacctacccgagagcggctactgtgacctccccacagggcaatgggcatgagcgagacttcatggacgacaagcgtgtgtacatcatggatgtctacaaccgccacatctacccaggggaccgctttgccaagcgtaagctgctgcccctaccctcatcttgggtgtgtccttgtggatgaggctctctcctgagtgtctcctgtctgctaggccctgcagaagccactgcagtggttcatagcatccctgtgaggtgatcctttccattttacagatgaggaaaccgagacctggagaagtcactcgacccacccaagatcacataacccttacaataaacatgcatttgtctggcaaaaaacaggaaagaatgaaagaaaaaaaagaaaaataggataaatttgaaaatacgaaataagaaataaattcacataggctgggcgcggtggctcacgcctgtaatcccagcactttgggaggctgaagtgggcggatcacctgaggtcgggagtttgagaccagcctgaccaacatggagaaaccccatctctactaaaaatacaaaattagctggatgtggtggcgcatgcctgtaatcccagctactcgggaggctgagacaggagaattgcttgaacctgggaggcggaggtttcggtaagccgagatcgcgccattgcactccagcttgggcaacaagagcgaaactccatctcgaaagaaagaaagaaattcatgtataatcgttaaaatgaaaatgcattaaactcatcaatcaaaaggcagagactctcagatgagatttaaaaacagggctgccacctttgcaggtaggggacatttttgcaccagtcacgatgagtctggtgtggataagtcagcagctagtatggcccaaggaaccaatttctgaacagaacctcacatgtgctgagcctgggcttaagggcagggcagggtgtccatgtgtgtaggcaagacccagaggaggcagtgaaatctgacattgccgacacagatctccacacccccagggcagtgtctcagcttcagtgccccttctctcctttgagtccccctttttgcagctcttggtgctcttttcaccttagttttgggtggaatgaggctgagcagtgctgaatctgacagaccagtttccagtcttgcctggtgtccacagtcttgtcctgagcctcagtttcccttctctataaattgaggccatccatgtctctctcccagaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcggtacgtcctgacccttggggccacgggagggtctgctctatggactcagcagcagcaggaaaggtgggcggcctcatgtcagggaggagatggactgaagcaacagcagtttggagcagggctagccctgcagcaggacttcctgacaccatgggggtctggcctgcctgagtcaccctcctcttcccctaacagggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaggcagagcctgtgtcccagggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctggatgtgaggggcggtcaggaaggggtacaggtgggttccctcatctggagttccccctcaataaagcaaggtctggacctgccttcccaggcccttctgtgggggtgaaggtggggaaggcctgcggcgcccagatcactgccttagcagtagtcttgcctgttcagtgcaaggggcaggttttggggggaggaattcttagcgcaaggacgggcctcagccctgtcgcctccagggggccgctgacccaggtggggagagggcagaagaagggtgggggacgtgggcaggccaggctcacaggtggaaatcagggatgcagggtggtgcccaagccaggtcctgcaggaacccaggcccagggagggacccagacactggtgaggcggggcaggggttcctggagagagggcagcgaggatctctatcctggcctggggattatgaacataggtagccggggcagggccctgggtgggactgtggcctccactggcctcaccaaagtgcctgggccccaatccttctccatgcccaggggccccaggtgggccagacctctggcctgttcctcagccctactcatggggacattcagggacctccaggaagtgggcgggggagcatccacccctgctagccggcagctgtggccctgatcaaatcaggggctggggagggaaagtgggtccattgaggtggccctgctccatcagccccctacgggacttgtgttcattacagtgagggggtgctcccactgtctcccggcctccctaatgctccctctgctgcagggagaagggttccaagatcacaaaatgtcaacaatgctggcctcctggaccagaccccgaggctctaacaatgcactctgagatccctacccttgccgttggtctctgtcgctgactcgaggcacctaacatccattcacacccaacacaggccagcgacttctggggctcagccacagacatggtttgtcactgttgagcttctgttcctagagaatcctagaggcttgattggcccaggctgctgtgtgtgctggaggcaaagaatccctacctcctaggggtgaaaggaaatgaaaatggaaagttcttgtagcgcaaggcctgacatgggtagctgctcaataaatgctagtgtgttatttcatcttctgagtcctgtggagttggtaatgattcccatttcacagatgaggaaactgaggcttggcaggggtgagaaatttgccccaggccacacctcccagcagatctcaacagtggtagagccaggcttgaatccagctctgccagatcccaaagtaaaagttctcagctgcctcacacttggcaggggggtggggtgggggtggggggttactctggacagagaagggtctaggatcccagggtgataaggtcactgggctggggtctgggacagcctgggaatgggtgggcaggcacagctgggctgtgatggtggctctgctgcacagtgggagggggccctggcagggcagtgggtggatggggtgtcttccaggcctggggtgcttttggagcgcttatggggatgggctgccccgagatgaggctgggctggggtggggtatccaggcagggggaaaggcagagccttggccgggcagagtgaccagagcatccccagtatcagtggcacagcctggatggggggcagggtggccccttgaggttcagacagggtgtcagggaaaaggacatggggtagcaggcaggggtcccgattggccctgtgctgggtgggaggagactgataaaggctgatgctgaccaggtggtactaagggccaggccctatccagactctagctgggaactgcatatggaacttcatggcactctgaggtgagaactgtttccatgcctacttcacagatgtagaagcagaggcaggaaaggggttagttatttgctgagcaccgcagcccctaagtggaggagtgaggactggagcccaggccccagctccagaacctgtgagctgtttcttccttaaagatgctcgtggaagaggttgtcctgggaataagagcctcagtacctggaaggcactcaggacactgggtggctttctgctgctcccagtaactgtcagggtgagggggaggaatgtcctgtaggtcaggcggaagaactgaggccagatgaagtgtttggacctgtttgcaggatctgtgcattttgctgtatgtaaattacaccacaagttacatcaatcccagtggagcaggtcagcttcatgaagtggctgagaggtggcacagcagccctgacgccccagtggctgctggcagccctggataagagcagggacaggctgaggacgactggccatcagactcatgatctggggagaccttgggaggcatgaccttgcaccatgcctggccagtgagccagctgaggcttggggagagggatttcatcttgggagacacagctctgttctctacgggacagacgcagggaggttccagcaggaagcagcagtgcccggctgtaacctggcccctgcccggaacccacccctccaggctaggctaatagggccccagcgggggcgggggcagaggcaggcatgaccatccccactctgctgcctcaggcataaacaaaggcggttgctggcacggggcccctccctgcctagcgggactcctgggcagacctaaaggaagacttttatgatgcctccctggctgctcagccaaacatttggggtttagggccaggaactcctccagggcagcctgcccttgagttggtttcattcagcttagccagcactggctggggacaccttgctcaggcccagggccaacgcgtgaggctctgcaccactctggaagtgacgccgtcacgtgattgctagggaggcccagggagcggacgcgtgggctccagtccctccggcctggctctgagtcctgcctcctcccctcgatagctgtgtgccttagtttactcatctgcaaaatggggatgatagcacctacctcctaggtgttggagaattaaatgagtgaatgtttgtgaagggcttaaagcaagagtaaacactcaattaagcatgcttgattgtggctgtcggcactcatcatcaccatcatcaccaccaccatgttactgatgggaaacaaactcagagaggtgaaatggcttgccgaagactgcagagttgggcaatggcaaagccagggaatgcacccacatccatccgactccaacactagtgccctttccccatggccaggccctctggcaaacagtgtcttggtgagcatggcatcttgcacactgcctggacttccacgcccttccccagctcatagtcttaccagcaaccccgggagaggcaggcctcagcacccttgttgtccagatgagacagagacccggatgggaaaggcagtcccacggcccctcagcggtggtggcagggcctggtggagggaagtgtggcacctgtgggtacattgctgtctactcaggctggggcccgcagagacgggtgctcccacatcctaccctggaaatgctgttcagctggaaaacatacactgggctttctaaagggccattggctttcagcttgaactttcaaagtacaaagtgaattaaaaaatagtcataaaacagcaggcagctgagaaatgcatcatggattggcgtgtgcagctggggctagggccctggagagtacctgttccacctgcctgttccacctgcagaggcccagcctcggcactgcagctggacagggtgtgtgggggtggacgagaagggaggtatcctttgaggaggcctgctcaccctggctcagtgctggctgtcagcgttgtcgatttgtggatggggaaggtgaggcccagggagggcttgaaggagcctggcaccccctggcaagcaaaccagaaccccggcctcctcccctcctcacctggtagcctccttgcggggggtggctgtggtgagcatgtgccatgtgccaggccacatgtgtgagaggattgcagaggcccgtgcacggcgaggcccatgccactctctgcgtgcctggtccttgtttatcctcacagcagcctccctgtgcagggtcctggagctccattgtccaggctggaacaccaaggcttagaggggcctgcaggccctcgcccatggccacacacggtggagtggcagagtggccagtcttcaccaccaccccgggtgttgacctctgaactccctgattttattagggctgaggcactgtggacagggcgggtaaaagccaggacctcagctcagggtgacctcagctcagggtggagagtggcctccagagaaagaatgcagctctgtagttgcccagccagggtttcagtcctgcctctgctgtatacctgcgctgtggccccgggctgagcctcattgcctcctctatagaggactctggtaaacagtgggaatgaggctggcatacagcaggtgcataatacatgtgacactggccaggggcttctttaccctcttctgttctcatcacctctttgactcagcaacagggcaaagtcctgtttccatctctggtttagggcctcccagtgagctgcggggcagcccttttaggcagggccccaggccaaggcttacccagccctcgcgtgcacctgcctggggctgggcctgagccctccctcaaccctcccatggctccaggctcctggctggagagttcgcagggtccgttcagctgaaaggacctggggacacatatcatcaggcctggcgcctgggatgctgggtagcctccctgaagcctgctgcacctccctgctcttggccctggggaatggggctgggcaggtcaccatctctaaactgtgggaagacacccatcttccctcggcgagggtggtcccatacagggaaaattcaggcctggacttggatctgtgtttgaatctaggctctcagtggctgtgggcaaatcacttcacgctttgtgcctcagtttcctcctctgtaaatagcgatgataatcccttccttccctagggtggcttgagggtcaaggaggctaggcaggtaaagcaccagtctgggtccccctcacatccagaattcgcaggtcacccctgctggtcctgagacagtgacgttcttttcttttcttttcttttcttttttttttttttttgagacagagtctcactctgtcacccaggatggagtgcagcggagtggcatgatctcagctcactgcagcctctgcctcccagggtcaagtgattctcctgcctcagcctgcccaagtagctgggattataggcacctgccaccacgccaggctatttttgtatttttagtagagacgggatttcaccatgttggccaggctggtctcgaactcctgacttcaggtgatccgcccgcctcggcctcccaaagtgctgggattacaagcgtgagccaccgcgcccagctgacggtggtcttctgaaagaaagaggtagcgtgcccagtgcatgcacactctgggagccagggcagcagattcaagtcccactgctgcctctaccctccatgtgaccttggacaggtgacagctcctcgtgcctcagttttcccatccgtcaaatggggttcacactagcaccggcctcacagagtggttgtgagaacgaatgaacccatttaagcatcagaactgcacctaatcagcctcagctcttgtatcactgaggggcaggggttgccaacattactgtaatcaacgcctccacctttatttaccctgcaaagcagtacagtaagtccacatttaagtccttgataggttcttggaaactgactttaagtgaaaccacatgaaatcgtttgaatcaggccaggccagtggttcacacttgtaatcccagcactttgggaggctgtggacgggtcacctgaggtcaggaattcaagaccagcctggccaacatggtgaaatcccgtctctactaaaaatacaaaaattagccaggcatggtggtatgtacctgtaatcccagctactggggaggctgaggcaggagaatcgcctgaactggggagctggaggttttagtgagctgagattgtgccactgcactctagcctgggcgacagattgattgggattccatctcaaaaaaaaaaaaaaagtttggatctgtgtccccttccaaatctcatgttgaactgtaatttcacataatccccaatgttggaggtgaggcctggtgggaggtgattggatcatgggggtggttttcttatgaaaggtttagtatcatcctcttggtactgtcctcatgacagtgagtgagttgtcatgagatgtggtcatttaaaagtgtgtggtacctccctcctctgtcccttgctcctgctctggccatgtgacctgtgggctccctctttgccttccgccacgattgtaagtttcctgaggcctcctcaggagcggagcagatgcaggcactatgcttcctgtagagctgccaaaccctgagccaattaaccctccttcctttataaattatccagtctcaggtatttctttatagcagctggagaacggactaacacaccagctataacaaaaccaattttaccataggctaattgatataaacaagagttcagttcctacagcgtatttttggtcacaaaaacaacatcaaacttctctaatacgaagcacctctaatattaaacattgaaataaatgtgaggtgtacatacatttaagaaagactagtaaaaacaagatatgtacccacttattccagtctcggctctagggtggctggagcctgtcccaagagcacaagatgggaaccagccctgagctggatatcaccccattatcactatagggcacactcacagacacgctcacactcagactggggccatgtagacacactggttcacctaacacccacatcttcaggatgtgggaagaagccagagtacgtggagggaacacatgcagacgttgggggaacattgcaaactccacacagacagcgggcatggccagaaatcgacatttttttcttatcaacgagacgatgttgaacaaaacgatgttatttgaggacctgctgtattcagtgacttctctgctattttctgggtgccaggccctgtgttgggtgccagcacacagaccgtgtcttccctcctactggtctccaagtttctccagacctgttgcatctctgggtcatttgaggacaggatgagggtctagagggccagtgtgggaaggattctcatggcccatgcagtccaacgtctccttgcacagacagggaaactgaaacccagagagagcaggagccttgggccgagcaggagctgggacccacggggaggtgggttcagcagggcagtgtccacagcgagtagagcttgggtctagctgcttgggtctagctgtgctgccttgggtgaggcaaccaccatcttgagcctcagccgtttcccccatcagatgccctggcacgtggcaaatgctcagttaattttagctaataatattacctaagtcagagtgagaaaggactttctcatagccagaactgttcacagagcaccatgatagtggccagtgcagaaggagcgcttgctagttttggcacactctaggcaccacgcttgtatcaaatggctttgtcctcacgtaactatgttttgcagatgaggaaaggggactgggggaggtttgatggccccccaaggctctcccagccagggtggtagagcccggggctgacacctagctggccgcagtcacccccacactgggtgccctgtggggtgtgacctctcacacccctcaaaggggtgcaagtggaggcttggggctgtgggaaccatctgggacttcccagtttctgggactttcctagcccctgccaaccctgagaggctgagtttctcagggtgtgccctggtcttggaaccagagggaagggatcaagtgtgaggggggctcctgctgtggcagtggggagtgtgcaggggccttgccagaggcccgctcccttctgggaccctccagccagtgtgcgcattccaccggttgtctcggtaaccgataccaggcggccagacaaagttaccgtgtgtgtctgggaggctattttgtctaatatgctaaaaggcctttggaaattcctggagcccatctggtcctagttaccccacaatattgctgcctcttcagctcacagacaagggaacagttttatttctccttttggagctcaggaatgtgccttaaacacgagccggcagacgcccacttggtgcacgagttccttggtcacgtgtcacactcatcgtcctttaaaaaaggactgctgctctttccccttggctccccaatcccaaagggtccctcccaaccccattacctagagagtgatgtggggagggcagatgcttcgggggtgggcccgcctgactgcgatgtgcccggcctctgcgttttctctcctgtgtcctggggatgggaactcctgagaatggaatgcagcctggtgtgtggtaggtgtttggtacatgcaggtttcccagctggctctgtgaacttaagtaggtcccttgacccatccaagccccagtagcctgctctgtaaaaccgggctggaaagtgtggtacaggagtttaggaaggtctcagccacaccaggggatgtggatgattggtccttactcacccggcgcttctgcccacccatggctgcctccagagggtgtgaacacatccagggctgcacatctgaagcctctcttgcgggcagaagagatgtcttcaggtccagctgctcccatgctttttgcggggccggagtgtgtttcttccctggagttcttgtccctttgggtttttcgggttcctctggccgcagtgcccagaggctgggtgtggccgctccaggctggctgagtcttggcagctgccctacatggttgcctggggccaggtgacatccttcttgcttccttgaagagctccctctccccagtcccaggctggaacagtcacagtgccctgcccacctaggctatgattccaggggctgtgtaagtgtgtgattcaagctcagataaccctagaccaggcttcttccaggctgggcaggcctgcacctccatcccctgcatggctagacgtggcatgtacttgttttatgaaccatgagctcagtggcttgtgtgccctccaagtggaagctttaagagccagtgtgcgattctccacaacccctttgccacagcgatggagggagcacatttcaagctgtagcccccgacagtctgggtccctgaaatcccagatgactcaggtctcccagtcaaaccagggctgacatccagtgtgagcgataaataaaccttgattgtttaagctcctgatgcttaagggtggtttgtttctgcagcataaccttactgatatcagcctggctgatacactttccatttccctgatcatagggatggtttagagatatcatgtgactcaagagtccttacattacttttacattttgagtggaagaggaaggactttatcttctgagttatcaagttttagagaagccatatttcccaccacaaacagaaagcctgtctgaggtatgaaatagtaaaacgaagggagaaaaagaaaaaacatgatggaaaagagggaattctggtgatgtcaagatagggctgccatgagcatctgcacaggttgtgcactgcacaactctcgaggctgctgttacacggtaatcacagtagatttgtgtattgattaaaataattttctagtaggcactagtaaagtattttgaagaagtggagcctttttctaatttgcaaacaattgctgcaaaggctagtgaccatgccataatcaagaccctgattttaatccttgagtccccagagcttctctagctcgataagtacttggtgtaatttattattttggtgaattccctttgttgttaagttctgctcacagca

SEQ ID NO: 287 - DNA, 521625 bp, Homo sapiens
tatccccatttataacatgagagaattgtgactcagaaaggctaagtaacgtatccaagttgtacagtcctgcataataagtggcagagacaaaattcatatcaaattctgtcttaatccaggcctcttatccatacaataagccacattatttgaaatgttattgtcttagtctgttttgtgttgctgtaatagaataccacagactgggcaatttataaagaaaagaaatttatttacagttctggaggctgggaaatccaagagcatggtaagggcatcttgtgtggccttcttatttcatcatcccgtggtggaaggcagaagggcaagagagcatgagaaagcaagagatggctagatttgcttttataacaaacccatttatgataatgacattaatccattcctgaaggacctaatcacctcctaaaggtctcacttctcaacactgttgcattgggaattaagtttccaacatatgaactttgatggcaaactataccagttatatagttctgtttcataaaaaagagatgccattattctcatgaatcaaatttaaattaatatctgaagccaaagtttccacattttccagaatatatctctctgatctagaaagtatatgatcataaggcccttccttcaaaaggcttagaccatgtaggatctctttaaagctgaaaagacagccttcaactcgatgacaatgtaaggtggaacttctttttattagagctttgatgttctcagagtgtctcatcaatgtgttctgtagaaaaactgtaatagaagccagtatggccgttagacagaaccagggagacccttaagagcatagaaacaattgttaaaattattttcagtaaacatagtttcagtatagaaatggaaatgttttaagtaaattctctggaatcttgaatatctaattcctgtgtttaattataggaaaataaagcataatataatttataatctccatgttttatattgataatatgaaacatgtttgggtataatttcgtccagaaaaaatattagatttgggaagggtggtaggtagaatggggaatgataatgcagaagatggtcaaaattgtgtgcctgacatttatttgtgaaaataagtatgaatggaagtgtttagttatcaaatgttttatctacatttctgtagattcatatgtatctattcaaccaacatgtggctttgccaaggagatcatctttggagagtgttttgggggatgaaaaggatttactgcttttagctccagagaatatggtgcaccagcaagggcttctatctcccttctgtgagctcaccaaatgcagagacttttatattggatataaggaaaaagatacagaagtaggctgcttataaaagagagtgatgcctaaaataaaggcattgaaaagttgaaaataaagggaaagaaaaatatctaccaggcaaatgtgaataaaaagaaagtctgttgtagtaatcttgaggcaaaagtcatcataagggacaaagaaggacattatatactggtaaaatgaaaaagaatttcccaaatgaaaaagagtgaatacaagaacatcatgttcagagacatggaaaaatgaaaaatttgggtaatatccaggaattgtgtctgttgcatgatgtttgcaaaagaaagttaggggttgaactcctaggtcaggtggttgtcaaaacttgaatggccttagagtgtgtttgcctctgttcttggcactgaaataagagaagtcctgaagtagagaagattccataaccataggatgtataatataaacttagtgatatggccagttgtaaatgtttgtatttagttatatgccattgctataaatacttttgatctgttgaaacataagtaaaatatgttttaggtacttgctatttcttaaattcaatagttcacacccaattagatcgaattatgaagtcagaattgaattgcaacattaaccaaaagttgttgctattttcagaggctagctttctagaatcctcttgatttaaattggttatagatcatggtgtggtatgccacgtatcaacttgacttttgtagcaagaaatgatgtaaaaagctctgggttgacttttggtatctgctacaattatgttagcaagtagtaacttagtcttgtcacagctctcaaatgtggtatatattcagatgctacacatgacagaatttttggtgttcagaatttccaagttgataaatattaaatgtgcagctacataagaagcagacttattttgtggaataaaataaacttttgattcataccaagtagtgaagatcagaatgctaatccttaactggacttctagaatttttttattttcatagtcctgtagctaaaaatagtcttttcttgaaacagagctttccattaagtttctgatcctgtgaacaccttgtatgtacatagcttagtcaacataggatgggttagtcagtgttaacttgcatttcaaagtagacactgttaaataaagaaaatagtgcttcattattcagcatgaaccattacgtgtcacttaaaggaaaagcaaggttttctagttgatatgtactgatacattcaggcatatgtagtacatatactaatgcaaaatgatgttaagttgcttagttatcttatatgaaacattagttttagggtcacagaaatgctgtttatacgaagtataaaaattgtgttataagtttctgtagtgacctttgaagggaggcaaagttgggtctgaagctgtaatatatttcttctagaattttgagcgcaaatggtgtattcagtgaaattcatgagttaaagatagagcatgaagacattagccaatgcagcttataaccagagttttctggaagctctgtcatgactacaaggttactagtagtacaaggttcattactgtaaagcagagttacaaacacatttttatattttcttagtgctgatatctgctataaatgcctcacaagaaagatattttaatactttgttcattcaaattgtactagataatgatggtcacattgagatcatttatgctacagtctgatgccaagtctttttcactggttggtctatgttgtgggacaagaacaaggcaaaggaaatgcaaaaagtgaaagtgcaattaaactgcacttgctttcaatgagattctttattcagttatatacttagcttttaattatggtttatttttgttattaaattaatattttaataagaaactatataaaatgaataacaatgaaatattagaggttgaatagtatgttagtgatttactcaagatcagtagtcacttaataggttcatctgaagaaggaatcatttattcattgcagaaatatttattgagtgacatactatgtgccagacattatgctaagctctggtaatacaggagaaagcaaaatgaactattttttcaagttgatgcatgaaactttttataactctgagtaaataattcaacatttaatcaattatataactttctttagaatttatacagtttcttagaaaaacaaatgagtaacagcttttcaacattttaataatcatgaattaaaggtccataggaggatatttttaataatcagttatagtaatattagctagtatttattgaatacctatttgccaggtattgtataattctctatcatccttataacaatcctgagaaatttattattttgaatccatgcttataaattaaaatttagggaagacttgaagaaaatttagttacagagtttcttatcaaactgtatagtaatcaccttgattgtattgcttctaaaactgaaaattccatgaaagtagggcctgtctcattcttgtatacatttatatcttcagggcttgcactgtggctgtgaaatagttgatattcaatatatgaaataactcactttcatagaaaaaataaacttcccttgattctatcaaaagactattaagttttccttatctctaattacaggactgcacagggccatattgatttctcctcctgtgctggctgccttgagtgctgcagagaggggctgatgtgcaactggaaaacactcagaaaaaaatagaacctggaacaaaatggctgagcagggaaaagctgtgcacacatgcccatcatcttaagagtacaatgctgctctcattcgcaagctagaggatccctttcttagcaatccaccttagtctttcatactccgaatattgatagccttgttcttacctagccttacctagtctaattattttcatttttaaaaattgttctctaaaaatgttggctaatttgaaatcacaccaaaagatactttattcttttatatttttgctgtgtaactcctgcttttgaaaggatgatctcatcttatggttctcaaactttattgtgcatcagaattacttggagggctgattaaaatacagattccttccagagattctgacttactcgttctggggtaggaaccaataaattgcacttctagcaagttcccaggtgattttgatcctctgtaatcctctaaaaatagaataaatcttggctcaacacatcccatttgaagggaagagttattttcaatcactgcaaggccaatgattctaaagtttttgttgtcgttgatttgttttgctttcaaatataacagtctccctgaaatttcaatgccaacgtgatttctcagaccctttacctgctgtaaaatcttgcgtcagatgaggaagattttctcagaagaccatttgttatctaattaggctttctaagtggggagaaatcacttgttaattgagtatcccttattcacatagaattgatgatgttcctctaagaaatagaaaattcagataaataaggtcttgagttggaacaaaaattagtacactgtactttcccctccatcctattccttggaggtctaagggaatcaagctcactgactgcaggcaaatgcatatagttttattgctttaacaatagtttgaggaatgtgaggttgggagaagaggtaacatcaatgagtgagtgagtgagtgagtgagtgagtgagtggaggagcagcagttattggtgagtaatttgcagcatactacaattgtagagcacaaattcggtatttgaggtaattaagttttaaatcttacttcatttacattccagaatcatagggtttgttaatacatgaaaagtctctgcttgattacagatgaactgatgatatatcattgtggtagaataaattgggttacattacctcctttgcttgtttccagttatcaactgagattgattttagaagaaagcctattataatccagaaaaatacaacttgaactccataatctcaagtgttgaaatcccaaaagatgaaaatataattctgaaagaaataataaaacattctttatatttatttacattttaaaagggggtttatttgagaaaaattaaaacaaaacaatacactgtacacgataaaataaataatggcacatatttttacaagcaaaaacactcaggtatactagcaacagtcacaccagtataacagttatgatgcagacaaaccgtatttataaagaaataggtcaaaaatggaaatgtataaatgcatatcactgtggttgataattgtgtgcacccagctttatataactgtagtcatcttaaatttccggatgaagaagctaagctttttggcaagatggatcaaaaaattcagtgggtcaacaacacgcatatagttacccaaagaaccgagatcctgataaattttctttcacaagcgcagatgtacaaaatctttctttcatttattgaagaaatttcgacatgtttgggttcagaagtactgcttatatgcaaagtcaacgttgtgataatgcagttctcgtggaatcaaatttctgatgtccaaggcattcgaagagaagcctgccctagttctcagacagaaaccagttcacctcctgtgtctgttctatatgggtccccggcagatcggatggtgcctgctaacattgaggggagatcttcttcacctaatccactcaaactcacactaatgtcatctggaagcaccctcacagacacacccaaaaaatgctttaataggtttctaagtatttaatccagtgacatctcaaattgaatccacaggtccaccccttgtcaacttggctcccgtaagtctctccttaaccatacttaatttccaagtaaagactgtaacagccgcctaacatgatgcaactaacatgatgcaataatcctgcatacgaccaaaaactaatcgcttcaccagaatgcagctttcaagatttcatatttgagattttaatatttcgagattgttattttcaggattgtagacgtgagagattttagacctaagggatttagaccttagggattttgtatcttttcagatttcaacattcaggattatggcatgtgggattgtgtctttcaggattgtgatctaaatccattttagaaaaggtcattgtgagctagaggtctgaggatatttctggaaatattttggtgccatacaggttttttaatactttttttttgcttatatgtctgcatagaaagaaattggattatggtaactttgaaataacattttacattaggatttaattcccactttcatttactattaaattgagaacctgagatttttttggcccttgttactttttttacctttttctttgacctatgtgtatataacatataatatttggattagtttgcaataaatgcttacttaattgaatttgaatttgttacattgaaactttttaaactacccatctacctagcctgacatttgtattagcttgttatagttcttgtaatagaacatatatctttttcccccacattagtaaactgtagttttataaataccccaaaagaaactgagtcacatttctttactaacattactgagatgatgtgggaagaattaactcaacattcttaataatggaaatatggtaatcaatatagttgatggttgttttgatgatacttatttttcttctgagaaacaagtggggttttttgtaagtatccaatgtcttttcactctaaaatattttttcattatcaagagttaaataaaagagaagatggctgatggaaaaacatactgcaagaatgcagggatgaaacgtaaataaacctcatgttaaataatggtcaaaatgaagaagacacattatttacagtattttatgtggaatgccctttcctggatcctttaagaactaggataattactaactcagtcttctggagttttattctattttttattttttattataaaagctgagagatctttttttatcaattgttgtttgaaggtgtaatttaaacttaaaaagacaaaagatgcataggcatattgtatcaatatggtgattttgttatctcttttgtatattcatcataaatttttgtattctgttaaaaatcactctgaaacagacagtgggtccatttttcatcagtagatcatattaaattttatttggaatatctcagataatgatttgtatcattttggtaagggacaagatggtgagactggataatataaatgctagacctatatggttagttattaattacctgtatttccttaagctactgtctttaaagcctgactccaatagtgagtccttttgtaatcaagcctccttcgtttcctcatgagtgaatttcaatgattgtttttcttaatataagaagttcttgttctgatctcaccacaaaaaaaatggtaactagctgagatgatagatttgtagcttgattatggtaattatttcacaaggtataggtgtatcaaatcatcaaattgtacacctgaaatataaagaatcttgatttgtcaaatataccgcaatttaaaaaatgttctttacataaatgttttgtagaataaaaaaaaaaaaagttcttcaaaagaaatctcaaatctccaaatggaaacaggtaaaagtggagctcccctggttccacggagaaccttttttgaggaaacttaggcaactcgcaggtaccttatgtcatgagacagagtttgaaaactacaattgactatctctaaatttcctcccaggtctaaaatgtgatgatagttactacttcagtacatcatccttaaggaaaattattaggtccacactgtttctatcctttgaattttacacataaattttgtaatcaaaagtttatttgtaatatcagatggaatcagataattgctttttgttttttccactgacaggaacataagattttgttgtgtagcttaagtcaaacgcagtttggaatatatattttttaaaaattgtaacttacatatccaaatacaatttttcaagaagtagagtattcagtagaaattaatctgtgaaagaagaggaattcagcagtggcctatttgatgaatgatttaacgtgcttatttcttccctttcatcaaaactctgtgtccccttgtttgccccctctgacttcatactctggagttgaccaagatccctcttccatcggattgttctgggaattttgaaataatctgctttttcctctctttcccctgttgcttctgatgccttagaattacattttcctcgctgatttagtttagaaaagagaaaagagcttccatgactagtagattatcacttttgggtttgctcttggaagtgacaagatgctaggatccctctttggaatgtaaaatttatctcttatatagaaaggatataaatgtagcaccagagactataaaactctgatactatctactgtactgtatagctgaacgccacaatgtgtctggtaatctattgactatcataaatgctatttctacagaaaagttaggaggtccatatttcgggcaaccaatgtatagctgaatgcagaacagtcatagttgggtactaaccatatatatgatttatccatcaacaggtgcatatgctcagaaattctgtatccataagaaatcagactactttcttttccttttgcaagtaaattgaatttagcctgagaggctgaggggaaattttcacatataagccacggttttgtgttttgtgttttgttttgtttatagatatagtactaactggatggatgcgataaaattcataggtggtactaagatacaataggatttgtgaaatggacaattgtcttgcataaatagcaagtaaaaaatcaagcctgtccttcataaaaattttattctggggtgtgcttgttttccaaaagtacctctgctaaatctcctgttagtcctgaaactagaaggcagaaaagcttctagtgctacagccaactgcagtgtagcctgagaaacaggcaacaaaaatagaacaccaggattgctgtgcgtgggtgaggcagaaaccacattatgagcaaaagcttccagtattattttagaaccaatacagagctctgtacttctctcctctctcttccaaaaacacatactacaaaaataaaatgaaatgaaatgtatgtgcatttgccctcttagaattatgattcttaattttttttcttgccttcctttctttggaagcgaatcgccagtatggaaacacagtgtgtaaagcaagcttcgagagaggaaagagttaattggttttaaggccctgcgatagagaattatggttggaaagatagaggctggacagctgggtttgctggggtatttttaaatgcattaatgcaggctccaatcactcggccatgcttgacctatttttggctcaggccgaccattgttctatttctgtgcctgtgggccatgctgttgttgattcatatgcaaatggattatcactcgctttagccaacttgagctgagagagactgagaaagggggaagagaggcacagacacagataggagaagggcaccggctggagccacttgcaggactgagggtttttgcaacaaaaccctagcagcctgaagaactctaagccaggtttaattggtttctttttctcgtgggtagacttaataattttctacgtattctgacaaagaaataaccccgaagcacgttcctatttcccacctgcttgtagtttccgggataacctaaactccagagagctatagcatccactctgtcctttctgctttgcacacaggttggtaacatgggaaaagtgtccaggtctttttaaaagtggatgcccatttgagcagaaaggaaatcattgtcgaagttgatcctctgctgcttctcctcagggaggagggagaaccagcgagggtagctcctggggccggtgcactgagcagtgatgaatgtttcatgtagctgaagtaagagtgactggaatatgctgcagacaatttacgagagtgactcctgtttttcctcagatggggtggctggacgagagcagctcttggctcagcaaagaatgcacagtatgatcagctcaggtaagatcctctttcataactgagacgttttaggtttgaaagggggctggcttgggaaatgcagctaagaaaagcacctctcttaaggaaattgctgctttttcgtgttgatgttgctattttcttggtgcgtctgtagggtttaacttagatcccttccattactgtttctgtgcatattcagtctgcttagggacagcagcttctgaatgaaattgcaaactattgcttctgatgaaagatgagactgagataagtaaaatgtagttgggggtgttttgcctttactatgcaactagaaaaaggagctgtgtactgattgtaagcctattctaataggactttaaaaatcaggtaagttcatattggggcttcagtttaaactgcagccccgctagcctgacgattttatatttactctgtgcctacagaagcacatctatttatagacctaccttctaaaatgtgtttgccacagagttataaaggtagttttcttttttccattatgtggctttttctcatcagccccaaatgaaactgtttaggatgaaataaaattgttattagcagatgcttattttaattttcttcaaaaacatgtgggaagtctagcattgtcaggcagatgtgatggcataacacacatgtaaatgtgttaaaagcaggtgcagcgttttaaaggataataggaacagattctaatttctagtttctcaaggagatgagctggtgggagattgagcttgtcagccttgtcaatttatacttactaaatgaacatactctccaggcagtatcacttaacgtgtaattattgcctttcatatttatttcctatggctatttcctaaagctttgggaactctttgtttctgtcctcttctgaatgtttcaacctaaaattggcttaaagttctcacttagatcccacttcccatgtgggcttaatcgtaattatagatcaccgcctagatttccatgataagaatgccacataaagcagtgtttactttgtagagctaggtgtgaaagaaatattccacaggttggcatgatgtctgttttggtgttaatacaccttcccatatggggatctatgtttaaagctagttttctttaaaccttggttagttatgttaattttaagatccttctgttgacccaatcttttcatggaatcagaataaaatatcaattttgcataatttggtatttatacacttaagtgacaggaattatgttaatgaatagtgcctgcttaacaaaagcaaacctaccagaatttcagtacagtttattcttatagctgcaaagctgacaagggctccgggagggtttaacaggtatgtctctaatgggactggtcatttaacttagcattttattttttaaaatatggatgaaccctttgaaaataactattttagaaatcttttcagcactatgctttatccttttagtcctcacttctgtgttacaagtttgatattttttttcatatggtagaaacatacatgccttccaagtagcaagtgtctgctgaagctaaggctggctacaggtgtttgcaagctttgcttttttctccacatctttgataatcacatacagctttacacccatttcagtagagattgtcattttcctagcatttaatggtttgtgtacaaagcaacaagattttcagacagggaagtgcttcaggctgtccatgctttggccagttctacaagaagcaacatttaagcagcagctagctattaaatgaaaagtgatgtaggttaacatcaactcccaaaacctgtctggtataaatacataatcactaagttctatttatttttaaaatgtgaagcataaaaacaattacacccttcctgccatgccatatatttcatatatgttcttaaatttaattcacctagtctttattgtatacttcctgtgaggcactggctctcaaagttggactcaccagaagcactttacaaaatatgatacctagattccactcccagaatgcctggtttaattggtatggggaacagcctggggattgaggtttttaaaatctccccaccttaaccttcagcaaactgagattcactgctgtagggctagggaacagatggtgatgctggtgaaccactatcagtagggtttgtcctttgagctaactgctaaattaggggtatgtttgtcttaatttagctacaaatcttgttcagctcccttttggaccagtggtctggacgtgattcataggcttagaagcagagtctttggatttgaaagagagaaaggatgcctggcagcagtgcaaaggagtggagagagcactgttctaggagtcagacactctgtattctagcatgagctccactgctagccgattgtgtactgatttttttactcatcttcaaactgaagaataatgatgtcctcctgcttgcctcttagcattcttgtgaggttcagatgtatcaatatgtctttaaaacgtatactcactattagaattgttgtttttagtgaatgaacctaagatcttggttttcaatgccatgttctatcttgctgaacaagccacatgagttacattgtaggtcacatgggggaaatgattgtttgttttgataatcagtttgccttagttatcttataaatcaactatttattttgttaccttggtttgataagagttgagatctttcctatgcagactatcactataggtaagagtagggtgtgtatgtgtgtgtgtgtgtgtgtgtgttctctgaaatgtctcattatgtaataaaggcaaagaagttgcacagtatgtgattgaacagtgaaccccaatcgcagatttcatgagattatttttaaaacattggttatgttgtgtaatttctttagcaattgcattagagttcccatttgttgttctagttatattggatattatgcactaatattgatggtttttgtacagagctctttatatactattggaatacaagttttttttatggttgtatgtttttttgatattgactcggccaggctaaacatgtttggtagaaccaggttctataatattgtactaatatattttagtttaaagttctataatattaaatcttagaattcagtgtgagtgacacattttgtcaagtacatccctacttttgtggcttgtgtgggccagggtaagtgataactgtggcagaaagtgaagcatgtacaaatattgactcaggtcactctgcaggagctggcaggattaggggtgttctcccattgccaagcatgttgcttaacacgttgggcagcagagctgtccagacaatattggaacaattattatgaaggaatttcctagagtttgtacagaagtaatgtaagatatatttacaataaggaaagctcatattttggccatctattcttactttagggtataaaagaaaaacatttaaatcaaagtcctgaaattcttttatatatcttcacccttttttgaatccttttgttccttagtgtatggtgttgaggggaagggaacattttagattcagtagtcacgtcacttatgtctacttgaaaagcagaatctaattatgaaaatgtaagtctgtgaaatgttcctgtcatgtcaagaatcacttctggtattccccataattactgttttgccattctctaactcaggttatcttcacttgcaagtctgttatcaattgagatagatgataggtatcaatcagaaatataattataaatgggctcattgagaatggagacaagaatgagtatttcatatttctaaggatgacacaggaggcataattattgttatgtccgttaagtaagaaaatccaataaaaccccttggaagactgaaataaatccaaattctgaattcaaaaaatattctaaatgatgattttaattttggagatgagcaattttaaaatgtgcctcataatttctcactactgataaataatgaagtgagcccaaaatagcatgtcagccagcaaacataccttccatccctgtcacccaatatattcaacagtaactgagcaaagaaaatgatataacctaatgcaacatacctcagaggctaacagccaaggcaaaaatggatgcagaggttctttgatcataacagagagacctgtctcctgggctgtcttagaattttactggcaagttgaccagttcctgaggattctcactaagattcccaaatctgaagagaagaaaactgagtaggtatcctcaccattttgggttgttcttgttttctcttgtggctgagaaatagtagaaatgaaggcttcagagcagcgtactaaattgggagaaagatcgatccatagctctttggaatgacgtacctttcaccaactaaacttagagattctgccaagaagaaaaacatcaactcattgaacccatggaattagacgtcttagtattgcttcctacaaatagagcaccttacataaattttatattaaaaaaagctgaaaggtgagatgataaacaagagaatgagatgagaaaggagatatagatctcaggaaatgaatcaagaatggaaaatcataatgattatagaaaaaaatattcattagaaatagaagaaaacagaataggcccaggtaaaaatctttacacataaagatgaaaggtttgaaaaaaatcagagtaaatgaaaaaggaaaacagttagacaaagtagaaattctcaaacatgaaagaggctgcttgacagtgaaagccacacagtgaagagatgaacttaaaacaaacaaaaaactaaattcagaagtagagaaaacattatcaaagtaacgagggaacactgaatgcatttaaacaactattggattgtgtttatagggcagaaaacagatattataaagtaggggaatgtaaaaatattaataaagctggccagtgtgaggtgttagagagaggtgagatggaaggatgtgagaaatgctaatatccttccctttctgagcagggacagactccctgctgcttaaaatagaaacacatacttaaaaaaaagattcaaagcactgatttttaaaaatagtttatttaaccttaaagaggtctttttggaaatagtatctcttacgttaaggaagtatttagtacatttatagttccttcaactgcagttttaaatctgcttaattcagttaagtttaaatttaaattcagttaagtttaatttcagtttttaaaaataaatataacatcagtgatatgttcttatttttataattttttaaatctatccatccatctcctgaagaattcatataaagataggaagaaataaggaaagatgctgtgctgtgtttggtgaagaggaggggctttttctttcagcatcatacctctttacagtgtatgattttttataataggcatgtattctatgagaagtgttcattacacacccccacacaaagctaccatgtcaaaatactaacagtgattaattgtaagtagtaggtatattagttaggttgttttctcctgcagataaaagaacactctagtcaaaatgacagacaagtaggacatttatcatgtgataaagtagttgggtggttaggcagcaccaggtagtcaaaaatggcagcagcattcaggtccttcatatagctccactctgctggtcttagccttggttggtgtgatcctaagattggatcctccaatggtcacaaactgacttgtagcagttccaagcattatgtatgtttatgcataacaaattgcagagacaaaggttggatcctccaatggtcacaagttgactcgtagcagtttcaagcatcatgttatttatgcacgacaaactccagagacaaagaggggaaactgctgtcttggcgtctcttttaaaggaaagaaatcttacccagacttctccagcagatcatcctttattctatattgactagaatagcatcacctgcctattctttcacttgtttttcagaggagtgggacccatgactgagctgggaaggcaggatacctaaacctgctcaagtttctattgggaagaaccaagaagcaggaggaatagatgttagctaggcactagcagtatttgctacaacgtggatattggtgataagaagtttcttctttgcaattttatttactttttagtttccacaaatataataaagtaaatggactatgtttataatttccctttcagttgaactatgggtgttgactttcttttcatgaagataatatatctgtttaaatactaatgtaagtattttttactagtattgaatataagttttttattaatattgaatagattgcctttcttagtactgtctattgttagaagaagccccctaataaagagactgaagtaattgtagaagaaactggatctctctaagctattaatcatgttttctgaaggaaggagagtcaacattgtggcctcatgccttacaagcatttattataaacgtgaatagagtattcctttaatgttggcttcgaggcacacaaaattttttttgagaaatataataatatatgaattgttttcaatatatgaaaggaggattatcttaaaaatactcagaatgtgttcgccagtaggttgtcacaagtattacattttaagaatcatgaacaatttttacaatatggaatgataagcactacattttaacattttttttctgaatttgaatgctttgaaaataatttaattgaaataaaagctcatgcaaatgactttagaaaagaagctttcaagaagaaattcaaaaatatgttggcctctgcctcaaatgagtgttggctgtgccatggtcccccctgtttttgaaaggaagctgaagtgagtggttagcttgggatatgtggtgtccttcctgttggcagttttccccttttcttttcccagtaagttggcaataaggaagcaaagaaagaggaaatgcctggtgttcctagttccattcttcttcaactaagttggttgcacaaaacaaatttaatttaaacaacatttttcacaatactaaacgacctacactttcaagtgttatcagagaacgttatgtttaggtttactctgagttgctatgattcatgaatataagaataaatacttcttgtgtttttataagaatatattttccattcattatcataatgttaacttttccatagtaaaataagtgatgggcttttcgtgtacagtgtttcttaaatacccattaattaaatccaatgaaaaccacttttaaggaagaaagaaatttaccaaaccacagagtgtaactagtcatttgcttatgattaaactttttgcatgctgataaggttggaaatacccacgactttattttcctgcttctccttatggttcaccacttgtatcagaaacttttaaattcataatgtatgttcattattgacccagttgcagccatgtggatgttattttcaatttgcttgaggtacattttggtgaatgtctaaggcatgacattttcaaatgagaatgtcatgaagttgtttcaaaatttgaaacttgatattaaaaacaaaataaaccccccaaaatccagaaaacaaaaaataagtaaatttcactgagttttcattaaatgacatcatagcttgggagttcttgctttagtaaaaatgtgtttacccagaaggttttcagggaaccccatgtagggtgaataagaaaaagctcttgtgttaagcactgttttaactttattcttgatgatgcttttgaaatctcataatcaaaattcaagggtgtattttaagtacatgatttttacattaggaactatccattttaagttagaaagttatcaccacccgtttttgtttttttctgtcatactcctctctgatcttctagttgcttagttccaattttattttattttgttttgttctgttttttgagacaaagtctcactctgtcatccaggcaggagtgcagtggtatgatcttggctcactgcaacctccaccttctggttcaagtgattgtcctgcctcagcctcccaagtagctgggattacaggcatgtgccaccatgcctgactaatttttgtagttttagtagagatggggtttcgccatattggccaggctggtctcgaactcctgacctcaagtgatctgcccgccttggcctcccaaactgctggaattataggcatgagccgctgcgcccagcctagttccaattttagaggtcagtgattgtaagcatatttttttcaaaaatttttatgtcattcttttattattgacacaatggctaatgtttcaaaagtttctctgtgtatcacttgatcatttaatcctcaccacagtttaataatgcagtagttgttgcagcaatattggtgttttacagttgaggaaatatattcagagagataagaaatttactgatggttactgtaggtaggaaatggcagggtcgtgtttaaatggcagggtcctgcccctttttctcaaaaaatatttagcataggataattctgcttggtactaaaaatgtggacacatttatatatgtataaacaaatacctagacagacttcttaatcctgggaggtttaaggcacaaataggcaagcatgttgaaagttttgctggaagatccttacttcatgttctcagtgctagataattaaattcgaggaagttagcactatccagggctgagaggagcttaaggaaaccaagcttctatgagcgtgctcttttccttggagcagatgctctggacagaagcagcattcctgatgcatttggcacctgtttgccagtgttcatgatacacagatcatgagggtaaagttagccccgcttcaaaatagcaaattattattaatgtattttggcaggagaaagtaattttttttgaaatgttagcattatggggttcatttattttgaccaaaaggtttgaattatactcaccttggcatttaccttgaaatgtaaggttaataaagcctatatcaccactcaaatcctaatttcaacttgcaatgtgaaattctctagccacaataaagatctagctaacataattcagtttctacttattttgaatatatatctgtccaatttgggtccagtttggacaatttaggtgaaaactggatggctgtgtttatatgtattatcatcatactacgttttactttatcttgagttaattttgctttattggatgaatgtcatatgttctgtaggtggcttaagcgtaaaattcacccattacctactaatccaattatgcaaaagcccactcttggctttccaacaggtaatttttatgatcttatttgctatgagaatcttgagccatcttcaggaatcaatacattgtaaaagcattattgattatcacgttaatgattgacataatttattgccttcctaggggaaagaagctttcagaagatcattaaatgcattaaaacctgcagatgtccacatgtctgtgcctctctttagcagcctgactcctttgggtcagttattcttagcctcggtatttctatcttatggcatcgcaggtctaagattagcttgttaggcgttatcatgccatatgagttacctcctaatataactctacactggaatgattatttatagaaagagcattctgtcatttttgggttatttctagtagtttaaataaagaagaataacattcaagtgaaaccacagattccttcctgctgccaaaatagcatgataactgtctgcttaaggggcaataatgttgtttaaatgtgtgcttagggtgattgcagaattctttttatctctgccaccttgagagaaaagggagagctctggtaatgatgtatcatgcttatggaaaggcaaagaggcggccttgatgctgtctcagagcacacaggactctggttgatgatgacaacaagagacacacagggtttatttttagaaacagacattgctaagctctccatttggtgttaatattgctcataaacagagcttcttggggctgttgacccttctcgtgaatatggcattacacacacatactgttttcttttttcactttgtaagaatgattctattattgaaagtgtatatatatctgtttctaaaaattaagaaatctaaattctattcaatttctcaattttttttttttaatcccatgaagcttgggtttaagaattggtttatgaaaaacaattgactattataagcacaataaatatacaggttaactataagtatgggaaaaaggcaagtatacatcatgaatgacttttaataataaataacaccaatgctcctagctttattaccacaatatataaaatatagccataaaagatactgtcattataatgcactattgtgagttactgatttaaatagatgagataaaattctcagcatatgagaaaagtaagtgtaagcctctgcttgctgtttgggtattactacctcttgatgttcccagcaagtctcatatacagtaaaatatgcagttttacatttgagaagtgttctctcaatttactttgtgtgcttaattcaaaccttagcaattgttactttgctctaaaattagaattgtgttttaatgttaaattcgcattttatattttactattaactcatttttcctaaatgataaaaatgttaaaatggatgttagtgcattttatgttaaacatttgccaaatgctatagaatggataacttatgcaggtcttccaaatattcattacatattattattattattattattattattattactatttgagacggagtctcactctgtcgcccaggctggagtgcagtggcgcgatctcggctcactgcaagctccacctcccgggttcacaccaatctcccacctcagcctcccgagtagctggaactacaggcgcccgccaccacgcccggctagtttttttttgtatttttagtagagacggggtttcaccatgttagacaggatggtctagatctcctgacctcgtgatccgcccgcctcggcctcccaaagtgctggaattacaggcgtgagccaccgcacccggctattattattattattttttgagatgaggttttgctcttgttgcccaggctagagtgcaatggcgccctcttgggtcattgtaacctccgcctcccgggttcaagctattctgcctcagcctcctgagtagctgggattacacgcatgtgccaccaagcctggctaaatttgtatttttagtaaagatggggtttcttcacattggtcaggctggtctcgatctctcgacctcaggtgatccgcctgccttggcctcccatgtttttaaaagataaatatgttttgtgttttgtttggttatctgctgaccattaggaatttccaaaatgaaagacaaaaataggaaacacacagtaattgaaatgtatcttaaaagaagtcaagatggaaataaattcagagagtggaaatggaagcaactgaaggaacaacataacatgttgcatcctgaccactcttttaatgagcgggtcgaagactttggaagatgaaattgtttgaagctttgggaactggggtgaaagagtcatttatcggttcattttttcacccaaaactgttttaagaaccaaccatatgacacagaagatacagctattaaacaaagcaaggagatacatggttggttgttcaatggaatgatggatggatagataaagctacttgagataggaattagtattaaggtgaaataagagaatggggtagaaagtgactgatagggcagtattaactagggtagctagggtagttaagtgaaggcttttgagtctgctaacctgtaaagggtatctttctaaaaaaagtagattttccttcaacgtttaatttggtctaagtcaagtagaacagaagcacagttaaaatagattaggaatggtctggatctatttcaatattgttacctctgctttgtggaaaggatggggaagcatttagcagtaggtaggtaagggaactggagaaaggctgttagctatgattttctctgtttttcatagagatcgtgaaccaagtgcctctctcttgtattcatattattaacttgaagtgaaggctcttttagaacttgttccctttccttgttcctaaggttcacccttgtccctcatctcacctgccctgtcaattgtgcttaacatttcttacccaagcagtatgagtcattgctagtagttcagtgaagcaaacagtttctctttctcagaaacccaaaagaaggggagcagagtatcttcgccagctgaagttagaagtcttagaacattttctcataaacacaatattgcacactttttaaaggagtatgaaatacagtattcatcacacaggcatttactgtgtacctacaacgtgccaggtatttaattcaggtagatcatgggtcaaatcacacctttgttaggcggctggagaatcataacttcccaagaaaatatttagcatacatagcatacacagtcgtcgttgggttagcaactggctagattcgtgacatgttgttacaaaaaaatagttgtataaggaagtatttcatgaaggtgacacatctattttttaaaaagggagaaacagctaagagctatttttcctcacacattatgctttgtgaatagggaacaatggtggatacacagagtaggttggacaaacatttttgagggactgacacattatctcacatgcttgatgcctcatggggttttccctcaacattccaattggtctaagtcaaagcacaattagaatagagcaggaagtgttctggagctattttaatctccacttaacttctgccttgtggaaggggtggggaagcctttatcaatgggtaggtgggagaaccaggggaagactgtcagctacgattttctctagcctcaagaagactgagaccgagccaaactcctggccaacgtgctttgtggattcacagtgtagcttgagaaaaatggttagtggtgacttgttttttcccccgagtgattatctcattcaatcagtatttattgagtccttgaaagctgtattttttaaatgaggctgcttgtttatctgtttttgttgttgttgatttcttagtctaagaattaccaggtatttccttcttctgagataccttaatgctctattccaactggtcatcactggggaaaattctcttacaagcccaatgcaaatgttacctaatgtctgacaccatcactgatttcccctcacctctgtaatattaatacttccctaattacgtgtattttttttctctttctcccttctctctcgatcctcatagtccttttattactctctttagaacatttccactttctgtcttacactgtgactgtgtatgtgtgtcctcatccccccaattagttatattataagctccaagaggaaaaggatcatgttttacttctatttttattccctacagtacctagcatataattgatccctgagactatttttagataaatgaatgattaaagagtacagtgttattgcacaatgtgtttttatacatttggtatttttaaaaaatgatttcttcttttatgaagaaaattactcctcagtttctttgtagatttgaaaaatgtagacatttttgaggtgttagagctttttgcccccaaattaaaattattcattatagaatgtaagcaggaatgacctccaatgctttaacaatgtgtgtatgaccctttaaatgcttcagttattcttaacgaagggaatttgggaatattcttatttgatgtgatttttcaatgaataatgaatgccaatagaaatttcctgggatatgtgtctgcattcaaaatgtgaaatgtgaaatagctaatttaagactgcctgaatataaatgcatactttttttaatccaagagaagaataaatttagttgtgaaaatgattacaggtgtacttttatgttattcaaataacactttgcatttaatactatttttcccttctcctatgtttttatgtagagacaattttcttagataaggggcaaaaataggtggatttttctgttaataataatatcaattggaaataatttatccccacaattgctatctagctcatctacatttattctgacattatttaattagctatattatttgacaagggggcaaggaatgatgatttttgatgaacaatttaatcaaaatctcaatgccaagggtatcagtaatttgaaaaattatctaaagtaaaatgtcagaataaggagttaacatagtgagatattaaggaaatatagatggaatgggtgaatcaatctctatgtacaactcttctaagagaagaatgagaaaattatctttatgtgtatgtgggaaaggaatggtatagggaataagatataaatctttcagggtagtctttttgctctattttatccttaaaacagcataaattaggataagggcattaagacttagaaaattaattgagttcgttgataatagatgtgtgggctgagaaaggagttagataataaaaccgaattttacagcataggtgttgaacacagtgtagtatatcatggtgaacaaatgtatgccagtgtccttttagtgaatttgcaaaggctgccaattaggctttcttatcattgttcatttgtttgctaaaagatgaacataaaaatattagaaaaaaattatctgaataccagcttaacctaacttttatattgtaagaaggaaaacaaccctcaatcaactgatacccgtagtacccctagtctctcactatttattatcccagtaattaaatggacattcttccacatccttgatctggaaagatcaatatctttttctttttttactttttctttccagcacatagtttcaaatctgaatatagttataactctaacgttagaaacctctatctcagttcagtcttagatgactacaaaccaaactaaattgccaggtacagtggttcatgcctttaattccagcactttgggaggctgcggtgggaggattgcttgagccaggaagtcaaggcttcagtgagccgacatcactccattgcactccagcctgggcagcagagtgagactctgtctcaaataaataaataaacaaataaaagaaaagacaaatattaaattgtttagtggacacaggagacaacattgttctatttgattatctactgcccagtcagcttccttgggcactcaaccaacaggtaacagagattatctttatgcttcaccagtcatatatatgagacccactttcttcacacccctgccaatatattggatattgtcagactgtagatatttttgccaatcttaaagatgaaaatggtagagaattacttttttctgtgaatttttctgactactgttggattcgagtggttttcatatgctattagccatatgggttttcttttatggagagagaattccaggaatgcaagattggttaaaggaaaaaagtctatcagtgaatgttgccctgttaataatgaattaagcaaaaaaaaaaaaaaaaaaatcttctcattagatgtagaaaaacatgcaataaaattcagtatacttccagcatagaaactcttattaaactaaaaaatagaagagggaagtaagtattgttgaccaaaacccattcaccctatctgaaactttatatttaatggtaaaattaaaatacattctctttaatgtcaggaattgtctttggatgtcctagtcaatatttcaagacatgagcattcaataagatgtattagaaattaaaaggaaaataaaataattgaaataataaagagttcacttatattgctcagtacaaggtcagtacaaaataaaacattgaaaggactgttttatataaaaaacaaccaaacacaaaatgtaatagtgctagcatttacatggcaaatgaaacttttatggaaaaattaataacattgttgaagggcatataagaaaacttgatcagatttgagcgatgctatgctcaggaataggaagactacatctttaaaaagttatttattcccaaattaatctacatatctctttgtttttaaaacagttttttaaaaaagatgcttgatgaatagtattaagtcagatacactaagtgatgtataacaagaagtaaatcttatttccacctcaactctactaaccattcgatttcccacctcatacatagtctgctgtaaatttcttctatacattatatgtgtattatatttcagcacaatgttgattaaaatcctgacaggatctatgaaggaacaaggcatactgattccagaaattcaaatatacgagtaagtgtgcacaaatggcagttttgtaaagcaacaaatggagagaagaagcctagatgtcaagtcatacaaagctgtattaataatgattatttggtttgggcagggacatgctcacatagatgacaaggaatagaatacaacgttatttttagtagctttgtgtatgacagagtttgcatcacaaatcaatggaaagaggacaaactgttaattaaatagtttgggaacaattaatatattcagtttttaaactcatagccaaatgattttgtactcaaatatctatgtttgcaatactgttgttatccagttatgcaggttacaatttaaatttctgcaaagcctatgtattgtatcatgcatgtaggatcttgcattgtatagagggaccggaaggaattttatgaagatagggcagggactttagtaaagtggttctaaactaggtgagagaagtacacaatgtttatctagctcaattctcaaaaaataacttgagaccaaataaaagattcagatctatgagtacgatagagtgaaatagagaggtgataatttagtcaaagaagaaaggtagataactgtatcctaaagcttcaccaagttagtcactgaatagtgccttaaaagaccaatggagaagtgacttttaagctgatgcctgagtgactagaagagcccagccatgcaaagatcaaaggacagcaattccaggcagggggaacagccaatgccaaggcccttgagaccattatgtatttggctgttctcagaataaaggccactgtggctacatcactttcaacacaatagagaggattttcaggaggtttagccaaatctgccactgtctgtgtggagataggtaatctagctgtcttctctggcatctgtaagctaggatgggttgcctagattaccgttaggtccctgccatccttaaaaatgttagggatttgactttttaattccctaaaccagatcatatcgcaagactatgtctttcttgaacctccaaaataattttgatttagtgggcaaataaccccagtaatttgtttgatactgctagtttataatcctacagattttaggtttagaaacccattcacttctagcttatttaaacgttattgcttattttgaagcttatgccatgtctgactttggcttagaatgtgttgccttttcacaaaagtgttgtggtctgttatagacctgtttacaaagaactatcactaattgttatgacttatctagcttagtttgatacctcaaaacaatctgagtcaatctttctttttctgtggtgtgtatatgcgttgtatgtgtatatgcatatacaatgtatgtattacaactgtaattgaactatttcatatttttctctgtagcaagttatgtcattcttctaatagaagtagaaagaaatagatggaaaatttgactatatgccaaatttcttatagcttagaactatttattaccatcttagtaatgaagattattatttgattgtttatcagaaatataaagttgtatcgttagtgttcatgtttttcttccaatctctttgcccagtgactacatttgaattttctaggtcaatttaaaattgtatttcacttttaaaaattcggacttattttgggctaaaatagaaatttcagttaagcacaataacagagatgattgtaaaaatgcagaaattccagttaaatattaacacttaatataattaattgctgcaggtcagctgcttaataagtaaataattgtttccagctatcttttttccccagtttattttaatcaaaataattttcttggctgtgtgctgtggcccatgcctataaacctcaggatttggaaggctaaggtgggaggatagcttgaggccaggagtttgagactatccagggcaacatagtgagaccctgtctctacaaaaataaaaacgaaaaataattagctggctgttgtggtgtgtgcctgtagtcctagctactccggaggctgaggtgggagggttgcttgagtccaggaatttgagtttgaagtgagctatgatcatgccgctgcactctagcctggatgacacataagaccctgtctctaaagataataagaaaataataacaataaaaataattttcttcgttaaactagtattttgggataagtactacatagtccttaggaatttttattcataactttttctaaactccagtttatagtcatatggttaaaatttaaaaacagaaagagagattatattggttattggttctaaagtcatattttattgggttttacacctactatggtgatatttaaatgatgccaaagctacatgttgcaatcaagataacaagagtattttttccttcttcctcattccaatcttttgaaatgtaatgcatggaaatttttctttcatatgttaagtgtatctcattgctgaatatagtgtgcctcactgaagtattcacttcgttgccaaaaacacatcagtcattcacaaatattcagtattctgagaatgaaatttttttttagctacttgggtagttggtgaaagccagtttgcaaagatttctaactcctacagcgttagacatattatgtggaatccagggctaagcagcagctcccaaaacatgaggtagagttctagatacattggacccttcaggccacagtatcctggaccaagatttgtagccagttaacagaatggcagtaagcagtcttctattttgtcagtgagatcaaagagcattataattttggagaacaaagggggttccatccctgagcacattcattagcatttaaaggaaatagttataaaataaaaatacaatccctgagttaattaaaacatggagtttcaacataagcaaacctaaggcttagaagattggttgacatataataattgcttaatgaatattcatgggataagtgaatgaatgaatggattgaatatcatccatttacagcagctgatatttcaagtgcacatgtgcgtttgcactttaaatgttctaggctttttatcctgggttttctaggcataagatatataaagaatatattttaaaagccaatttttaattttaaaacttaaagggaagaagaacttcttttcattcttcatgatgcttttactaaggacacattattatttttatgaatattaactacgtcatacttcaaatatggaggttcttcagtcacacttaaaattttttgggttgttttcttcagacaaaaatggctttgcagctgtgattttatactcttcatcctgcctgcgggcctctttctagtagggccacattgtgtcatcctaatttattatgtgcagtatagttagagaataaaacctcagatggttgggcttattgcgttggtttctaaaatgaaatttaaaagacctttaagaaggatttcctctgggtaaatatattcagttatgctcatatccatagaaaatgtaatttggacaataaaaggccaaaatcacttgagtctttggtatgttctggatagctggtgtttttagagttgtgatttccaggaaggaggatgtcaccttaccgccctagtcaatatcctatttacttaagaacagaaacagggaaaggacaactcaaccttcctctcacctccttcacatgagaaccccagaggatgttctgatgtgtgtcaaattcacattctagatagtaatatattaggctgggtgcagtggttcacgcctgtaatcccagcactttgggaggccgaggtgggtggatcacctgaggtcaggagttttgagaacagcctggccaacatggccaaaccctgtctctactaaaagtacaaaacttagccaggcgtggtggtgtgtgcctgtagtcccagctacttgggaggctgaggcaggagaatcacttgaacccaggaggcagaggttgcagtaagccgagatcgtgccattgcactccagcctgggtgacagagtcagactccatttcagaaaaaaaaaaaaaaaaaaaaaaagatagtaatacattgagcatctgatctgccttagctgaaaaatcaaacatctggcataatggtaaaaaattatatagaaagattacttaaaaagacatctgattttaggcttctttttctggcaacaacaacaaccaccaccatcaccccaattcagccagcattctctacatttctaatttatgtttaaataaatatgaatatttagtccaagataaattttttgatcaaaactgatgatctcacacattgacagatttactttctggtatttaaagacaaacatattcagaaaggttaagcagtgcagggcgtcatgtgcttacaggaattgatatcttttaagagtccgtcattgtgactgcctcatttcacggcttgccacctgactctgttcttacaaacgataaaagttcaaataatacattatgaaaatgcgttctgaggatgttttatttacttgctactttccacttgtagtttcatgtcaagtatggtcccttacacctggtaagaactgaataccatgtttgggaatgaacgaactaaaggatcagcttgtgtgatgcgagagctgcctgcattatttcctcccctccatttctcctcttttacagtctagagtctagtatggctgctctcatagttcttctatacattcattctaaagaattagctgtaatctattacacatcatataccaactttgttattctcttgtcagtcacatatcttttctcaacactgatttgaacatttgtccatctttcagaacacgatgttgcaggtagaagagtacaagttaagacaggatgccttaattaaagaagaggcctttactcctgttttcttccattctcacccctctgtttctgccagaattgtgacagcagggcagaaaatgggcttttcgtgcagagttgacaagatacagggtagtgaagacaagaatcttctttcacatgctaagaaactcctgactatacttctgaagtagtaattggaatgacagcttttctggctgaagtacaatttttttgttttaaaaatacaaatggtccctctcattttctattcccagttctttcactcacatgctcacacttacagttatacagtgttcacacatacatttttcattgttttctcatttgaaataaaatgttatgagaaattttcaccataagcaaataatcacttattttatttgttttaattgagcttttaaaaggacattatttattattatttcacacactcgtgcatttattgatttactctctcccacagtgattgatttaccggtatttatcttctccaactagactgacttctaatgactcatttatttgggaacttcttctatacgaatcaaaatcaagagtttgaagtaacccagaaagagacttggagagcccaagggatctgtgaatgagctttaggcagtttctgaatctaagaaaattgtctgcaaacaaatatatttgtgtacatatgcatttttggggagagactgtcaattccatgtcttaatactcaaagaagtttgtgtccctagcaaacgtaagtgatcaattttagaaagagtgataacaaatttgattatttgggtcttcagcccaagactaaaaggcatagattacaagcaggggagtttactagatttagactacctaaagacttacctagagccacagcacacaataaaaagcaaaaagaaaaccaacccatcttccaaatatagaaaaggtcgagaaattaatgcaaaagcttgtcccacctccattaaagccgactgctgtatttaactggccctgagggaaccacagtttcacaatgcagttacggaaaggccagtaatagccctggctggctcctccatgtcatagatatctttaaaatcagagatgtatctaacccattttggaaagcataccttaaaacattaaagtgtttttgatatttcaaggaaaaggcttccgacatgtgaaatgtttattttctagattctcttattccaaaatgaaatcaaacgtgtatgaagctgtgggatgtgtcgtttgccccttgaagctatagtgtggtagaaattgaatctttatgtccagaagcccagtgtctgtattattagttttgcaaacatctgtgggctctaagtgattgataaatactatgtatagaattaacctaaagtttagtttgaagaccctacttcatagatcaatatgaaaatgatgccagcaaaaaatatagtttagacattgtgccttggaaaaatatttctatttatattaatgagcttatgtgatgtcatcacaactcattctaggaaagatctaggtcagtgtaatcctatctagagaaagttaaaaaagaataattgttgacttggtattcttcgtagtcagaaacaaattaaatgacaaattatgacactattttttattacatgacagacaaataaaaagttaccatatattaaatgctcaagaggttaatatctataaagcagaaatataaactgtaaatcagtaagaaataccagtaactcagtggataaataatcaaaggctatgaataagacatttacaaaggaataaccaaaaataggcagtaagtatccgagaagatgatcaatctttgtcatgattaacacatcaatgaggtgccatttttgtcaacattatgggagtaaaaataaatgactagataatgcttagtgttgattgtggtttggaggaaaggggtgttgtcatgtattagtggaagagcacactgttcaaattttggagcagcataaattggcagtactataaaaattaaaaatctacacacccaacaatctagtaattccacttaattggtatacagaaatacttgcacaaattcacaataatttatgtaccaggatatttatcagcagttttatttataataatggaaaactgagggcaatctaactataagtcaatacataatccatactctgaaatacaagtcattaaagttattaagtaatgtctgaagatattaacatagaaggatgagctcaatatattaatgaatgcaaaaaaatgtagaatggtatacagtacatatagcatagtaagctcaactaatggattcatggtacttgtttccattattttattgttgtagtaggagcagaaaagtagtaaaagtattttaacccaaagaaaaaaaatgctagcatgaaaatcacagttcaataaagtgtttttatatcagtatgtttattaataattaaaagtattaataagtttacttcaggaataagattaatttacgtatctgtgagaaacttcgtgatatacatcaaaatattaaagtaatcatgctatatttttcttttcattctgaagaccacctcttgcaggtaactttttctattttattatactgtcctattctcctttctttacttagttatatatcacaactatagaagaaataggttacctgttacttgcagaaatgtcactcactattaatattactttgcaacacagaaaatttttctgaataattagaggcaactaagcaagcctaaatggagttggttaattaagttataaaattctaagggagtatgatgaaccatgtagacatatgagctttctgttctgcttttttatcaaatgtttctggcacctgggttttctcaactgcccttctgttgaatatgattttcgaattgatgtaatgaagagtggtgctctctggacaagtaagctgttcatttgtagaataataatatgtcaacacatattttccaaaataacagtcctactaccgtaaatgtcttggaaacagttacctgacacccagagagtaagtacaactagcctagagccttggtctgacaccaagcaagagggtttatgaaagaagatagcccagaaagctggagtcctgctctgctgtgtcgacatgtctacagctcagaataaaattgagtttcctgctttagccatagctgggtcttaaaataacctgaagaaattatagttctgattacatagaaagtgaaggacttagaacattctcctaataaagccatgagaatgacacaaagcttagtcatcggcagtcctcctctaacaggcgttttagagagaaaaatagaggtttgaaattggataatttgatttgaaatcttgcctaattattttaagaatgcagaaaacctttcttttttggccaaaaaaataatgatctggaatccaattaggaaagaacaggcttttaaaatgtttgatatctccagtaatggagaaaaatcatgtctttaaaattacattctgctacaaacctcattcttggatgtcttgctttttgcattttgaatggacaaatttaatgtaatttccttttggaaacatggcattggaaaagttagatgagatgtttaattttatgttggatcctatctaccagggtacagatttttaagaagaaaaacacttcttgtttcgttttatttcccaagggagatatctcacttaaccagatgccttgcgatttgtcacaatatagatcatttacacagaatttgtgtccagtcgtccatctatttgatttgcacaccatgaataaaataagcaaaatggataaagcttctaatactcccaattaaaaaattgctatctattttttcaccattaatatgctatcccaaatggcatttatcaccatactgtctcaccatatttattcgtatgctgttgttttctcaagatacgttcaattcagattatgtttgacttgcagccatatcaataatatgactaataataaacaacagtctaggatttccagtttttagaaaaacgataataaatttgaagtgaacctatattcagatttacattttacttagtattgtttttaaaaaaacattcaattaatattctgaaatgattccatttatttttactacaaagttagctggacctttacagcattttagagttttacacgaggtttagatttgactaagccttagtacgatgtctggaaacaggaggttgaatgaacatttgttgaaaggaaaaatcagttattgaaatattgtgtcttctgttatcattcttgagaaatggtggtgagacaacttagtagaagtgactaacaactacatatatacagaagacaggatgtaagtctccaaggtaatcaagaccaacaggaggatgttagaccaaaattaacaccgcgagaaatgtgttatgcatatattacagcccacgtgtgaaaatctgttcatttatagagagattgcttctctgtgaatggctaagttggctccactaagtacaaaaaagcacttagggccattcagaactaacagccacacactctgaaagactaaaccaaaagatacctgattagtaagtgctctttagatgtggggatagacgttttaacaaagaaaggacagggatggagaggactaaagctccgtgctgggaaactcttaaggagccagggcctcccaacaatatgctaagagtgcacccctagctgtctggccacattttcatttcttgtctcaatcctgaggattaatcatgaattccagtccagtttctttccaagcatataactggacatgacagagtatcttagcttctacatcataaagctcaattgttaatactgaaaaaaaaaaagcagggtggtttttttaaaaaaaacaaaaaacaaaaaacaaaaaaaaaaacatctaatgagcaaacaaaccaaacatgcctctcttatttcttgtcctgtctattttttatttaagcgctgtaggtgaggtaattgaaatggagcccatgatatgtcttaagaaggattaataacattcagtgaccattaagtgctatgaattttcaatgtataatgttttatttgtttctcccaggaatcctctttgtaggtggtaaaaatcatttaacaagtgaggaaactgagctcaaagaggctgaataactttaattaacaagcatttatggatgtccactgtatttaggccaaagtaaatgatgtagtgtcttgcttccaagagcacattgtctagagtggaggaaaaaggcaaagtaaacatgagagaataggtgctaaaactagactttgcaatattgagaaggcctgggaagcctttcaaaggaaataaatgaaggggagttcagtgtttttgaagatggttggaggacatgatctataatgttgccatggctggagatgacactgcaaaccaggcaggagacagatgattaaggacctttaattccatgcaaagctagtgactttgaacttctaaaggattttaagaagagctgcatgatcagaaatacttcttggaaaagtaactttagctgctgtataaaggatgggacactccttaaaatgggttgtgtaattatcacataacctctaactattaactagaagtgcccagcaaggaatagggagagaatagtaagagtgaactggaaggaccagaaagagataaattgggaattcatgcaagaggtaaagggacaaattcagagtctgagatttccacattcataactgggtagatgtgttgccattattcattcattaattattttttgagtgtctcttatgtgccagacattatcttcgtgccaaaatagatgacagagcaaaacaaccttatatatttgcccttgtggaatgtgaaatctacactgtttgcacatgtatatgtgtgtgtgtgttgggagactgataataaattataaatgtacataattatgtaattggttagaaatggtgctgttagatgaacaaaaggtagggcagagaaaggtggttcatgagttgggagagaaaggtgcaccatcacatagagtagttagagtaggtaatttttatgaaggtaagattttcagcaaaggattggagaaggattgttaaggtgaggaattacacaagagacagatgaggagatttaaatgtagaccccgccctcccccacctccccctccccgctccgccctgcttcccattgcttgtcttgctattcacctggactggcagaataagcgtggagcttggtaggtaacattgattgactatcacaaaatgaagtgtagagcaacactgagagtaggaaaaccttacactatgaaaacatagaggggaaagaagcacttcttcatctggctgggttagctattctcaggataggtactcaagtatggaaggtatatagagattgggccttggcatacattcatatctacacagatagcatctatttacctgtgtagtgaatgtgagcatgataattcatgtaattaactgccatatttcttgtagggactgaaagttaacaactttgtatattaatactctaagagaactctaactatagtctccaacaagaattgcagggattttaaactcataattactcctcagctgtaaatttcagatgtgggttattgctttttctcatttaggggagtgaaattgcttcagccatcgactttgtgatgaggcctgcagtcagctgtagttgagaggggtgctcactctctgctattattagtagtttgtccacgtaaagacaatcatacaacatgtacaaaagttggattcaggatagcaacatattatgttttgtggctgcaagatatttaaatctaacaccaatagcataacgtttaaaaacaaaaattttattgaaaataaagtttatgtttggggcaaaggaagattaagaggataggaatatatattttcccattcttaactctgtctctcttctagggattgagagatacagagagattgagagagtgaattggagtgagtggatatgagttatatagcactgcctaatggattattacctcccaaacccctgagttgaagagtagatggagagcctgtgtaaaagattttgggtagacgattttgaaataaaacttagtgacatacacacacacacacacacacacacacacacacacacacattacagataagtatatatatggaaaaatatgtatacgcaaggaaaatactgctgttctaaatgtagtataatgattttaatatactacccaagaaatcttatgagactttaaaatcattttaagatttaataatagtaatggatttaatttttttagtatgctattcattacaaactagaaaaatcctaataaatcagtctgaatcagtaaagcctcatagatttccatgcaataatgtgtttcctcagttgcttttacaggaaaataattactaattatttgataaatttaattttggagcaaatgtgttgacagctgaaaaaacatgtaatgacttggatagagaccagatataacactagaacaaataatattggcgacttaaaaaaatagtaactgatgaaaaaaatctaattgcgttaaatattttaaagtacctaaaaataccaaggattttgtatcttttgtccttttctacttgaaatttcttaatcattttggtgatcatacaagataaatctttaaaattactgtgtgagtattcttaaaataaatataattctttggttaaactatacttctctaaattacatgcagtcttaataaaataattcctatggatgttaatgttcattctaaacaattttgctcaatccatatttttgtaaactgcattgctttgctttttttaaaagctactgtttatatagtcctagttcccagtttttcatatatactgtattgtgtctttaaaattagaaatgctgctgaaacatagaatatattaatccttgatgaaatgggacctctctttgagtataggactgttgcctgtacaactaagtctagtctttcagaacagaataggatgctgtatatctgttccctggaacttagatcctttggccttggttctacctgactttgagaaattacaatccctagtttttgtacatgtttcacttactttctgcatacgatttctggcttacttgactcttaagttcttgctgccagtcttgcctctgcagcagtccacattctctcaccaccaaagacataatgtcttgtggcttccccacttttatctctttgcctgctactcaacatttgttctgcaccagatgaaagtcactgttttaggtactttttaggggtacataaataattatttccttcaagaagccagcaatctgcataggaaaggttcacaaagcaattttgaaataatttaataagtctgcataatggattatcacatgagctttgtaatttatactattttgttggaattgtatagcaatatttataagttgttactatttgagaattcttgtgtcttaaatcatcttcctattagactgatatacaagtctccccattgaccacccccaatgccaaaaagaagcatgctgtgaacactgcaaagtaaactattagaaattaatggtcactacctataaagatagcaaaatactaaaggggtggtattttatgagcaatggaaacttttgttgtagatatttcaactgacactgtgcctttattactactttatacctacatctgaagatccagactctagtagttgtaatacaatagatgcaaacagtgggaacatctagttcttgtcaatgtgtcaccaaaacatattatcaaagctaatctcataagggtgtcagaggaaattaaagttgcctttggctgcatgttataagaactgactgaaattttaaactacctcagtagctgactatatacagcagcaggaagccttcaattaactgcaccagttctatttgtagtacaaaggatctatggcttaggatagcctacataacttaaaaagaaaaaaactcaactagatcttaacagtatcctgaagtacagcctgagagaaaaggatagatagggtcagataggagcatggagcatagtaactaattcaaagacaagggggtcttaggttgagctttaaaaaatgttctgtctagtcaataagaaattcagagacaatgtctttgaaagaaaggtaagccagaatgaagagtagcagtctacattctagagattataacaataaaagtcagcaatattaaatgatttagtatagaaaaaggtgagcttttacaagaataatggatagaaaagagttcttgaggttattaagtagaaattcacatggatttaataatgaaagatcatttccacatgatcctcaggccctgtttcttggactgtaattaagaagaaaaatggaagaacactaagagaaaggactaggaagtggtagtggctctaatgttcttcttttaccttttgaaatgctacctgatactaatttttgagaaaaatttgttggagagtgaaacttgcatgtcttttggataattttatttaaaggtgaatgatctcaattttaccttctttgtttttcacagttgcctccctctccttttgctatatggactatatgtatctaagtaagttaatgttggaaaaaagtttaaacattgagaaaattactgagggtgtctgggtaatatctcagaattagatttgaaagtcactgaacgatatgttgtggctcaatgaggaagttgttagatttgtgataataccgaaaaaaatccctcttttggttttatctaaattagcattcacaatacaaaagtcattctaagaattataattaggagtctgacattttacacagaatttggtagttatttttggtaaataatttttacagaggatgtttgatcaaattaaaatgtaaaaattttaaggatcaacctatgattttcttgtattaatatattcacgtgggatctaaatgctgaaaaattgtattattattttttctagtttcaaatctaccagaatgtttatctataacaacttctatacagaagttgtttaaagttcatggaaactatcttctgtaggagacagtttacagtttacagttctgtaaaatgaatcataaaatccagaattttgctccacttgtcccattactgatccataaaaactggatttaatttctactgtagttatttttaaaaaatacacatttggtaccttaagaatgaaataattataggtcgggcatggtggttcacttctgtaatcccagcaatttgggagggcgaggcagtaggatcacttgaactcaagttcaagtggagtttgagaccaggctgagcaataaagcaagactcagtctctacgaaaataaaaataaaaataaaagtaaaaaagtaagccaggtgtggtggcacatgggaagctgaggtgggaggattggggaggtcgagggtgcttctgtagaagttttccatgaagtatttttttttttttaaattaggtcgaattaatttgcttatttttcagaaaatagattttggagctggtaagaagaaatgagaaatactaatatagcatattagaacaaataacattttatataagtgaaaacagaaaaaaattaggtaaaatgatatatttataagcccagtgaaggaaatggaatgaattatcttctgggttttcagaccaaatggactgtcagatcctttagttaaaaatttgaaatatcacctttaaaattaaggtttagtcttctcttctttgccactttacttacttttcagggcattaaaaattacttagcaaactcataattatgtaccagaataattccctttaataggaattttattctaggaaatcatttctaaaagtgataaaattttaccaatttacaaatacttttgtactaacagtattaataacaatgaattttatagtagtgatagatacataaggagacaggaatcgatgagcatgggacttattatggaatatagttgaccatgtttcaacatatgaagtattattagaaagtgatacctctctacctccactcttctttctaactttaacaatttcctgcccagtctagggtgtgcatatttggaattatacctatttacaaaggaaccacataagtaaaaaacatgagataaaatggctattttagccatcagagtttttctggggtatttgtattacatttctgttttcttgcttgatgtctttatccttctgtcatgtgaatctctttattcccaaacatttgtctgggtattaaaccttttttcttatatgactcaatgttaagagagcctcaaacagctaaacaaaataacaatgagtggaaaatttctgtagccaagaagaaaattaaaaataggagacagaaaataaccagagaagaaaaaaaaaatcttttgaaaaatggtcaaatgtcatccagataaccttccaaggaaagctgcctctcatctccttcccccttcttttccttcctcatcttcctaaggttgtcagttggcataggacataaaagtaaataaaaagatgggcataaaagcaaatcaaaagtggtaggaaagcagccaataaaaatggggaggtattgtcccagaataaggacagagattttactttagccaattccaagttaagttttcatccaacacttagtttggtatttacatgaatgcttgtatagatttccaaagtagatgccaaagtagattgaggaagttagtggattagtccctagggtttgtttgttaaaagaatttgagaagcttcccataataactttaacataacagaaaagaaaactgataattgtgtgtatttcgtgtatttatggttatatacattatgtagtttatttcatccatagacttgttttttctcaatcatttctttagttgttttagaattaagaaaatgcattcatacattgttgaggaaagagtcttgaactcattggattcaccaatgtttaaaatctttattgcaccaatttttttaaatctttattggttttcattgatctgatgtggttcatgattttccatgacattcactcttttaaaatgaatcataaaatccagcattttgctctgcttgtcccattacttatccataaaaactagatttaatttctactgtaattatttttttaaaatacacatttagtgctttaagaatggaataattacaggtcgggcacggtggttcacttccgtaatcccagcaatttgggggggtgtggcaggaggatcacttgaacccaagttcaagtggagtttgagaccaggctgggcaacaaagcaagatccagtctctacgtaaatagaaataaaaataaaaaaaataagccaggcatggtggcacatgggaggctgaggtggaaggattggggaggttgaggctgtagtgaaccatgatcatgccactcctgttctgcctgggcaacagagtgagatcctgtcttaaaacaaaacaaaaaagaatggaacaattataaaataatgtatgttctatctgaaaacaatgtcgttaacactttatggaagctgtccccagagttgagggacacttgctgatgtgaagttagccaacacatgactgcttcagaatagaaacaatgttcaatggtgttgaacaaaaaaaaaatgcacccttgctaaagctacttctaatgctgtgtagctctaacaaatgatttatactggttttccatttaatgagctggcagggaggatttttagctactgcaaaatcttctagaaaaaaaagaaacttgttgagaagtctctgaaagggtgtgaagtttcttattttacattcattaactttttattttattcaaagttcagaaataggctattggtcatgcattgtgaactcaccatctggctccatccagcttcctgagggatttcccccagtgtcacagtcttctgatgtacttcatgtttgtaaaagttttgaatgcttaattatatatataaaatatatatttatatatgtatgtgtatatgtatatataaatacatatatgtaacacttataaaagtgtgagaatttaaatatagatacatagttaaaaaaatcaatcggtatataaaggcttacagtgaaaagaaattatcctctatttcacttcagcttcagcccgactcgtttcagtactccagccctgcctcccatattagccattttaacaattttttactcgtatgcttctagtgcaacctctctgtctttaaataatattcttgctttattcactttcagcattgtctattgacttaatgcatggtaataagaataactcaccaatttttctcttttctcccctgcttcaaactatacttactttattcttagttcattcatttattataataattattattaattagtgttcagaaacctcaggaagaataattctcttaactggtttctaagttgttgagatatgtgtggatctgaatgatttggaaagtaagtaagtggactagcaaactgtaagcatcatataaatatgctttattaaggaatgtggttacactcaaattactcttttacttaagaaaataagaatttaaaccacttgacataaactgcaggaaattgttgaatgatttatcttaatttaatttctttaaattctttcctgtgatgtgctaatatgtatgtaattaagaaccaaatgagaaatgtactcttgaaaaaaactttaagttttgaaaaccttataaaaatataaaaagtcatttttcccctatgattaaagaaaatcaagttaatgcatgacctatatgttgctccttgacagtctttaatagacaaaatactggatttcctataaataagaaaatggaaaggaaaaaatcctctgttcctttcatacttttaccccctaactctttaactatacaatgtagttcggcctctaatgtgcttgtgtaagcaaaactcaatacccttaacctccgagaaccacacttctactgttggagttctattgaactccatttcaatgcaaacaagtaaaggaaatgtttaaaaagttgacgtgtgatgagaaatgaactcttttatgttttgtcaaaatttggtgcttctggaaaaaaattgtcaaatacattttttggtccaaagctttcattttatatttaaagaattaaaaggctgggcacagtggctcaagcctgtaatcccagcactttgggaggccgaggcaggtggattacctgaggtcaggagtttgagaccagactggccaacatggtgaaaccctgtctctactaaaaatacaaaatattatctgggcatggtggtgcacacctgtagtcccagctacttgggaggctgaggcaggagaattgcttgaacctgggaggtggaggttgcagtgagcccagatcacaccactgcagtccagcctgtgagacgccatctcagaacaacaacaacaacaaaaaaccaaaacaaacaaacaaaaaaccacaaagaattaaaatacttccatactaaggcatcacattttggccatccaggaacactgttgcctacagtaagattatgagctctcctagaggtatgattctaaagcaagattaatgcatttgattatttctggatacagggatgggaagagaagtggtctaattattcatttaaaatataccaattccaaaaattaatttgttctttcttgtttaattatatgattttcttagaacatcataaacttcttgtttatgcctcttctctctactctgaatattgactatcgtgagagctgttcaggcattaaacaccgatttgaattttgggttctctatgagtgaacaagtaaaattatcaaaacgttatatattgatcctataccgtttttgttttaaatcaaagtaagtcatgcatttagtttaaaaaggaaaaggtcttttaatgaaaatagcagttctctactctgcctctccccaatcctccttttcactccacagcagcaactaccttcaacagttctggctttcttctgtttttttttttaactttaatatttctaaataacatatccgtttagaaaattatttgtttatgcattttaagcactatgcattgttttctcagcctgtgagatgaggaggttcccctgtacccatatgtgttcacccacaggagtgtgcttgtgtgtgtgcacacacacaaatatgtacacttttcttctctactcttcccagtagttgaatcaaatcaatagtatttatatgactagtcaaatgtttactgctgaaccaagtcatgtattataaccatgtcaattttcaagttcaacttaggcttttttctgaagttcattgcaaaatcgtaccctctatttatctggttttgtatacttgcatgtttctaccatgtgcttaaaaataaatattttccacacctgcagcacttcaactctattttctccgggagtttccagccttctttctctattgggaactaattgctttaggctccccactcatccttggtctgttcctttgctgttcttttgcgtaatcctctctttcttggattcttgtagcttctttgtcggttttatttttgttttaattttcagaagaatattttacaatagcttatatttgttgaatttttacatacctgaaaatgtcatttttctatctttttcaatgatagatttgtatgactgggcatagaacccttgtggaaaattattgtgagttctagtcccaatttgactctctttcctttgcatttggcttccccaacacatttggaagctttttagaatcttctctttatctctgtggttctaaaattgtataacagtgtatcttaccttattcattttctcggttattctatggcctctttcaccttggaggcttatgttttcagtatttagatactcactcgaattattttcctttctttaatataacttcttctcctttgtgttctctactcttatttttctgcagttcttactagttcagtgttagaccttctgattagagtctaattgtattttctttcaggtagatttagttcactttgtcttcaagaacatttagtgacattttaatttaagttactgagtttttaatttcaaagagtttaaaatttttttttaagtttttcatcaaagtgcaccgttctttattttaatgtagtaggtaacttcctctattcgatagaggctattaattatagttaaccacattttaatttttctgcgtgcactttatactttttctctgctctcctcctttcatgtttgttttgatctctcctgcgtgttgggagccttcatatttaaaatgagcatttgatctttggaagctcatcatttgtgtggcaattgtagcatagaggggttctggtatagacggcatggacatttagcagccctttcagtgggtacatgtgtgtttgtgtgtatgtggttagaaagaatccttgcatgtgcaggcgtgatggctcacagctgtaatgctagcactttgggaggctgaggcaggagggctgtttgagaccagcctggacaacacggtgtgaccctgtttctacaaaacaacaacaacaacaaattagccaggcatggcagtgcatgcctgtagttcctgctactttggaggctgaggcaggaggattacttgagccttagaggtcaaggctgaagtgagctatgattgtgccactgcacttcagcttgggtaacagaataagaccttgtctaaaaaaaaatttagagagagagagaaaaagagagaatccttgcgtactagtgtctgcatttctcaccttatgagtcgttaggtgtctcaaggaaagaattttcccagcttctacttgaaggcaacgtgcttgtttgccagagctggggaagtagatgggtgagtgtgctttgtggaactgcactcgatccaccactgtgcagctcttgtgtcccacgtttctgctagagctgtggcctcacctcagttttgtttgtccagggaataactctttattcttctagtgaaaagaagggtagtaaatacagagagtggcagggacttagagaggaggagaaatgtcttggctgtgagggtatgggcatggtgatttaaggatgctacaatcagaccttaaaccagtccctgcgcttttgaccttgcgcttgaccactcgtcttcctctgtgcctttctgcaagttctgaacctcttagggattctctggcatgaggctgcttgttgctcactcactgcagttacttcgggttgtgctttctcctttcagtggggctgttaatcactatccaactcactttccatcttcagcaattcactgaactctcctgctcattcttgtcatctcttccctcttctttttttgctgtaggtttatagcattttaattcttttactgtcattttatggcatttctgaagggagtagaaataaatgcatttggtcaatccatcatttttattcagaagtcatacaatttttaaatcacccccaaattgatataataaatattattgttgatgttcttattattatttataatatgaaatattttaagttcataatactggagccattctgagaaagttcctaaaatagactactgcggaagcccattattgccatggacctgatatatttacatctataattttaatgaggatgtcataagattaaaatttgtgatggacatttgtgatctctctcaatgatgatctctattatatctacatacattcatttctttattaatagctcatccatgcagaactcaattatccaacaatctcattttattgataacaaatgctagaaaaagaaagtatcagaaatggctttgaaacaacgtttgcattgaatctacaaacatttttctggggatagcccataaaggcattaagcaaaaaaaaaaaaaaaaaaaaaaaaaaaaatttacttctatttcataaccaagtacaacagcttttgaaatttacatttcaaatacacagaacttagcaaacaaaacagaagaaaataagagggagcctgtgaacagacaaggaatgatcaatgaaactctacaataaagaggaagagaggggaaccagatggtagccaaagcaactcacattcctattaggagcttgtaggagaagctgtagatgccccactcaaacctcccagggctctgtcatttttatgttccccggcctggctcttgtctgcataaacctctctttgcctcagagctttcttttgtagttcaagcctacactgcaacccaggtgcatgacaggttaaaagtgccagagaattaatgccaccaggaagcagcctgcaatgaatgactggcagaattgatgtgtaaatatcccagcttccttgccccttggttaagtctaaagtatgtgttgtgcactggtgaccagaggtccctggaaggatgaagctccagttgtcactgtggtaatctgcctgctttcttggctgccttcctttactgtctcatttctctactctactataagcatgatgttttcccgaatcagctcccacctaaaccacaaatttgaactaaaatttgtaacttaatttggaagagcccaaaataagaaagaactatttagatttggagaacaattacgtattcctcaacaggacattattatatgtacaaaaagtgaaatatttaattttcaggatgacccacattcagtgaggaaacattcagttacattcaatatattctatttaagaacataaggatcatgtatatgtttaagaagacttctacttaatctagctaatacattatggttccagtgtttgacctttacttatatggaaatttaaaccaccctgaatgattcatctgattaaaattctggatatataagagctcttgggttaaggaaaacacgtgtgaatgttaaggtactttaaggaaataggagattattaactaaattgtatacaacaaaaatcctccataagcctctgtaaattcaagagaatatactagggagggtattaaataagttagttatagttactactcttttggaagatagaatattctaaaatatttaaaaagttaacacatttatgaaataaatgcttgcataaaatactatgtgtatatctgtgtgtgctttctcccagcttcccctggaaattagtttactagaatatccttattgctaacacatttccacgttctcctgactctcttgggatcatctgaactatggggctaacttactctcactctactacaaaaatttaactaacaggaataatcgtaaagcaaacattttaagtgtatcctgaataaaaaattgtctccatgcttctccattctgctttctcatcttctaacaaaaactaccagaagagactaaggactaaattttgggacaggtgaaggagagagttgaatctctctgccaggagaatggaagaaacatatctgttatcgttgttgtttctagaggaatggaaccaaactaaggggtttgggatagaggagaaaaggtttggaaaaggaataagagagaggagccaatagacttgaaaaatagcttgtatcgaattgcattttacagtgattgtgctgcactcatctccaatgctacaataaaatcaaatgcccacaaaaagaccacaaattaatgagtgatttatttttaaataaataaaataaatagggatcaaaagcagaaacttttttttttttctaatttctgtcaacaacagaatcaatgccaggacagggataaaggtggaaaatgcaaagccaaaaacaataatttagtggaaacaggaagttaaagccagaagtaaccttaaggttctaagtccttggaaattcccttacatacagagaaagccattggatttttgtatatggagggaatactggttcatcccagtctgacccaaaagttatgcgggagaatagttaagttccagagagatgtagctaatgtctgagtatctacttagtggccacagacattgaaaatcttgaaaatgcccaaatcttgaacttgagcacttcagttttagccacaagagtgaagaggtagaccagcagctttcctaaggcctcagttgatgggccttgccttcagtccttcataacctcaggcagcatcatcctctgtgcccaacgtgacctctgctctattctgtgcttcacaagcttaatggacttactttgtagtagaccactcattcttctacagtcttgattgtatggaaagagggaaactacagtagtttttttctgtaacaattgtctgctgttattttctgtacatttctctggcattcaccctgaattcattttctggtcatgcattaacttacattctcccgtggggtctcactttccatttagtcctcctgttcctagacttgatgatgtttatctgtgttgtctggtatcctactagtgacaggtcctgtttatcagtttgctaattatcacacagctcagccacagccttgtgaaataaacatactagttaagtatggtggtatgttaaggagtaaaagtaaagtctgtgagttgcatacttagaaaccgtgacaggaatttatcgcttcattctcattgacatttatgttgtggtagatgaaaggacagtctgacaagaagagagcacgtgtttgggaatcagatattcatacacttgaattttatttttaccccttactaactaatagctatttaacggccatgagccttaattcccttgtgaagtcaggatggtaatacttgactcatgtgtgcagttataagtaaaaggaaagcaccctctacatgataactttcacatgataggggtatggataaattatgcttgcaatagcatagtcataataatacttttaaattagtgactcacttccaagaatggagtataggaaagtgaaaattgtaaaattataatgaagaaacctggcagaaacctctttaaccaagtttcattctgttttctacttctgtgttagaatgctggagactgtgtaatttatagaaaaaaagaaatatatttcttacagttcaggaggatagggagttcaaggtggaggggctgcctctagggagggctttttactgtgtgatgcagaggctatcacatgatgagagggcaagagcatgccagctcaggtctctctttatcttcttgtaaagccacaagttccaccatggggcctctaccctgatgaccttatctcatcttaattacctcccaaaagccccacctccaaatgctatcaacatatgaatttggagattaaatttcaaacaaatgaaatttagggaacacagaaacacattcacacaatggcaccaagttatcaaggtgaacatcaccagtgataagtcatgtggctctactctacttatgtgggtgtgataggaagggcacttcacctcgttgtttttcccccaaatttatatcctcagtccaatcacaaaaaaacaccagacaaattcaaattcaggaatattctataaaatacttgatcaggaatcttcaaaaagcatgtaggtcatgaaaaacaaggaaagatgggaaactgtcacagatcagaggagacagcaagtaaatgcaacctgggaccctggattagatcttagaacagcaaaaaggatactagtaaaaactgatgaaattcaaataaaatctgtagtttagtaaacggtattgtactcacgttaatttctttgttttaacaaatgtcttatggttatctaagatggtaacatggaaaactgggtgaaaggtatatgggaacttatactatcttgaaaacttttctgaaaatctgaaattattccaaacaaaaagtttgttgttgttgttgttgttgttgttgtttaaactgaaaaggaaaaacatttggtaggtaacagatcagtggttgccaggggttagggtacggggagcataagggagattttaggggtgatgaggctcttctacatcttgcttgtgattatagttatttgaatctataaatgtgttaaaatgaggacaccaaaaatgtcaattttaccatatgccaatttgtttaaaataaaacaaaataaaagaaacaaatgtcaatgggaagcataagtactttttatagtaaataaggcaaaaggggaaaatgttggccgggcacggtggctcatgtctgtaatcccagcaccttgggagactgaggcgggtggatcacctgaggtcaggagttcgagaccagcctggccaacatgttgaaaccgcatccctactaaaaatacaaaaaaaaaaaaaaaaaaaaatagccaggaattgtggtgggtgcctgtaatcccagctactcagaaggctgaggcaggagaatcacttgaacccgggaagcggaggttgcagtgagccgagatctcaccactgcactccagcctgggcaacaatagtgaaactccatctcaaaaaaaaaaaaaaaaaaaaggttgggtgggaaagtttatagacagtgtaaaattgctgccttctttcttacatataacactgtcatcatcaaattgaagaaaccttattaaatatatttattctttcctttaacaaatattcattgaatcctaatggtgtgtcaagtactgtgctaagccttgccagtagacaagaacttgatgtgttctagatgttaaaagaagcccttattccaagataggccagcatatactattaaaaagttattgcatgaagtcagggtgtagacatatcgggggttaaacagacatgaaatatttacatgatatttcaagataatgttggtactctattaaacaaaatgaattatgatgacataagttaagaggagacttaagacagccttggatgtataaagaatttttgtgaaggaggtacagagaacttgcagagttttcttgtctgtaatgtaagactattatatttagaaaaggaacattgaaatttaaacaatgtaatgtttttagttcaaaagtatattaaaatacccaacactaatgagcatttagcataagtaaaacactattgtaaggactttacatatgttaacctacatgattctcgtaagaattttagaagatagatactattatttcccctgttttatagataaagaaactgacaccaagcatgtaatgtgcctaagatcatacagccagtaagtaagaaagccagaatttgagtccaggtatttgactccaaagcacacactccaccatactaaatacatggcatctatagtgatggttatttaactttcccagctggaaatagcattaagtgtttcaaatatccaaggaaccgtgtttttttttttttttttttttttttctgattgaaaatacaactggttataacatttgtttttttctggaagcagatagcctttgccatgccttccagttggcaccttgccccttgctaatatgcatggatgggtgccttttgctttgcagcctgccagtagaacgtgaccttggcagcccggtgtgccagccaagattccagaagagcgaaagtagctcttaacttcttgaagaaactctttgaatcaccaactatgccttgccatatctgtccacatggtactagtcctttcacaaggggctcccaagctaatgactctaattggggctcaactgtctctctaatacattctttccttaattttatgtttttctctggttggaatttcctaatgtctaaaatattccattctgtgttactcagcaacgatcttatttgcttgcaagcattgtggtgacaaacataataattaattatgtggaattttgtttagaaatatttttgttggaacagaaacaggaattctatatctgtacagtgactgaaatacaagggccctctctaaatgaattatgtgtttaaatgttcagattttatagtctatttaatcctgtaaatcttaataataaatttgatggcaagcagactgtgagtggaattttagataacaacatatgttcatagtgattcatgaaaatgtaatcctttatggtaaatctgtattatttataccaaatctttctctctggcctagaccgcttttttaaattccagacttcctacagatatatccatttagatcagggtttttgagatttgatgctgttaacattttggactggccagttctttgttgtggggtgccatccttcccattgcaggatgtttagcagcgtctctggcctctacgccctagatgccagtagcacaacactccactctgtggtgacaatcaaaaatgtcttcagaagttgccataagaccccggggcaataaaatcatctctattcacgaaccactgatctcgatgttctataggcttatgaaaaatgacatatacaaaattaaactcattttccccttagagcttctcctacagaggggttaggagcatatctgaagcaaactctgcctccctgctttgatagctgtggaacttgatcaaattaccaacttctctatacctcaatttcctcatctctaatataaataccttaataaaacctccttcatatgactgttaggaggattgaatgaactaatatgtataaaacatttaaagcagttcctggcacataggatgcctaagttaatatttgaataatcaattaatactattaaatgttagcaatagtcctacagtacaggaaaattctaagatttttctttgtatagaatatgtgcagatacttttttaaaaagattaataagtgacagtaaatacatgcaacaaagctcaacatcattaataatcaagaaaacacaaaataacatcatgatatataaatctattaaatttggaaatatttttaaaaatacttcatattaataagattgtggcaaaaggccctgtactgtactgatgggagaatatgtgtctgttttctttctggaggatcagttaccactatgtatcagagcattaaaatatttatagtctttcacagagttaatctagctctagaaatttatcctaagtgtgtaatatgttaaaaattaatgaagtatattaattactgttatttataatggcaaaattagaagctacctaaaatctcaataacgggaatgaagaaatagctcatggtatatttatgtcatgcaatatgtagatatcacattttacaaataataaattaggagaatgctccgactatggtaattcttagttcaaaatgcctccatcactttcaagataataatagaaatatttaagtgtgcattatcatgcacacataaacatacaccttttaaagttattttttgacagaccctgtgtatttatcgagtcattttttctctctaggtttccttccaaattctctacccacacaccttaagagattctgatacatcataaatagagggacatacatctttacatgaaaacgacatggaagattttctgagggacatgtgaatggtgaatttgcatgatgtggagacccaaaatggctgaggactgctgctcagtgccccagctctgttcactcgcctagagtttcctcaacaagccctgctgcttctgtcttctgagctctgacccaccaagccatttcctctacttggagtgctttccttccctttctgcttttcccttctcaaaaccaagctaaaacattgcctgctctatgaaacttatcctatcaccctgttcagatgcacatgcctttcttctctacttttgtgacaccacatgcagatctgttcatcatattttctggtattcatttgtttaaaaatatgaattgagataccactaaatgccagatgctatattaagtgctaactacagtcttggtgaacaaaaaggtaaaattttcctgctctcgtggggcctgcattcttatggaggagatggaatatattttttaaaacataaaatctaaatttattttgaggtgattttgatcagcacctcaaagaagcaagagggtgaacagcagtaatatctgagggacaagcattctaattatagggaacagcatatttaaaagtcctggactcgttcagtgtattttaggaaaaaaaaaaaaaaaagaaaagtggcttacaaggttgagactagcagaagtgcagcaagaaatgtgaccaggaagacaccaagatgctgtatgataaagtcctgaggccactgtaagatctttggattttaatttaagtgtgtagaataacatgatcttatttacgtagtaaaatactaagaggcaaccttctggctgctctgtaagaagggattgtaggacccaaagtgaaagcaggatggtcagctagaggctgtcatggtgatttagctaattgatgttgctggcttggatctaggtgacaacactggaggtggggagaagttatcagatttgaaggatattttgaaggtagagttgataaagatctcataggtttggtataggttaaagaaagctaagcctcaaggacaactctttaagttttgggcttcaataattggatggattttggtggcactttggtgaatgctgagtgaaggacatgtttaagaatgaaaacatgttaatagattctggctgtattattaggtgtgagatgccaaccaggcatcaatgtggagatgttgaagggacagtgtttaggaaaagggtcagaacagagatatgtatttgggcatcatcctcatatagatagtacttaaagttatgatgctgacatgcctaccagggctgtgagcatagtctgtgaagatacaagttctgaggtctgaactctgggacactccaccatttagggagcagaaagagagtctaacaacaacaacaaagatgagtatgagtggttaatgaattaagagaacaggaggatgtggactattagaaactaaggaaagacagtatttcaggaagggggagctgatcatctaggtcaaatacataaagaatttaccactggatttgcattgtggaggtcattgccaaatggctacctttgtcagagccatgatgctattccttggcaaatgttgacttacttatctgtttcttccaggaaacctgtgaacctcacataggagtgattttgccctccaggaaacctttggcgatatctggagacatttttggttgtcaaaactgagcggtggtggagtgatgctactggcatctaatggatggaggcacaggatgctgctgaacatcctgcaatgcacagagcagctcccccacaacaaaataatgatctggctccaaacgtcaatggttccaaagttgagaaatcctgcactaaacgtatggttcccaaagtgtgtgcttagacaccccagggtggacataggagtgccgtaggacattttaaagtgtgaatggaaacacagtggcatctgtcaagcactaaatgaactactaactcaagatagttcacagtttcaacattagctttctttttttttttttaaataatgtctctttgtaaaacttggttttggaagttgctgtgataagaatcaaatacttggtgaatatcactgtggaataagaagtgagaatggcagtttccaatctgacttcaaggtttgtgaagttgggtagtgaccagaagttgttgagtttttaggacgtaaatagttattaaattgtttggacttgacaactcaagaaactcaattattaggtatatcttttggcctagggggtgtagtaaaaaattatggatatgccacgggcaccataaagcagaaggcttgaaactgctgggcttgactttaagttccttgggaataggcattgtgtattagtactttatatctgcagcacccaaaacagtgcctgctacaagtgtgaggtgcgagaatgccaaacagatatccataaggagattgagggaaatttaataaatttaagaaataaaatggcaggtatgaaatgaatgaaagggcacatgtgcactgtagtgtcaagagaattatatgttaagtggcaaaattcgacctactggttcactatgcactacaacatccctaaatacctccctacttatataggataaaataagagaggggaaaagaataaagcttgactttcttattctttggcctgtgaatctctagactaaaatttcttgagtttggtgcaagtttacttcctcagattacattattttttcccaatacaaatttctattctcacttatattatgcatattgacaaaactgtgatcttattctgcaggaatatgtgaacgggagtaatttgaatatctcctaaatttttggctgcttttcttcctgccccttttgccaagcactacatgccctagcctaatgattgcatagatgttggaaagagatgttctttttagagttagtgattctattttgtttttgaaaaaaatcttttcagtgtaagaatatgatttcagaatataaacttgtggaaatattcttggtatagtggcaagaagtcagcttttagaatgggatatatagtcccatgcatctcactctcactgggtcacatctggatcaaggcataaggtttctttgactcttagatttgtcacctgtaaactcggaatacgaactctccaagttcttatgaggattagactagttagctgatgacaagtacctatcacagtgcttgacacaaggagatactcaataaattatagcttctccttatatttcaacctgacctatcctgacaccttctttctccttctcattctcttagtcttttgtttgactttaacacctaggatgaagcttatagaacttattaccattttaaaataggcaagttgtttgctttgttggtattttgtgttgtatagtgatggggtggtattttccctattaataatgtagtgcatcaacaaatgtaaatatattcatagaaagttctccagcagggacagagttggagaatcgctgagtcaccagtctcccctcacctgagagtgttcacagtgaaacttctctccgttgtgtgttttgtggccttgcttatttgcaatggtctgtcctgaagaatttgagattagagaccccgtggataatcatattccaaggtcaccagtaaaactaaatttctgtaatagttataacttctactaaatatttttgctagagcagctaaaatgcagtctgcctgtgaaatctggctgacttaccttattcagcctataaaagttatgtttactctacagtgtagtcatttaagtatgtaacagcattagcctaaaaactatacatactttaattaaaaattactttattgcttaaaattgctaatgatcatcttcactgagtcacaaccttttttgctggctgagggtcttgcctcaatgtcgatggctgctgaccaatcagggtggtggttgctgaaggatagggtgactctgacactttctttttttttctttgagacggagtctcgctctgttgcccaggctggagtgcagtggcacgatctccgctcactgcaagctctgcctcccgggttcaggccattctcctgcctcagcctcccgagtagctgggactacaggcacctgcaaccccgcccggctaatcttttgtatttttagtggagacggggtttcaccatgttagccaggacagtcttgatctcctgaccttgtgatctgccctcctcggcctcccaaagtgctgggattacaggcgtgagccaccatgcccggccgactgtggcactttcttaaaataagacaacaatgaagttggctgcatcgattgacttttcctttcatgaaagatttatctacagcaagtaatgctgatgtggtttcatagcatttgacctacactagaacttctttcaaaattgaagtcaatgcttctcaaaccctgcttctgctttatcagctaagtttatgtaatattctgaatcctttgtcatcatttccacagtgttcacagcatcttcaccaggagtagattccatttcaagaaaccccttccttccttccttccttccttccttccttccttccttccttccttcctaccctccctccctccctccctccctctctccctctctccctctctccctttctccctccctctctccctccctccatttgcattcacaattttgtggtttggttcaagaggccttgctctccacctgtcttggctgtcaacatgccttcctaactcagcttaatcatttctagctcttgattgaaagagagatgtgcaactctttctctttcacttgaacacttagaggccattgtagggttattaattgccctaatttcaatattcttgtgtctctgtgaatagggagacctgaggagaggcagagagtcagagactgactgctggtcagtgaagtcggaacaccacacacaacatttacagattaagttcgccgtcttatatgggtgtggttcgtggtgctccaaaacaattacactagtaacatcaaagatcactgattacagattaccctaacagatataataataatgaaaaaaaattgaactattgcaagaattacaaaaatttgatagagacataaagtgagcacatgctgctggaaaaatgacactgacacacttgctcaaagccgagttgccacaaaacatcaatttgtaagaggaaaaatatctacaaagcacaataaagcaaagcaaaataaaatgagatatgtctgtagttgtatctggtatgtaattagctcttggatttattgctttaataagtgtatgtgagtctattggtgtaaccttcactatgtaaaaaaagcaacacttttgtaacacatttatgacaaaggactcatatctaaaatgtataaataactcaacactcaacagtaaaataaacaaccagagcaataaggaaatgggcaaaaatattaaaagactgttcactgaggaggatatacaaatatcaagtaagcacacaaaaatgtaataaatatcagtgggtaaatatatatatctctatgataatagctggaattcaaattataatgtcaaatgctagtgaggatgtggataaattggagcgctcatacattggtattgggaatgtaaaatgatactgctattctggaaaatagtttggctgattctttaaagatataaaaaataggccaggtgtggtggctcatgcctgtaatctcagcactttgggaggccaaggcgggaggatcgcgaggtcaagagatcgagactatcctgaccaatatggtgaaaccccatctctactaaaaatacaaaaattagctgggtgtggtggtgcgtgcctgtagtcccagctactcaggaagctgaggcaggagaatcgcttggacctgggaggtgggggttgcagtgagctgagattgcaccactgcactccagcctggtgacagagcaagactctgtctgaaataaataaataaacaaacaaacaaatttaccatataagccagcaattgcacttctggaaatttgtcctacaaaaattaaaacttatgttcgcacagaatattgtgcacagttgttcactgcagctgttttcatttgaaataactcaaaacaataaacattcacagtgtccctcaatagctgaatagttaaacaaactgtgtggtacatccatgccatggaatactgcattgcaataaaaatgaatgtactgttgatacagacaacagcttggatggacctctagggcattatattgaaggaaaaaaagccaatttcaacagtttacatatggtatgcttcaatttattaacattttaaggatgttaacttcctgattttgatattgtactattattatataagatgtaaccattggggaaaactaggtgaagctttcacaggattcctctttgtactacttttgcaactctccaagaatctataattatttcaaaataaaaaggtggttttttttttttggtaaagtcatattttatgcacacgcacacccacacccacacatacacacagtttcttatggggaaatgttattttgaagtaaattgggaatgtaggcatttcatttattctttccaaaatcatttgtttctacttttgcaggattttttttcttcttcctcctctttctctcccttctccctagttcttttttttttgtaggatactgagatagcttacttttcttgcttaggaatgccttcattttttggaaaggcattctttattttttttttaccattttcaactcaattttagttatttaattttcctgtcattataatttggatatataacttctttgagaagtgcagatcatttcatagctatctcattctttataactcaatctttttgttttttaacagattagaacctaaagcagagaaagttagtgatagaaagcatgaagtagagtaacaaaactgaaaacagccagttgccctaccaacctgttctgctctattcttctattttttactgtactatattcgatcccatttttttcgttccattctatgttatgatttcccaacctatatgtattccattcatcctgttctgttccattctatgcaataaatatttaatgagtgtttagtatgtggcaggtgttagtctatgtggcttggcatgtaccagtcaacacaacagataaaaaaattgctgctcttctaaagcttacattacaagaggaggagacagaaacaaaacagacttaattcgtaagtaaattttagaagttagtgagtgctatggaataaagaaagagttaagtaggtgggggatatcaggtgggaatggagggaaagttacaattttcaaacagggtaaggtgtgagaaactgtaaggaattttgccataaattgatctgagcgatgcattttctgatcactaagaatagcaaggccaaaggcactaggatgtgagatgcctggaatgtttaagaaacagcagggagatcagagtggctggagtagagtggtgagaggagagtaggtgcaggtgaggtcagataggaaagaaagatctgactacaaagggcttttgaaggtgttggtttttactctgagcaaaatagtcagccatggcagggctttcagcagaagaccacatgatctcaattatagtttaggaccctagcaatcctgttgagaaagacattggcttattctatactcttagctgtgaaggtagagagaattattattcatattattaacaacaaccacatacatcaaaaaaccctcaggatattttgaagatagagtcaaagggatttcctgatgaatttaatacagattgtgagagaatggaaggggtaaaacatgattccaaggatttgggcatgagcatctggaaggttagtgttgccaacaaccaatatggagaagatggcatatggagcaggtttgagggggaatgtcaggagatctttttttagatatggtaactttgatatatcttttagacatacaagtagacattgcttgtaggcaggtgggtatatgagtctggagttcatgaaagagatccagggcagagatacatatctgagagttgccaacacatagtgatatttatcatgagattagatgaggttaccgaggaagtgactataggtggagaagaagaccaagaactaaaccccggggaaccagagttaagaagtcagggaatagacaaggaaccagaaaatgagacaagaagcaactagtgagatagaaaccctgacaatgtgtgtcctctcagccaaaagaagaataagtatcaaaagcgatccaattactaaactgtgtctcttacctcagtgcaaatgtgtatgatgtgattcaatatcttcctgtatccctaattttatttttattctatttttatactggaaaacaggatcattttttgtttgaaatttagcctgctaagaaaaagtagactttgttgttattgttgcttaagtttcaaacagaatcaacattgtttaaaattgttttaagaactagatttggtgttaacagtttttctgtggtgagtctgaatttccttgagccgttatttacagcagaaggtaaccactacacttattctaggaggctggattgaaatgtattttatgtattattatcttaggaaaaagatattaagcatcttatctttattatgatcacatttgttattatcagcatcttctatagatagtactttttgaggctacatgttattgtggacttgtgcatttttaaaagattaagcatttggcttggaattatcaagtaatcctgtgtagtaactgtgattaaaattatacaggaattcatttcaaactgtgacaaatatattgtagcttacactcttattgaatttgttcatatattttatcaagaatgtcaagtatttttacattaggtttatgtaggtttataggtggaaatataaattattagtaatgcaaattatgatcttgaaaaagtagctagattttcaggttttccttttttttgagcctgcagactatttggaaattaatttgcatttttttggtgtgtatttatattgtcttttgcttatattctgcattacaggattctgagtttccacttaatgagtaggctttacagtacccacaaattactgcaacaaagttaaaaaaaaaagcactagaagcctaatgaaatggactgctgagaacagagctgaataaacacaagcttccctttttgcagtgactgttccaaactaagcagaagctgcttctttatttcagggaaggaaaaataatgacccggttttctttatttttctggtgagcaatttaactgctacctccatttggcatattctcccacttcttttactggaatgggctataactgtaggtatggcattctttgccacaatgtatattttccttactgcagtgtatattttgagccatatttaccaacacagatatttactttttctctgagatgtggtctagaagcaattgttcagagagaaattcaacactgactctagaggtaaacctgtacccggcatttcagtgtgtatgtgtgtttgtagaattatcatcaaagagagaagattattcttccagatggcatttaccttaataaaaactgctaatatgcacaagcttgaaaaccatttctaatccaagtgtactggcagcgtgttattttcaggagtagttgcattaactctttgaaccttttaaaaaaattatcttctacttttgaactaggtcttttgaaagataatagctatcctaagtaagttatcctttgagtactgtgcgtgtgcacctttgtgtgtatttgtgctgtgcgtaaaccattgtgtattttggcatggcccaagtcagcaggaaggctccagggctgaggctgctttcatcctctgatacaccctcacaaccttcctgttttacgataattctgaaacctaacgctcctgctacttttaactcagaactgtgtttatttgcctgtggcctgttttattgtaaaataaaaaccttaagaaccctatgtttttagggtgcttttcccccctcaagaacactgtggttgtcttaaagcctaaatgactgtgttttaatgatgtgtaaagattcagtaaaaaataaatcatggcaattttgttttaagaagaaacttttaaaggcaatacgtgctgcagacttcaaaaagtctaatcaaacaattaagaacaaacagtacttgtgtgaacttatcattttattctgcacttttcataacatattaggtgttaagcttcgaaagattctgctttaattccgggtaactattggtaggggatttaagtcacaattatttaaacataagtttttcacagatcttgaatgtctctgggaattttctccccgaggcaaataatagagggaattaaagctgatttgttttctttgccaattgaaattatgagataggtggctgccactgattttatcttacctacgagcatcctacagccccttatgttctggtaatgcccctgatggtgatgcatagtaaatagtggagtaaattagaagagagttataggtgtgatgggagtaatggataagttaaatgccgtctttatcctcaagggacttacagtctggctcagtatttcttatgaagggagggtgggacactattggcattttaggtagggcagttcttttcttgtatggaaatgttccacacattgtaggaagttaagtttctctggctcctgcctagtaattattagtagcaccgttagttactgtgacagtaaaaaataagtccatatatttatcagatgtcctctagagaaggtattaattctaatccttcttccttagaacagttggaagatctgaaatatacactatatgcataagaagtgattatagaactgtattgtctatattgtcgaaactatgttaaaggaatgatgcataccataaaagcgaagaaaagacaggaaaaaaaaaggctggttagttgcctctgtgtacaccaactggtattacagatcactttttttttttttttttttttttttttgagacggagtctctgtcatcacccaggctggcgtgcagtggcgcgatctcggctcactgcaagctccacctcctgggttcacgccattctcctgcctcagcctccggagtagctgggactacaggcgcccgccaccacgcccggctaattttttgtatttttggtagagacggggtttcaccgtgttagccaggatggtctctatctcctaaccttgtgatccacctgcctcggcctcccaaagtgctgggattacaggcgtgagccaccgcgcccagcccagatcactcttgaagatcatgctgattcttctgctgtgactatcctcttctgtctccctccttcttttttttctgccctggataactcctacttaaccatcaagataaactaaattgttataccttccaagaagccctcatgagctttctctcttcttagactgggtgggatgactatgaacctggttcttacaaatcattgggtgcatctctgtcactgtcttctagaattctattgacatcatctgttaagggtcctttctatcttctcagtagcttctatgtgtatattgcaggcaggaactatatactacatctttcttacctagttaaattctatgtgtgaagtgcatattcaattaactgacctgaacttggcagaaacatataaaattgtgtagttgtatagttgatgaaaacatataaaatgtagtttcattattttttgacatcaaattaaaattctgttcaaaagtctcctttaatataactttgctcatttaaaaaagattcttatgccccactgttggaaatataatttggtacaatgcttttggaaagacatttggcagtaggtatcaagagatttacaagttcatggtatttgattcattaattccatttctgggaacctctcctaaggaaacaattctaattatagaaaaagcctgatactcaaaagtctgcatttcaaaactgttactaacagcaaaaaattccgaagtcttcaagaagtctggggaatgggagcttggttaattattgacaatccaattctaatggataattttgggacaattgtggggaattgtgtgtgaatatgatctggcttttagatgtgatgaaattattctgaaatagatggagattgttgaccccccaaaataatatagctacaatacaatatgactatattacctcattttagtatacacacggagacagacacaaacacacagatgtgtgtatatgaaaaagatccaagaggatatactggatcttagcaatgctaacatctgggtattaggaattggtgttgatattttctgtattttattatttcctaatttctacaatacccatttacagatgtaataataaacgatatttttaaaaaacaaggaatcgaaaataatttaaatgttcattagtaacatatggctaaattaattattgtaggtctgtattctaagttatttcattatattcaaagacaatatgagaaatttttataacatggcaaaatagttgtattgtagtattcagtgaaaagagcaagatgaaaacctttttacataggttggtctacactccaaaagtagatctcacagtgatttttttctacatggtaaaatcttgggattttctttttattttcttgaattatttttctttagtaaatatatctttttaattggaaaaataaatatatcatcaaaaattctgttaaaaatgttcatgcttcaaaagtttcaggttattgttggaggcagttcaaaaatgttatagctgtgaatcatggctgtatttaaatacaggtagcacttcgtgttagaaatatgtgttgggaggggtttatattgtgtgtttatgtaaagatagggtaagatttcacaaacttcttatagacaaaaacagttacaaagatttgtgtcattttagcataaaggtgagttccttaatattactttttattaaatcatttattcattccttcattcaataattatccattgagcaagggcttgggtgcccaagattcagaaataagaaatgtagtaggaaacaacacctaaaattgacttttctctcaccttttgggcaaaaattggaagacagttaaattcttttacgatagcagtatcctatgtgatcaaaaattcaaagcgtctttactatctaaataatgtctattgaattttcagatgttctctcagctctttaattaagttcactaatttctgtctcaatccagtgttgaagtcagcagccaaatgccacatatggaaaaatgttcctctggaagtaaattgaatattttaaaaattactgtcacttatcttaatatttaactcaataaaacttctgtttctcagtgtttccccacacattttcatgtgtctgttaaattgttggtaatgctgcatacataattccttggaaaactaaatggattctctatcatttagaagagttttgggggtaatgtggtaaatcattttttgagttgggtaaataattcttttgagtaattaagtaaatctaatgagtgctgtttaattgcttattggtttattcagtcttttatttgcttcctgtatggcaagttcagaaacctattaatattgctatttattgagagggcttcttaatatcttttaatgagaaaaatacctggtgacagtttattagggaattcagtagattcaagaggaatttttaaatgatctcatttgtattttagctataagttaggagacaaggttctgtgctcagattcccagctactgcaggaattgtatgattgtggttatttttaaagccagaagacgctcttttggagttctgttatttcaacaatctagatctattctccatgtgatattgacttaaaatttaaaaagcagatgtaggtcaaaggagattctgcaaacacttttgctgttttatcctggggctttgacaactttaaagcaatgatgagtttttttttttttttttatatctaaccttaatcctcctggtatactttaaagtcacctctccctaagttttctttattacaaatgtaaataaaaatgggattgttatgtgtgttctttattttagttatgttatctgtttcatctataatatatagagatataaacataatatttcatgaaagatagactttatggagaatacacagaatctgttactagggatttctactagtagtagtagtagaaggggtgagaaaagggaatttttgacctttttttctcttgtatggttaaaatgtcttgccatgaacattgcaaattatatattataaattacttttataatttaaaaatatattttatattgtaaaatattaacaattataatgatattaagtattataaattatttttataatttaaaacaaaaatgaaatattatttatatacaaattgttggtttgtattaggcttttggcatattaggggcttaataaatatttaattgaatttcagcatgtactaacatatatttttctttttacaagtgagcctactacctgctgaacttgaaagaatctagcatttaaaagttctttaacaatataggaaacctagaataaacaagcataaagactttaaacatttttaaaagctgtttaaagaatgttcttatattggttagcctttgggccccaaatacagaaagcatttattttcattttaaaaagggcccccaaacaagacagggctaataaaccagttataggatacagctttttttccatttagaactttatgcaatctgtcatcttctctgatccatcattattaatggttagtcttctcatgttttacatactttattcttagaatcctcagaaaacacactcatttttcctgctactaaaataaataaacattgcaatttattcctaaatatagtgtatttccggttattggtgtttctttcataggccattggtaagtgaaggaactacagagaaataaggggtaagaggaaataaaaatgctatctcaaggtctttgttctgccaaggtcatctaaaagctacacagcagggttcatttcaagactacatttcagggttagctcactaaatgtatccaccatactctacagatggggaaactcaggttgtgcttagcctaacatacttggttctgataatgcttggttctgataatgccaagatgataaatagatttagtccctctattgtaacatttgtattgaatatatgggttttgtaggataccaccagaaaaccaactttaattgctttctcttctacccattcaaactagcactgaaagagaagtctgactcactgaccaccacttgagcacgaacttttctggcaacattcagataattaaaagtcatcaaagcactttagcctcaaatggtctcgattcagtaattatcaatgtaatgacgttttcttcacagtaaaggtttctcagattcactagctcaaccagctgcatggatacacctgaaacagaaaagaatggcatggtcagctttgctgtttgccccagcttttgtgttccatagctgctttgccagcttgttaagagtggtgacattgggaagtgaggggaacaggtaaggcagggaaatgccttccatgttgggtgaggtgacatccctgttttggactgatgattaaagctgcctctttttctggtggatgcttacccagggttcactcatctacagttccctgaactaagtgaagcatcccccgactgacaagttacaacttgttcttcacactttggacattagtctgtacacctccagaatattccttctgaattccaactaggtgtccttcatgggcagattctaagacagcaaagcccaatagtcttgttctccctctctcccggcccagatctgacccacacaatacatacacacaccttcgtcctgctgattaggtgggtcatctttgcccaagtgtgttcaatcaccttcttatccttgatgtttatactttagatttctcaggcttgagtgagaaaccaatcgatcgtatctccaaaacttctggaaacatatcaatctctctaaatgaattctctgaagtcctttttactaatgttaaggtgagggacaagcaagcctgaaccatccctgaggaggagggggtagggacatggaagatactgacaactctctctcaagacattccccatctcttttttccatctctttgaccggttttactgcagcccttttatacgttggagtttaaggagctaaggcccctacactggtgttcagttattcccttttcagcctgcataggtggtctggaatgtgggagtagttgacacctactttcctggggtctcagccaaatgaaaataattatttagtaacagctttgggaatataactttttcacccttttctgtggtctctgagatactttttaatcctcaaatattatattctaaggtcttttaaaaatgtctgtatgttagaagcagtaatgctggctataccacctaaatataagtcttacactaaatgtgagtcaaattgacccaaatcctaaagtcttcctatatttgttttgattactcattcacttgaatagataatacatgacatgatatgaaagctaagataagcaaaagactatataatgaaaagtcttttcttctgttgtaaatcttagtcatgtttctctttccaagaggcaatttttttattatttttaagattcttatttcaaacatttctggagatctcaagattcatgtggagaatataaaaaataattgggctcagactgatctgacataatattaggtatatgttatctgtcagcagagagatattgagcatggaccataactgggctcactcctgctattctacctgtgagttagaaataatactaaagacctctaggagttgtgagaattaactgagaaaaatggatttaaaggaaatagtagtttctgttgtagaatattcactctatacatattaatttcttaaagtcccaacctctttgtgatgtcgtattagtttctgcttactccccaccctcaacactaaccattgtgctaccaacatcccctgtatgcctctgtgacagctgcttggtttcctgcatatactcacttccaaaaccttgttgtgtaaagtgtgcctgttgtgccccgtgctcatctctgacatagcacttcttcactacagtgtagtggaatatgcgtttttctcttcaacttagtgccttgttttgtcactcagcacagtgattggcacctagtaaacagtatgtatttgttggacgagtgagtgcacaaattaagcaccctcattaaaggcctgttctgttttgatagagggaacgtggacagaggtgaagcattttgatgtggggaattgtggggaccatagagctagctcccctggaatcagagagggagcattagcttggtagagagagagaatatgttaaggaaaaggcaaggggcaaagtcagaaggccatgaaggtcagataacacatctggaagtttgcttggacctcaccttgtcccgtgctctcctcctggcattaggaaatgactatcttattaagacactggcgcctttgaaggataccaccgatattcttacatactgtatcagtcagccccagaaagcctttggtgtcaggggataaaaagaaacaacaacaaaaaaatgaatcatttttctctcactttcaagtgattagaatagaagaaatagaaagatccattgccttgattaaaagaagtcagttatttgtggtggcattttaagtggatgctttcgcatgtgcttctccaaaagaagctggtaatagtatgtattgaatttaaatgtaacctgaacggctagagtgagcacactaatatggcattggcaacttcactgagcatactttaaaaattctaaaggaatatgccaattccccagagattatcttcatttctgaatgaagaaatattttgttctgtatattaaccttttgttatgcctagagctcagtatatctaaacaatttaattagattattttaactgctttattgagataacatgaaattcacccatttaaaatgtacaattgagtatattttagtctattcacatggttgtgcaaccatcaccacaatctaacatagaatactttttaccctttaaaagaaaccccagacccattagcatcaattcccattctcttttccatactaccagccataattaatcactaatctatttttttatctctataaatgtgcccattttttggacatttgatataaatgaaacgataccaaatatgtggtcgcttctgactgccttcctttactcagcatggtttcaaggtttacccatattgtagcatgtaactcagtacttgtttttattattgctgaataatactccattgtttcgatataccacattttatttatcagtgaatcagcagatgtgtatttggattgtttcgccttttggctactatgaagaatactgctaagagcattcatgtacaagttttcgtgtggatgtctttttgtttgcatatatctagcagtggagttttgctggctcgtaagtacttgccaacacttcttataatacatctttttgattatagccattctagtgcatgtgaagtggtatcttatttcagttttgatttgcattgccctgaagactaaaaatgttgagtgattttcaaggacttattggctatttgtatatcttctctggagaaatgtcttttcaagttctttgtctgttttttaattgggtcatttttattttgattattgagtcgtaagattttattttatacactctgagtattaaagatatatagtttgcaataattttcttccattctgtggattgatggtattattttcagcaacaattttaattttgatgtagtccaatttatgtgtttttctcttattgcttctgcttctgattttgttacctaataaaccatagcttaatccaaagtcacaaagatttactcacgtattttcttgtagttttaactcttaacattttaatacgtgatccattttgaggttttctgtgtgtatgtgattagttgtcccagcaccatttgttgaaaaactgttattttccccattgaaataacattcttgtctaaaattgattaaccataaatgtaatggtttctttctggattctaatttctataccattcatctgtacatctgtccttctgccagtacttctttgttgtattattataactttgtaataagttttgagattggaaagtgtgagtcctctatattgttcttccattctaaggttattttagctatactgggtctcttccatttccatattaactttaagattagtatgtcaattgccaggaaaaaagatggaattttggtagggatttcatggaatttgtggatgaatttgggtcatattgctatcttaataatattaaatatttaacctatgaaaatgaaatgtttttcattcgtttagatctcctttaatttccttccatacagtgttgtaatttcgatgtacaaggtttgcacttttgttaaatttatgcccaacaattttgttcttcttgatgtaggtcatgttttattgattagttatttattttggttgtatttactgatcaaattttccaagatttcataaatatattatgatatattttgacagaaaacttttgtgatggctaagaaaggtttattccatttatgtgctcccatttttgctctcaaatgatgttgcccactgactttaaaattaatttcaaaaagttcaatgtggccgtaatagtgctattataatctcagtatatcagtgatttttaaaaacggatttctacttgttttatacaattggtcttcaaatcctgctattataccttgaaaatgtctctcaaagtcatctttttttttccatcctgtgttaagcatttgaaatataaaatatataagcctcctccaaaaatatataagctccagttattcaatggttatgtttttgttatcttcttttgttgttattgttagcttattttagttatttccccattttccatcccctaatatcttttactcagaaaattttcttataacccctacaggcagaattaatttttcctgtttctgtgattacacaatgtatttaaggtgtttagcacaatattcgttatagagaatagtctcaaaacatggcacctgtcaccatctctagttatctattcaaatcatcagtatttgcccatatcatactctatatctttggtatgttttcttgccatcaattccctcagaaccacccaaccccccccatgaacttagattatttttttttattatactttaagttctagggtacatgtgcacaacatgcaggtttgttacataggtatacatgtaccatgttgatttgctgcttttttttttttttttgagacggattcttgctgtgtctccaggctggagtgcaatgccacaatcttggctgactgcaaccctgctgtcctaggttcaagcaattctcctgccttagcctccaaaatagctgggactacaggtgtgtgccaccacgcccagctaattgtttgtatttttagtagagacaggatttcaccatgttggccaggatggtctcgagctcctgacctcatgatccgcccgccccggcctcccaaagtgctgggattacaggtgtgagccaccgcactcggccagattgtaaattttttgacaacaatgactattctcctcatctttctatgttcaaggcctgcatagtttagaaacaaggaaacagtacagttgcaaccatacaattgaaaaaaaaaaattgtccatggctataaattaattaatctgtcctgattttatgtctgtcaaattataggtagtactaacccagtaagagctttattgataaataaatgagaaattacagttttatcaagtgtgaggtaatccctttttttggggcttgcttatttctattaagcttccaagtattttttaaaagacaatttgtattcctggctttattttacagtttggttttatctattctatttgcatactgagaggaagctggtatatagcagtctaagctaaatgaaaaataagtgcgcaattctaatattcaaaaacaggatagaagatgtccatttttatttttttattctaaataggaataatatgcactataatgtttatatttcttccaagtatcttgtaccacatgcttatgattgacattgggcctctatacctattccttttcgttaagagactacttttgtattaacattttaccattagattttattgaaacactattcaaagtcctcaaaatttcaattttatacctttttatttttctgtaagatgaagcaatgtctttagaatgttattttaagctcatctttgggcttccactgtttcctctacttgcccttattttaaactggaaaatccatgaatgtaatgaccacatcttaggctctttcatatttcaaatgcctaagccagcatcaaataaatgtattttatttatttatttatttatttatttatttatttatttatttatttattattttgaggcggagtttcactcttgttgcccaggctggagtgcagtggcacaatttggctcaccgcaacctctgcctcccgggttcaagggattctcctgccttggccttccgagtagcttggattacagccatgcgccaccacacccagctaattttgtatttttagtacagacggggtttctccacgttggtcaggctgatctcaaactgccaacctcaggtggtccgcccgcctcagcctcccaaagtgttgggattacaggcgtgagccactgtgctcagccaaataaatgtattttttaaaaaatatcccatggtttgtttatcatataatgtaaaatcaagaatccaaatatttttcaaagggtagagaatttctgtgagtaattttttcctcagcatcttaatatccaaactctacttgctcacaagattacttaatcagcatcatatcagagacagcttgctgtgtttaccattgttagttgggccagcatatgtccaaaacagttggaatgagaaaaacagccttgacttgaagccaaattagagagggaggaggagaagagttctttagctgttgaacaggactacatattttggacagtgtagggtacttctgtagaaaaaaagaaaaaaaagggtggggaattctttcagccaaaaaacaaaggtgcattttgaaatatctaaatgcactgaaataataaaagcaaattggtgatgttgttttaattttatttatataagcctttgcaagtaatgaaatctttttatgttaaccaaaaaaagaaagaaagaaagaaaagtattctaagatatttataatgtggataatttttttttttttcagttttaccctggcaactttaattggcttagtggtttctaattctgggcaattttctgtttctttattaagcaatgtgggagctgttgaataaccatcacatttcataggatcagaataatatttctgatttttctcaaactgggtattatattactgtatagtaaaaactttttaagtgaggaaaatgtctattcttgttttgctaagtaacattacaaaaagtagatatttttgtgcattccacccccttaagaagcaactattgtagaaagtggtgttttcattgagagagaaaatggaaagtaatattttgctatttattatggaaagttagaggagaggtttccaaataccacaatcaaggaataaaacaattttgaccacaactgaattttatatatcaggcaaagcctgtcctagggtagtttttaattagataaagctttcttcagagttcctgctttcaattctctatcatttcttatctggtagggatcccgcttgcttcctagtacctctccctttctttacatcagaatctattatgtatggtggttattgatttacccaaagaagtcaatgaaggccaacagcagttgccttttgcatgagatatactttctgataaagactaaaaaagtaaatcacacacacatacacacaatttttaggtggggagggaatagctttggcagtagaggaagccttgggaatcactgttttacctccctggttttatttgttttatacatgagaaacccaggatccatagacgtggactaatcaagactagaactggagacgcagtgttctttctgccaaattctgtttctttacattgacaaggtattgggcattagcaagcaattgagagtagactgatagagatgttaatttattcattacttgttctttaaaacaactgtatcccatgcttgtgagaatcaagcaagatgacaaaggtttgttaccaacgagtttggtaaagcattttcagaggagtgtagtggatgtagtaggtttgtactctaggacctggaggtgagagaagacagaggaaggatgtaccataccgtatgttcagaatcaaaccttccctcaggtcctgaggttatcaggtcaagtgtgtcgcaaggcctagcttcctctttgctaaagatgagtttttcttaggtggtgccttagtcattcatgcaaatagacatctgcagtgccagccccacctgctctccagacatgcccagtagtttttgaaccttggctttgagtatgtcctgcagcatgccaaatttatctcgaggggaataagcccaagtgaaccgcctacgtaaatctaaccaagacaggcctgatgtggcgggttgaatttctatgttgaactaaggaatcgcatggggttctatggctatacttctcccccctaactgggcaaggcgaggaaacctgaataacaacccctatacaagagcatttaccttagcatagagacaaattgcactgtttgttgttctctcatttcttttgtttaaccatgataatacttacctttttagcttcaagatttataaattccaagcaattcatttaaagcatttttttaaaagcttgaacttaaaattttgtataatgtgttctctagctactgaatattctactggtctaatctaagttatattataaattttgtggaaaataagcagaagccatttgattcagaatgcctttgctaagctctatgattagcaatgtatttcctatgattttgggttatataaatttaaatttgcattaatatctggaacaacatttgggtaaatatttttcccatagtttttaaacaatacctaactaccagaactatcttgcatgaagcacaaaatttctgtagtggtttgactacagatctattactagggtgatagccaaacttgtagtattattattgcagctttgaggtgtataagatgtttctttaaaacctcaaggttttaaaacattcagaataaactatatcaacccacacattaacaaacatttaaatgtcaaataagcagaatatcctttaatttctaaccatccctttgcaaaacccattccaatgttggtttctataaaatatactggggccttgttagtttatacatacaggatatatgtatatgtatatatatatatatatatatatatatgtaagcttagaattatgtagcaactgctgcacagattggaacagtctatgtatgtctttcgctataatttattaaaagaaatttcaattcaataagtatttgttctatttgtagcttattgaagggtatacaatctctgtctcatggaaaaagagataatttaggagaacactcctgaatcttttactatggaatattatacaggatctttcattaggaccattctaaattaatatttaccatattattaaatatgcaagataaaaaacactgaaaaataatattgtatatgtgacaatggcaaagctaactgtaacctgtctagtgctcattattctcgtctgtgaaatggggataatagtaaagctgtgtattcaaagagaaagtccatccaaaagtcatagctagcgctcagcatatgttgctcattttaaagtgccatcattcttatttatatttttgttttccagttgactgcgtattgtgaagagcaagcaacaaagtctaaaattagtatatcaatctagtgaaaatacttagaacttgttttatatggtgttctcctgtcatgttctatttcctaattatgttttattttagatgaaatacactatgataatttttaacctaattcattcaaccattatagcagagaggtagcttggaaatttgtttgtcacagggacatcccaccatgtgagaataaaaattgggccgggcgcagtggctcacacctgtaatcccagaactttgggaggccgaggcgggtggatcacctgaggttgggagttcgagaccagcctgaccaatatagagaaacctcctctctactaaaaatacaaaattagctgggcgtggtggcacatacctgtaataccagctactcaggaggctgaggcaggagaatcgcttgaacccgggaggcgaaagttgcaatgagccgagatcacgccattgcactccagcctgggcaacaagagcaaaattctgtctcaaaaaaataaataaataaataaaataaaataaaatttggctatagattgattctcaggagttcgcaaactttctgttaggggcagataataaatatttgagattttgcagcctgtactatctctgtggcattcaattctgactttttagtgcaaaagcagctatacacagtaagtcaatgaatgagagtggctgtgttccaattaattttatttgtaaacactgaaatttgaatttcatatatttttatgtcacaaaatattttcctttaaaaaattgttttcccaaccattaaaaatgtaacaatcattcttaggttgcaggccataaaaaattaggcaggctggatttgacccatgagccacagtttcctaactcctgttctgcatagttaccttcattataaatattttcaataatttcttatacttttgattgtacaaagaggtatggcttcaaattacagactgatatctcagagctgtgcttaaagtattgagaagcattctgtaatgctgatggttttctcaatattggctaattctataaacagatactatgagttctgccagaaatagaaattctaatgacagtctaattaaatagaagccatggagaagaattattacattttcttatgccaaattataaatgtcttcaattaatgcacagatatttatttatttatgtatatgtaaaaagtggattttctgacagcctcaggctcctctttgtggtagaaccttctgtttctctaattagttgtgccttaatggccagtaattgtcttttataatgcacagggaacctaaaaaaaaactgaaggaaaaaaaatagaccatcacagtctatcttttcaaatcttttctcatgctgtcaaaaaacagctgcctcttactttttgttactactttcttcaattaaaaagtaatctcaaaatttatgaataatacacccaaacctcattaacactgtttacagttaattatgatttagtatctctctctgtctgatataacccaatgggatttagttaatcaagtaccgaagatgacttcattaccaggcagtctttacctgtgaatcagtagattcacagattggagagtacagccatagtgaatttaagaaaaacaaaaacaaaaacaaaaaaaaatgctaattgcctagactcaatagaattttgtatagctaaaagaaaagggtgaaatattaaatttggaattcttaagtacagaattgttccttaaaaagagtgctgaaatacacactttaagaaagatgctttagacttacctgaaaatacacaagtgtgtcaaaatatgaagaaatatattcaattacacatatctctgtggaatatattgacaattatgaacaaatgtttttcttcacctttaaaaacaaaaatatgtaatattattttaacaaaaacttttcagtctcatctgtatcaaggcatactccagaatgaaatgtgtagaaataaaatgaaatgcctattttgtagaagtcaaatagaatcagaatggagtggttgagatcatggactctggagctggacggtgtgtgttctaattcctgttgtacctgttagtgggtgtgtgaccttggccaagctcctctgtggcctccattttcctcatttgtaagtaagaatcccaagcacgtctactccataggttactagatattgcaacctcataatgttgtaaagaacaaatgaatgaatatttactttataaagcattcagaacgatgtttgttatacagtaagtgctgtaattagtgttggttccataatttaaattagaataagagaaactcgggagactggccaaaattatgctgttactctttgtgcttacccatgtttgtaaagccaaacttggaatcagtacatttagggaagtcacattttattagaatgcttaggacctcaaaactcacctattttaaaactcacatatccaaagtgcttcctgacaaaggatactggatatttctctttaggagcaaaagtggtgccaccatgtggcaataacataaatatagctgccaatccatttagcttggcaaggcttatatgagcacattacatgaatttttaaaatgttttaacgttcaatttttttctaaattgtatgtacaaagtataactttattatttttaattcagcattttaaaattcccataatttcagttctcataaaacaagagtggcattttctttgaaaaaacagtaatgtaatttgcctgtgatttgaatttggcaaaataaacaaataatgcccttataacactgattttcaaactgagttccatggagcctgcattccctgggggaaaggaatagcggaggaagtgagtggatagaaccttggttcctcctctccgtcttttctaaaacatttccacttttgctggttttatatgttggaactgttcgtaagattttatttgaagaaaataagaaaatatccagccgtttaaagaaatgtttttcttttctaaaagccagtgcagtcctatattaggagtttcagtggggctttaaaactttattttattttttattttttatttttttttttggtaataaagatttactcagaactagaaaacagctaaattctggagaagaggtaagatgcattggttgaaaccctattcctgttatgcaggactgaaaagattagagcagagaaaaggcaaagacatggtctgaatcgcagaagaaaagaaggaaggtatatcacacatggcatttcagctttgtttctcctacttttcccgcatattttcatgtatgttgttgtcttaaacatattaagcattgaggctttcagaaaatattcaactgttttgtgctggctaaaggtaattgtttcctggtggcaggaggcatgaaccaatgaaacttttttttttttttctgtcaaaatagcacataatgatgtactttttgtaagcaagaattcctgatagaagagtgggaacacatttttgaaaaagtttatttgctgagtaatatgtttagaaagaatgttgttagagaaggatatttgctaagaaaaatcatttattcaactaatatttattaaacttacagtataagctacataatatactaggttccggagttataagggaatcccttgcctcaaatattagggtttcataatgagagggaagttttgttagtcatttgaaatagctatttgaaatagtcaaatttgaaatttgactattttgtcatattcataaatatgtcatattcacaaatatgactatttgtcatattcaaatatgacaaatagctatttcaaatgactaacaaaacttccctctcattatgaaaccctatatttgaggcagaggatttccttataactccaagtatttgtctgtgacctagaagaatatataagttgtagaaaaaaatacgggaaaggggacggtttgcaccatcttcctcgtagttcctttagaagtgaatttactttagatcccagaggaagagtattagatctggccacagaagtaactcttttatattattacctatattttctattttaaaacattaaaattttgaatcttctcaagatttcatttttaggtacatttatatcaaattgaattttaatctcaaattacaaaataatatggattacaaactaatatataggttcttagcttctattaccttggagtcccataaattggcttgattttgtttccgtagtgcaaggagctgaataaagcttttactcagttcttaaatagtaaagaactagcaaacattgcgatactttagaactaagtggccattacagattagttagcagttcatgtttgtgttatggtttgttatgactgcttaattcaaaagcatatttgcagacagggagtttggattaagtaaatcaaaatagtaaaggctttgattaagaagttagcttgctttaacttaaatgttgatatttcaaggcctactgatattttagtcatttgcggttatttttgtttcctgttcagacccctgggaaataagagaatagtaaatcaaagcccaggttgctttttgcatttttttccttttcatttatgccatgtagtagttgactttaagaaactaaagacatggataacttgaacagaatcactgtgagggagaattgtatttctggattaatcaatttaaataattcttgttataaaatgattcttttcatgtttgataatttagtaattctttttattccacgataatgttatcgtaactagtggaaaagcagctaaaaatatctgcattactaaagtccaatttgggcagtattgttatcaaactgaggctatgttgtttgtgtctagggatcgctagggcgttgcttcatcagccagaaacctctgtgacaggtggtgccttctgcctgagtattgctagtgcccgtttctttccacccactcggctcaacaggctgcactcggctcgtgctgccagcccagaacccacacctgccaagtacgagcaaggcgtggagcggtgaggggtgtgtgtgtgattgagtgcagggtctagccactgcacacagctgggcacactggctgctgtggtggggcaggcagctccaggcaacaacacaggtgccagctccatgtgaggaggctgaggctggagcacatgtactgcacgcggcttctgctatgggcatccgtgtctggatgaggggaacatggtggcacccagaagcttggagatgcctggaaccactgaaccccaaagagagtgtcacagccccctggctcagggagcccctgggcctgggctccccaaagggccacagctcttctccccttctcatcgcccacaacatggcaagcgggagggtgtgtttcagccctgttcgtgttaacagctcttttagtcccaccatttgatgtgtcccgagttcttgtttcatacccaggaagaatgaggtatgcggacagctggaggctgagcaaagcgaagaggagcttcactgattggcagaacagttctcaagagacccaaagtgggcagctcctttctgcaagcaggtcatcctgacgagtgtccagctctcagtggagaggagacccacagtggttagctcctttctccaggcaggtcatcccaacacgtgtccagctttcagtggagaggagacccacagtgggtagctccttcccccagtcagtagtccagacatctgtgcagccctcagtggagaggtgacctagaacgggtagcttctatcggcaagcaggtcgtcccatcctctgcctcagtctggctgagtccagggtcgttatgcgcttcagaggaggggaagtatgtgctaattggtccatggacggccatgggtgggcctggataaagcaccataagttctcactctggtccacggaactgacagcctggcccccaggattttggctgtccctggcttgaaggtggggcttcaccaggtaccctcccctttctgcccaggagcttgtctgcctcctgccgccatcagtcatgttgttcacggttcccaggctgttgccgaagggcgcctgcaggcccctgttgagctgccctcaatctcccactcatgctctttggtgcccaagtccaaaggaggccaagacgacagggggctggcgtgtcagtgctgccctgagcatgcacatacccagccgggttgcgacagtgcctgggcttggcctgaactttgcttcaaaatcagagcgagtgctgggagcatggagaggccaggcagcgacagcaggcacttccaagcctgtggggagcagaggacctaccaggtccccgactgtgcgcagggatgcctgggtccatagctgcagctgcaccccggagggtggggcttctgcccctcaactcgaaagcgggtgaggctcccgcctgttcccagctcctgcgggctccatggagtgggcagcccccgcccccactgcagctggtgtcatggcagcagcccttctggacaggccagccactgccatcacatgttttcccattttctatttttggtgatagcaaattcaaacttcttaatttacttttcctgaaaaaagttgcctttcaagactacacattttaatgaagagccttcagtaataagcatttcagcatgtctcaaaaaagattcaactgttggttattttagctaaaatgtcaaggaattttgattaactttaaaaggatttaccttttatatttacatttattaatttaatttttatctttaaaatggaagatttgaaaaaaaatcttagcttagcttgcagcttaccagttctggtgtaattttcagtaatataacatggagtattcaatcatgaattagccattattatttaaataattcacggtgtgacctatactgggttatccctactgaagcaaacagcatgaatgggtaagttttattttcctcagtgttcacttactccatgttgtcacgtgtcagcacattgaattttaagagatacagtggagtctaggaaatgcaaaatgacaccttgggtggaaaaacttttcagattgttttcaaatacttacgcagtgttgccagaaatgtgttaacttagaaatttaactagtaaaacagcatatatttgtaattcaaacagtcaaaaagcccagtaagtaattgctttaggattttaatcgggtatgtgtgtatgtgaacatatacatgcagatgtgcacatgtgttactaattttattcccataatcttgtgactattattcattcattcattcattcacaccacacatgcactgaggccttactatgttttcatgttgtactaagcactgaaaacatagtctctgccctcatgaaatttggaatagtggtaaagatagacaaatgaatgttatgaaaagaactgagaaatttaatgggaaaattaaataaaactcagaaaaacatctatattaaatcatgttttagctaagatatgaaggataggactaatctagagaaatgtgttggtattgggggaaaggttttaggaagagagaacacatatggaaaatctctgagaccctggagtgcataacatgtttaaggaactgaaaaatcagtgtggcttgagtgagtggaggacaggtattattgaggctggaaatatacagagaaagcacactatggagaaacaggccagccatgttagagacggaggctccactgatgagtgttagccaggaacgtaacagaagtgctttaataaaacaggcagcagtggcagagagaccttgatggcttcaaaaactatttaggagtaggggccagtcgggctgactcatccctgtaatcccagcactttgggaggcagaggtgggaggatcacttgaggtcaggagttcaaaaccagcttggcaaatgtagtaaaaccccatctccactaaaaatacaaaaattagccaggcatgctggtgcacacctgtagtcccagctactcgggaggctgatgcaggagaatgacttaaacccggcaggcagaggttgcagtgagccgagatcgcgccactgcactccagctgtcagagtgagacttcatgtcaaaaaaaaaaaaaaaaatcaggagtaggaaagataatttctatcaattagataataaaagagagaggagtcactatcacttctctgtttctcttgtgtctgcaatgataaaaaaaaatacagggatactggagaaaagaacagtaagagacagctaaagagaatcccagtagtacctgtacatatgagttgcacatttggtggaatagatgtttaagctggagatagaattgtcaacatagaggaagcaaagccctaggaatggaagggatctgcagtgagagagaaaaagagagagagagagagactcttttccattagtttcccattccatgacatacttccaccagacataaactgttccttcatgcctttattctactttaaatcatttgatgtcagtatgtcaattagcattcacagaataagataagggaaactttttttagtctcatttacatctcacaactaaataggccagattttgtaagggaataaactcagaggctgctgaggggttgaataacttgtctctctgacagtggtggccatggcttctgccacactgcttgttttgtgaaacaaccaagtctcctgcctacctttctgacctttcattccacctgtgccttgtagagtccaatcacaagtcatttgcagtttcctttttcttttcctgttcctgtgtacatgctcttctgctctgagttcacgtctctgtgtttttggtggcatagggagggttaggcaaacatgctttctttgtgaagccttttctgactcgacctgaaataatcagtggtttctctttttcaaaatttctctgtaacaaataacataggacattatttttcagttggatgcctgtctcatgcctttctcctattctcagaacctgattaccttgccctaccctgcccaaccccattttatatgtactttatgtgagctttggcaagcagggaccacattatactttttatttttatttccattgtatttagcagagtaatagcatatgctcaaaaaatgtttgttgaattaagttgataaagaaggaagacatgggcaagaaacatagtgtaaaaggcaggaaggaaactatgtgttaagagacagtggtttagccccccaaaaaggtagcaagagataagtctagagaggtgtcggtgaaactcgtctgtggtaaaatttgttggggcaaacagtatttatgaaacccaatccataatacataacatggatagaaagaatgagactgaaaaaaaggacttgttaaaaaaaatttaaaaaccttggcagctgtcccctctccccaaaacacacacatcctccccactcacgcccccacttctgcctccacctccatctctatctccatccccaccagcttagcttgacttttgggagctagaatcccaaagatccctttcccagagtgctctgctccagacctagcagctgcagggaactgtgggtattttatgattttggagccagagaaacaagatggtgagtgacctccacaaactgagggaaaatgtttgggctttggctgggcttcttctgagcagtagtgcagccctaattcattcttctcttttccacacaatgacatcgaaggtgttttggcctgctattcgtaacgaccccttcacacatgttagcctgcggaaagaagctctactgagcagaggcgatcagctttccccaggtggattttgggccatgttacccaaagaaaacttctgttttctgttttgtgtcactcttctcagtagctttgctctgtaggccagccctggaggccccttctctgcagagggttagaggcctgtccccagtccctcatcatcatatttcaggatggctggaagcagtggttccaaggccaaattcatcatcagtgggaaatacaaactggtatggaagatcacatctggcttttttggggacatttatcaggcaaagaacataaccaatagtaaagaagtggcgctagcatccttgaattctggaaagctaggtatttctcattgcagtcccagagaaaactttttagattcttcagggcgggttagtatttcaacatgagatggtatgattagagcaaagactgcaatgtgctactcttggatcttcagccctcaagacctcttcattttcttttggagaaggctcccagtgaaaaccgtagttaggttagcagaccagatgactggtagaattgcatatgtgcatgcaaagaatttgagtcacagtttaaaccagataacttcctaatcagtattgagtattgctataggaagttattccttattgattttgatttgctgaaaaagtacagaaacaataggataaggcagcacatatcatagaggagatagtaatctctagcaccacttgctaagttagcatcagtgcacatcttggtattgatcagagttttagagatgacatgttatcatcatgatacatgtaaatgtaatttaatagaaccagcctgccatggcaaagattaaagtctgcaacaaagaacagaaaaatgaaaatgttaatgagagaatgataaaatgaaaaggagttgatggaaggtatctactcctgttgaaattttgtataaggggttttctgcagaatttgcagtaaactattgttatggatcacacattaaggaagccttgagacagctattccacaatattttctggaccctgaactgctgatattaaatacatatttggttgaatattgttaaagcagaaaacagtacagaaggcagcctcttcccatggagttagcatgcccaaactctcacaggtttccatgcatgaagggaggaacagaagaagcagaatagataatcagagtaacatttgtatatcgccaaatccagaatttttagttcatatgtcgcattgccagtgttgtgaacaaccatttcccaggtaaaaataacgtaggaataaaatggctctgggcagcattgctgatataaccaagttgtggcctctgtaattatgtatattaactgaagttgttaaacatgctttcaatttttatagcacctttttcagtggaaaacttaactaaataattggcatataccaatttgtgttgagagtttttccatgcctgtgtgtgtgtgtgtgtatgtgtgtgtgtgaaaacctattattttgaactctactgctttgagaagggccatatggttgtatatgcacaaaattgcgcattcttaaagttttttcatacgtaaggcttgcaagttgtttacttaaaacattaaaatggttggcatcttgcttaaggcagctgataaagtagcaacgaaagagtccggtttttgaacatatgaaaattctgtttgttatactatgaatagcagcatctaaagtgaagaagtaagaaatactctgtggtaactagattatccttagtactctgaatgaactctttaacgacccttgaattaaaaaatatttgttacagaaattgaaagctaaacgtgaatgttcatgttcatgctcaaataaatgtaattattatgaacacctacatgatttgggattttggttttattttgaaatgagagctctttcatttacaagttcactaaaaactcaaatgtttcttgaaaatcacaggagcttatgaacattaaaaagaaggaataactattgaacaaataagacagacactgtcaagaacgggcaggactttgcaaggtgataattaagactagttaatatttatgtggaaaagttctgactgggcatttggaacataataatatgaacaatataatataataaatatagcatacatttgcatttatttgcaacctcagacaagcaagatgagtccaaataaagctagcttcatcgtagtcctttcttacatgtgtcacaaggtcttgagatcagtttaaaaaacatgttttatttacaactaatgtgaatactaatatttgctgtcatcagattccttcgaaaataacatatgcatcactggccacctgttctaagtaatttttgaggaatttgcatgttcccagacaaggaatgttgtgaacagagatgattctatttatccactgttaaaaatggcagttaatttttccttgtaagttgatttctaattatgataatatggcagctatggacaatgccctttcttaaacatactgggatgtaaaagtgaccataacttgttgaaactcagtcctggtattgtgttactattatttctcctggggaggcttattagcctgtcacaaaagatgtaagaaaaatccaacattccttttggaatatgatgagcctttgtcacccacaatgcaattaatgttaaaaatagaaagaatggctatgatatgattatgattaggcagagatgagctattgtccaagtaacaggaactaatctagcaggccaaagatgacctacacagaaccatcagtgtgctgattgccatttctctctgagtttgatgaaatattcatgcctttgctctcctctctgcaagcactattgatttcttgtataaacgctgctatatttagtctagacaaatggaatgtggattgctgctgaataaattggatgaaagactgggatcttgcctgccactttctctcagtcttgggcaattatttataatcaagagcagtttttgtaagttgagggtgatttttcacaatttagtgattagtctctgaacaaaggcaagcagttagacgcaatcatttctgttgggatagcaggttaagaagtcaaattaccctttgaggtttacaataactgtttcagagacttgtaggactttttttcttatctttttaaaaaagcttttttagaggtttgatgtttgtagttcatggataacaagaatgccagcaagaagagactccagggtctcttgaatttttacattttgtctttatagggttaagttctgacctttgttttttgagatttccatgtaaaagctgaaggctatagcttggcctttttaatgtaaaaatgaaatatatcattaactgccattgcttttggttggaattatgccaagtcttttagttaatattcaaaatctcatgttactccagagccttgactaaaagttctacattgggtgctacaattaagagatcttacaggccatcattctaatttgcatctgaacttgtcatgattaatttctttcctttcacaaatatcatctttgagaagtcaatgtccaccaaactatagttcatttataaattattttcccattttcattaaagtgacacataaagtaccatcaatgcaaacttctggtcaatccatggcaaaataaccaatgtaagcaacccaagattgatatcagtctgcatgcacaggcacaggcacatgcacatggacattcaactcagatgaccagcaaggacatttaagtatatgaagccttaacatctgtagacaggatttctgttagcctttttttactcactgaaaataactcttaaattcacatggaaaattaactttgtagttcccaaactggaatctgcaaatttaagttagttacttatagtaatagagcattagatgcaatttggaaaaatacagaaaagtaaagggagaatcattcatatttccgtctaaaatacagccatcttctgttctctacatcaccagtcattgctattagaatttaaaaactaatatgatttaaaaaccgtggtagaatatgtgctcgataagggctggaatttttgtctttctttaaaataccaaaccccaacatctagaatgaagcctgggactttaagaggcttgataaatctattttgactacattgcttatatatatatatattttttaaatggttatcatagtgtaaatatcacttttttcacttaatgtgacaacttttttaatgttcccacaaacattatttttaatgaatgcgtagcttttctaccaaatggatgcgacatattttgctgagacatttccttgtagttggtgatttcaataacaatactagaactctagtaaataatacgacattgaactgtttttttccctattcagtattgtctcctggagatataatcctagagttggcaaacctgaatcaaatggtagaaatatgtaacacttcttgatacgtattaccaaattggttttgcataagttttgtaccaattgacagctccacttgccataaataatcgtctctttggtcatacgcttagcctatacaatggggcattgtacacatatatgtatacacgtgggtcatatatatgataataatcaatgatgctctattttgattcataatttgcaattctttactagtgaaggtgattttcagttgttgcattcttttatttgttttgatctagatgttttagtatttttattttctaatgtttagtagaaattgtgtgccattttatttttatatttgtttctaatatgtttgttttgttagctacttactattgatggtttattttaatatataagaaatttccatttcatataataaaaaagcaaaaacaaacatctgttaagggctgtgctacatgctattagtacttactgttactatctccaagttacggatgagggaacagaggcctagggaaattaataacatcttcaatgttacacacatgaaagagtcaaataagcatttagattatagaacagaatttgaaaactggtacatgtaaagactgaagcattttgtttggttcctggagtatttaaagcttttgaagagcctggtgctgtgactcatgcctataatctcagaacttgggagctcaggcaggaggatcacttgaggtcaggaattcaagaccagccttcgcgacatagcaagataataccccagctcccactgccctgaccccagctataaaaaaaaaaaaaagaaagaaaaatttagctggtcatggtgatatgcacctaaagtcccagatacttgggaggctgaggcagaaggatcccttgagccaggaagttctagactgcagtgagctatgattgcaccactgcactacagcctggacgaaaaagtgagccctccagcagcctaaaaaatctttcagtttaattttcagttaacagttatttctgtctacactggatctgtattttctttttctcccacaactcccacaaatagttggttttatctgagtagtgactggcctcttttgaaaagccatgcaatccagtttgccacagtttcccctccaaaattcctgttgtctttagcttaaccttttacactgaactacagaattttcccgattcttgtgggtaagggtcatactcaaaatatttaacaaccagtttggcatggatgctggtcattcaaaatgtcagaatggacaccaacaataaataaatggtacacctggatatcctgtctgtgagttttcctgcttaaactattcctttagaaagcagcattcttttttttttttttttttttgagacagtctcgctctgtcacccaggctggagtgcagtagcgagatctcggctcactgcaagctccgcctcccaggttcacgccattctcctgcctcagctgggactacaggcacccgccaccacacccggctaattttttgtatttttagtagagaaggggtttcaccgtgttggccaggatggtctcgatctcctgacctcgtgatctgcctgccttggcctcccaaagtgctgtgattacaggcgtgagccaccgcgccgggccctgaaagcagcattcttatctactaagagtttttgctaagaattttatatctattatctaatttaatttgtataaatttaaatattatcatctgtagttattctcagatcatcaaatcttttttactccagtggtttgattaaatacttgttttaagtttcctcatactttttccaccttgtttattttaggaatgaggtagctgagatacagattattaccaattcaacatcaggacttagaaacttggctactttcactccttgttgtttggatctggcaccattgctgtggttaattaccattttccacattttagcatgcagttgtctattctgtctttggtacatccaatagtgctgcaaatacgttatattacaacctttactttgtaaagttgaagatatcttctgacgctgattacaaaggaagatgttcttaagtgtacaaatgtagtcatggtggaagttctctcttagggcatcttttcctcaacataattccatttttttttttgtcctcgttgacttgatttttgttagtggttcagtagaataagttttatgaatgactgataccagtaaacaattgaagtcacctgtttgtaaaaggaaattgtggaggattcatggcagagtgcaaattgctgaatgaaaattagcctatggcccatttatcaaaactaatgtacaaatgactttatatcatcattgtaaagaaatggctagagtcattggcataaaatttgttgtacagggtcttatactttttatttgtttccaaatcaatgtgctaatttccaatcttctattaccctcccccaccccatttccctttttttctggttctttagtggatgtgaagtcagaagttcctgtgggcctggagcccatctcacctttagacctaaggacagacctcaggatgatgatgcccgtggtggaccctgttgtccgtgagaagcaattgcagcaggaattacttcttatccagcagcagcaacaaatccagaagcagcttctgatagcagagtttcagaaacagcatgagaacttgacacggcagcaccaggctcagcttcaggagcatatcaaggtagcaaatgcttctttgtctgtgaccttactcaggagtctgcaccgtggtgggcatgaacagtgcccatgggaacactttgcgggtagattcactgtgattaagacatggatatatggcttgaagggaattgtgattttactagtgaaaactttgggtaagtacctgttaaaaacctgttttgcttctcagagggaccttctttatcctttagcacatagaatcaatagcagggaatagtaacttcctatcctaattttagattctctcctacgtgattttgttcatttgccccatctgctctccaccaagaagaagcatgagcctagaagacccatttcatatttcatttctgaagagtctacatgtactatttgtgagaaaggataaattagtcaccttatatgaagagagctgtttttaaaaaacaaacatggtgtataagtagatgttctgagtatgtccgactcttccttatagaaaagatctcataatgtacacattcaaaataatagtataataaaaagcttaagggagttataaatggagaaactggtgcaaatgtttttatagactgtagataagaatttattgaaagtatttgggagtagttgacaatttgagactaaagttgtttaaattattttagcacaaatatatccatattccagaatttttaataataacttattttattatctaataatattagatgtgtctgtttttttaaattttgtatcttcagagataaatattactttagctttatttgtaaaacatcttgcaacttcttgacaaagacagttgaaacaaggctatttaatttgaatttattgtgacagaaaagcagcaaagatttacaacaaaaattttatttttatatctaactttcaaagatgacaaacacttgctaatttgtgaatgtaataaattatgttatctcatactttattgttttgtattataggaactttattacttgcatatcaagtacaagcacattgatagagggttgatacagataactgatgttactagtatgtaattttaccacattaatatgacagtttctaaggaagtaaaaatgctatcttcttctctatattacttggtttacaagatgtttcttaatcctaaaagaactttattatcgtatattcctaaaaaggctctttgacaagtgatataaaatatatttatttcttttagtagtgaactttccaaaaagaactcttgtatattattgatgtacaaaataccttaaagtgagagtattttcttttgtcccaaatggaatcagtagctcatggctacattttgaagtatgggtagcctttctttagtttttagacttatttttgaatgaatactgaagctttatttaaatttgacctttgaaacaataatagaaacattgatatctagatctgtttctttccttccagcatgttaagatggcaaagagaaatgagtaaaatgtacatttttcaccatactttaagatgtaagggactgtgtagttcattttgctgctttaagtgagacatgtttccctaaatacagggcaatactgataagttactgctttagatacttcttttcatttatattgctgcctttgatagctataaagttaatataaattgtttagaaagaaatttattgcttaattttactcaaaaggtaatagtagcaagtagataattaattgttcatttggcacaagcaaaacaatagtgttggtttattgacatctggaaaatattggaaaagtggctcctgtgagaaaaaagaattatgagatagctaaaaggaaaatttagcttttaaaatgattttccaaaataataatttgttttcttagaaaccaaagacataattaatattactttttcagattaggaagttttttgatttttagaatttttattttgttttgtcttgtattttttatggataaagctaaaagttgatgcttttcattaagattttatttttatgagaaagatgcattacatgatgctttatttatattagctttttgaatcgttagcttctgtaataatcaacatttgttgagttagatgctgttattccatttttccacctagtgaactgaggtagagaaaaataatgatacctttccaaggctacatagccaataaattgttgctccaagatttacagtcttgccctgtctgcctccaaagctcttaagttgccctgcctctctcatgggccagaacatctagcaatagagggctaaagttttatttctttctattgttttaaacctcattcatgcaatctttgataatgaatagtagtggtaattaaattgtgtgcttttctagattcctatgaaagattaaagttcaaatacattggggctttgggtgaagcaccaaattaatttgaccaacccaagtatctatatagaatttaacagtaaggcagaatttaagcattccttctgctaccatggaatattatttcattacaatggaataataacacccattaagggagtgtattgaagccaaaacaccaaagattttaatatgaagagtaaccagaaatgcttctaactatgtccttctgggagtaataaggctattatggttgatatacagagttagcttcctgttgctccagagtgactctgatgccattccatataatagctttttatttttgttctattactttttggtgtaaaatcaagagttttaggcacctaatgtaaaaaacaaaatttactaatttcattagtattgaaagttacaaacacatgttgggtatcccttatctgaaatgcccgggaccagaaatatatcagattttggatttttttttctggattttggaatatttacatatctgtacataatgagagtcttggagatgggactcaagtcaaaaatataaaattcatttatatttcatatacaccttatacacatagcctgaaggtaattttatacaatatttccaatagttttgtgcttcaaacaaagtttgggtacattgaaccatcagaaaggaaaggtgtcattgtctcagccacccatgtggacaatctctggttgtttggcatcactgttgttgctgagtctgaatgtgaggaacatgccattggcatgtcttgcccacacacacaccattttgttatcttttgtgggtgtgcttatgtgggggaatctgggcgtgtgtgaaaaaaatatattgcagctgaaagggggctggaagggtcttttttcccatggtgaagctgactaaactttgtgctgtgtgcctgcattttgactggaactcatcacatgaggtcaggtatggaattctccacttgtggcatcatgtcagtgctcaaactatttcagatgctggagcatttaggattttggattttcagattagggatgcccaacctataataataataattaaaatcagtagggttcaaacttaaaaactaaattttatgtacgttatgaatatgcggctgaagagagatattctctctcttacatatgaggaagtatggctccgagtagtttagtaacttgtccggatttcatatctactaatgtcagaacctaaggagaactcaaggtctttagttactcctcagtgtgcacatttactatagttcatagatatatatttctcagtctgagtggaaatagacatctcaagatggctattaaaaaagaatgcttcaggctgggcaaggtggctcacacccgtaatcccggcagttagagaggccaaggttggagcatcacttgaggccaggagtttgagactagcctggggaacatggcaagactttgtctccactaaaaatgataattttaaaaaattagccaggagtggttgtatatgcctgtaatcctagcaacttaagaggctaaggtgggagtatcgcttgagcccaggagattgaggctgcagtgagctataatggtgccactgcaatccagcctgggcaacagagtgagaccctgtctcaagaataaaaataaaaataaaaaagagtgcaagaatgcatcatattcatgtcattcattgtttgagagtgaattcaagggattcagaaagctaaacaatagtgcattaaaatgaagttttgtggaagtggtttcttcttgaccagtgtctttaatctaaaagcttttatgtgctgaatgaaagaataaagcttctgctattttgatattttgagagactatatgtatataatatattctacatattatgaatatatacattgcattagtctattgagaacttgctctgtaagattttgaaatttttagcatttgtttacttcaggtaaacttcccccaaattaatttaatatctcaccattctgtatttgcgttgattatttttacaccattttttaggctaagaatggaagatttcagttgttcatttataatgtgagggactttgtaaaataggcttctgggcagtccctaccttttcctgtttgtatgttcaaagaaaagtcattaagggaactaaagatttaattaaaggaaatgggaagacctgagtgaatttaacagttagttttgatagggatgcacagataatggagctacctaaaacttgcctgttgatgacgttaagaccttcactgcattagttgcttgtccttagatttcaatgatttacagaaaaagtgggtacaaatatgaactaaatacaaacaagttccaaaagctcataacatttcagttttggtcagtgatgactatgaagcctaaagaaattgcacactctcatgtctttctcttctcgcaagttgcaacaggaacttctagccataaaacagcaacaagaactcctagaaaaggagcagaaactggagcagcagaggcaagaacaggaagtagagaggcatcgcagagaacagcagcttcctcctctcagaggcaaagatagaggacgagaaagtaagaggcaccagggtaaacgatggactctctttcctcatcgttagctgatcattattcagaacaaagcctgataaagagtgcggttagactcgtcaaaattatctgtgtttaattaaaagcatagattacagacccaactgtaaagttttgacatttacataccagctcacatcattgagtctgcagagcgtctcaagaagcaaacgtaacattatctggcaaaggtgctgatttctgttgttttgaaccttaaaaataatgtaattctaaagcagtctaatatatgccatcttgtttaataatcagcttgtatccacatctcctgactatgccttccttactcctggccaagtaataattgctctctaagtaaagccttgcctccatttagttttggcatactcaaactttgagaagatttaagacataacacatgcaaaagaactatccacaagagggagacagatccaaataattcccctgtattaggtcagttcaaaatcaggtcgtagcaaagtttaaaatttgatgacttgaactggaattgtcagcaatatttatttgtttaatgctcaaagggtttttttaaaaactaaggttttcaaactagcaactcagaaaagattattttaatgtgtttaagggatttaatatggatctaatccctcaagataacttgattattaaaatacagtgttttgttcctctgcagtattttttaaacttaaaaaagttgattttgggaattccctctttgcaaaagtaattaaagaaatagctgaaagtcttttgaaaatttgcaatttaagtagtatttataaagcattactgtactattttctaaagcatatttggactgtggtttcttcttttaataggaaaactttatgtgctgtgaccagcgattttacttcttaatctttgtcaaatattctagaggcatgagaggacaaaactcaccatcaacatctgtttctgtgtgtgtatgtgtgtgtgtgtgtgtgtgtgtgtgtgtgtgtatttcaggggcagtggcaagtacagaagtaaagcagaagcttcaagagttcctactgagtaaatcagcaacgaaagacactccaactaatggaaaaaatcattccgtgagccgccatcccaagctctggtacacgtatgttcagtgtttggctgttttcattcctggggtaaagaacacaggttctgtatttagccgacctgggtacacatccttagcctgccatttctcagctgtctggctgtgggcaagttccttcagttctctaaggatcagtttccttctccataaaaagaggaaaataatagtgcatgccctctagggttgctggcacggtcctataaaataacatggtaaggtacataacagagagaagtgctaaataaatggtagcatttatcaacttgagggcaaggaagtatatatgttctttgatgaatgaataactgacaaatgtgaggtgggcaaagaaatttgtattttgcatttttccattctcaactggtgcatttggtatctatatagtaatttcaaaaggtttagcagattgtgattttattacacttgacttggtgtaagatggaggtcagagctattttcaaaaatctagtagaattttgtctcaaatgaagaaaaaaggaaggaagaaaggaagataagggagggtagggaagggaagttgagaggttgctaaataaataactctaagtcttcagtgaatagtttacccctgcccacctcacttcatttcttcccagacagcaaaataatagcttggctcctgacacacaacctgacaacataatacactgtggtattgtggtttttatagaactgtatttctgtaagtccaatacacaaatatttcaataaaatatagaggatgtggtgattttaaaactcagggcaaagaactgataggcaaatcatatatggataataaactaatagataatagtttcatttctttcttagaagtgtttgccaaatgaccatatatttttacacttatatatttttcaatccctcacaccattaaagataggaatagtacttgattactctgttatattaatattgtaagcagcctgggagttctatttaaagagttaatgtacttataaggctattttataggtatccgcccttctctgcatcccaaaacaggtaacagacagataccataatgttttataaatactttttaatgattttcataatttctgtcatgtatatcagttgacatgaaaaacaaatctctgaaaaacaatttcaaatattcaatcaatatcacgaatgatttaaaaagaaacacgattttgttacctaaaactacacacataatttatagctaattcataattcaaaattaaagtctgttctaagaaaagataatagcattaaatgagaaacagctacatgcaaagaatttgtcggttaaagttcattagctgttctcttaggtaatattaagcatagctctcacatgttacttagcagtatttaccttgtttttatgaaattgaacttcagtagagtccaactgcagataaccacaaacgattaatttatagaatctgaatttaatgccatttttgccagttatagctagaagaaatatccttaaaccaataaagtcttaagaatatatgatttaaataaataatactggtagaacaatcattgtgatggtgatactatgtcctgttcattgttttcattacatatgtaattatagatatttatatctactagatagtcaatattcagtcctataaactattctccagcagcacagttgcatctcttagattgtattcacccaggaaaaagaaaacatttaaaaaaattggtttcatattaaagaatgtgatccccattctttactactgaaactgccccagaagtcaggagatgggagtccgttggcacaatcctgtcttttcagtaaaaaaggctactctcatgtactcacatgtactatctagcaattttttaaaatgaagtccttgcgtatgtttactattaccttgattgttttatactgttgactagaaaggattgagatgatgacttttcccctagggtggctcttaagagaacataggcagtaatctcaaattgtcaaaagctcagactcttggtaaattattttagtgaagcaaactttctatgtgactgtatgaccaaacacatgctggacatccttaggatccctgcatcattccatagcatactgctacagtgaacttggttatgtgaggctatggtttgtatacactaaggagaaagagcataaacatagctgaggcacgtgtacagcgtgtgcagctgattattgctgaccaatatgcagtaaaaactaccaagtaaatagtgaaacttccttgtcttttctagggctgcccaccacacatcattggatcaaagctctccaccccttagtggaacatctccatcctacaagtacacattaccaggagcacaagatgcaaaggatgatttcccccttcgaaaaactggtaagttggtttaacaggaactctgtttgctcttctgtaacacacctgtaagtttcattttgccacacctctagaagaaagtcaaaggatttgagtcgtagataatatacctccccacccctgcccccagcataagcaaacaatgcacacacataccctacttatttctgcatcagttgattcatgacataatcaaaatatctctttttcagtttaaaagtttatcatatttgaactttagccaaattattttcttactaggaataaataaaaataaaaatttcgtatctcggaaaatctaactcttctccattagatagggcctctgtaatatctttcattgtcctgtttttctgctgtacctcaaccatttaccacaaaaacgagaataataaagtttaatttttccaataaatattttacaaaccttaaattttaattgtttttgtggtgaaagcaggtaaggccaaagctaccttctgagtaagtgactagcctaatatctcatggattataatagaactcagagtgaaattatatctgataatctcatgaagttaggggaaatagcgcaattaagcttttatttagaatttagtaaacagttctgtggctctaaggattgtatttgctgttccatcttcatctcctttctgagcattctgatatgtatatatttaatgtcttatatgcttttactgctataataaatgtttaactagatatacatataaatagcatttgtgtacattctattctaaatctcaacgttgtttgccaaatatagttctttagagacagtagtaaatttaaaaatgtttatctccacaactgatctgaaaagatattcatgtaagatagcttggtctattgtatttgactcagatctacttgaagaagtatagatttatttgttttatatatgaaatctgcagagtgaaaatgatttcaaataattatattcattttcccaagcaattttgagaaattaaaatgaatatagattgtaaaaacacatgccgaagctattttttgtcatataatttacctgtggcataatgaagattttaaaataaaatcagttatgaataagaatttattattcgccatctagcatatattgaaggcactaggaaaggatgtttaactattgcaaaacaacctgtggctttttaatttaaatagcccaaatatttttgcatttctactaaaagatgataagtattataaaataccttaatagaaggctatgcaaaggcaaggataattgagttttatgtattgcatcagaattccaccctattatctgcaaatcagagtgtcttataaataaacttttctaggatgaaagaaagcaaaatgtgagcctctatgttatttctaaaacatgagtatagtttatgaaaagtgatccataaaggacaggagttttagaatgtggggactttgatctgcaggcttgacatttatttgtgagtagcatgagtaggagctatttactgagattatgcagatactaccccaggtcttagggcagtgaatggcattcaagaatctaaggagttactaaaaggaaagaaaaatatggattccccttatggcaggaggttactgatgagtgatatagttacattcacagagaaagacttctatcctgctgagcacagagcctttgaatatatccttaccactgggagattgaaaactgactgcagaactgataactgactttgaaaagaagtggcatttgggaacattaagcacccagtgagaaaatctgatatttttaatacttaaggagaagtactaaaaacccatactttgtgtcccactgttgccatgcgaacagcttaaggtttttcctctgtgaagaataaataacaagctgttaatttattctcatagatttttttcaatccacaacacaatttaaaaagaaatccttctcaggatatatatgttacaaaccctatttagatttgtacaaatatgcaagacattttctgtgccttattatgtgctatataataatagtgaaaaatccctggtcttttctagaggtattttttctgtatttgatcagtatttcatgtttcttccttttatgttgaaaatctgatatttatgaagtgtctggctgttgatctgtaaaaccaaacattttcaagcatcgtagcaataaagttcttgaacagccattaatactttagtatctctatagaggttttaaaatattccttaattcaattccaattgtctgtttaagaaaaataagatgtaattaaatacagatgctttctatactctatctaaaatacttagagatgcccttcattaattacaaaataggtggaacactcagcttttataaatataatccatttggtgtatttccaattccattatgagaaaatttagacatatatttgcactaaaagaataacactgaaatgttgtcaaataatttttacttcaatgtttattgtatttcagtgactcaaaagtatttacaaacaaagcgaacaataaaattttaccataataaaacatatgtgatgattggggaaactgtttaagatagcttgtgtaaagctacatcatactaaatgaaatctggaagagtgtcattgatcatagagtgtaaacaccagcccagctactgtagagtgacgctttgttattagagccagattctaaacctctcttgtctgcttggatttcattgaactcaatcttagagttaaaagaagttgttaaatgagtgtatcctatcgtttgatctatgtatgatactattttagtttcttttaaatctacatcagcaatatgtattagcaagcaagatttacgagagtaaaactggaatcagagttagaaaagtcctaatgatcttacattgattgagatagccctaggatgtcccttaagcagtgagcacaatttgaaacctctcttgaccttttaggaccttccccagacagtgataacccgggaacagttaactacagaaacctcatttgcctgcagaaatctgacctttgtcacgcaaagtggacctttacttccttccccttaggagaatgatagttgctcctagaatttgggcattttagaaacatggaattatattaaaagttggctctaatcatgcccattccaattcacttttctttaaaatgtaagaatggagtgacttctcctcctttcacaacaacatcaaaggctttacataacttattttgaagtggaaaataacaattgtttttaatttttatatgcattgcccacacttaaagtagtacttccttctagaattatacattgtaattaattttgttctataacacaaggataggttgataggaaaatttggaatattttactaaacttatactttggctgaaaatagtatcattgctgtagtagatgactttattgtttttatatagtacactgctgaactgataataaactatgaagtagggaaaggaagttttggaaatagtacatatttcctggcactttggaaatggtacatgtttctcacagagattctacatatgtggtgattttgaactgaccttcaaaaccatttgattggattctgttccagtgagtgtgtgcatatgtttcataaaatattgtgataaaatttctagaagttttaccctccattatattattgaggttttacccaatgaactttgcctttctttgaatattacagtctttccatttaatacttctgaacaaagtgagttagctggctagattaacctcttaaagtgcacaagccatgtaaagcttggcttgggctgataagagacttttccagccccactgaaatatttattttaatggtcagcaacactagaataagactcaaagatggaaagagtccaaacataagtgaaggttttggaaggccagtatcattttccacactgagtaaactggaacgaaggcagagattagatatgtagctttataaattgccttttggtatagcagtcagcagttatgttctagtaccttgatgacctattcaagtcattataataaaaaacacaataattatttttaatagtttagaatatctcttcctctctctctccctctttctgtgtctttcagaatacacttgtgcatgtgtgaattgcatacatgaacattatacacatttctgcaaagatatcattaaagatggcttaggcttataacgatatttgctcaaaatcttattcaagattgacgaacactggagcatttttatatagcttagtactctatcttggttacattgttttgactaaacttgtcaaagtttatttttattgaaatatacttcttttaatgaatcttatactagttttctcagaattgagaagtaatatggccattgtaattcaggctttgaatccacacataccacttggaaatttgggtcctcaatcttgagcgattaatttaacctctctaggccacgattccctcatctgtcaaatgaggataataattgcacttggtttgcacagttatttttagaattcaattaaataatgcatgtaaagcacttaggatcatacctaggatttaaggagtgcttactcttgactgtatgcttgtataaggaaatgttatttatttctattatgccaaaactaaatctctttttgttgtagaaggtctttttaatgtcttacattcttctacctttattaatagaacaaccaaactaataaaaaggtgatcaatattttctttttaagctatgggcaactcacaaggctactgtcaaaatgagggtaaagttatttgttaattttgcatattctctggtatttcagagctcactatggtatccaaaagaagcagcaggctgcatgcctatagtcctagcgactcaggaggctgaggagggaggattgcttggcccaggaatttgagtccaacctgggtaacatagggagaccctgtctcttaacaaataaaataaaaaacggagcagcaggcttgtttttgttgttcatcgtaggaggaagtctgattgatgttctgtgctcactagggccagagttttaatttctgctgttaacttcatttttaaagtagcagactttaattttaagaaaagttttatatttacagaaaaattgagcagatattgttgagttcccatattgttgcctcctcctaacccctaggtttctgctttttaaatatcttgcatcaatgtggtacatttgttgcaattaaggaacaactattgatacattattgttaatgcagtccatagtttatattaaggtttactctgtgttgtaagattctatgagatttaacaaatgtgtcatatcatgtcatatatccaccattacagcatgatatagaatagttttaccaccctaaaaatctcctgtgccccacctattcatcctccccccacccaacttttggtaaccactaatttttttattgtctctatagttttgccttctgcagaatgtcatagggctacgatatgtggccttttcaaactggcttcttgtatttggcagtatgcatttaagattcttccatgtattttggtagattgaagcttttttggttactgaataatattccattgtatggctgaaccactgtttatccatttaccttttgaaggacatttttgttgcttccaaattttggtgattatgaataagctgctataagcattcatatgcagtctttgtgtggacatgttttcagctcaattgggtaaatacctaggagtacattaactggatcatgtggtaagacttgtttgttaaaaaaagaacaacaaacaacaaaaaactgtcaaactgtcttccaaagtggctgtactattttgcatgaccactagcaatataacagagttcctgttgctccacatacttgttagcactttgtattttaagttttttttttttaattttagccattctaatacgtatgtagtggtttctcattgtggttttaatttgtaattccctaatgacaagtggtgccaagcatcttttcatatgtcatttgctatctctgtatcatctttggtggtgtctttttagatattttacattttttaaattggtttttttctcattgttgagatttaataattatttgtgtattttgggtacaaattctttttttgctgtttgtcttacaaatatttttcctcaatcagtggtttatcttttaattcttgtatcattgtctttcacagaacagaagattctaattttattaaacatcaatatttcctttcatcgatcatgcttttagttttatatccaaaaattttttgccaaacccagcgttaactagattttctcctgttttcttctagaagttttacaatatttcatttagatctataattcgttttgagaaactttcaatgaaaagataaggtccttgtctagattcattgttttccatatcggtgtccaattttgctggcaacatttgttgaagagactatcatcctttctccaaagaattgccttagctcctttgtcaaagatatatttgtgtgggtttatttctgggctctctattctacttcactgatctacttgtctgttcttttgccgataccacactgtcttgattactgtaacttcatagtaattcttaaagttgggtactgtcagtcctcttaactcttcttccatattgtgttggctatcctgagtcttttgcctctgggtataaagtttagaatctgtttgtcaataaccaccaaataacttactggaattttgttttgttttgttttgttttgagacagggtctcactctgtctcccaggctgcagtgcagtggtgcaatctcctgggctcaagtgatcttcccgcctcagcctcctgagtagcttggcagcataggcacacaccaacatgcctggctaatttttgtatttttcgtagagatggagttttgctatgttgaccaagttacttactgggactttaactgggattatgctgaatctaaaggtcaagttgagaatagccatctgaacaatactgagtttttctatccatgaatacgaataattctttcatttagattttctttgatttctttcatcaaagttttctagtttttctcatttacatcctctacataatttgtttgatttatactttcctaatttttttggtattgatgtaaatgttactgtgttttaaatttcaaattcaaatggttcattgctggcatataggaaagcagctgacttttgtatattaactttctatcttgccaattggtataacagcttattcattgccagagttgtttgttgtcattggttctttgggattttctgcatagacgatgtgatttgtggacaaaaacgttactttatttcttcattcccaatctgtatgccttttttttttctttttcatgtcttattgcactagctaggacattcagaatgatgttgagatgtcgagcaggagaagtaaaaggggacatcctcaccttgttcccaatgtcaggggaaagcattttgtttctcaccatcaagtgtgatattagctgtagattttgtgtttgtgttgtcaaattcaggagttccctctattcctaattttctgagagtcctcacaaattaatgttgggttttgtcaagtctcttttctgtatcaactgatataatcgtacgattttttaaaaagccatttgatgtgatggtttacattagccaattttcaaatagtgaaccaacctcatataccaggaaatcctacttgcttgtgttatacaacactttttgtacatcattggatttgatttgctagtattttgtggaagattttaaaatctatattcaggagagataattgatcaatggctatctattcctataatgtctgtatctgattttggcagtatggtaatgctgtcctcatagaaagagttaggaagtagtcctcctattttctggaagagattagagtattgataccatttacactttaagtatttggtaaaatttactagtgaaaccatttggacctggtgctttcctttttggaaggttattaattattgattcattttctttcattagatataggcctatttaaattatgtttttctccacttgtgagttttagtaatttgtgtttttcaaataattcatgtgacttttcaaacttgtcagtatagagttattcataatattgctttattatccttctaacatccacagcatcaatagttatgacccctctttcatttctaatattagttattagtttcttctctcttactttttttttcctgacagcctgactgtagtttcatcagttgatctttcaaaggaccagttttttgttttgttgagttttctctcttgatttcctggttataattgtcttgaatttcccattaatttttactttttttttctgcctactttaagcttagattgttatttttcctctattttttttaaagtggaagctcagattattcaatttttatcttttcttctaatatatacacaatgctataaatttgcctctaggcactgcttttacagcatcccacagattttgataagttgtattttcattttcatttagttgaaaatattttgaaatttatcctgagagtttttttaagtcatgttttatttagagtcatgttatttaatttctaattacttgagtatttgctagctgtctttctgttatttattttaatctttctgttattgatttctattgtgggctgagaaaatactgtgtacacattctgttcctttagatttgttgaggtacatcttatgcctcagaatgtattctgttttggtcagtagtactaaagtctccaaccgtaataggtttgtctatttgtccttccagttctaacaggttttgcctcatgtattttgatgtgacattattaggagcatacatattaaggattgttatatcttcttggagaactgtgactattttatcaatatgtaacaaacaccacttttatcttcgataatcttcttggctttgaaatctgctctgtctgaaattaatatagctcttccaacatccttctgtttagtgtgaacatgttatatctttctccattgctttacttttgatctgtgtcttatatttaaagtgggtttcttttaggtaatatgtagttagaacgtcttgttttttaaatttactgacagcctctcttcgtgtattgagacaattcacatttaaaatgatcattaatataattagattaatatctagaatgtttgtaactgttttcttcattatatttacttttttaaaaaaatattcacttctctctgactcctctgctattcagaactttatataattcagtgctctctactctcttaacatatcaattttacctcttttaaaaatatgtttcagtggtttctctagagtttgatgaatccatttatagtgaatccatgtccactttcaaataacagtataccactttacaggtcatacaggtaccttataaaagtgtatttctaatctctcccttttattctttatattgctgtcatttatttctgttttccaaaagctacaattatccagtattttgttcctattattattgtgcacagttaactattagatcaattgataataaaaataaaagattttcttttaccttcatatgctccttcctttatataggtctgagtttctgacctatatccttttccttctcactgaaaaacttttaacatttcttgtatggcaggcctacaggcaataaatgtccttagtttttgtttgtccaagaaagtgctttatttctccttcttgtttgggataatttgtgttctttttaaaatttttttggcaacattttgtactatactttcttttttattctacagcttatgacaggacatctgatctaaatcttatccttgttgctctatagataaagtttttctttttttctatggtttctttgaagatctctttatcttttatcttctgcaatttgaacatgatatgtctcgatactgagtttttggtatttatattgtttcatattctctgagattcctgtatctatggattggtgtctgtcattaattttggataattcccagccattattatgtcaaatatttattctttctctctttcttgttattttgctattcccattaggaatatgttataccttttgcaattttcttagagtattggggaattctgttccatttaaaaaaattgttttttgcctttctttttagggagtttctattgacatatcttcaaagttattgattccttccttagctgtgtccagtctactgatgagcacatttggaccttttttttttttcttgagacggagtcttgctctgtcgcccaggctggagtgcagtggcgtgatcttggctcactgcaagctctgcctcctgggttcacgccattctcctgcctcagcctcccgagaagctgggaccaccaccacgcccagctaatttttttttttaatttttagtagagacgggtttcaccatgttagccaggatggtcttgatctcctgacctcatgatccgcctgtctcggcttcccaaagtgctgggattacaggcgtgagccaccgcgcccggataagaccttttttaaatttctactgctgtgcttttgatctccagcattcccttttcaatctttcctagagtttccatttctctgtttatattatccatctgttgttgcatgttgccaacttcccattagaacccttaacatactacttttagttcctttaagttccctttctgttaattccaaaatttgtgtcataactgagtctggtctgatgtttgctttgtctcttctgattgtttttcttgccttttaggatgctttataattttttgttaaaagcttgacatgatatattggacaatagaaattgagtaattatacttttgatgtgaggttttatgttaatctggctggggctgggctttgtttaatatctgttgtagtggtaaatgtcagagtcttcagttttctctagtttcctttgatttttttccttctcctattgctttggggtttccctaagagctccttcttaaatagaatttgtgtcctgtagctccctcagttttaattcactgttataatacagaacctggttgatgtgatggtaaggcgttggacaggagaaatgttctataaccttacaactaaatttcatttttttaagtgggcctgactttgtatgctgtgatcccttgaactacttcttagcctgtttcctccccttaagtaagataggaagctgagatttactaattgccttctcccttaggtcagataaggctctgtaaaatattttcccttggagagtaggctgttgttatgaagaatccttcgtgtgtatttcaaaattgttactttttcattagacaagtattacaaaatggttacttttcttccctctcccacgcctactccctaccttcacttaaacagaaagggatttttttctcatatattcactgagagaaactggttgggttcctggaagtaaaacccatgaaaatgtaggattcttctgagactgggcccctggagttttgtttgtttgtttgttttttgagacagagtcttgttctgtcgcccaggctggaatgcagtggcatgatctcggctcactgcaagctccgcctcccaggttcacgctattctcctgcctcagcctcccgagtagctgggactacaggcgccctccaccatgcccagctaattttttgtattttcagtagagatgggatttcatcgtgttagccaggatggtctccatctcctgaccttgtgatctgcccacctcggcctccgaaagtgctgggattacaggtgtgagccaccatgcctggctgcccctggagtttttaactctcaagctggttcacattcagcctccagcaattcatgcctccaacacctcattaaaattacctcatttaaatatttcttcgttactgactccattggcttctgctcactgtaagctgaactcagctgtgattttctgtattttcctatttctccagattttagcatggcagtttgccctgcaaccttaattctctgatagatctacgaaaataattttaatttttactttgttcagctttttacttgtggtgaggttgggagtgaaaatttcccagttcttcacatgtggaaatgaaaccagaagactaccacttacttttaaatctgtaaaacattaaaaatactttttaaaactcaactttttcattttttgaggtgacaaattcatatttgagcaatattattcttacaaattaatgattatatttattttaaagattaacatcagtgtccagcttgctcatgattaacaagttcatatgctaaaaactgagagagagaaaataggttgaaattattttaagtcacattttgtaagcaagacttgggaattgtaaggactttttgtcgatttttgtcttactgttttcataacattaaaccatttagcaaggtatgaaaatcaaaccaatttttgacctgtatcaaattagaaaattttagcttcttttcaaaataagactcacttttaaagtaatatttttttctagataataatttactttttaagcattcattttgatagatgtaatcatttagattatgaaaagttggcaatttcaaaagaacatatttagttgattttaagatactcattttttaaactaacatatctgaaatctgaattgctctcatggatgtttatagtttagtagtgctttctggtggcagggagttagtggtatacaaggtacttgtaaatgttgtaattgattaattaccatagtatttacccaacaattaaatggtccagaatactaagattcctcatgataaagaaataatacaaatgtataatttatacattttttactttaaaataacaaacatagtagaaattaataatcctaaaaattttttatgaaaaagttaagtatgttagtttcaaatcaatgaacaaaatgatttaaatttcacagttcagtaagtgagaagctggtttcattgattgcatatgcaatttgtatgacaagtagttggagctaagagcaagtatcaaatgacaattgtgtgataatgagtcagccttgtaagaacttcgaaaatctaactcaaatattttgcttgcagaaaagctaaggtagcctagaaagacaaagcatggaaaataatttcatggcttggcattagatgaacaaagctgagaattctagcttggcacttttgatgagagctgtgtgacctgcacatagtgcaggatttctctgagcctcagtttcttcaaatagcaaatatggaaaatatttgccttccagtgttattgtaagcaaaaatatactgcccagtacagtgtgtgacatgggtctcagtacatattgccagtatgaattattaagaataatagtatggcattagtgacaggaaatattagtagtagccatataatgtaattattgaagaactagaatggcaaaaggagacttaagttttaatcttaaccttgtcactaatacatgactatgagcatagtgcttcatgattttagatttctgttttttcagttaagtgcaaatggaccaaatgattcctaagattgtatatgaaactaagaaggaaatatataattgcatttcataaagaggtgtgataaaaatatattaatgatttgaagaatatataagaaataaatgaccatgcttttgcacagtggtatctcaaattaatcataactggtaagtgcagaaaagtctaatgacatatttttcactcctcatgaaatgctcatttagaacaggcaggacattttagataagattggaatgagaaaatggcaaaaaataataattaagactttaaaagcatttagccatctgttgtataatcatgagatttattgaaaaatgattcctaatttatagtattcacaactatagaactgagaacactgaggaaatattccatgcaaatgcatgcatttatatgtctttagacttacctaatgaagtaaattaagagatagaaaataaatgatgaaatatttgggattgtattttccttaaattttcagcctctaactcagttactttaaaatggaagtgttctttatggcaaagaaattggagagaggagtgggaggggagggggactggcttaagaaccatgttattattaaaagcagcacataataacagtttgacgtgacatgtaagattttttatcaagtgactttattttgctttatgtgtatcagcctcctgttttatagatttatttgctttttagcctcttatttgcatttttatttcaatattcacagtgattcctccattatttcccacttattcatatacaagataaattctaaagttatttttcatagaaccttcattctaacacttcccttatctgtattctcatatcattgtaatttttgctataaaagctggtaattttgtcaattatgagatattaaattttataatgttgtttttatcctgttcatcccaattagatgataaaaatatctgagaatataatgcttgtaacatcttcctcctttatttgacaaaccacactttgtgctgggcctggacataaatattaaataaaccagtataagtaaaaaaggatttctgacattaaggagctcacagtcttcatagtgaggcacatgtaataggttcctaatagattgattgatactttaattcagcagttgaacagttgaaccaccgtacttcttgaggaactactatttcatattttcagattataggcattcttgagtgaaagcaaagatccaagccacccgaggaatatagctgggaaaagacattaagatgttattattattatttttttggttgtaagccttcaatatctttatttcaaaatgcatattttaatgtcattatatatattttgaagtaggtaatacagaggtaattaagagaaattcttggagagaatgcattagcctattgtagctgtacatatgtggttctttgaaaatagtatggaccagcactgccaaatataatttgatggaagagttctatattggcatggttcaattcagtaggcactagctgcatgttgccacttgaaattgaacacttgaaatgtggctagtatgacttaggagctaaatttttgttaactaatgtattagttagctcataactaattttgttaactaattcatttgaatctaagtttaaaaagccacctgtgtctagtgattatcatgtaggacagcacaagtatacaccaaggcaggcacatgtgtggcataagcatcatggtgaaaccgtttcggtgtccaagacagagttcactaatcagtcacagcaaactcttccctctgagtttgaacacaagtcttagtaaaagcattctaagtcacatcacctaaagaagatacagtgtctaaacagaattatattttcagaactcgttaattttttaaatatatatatatttttattttactttaagttgtagggtacatgtgcacaacgtgcaggtttgttacatatgtatacatgtgccatgttggtgtgctgcacccattaacttgtcatttacattaagtatttctcctaatgctatccctcccccctcccccaactccgtgacaggccccggtgtgtgatgttccgtttcctgtgtccaagtgttctcattgttcagttcccacctatgagtgagaacatgcggtgtttgggtttttgtccttgcgagtttgctgagaatgatggtttccagcttcatccatgtccctacaaaggacatgaactcatcattttttatggctgctggaagacagtgtggcgattcctcaaggatctagaactagaaataccatttgacccagccatcccattactggatatgtacccaaagggtaataaatcatgctgctataaagacacacgcacacatatgtttattgcggcactattcacaatagcaaagacttggaaccaaccccaatgtccatcagtgatagactggattaagaactcgttaatttttaagaagcaagcaccaaatacaaattagtttagtttaaaaagtgggaggtgtttggagggggtcatttaaatgaattttcctagtgtccagctgcttagatgatgttatcaattcagtgtatttaaactttgttattggaagtatgagttccagtcttgcctcttctgggttttatgtgcagtaatgctctccctccaaattttgacaataacccagagcaagcctaggctcaccttttcacagtttaacaacgatagcaaaaacaaacactctttccccggtcattctgataaattcccaggaccatctcattcggacagcttatctcacttgcgccctctagacgtttagatggagtttgcagtttacctctcaaataacctggactaagagcaaaaccctaaccagcattcatccatctaatgggcagctttgatgtataaacttttctgtttagagttttgtgtggattttcactaatgcgcttggcctttcctaagtggacttttcaagtataaattgtctaccctttcttcacaagccatcgtaagcacttcaactcaaaggaaacttttcccaatcctctatgttttctgccccaaaacagtgatgttgaaatcttacaattccgttcctttaatttgcctttgctgctgtgctattcccatgtacacattgcacctccataataatcaagtttattcagaagcaggatttgtgttttattttgggggcctcaacagtgcaaatgatatattctttcctattacattctttcctgtttatttaaaaaccgctgctaacaacacaatagagtcatgtgaaatccttcgttttttgaaacattataataggtgatcatgtaagatttatgagatgaaagctgtattttccagagaaatgcattgagacctttgtaatataaatcatatttggagaataaagaatgtaatagcaagaagagcataatgatttattacatgacagtgatgtttaacctactttagacaccacactgtgtttttccatagtaaaacactgataagggaacagcacattactttagggtattatttggtcaggaataaatgggtaatcagtggattctgagatcacaactagcaagaataatatatatttgttcaataataattttgaagaaaattaatgttaacagacttatatagtagaatagataactttggtgactatgtgctagatccattttaggcatcttacctatatcttattaactctatgcaataatcctagaaatagattttattatttctcaccagttttatagatgagagaaccgtcacagagaggtttactaactttcctaaggtctgattttctttattatggcagtatgtacaatgccaggtttgaagacagcgagttttgtttcagaatctggtctcttaacccttaacacttattctttgaacacgaataagtgatatctaatatcattgagaatggcaattttgctaaaattaagtaccatgtagcatctatcctgataaaagtagtgacttataacagtttaggtggtgtcatttgtaagttaacttcagtccaatgatgaataaagttcaaaatctttttagaaatagcatatgtttgggatattctttgtaaaagcaatgatgagagatattttcaatggaaaacaaattattaaaatcacaaatttttgttttctttctgcatcgaaatatttaacaagtttttcaaataaggtatttcaaaggtgaaacctgtttcaagttgggctttccaaatatgtttgccataaacaaactttcagaactaatttgctgattattgacagaattctgagaaattgtaaatgtcatagtagtgccaaaatatgttaatttgctaatcctataaaggaaaatacaatttttcaaatctcctgtatttcttaagggaaatagataaacttacaggcccataaataatagacatactttaattacatgggtttaaatattccatatagaggctattacaaaagggatcttttgtttgtagtacagttataagaaaacaatgaatatatctccagcttttataaaatgttttttaaagacacatcaattgtgtttgccactaccactacatatacatatgtagaaaatcatttctctttggatttattactaggataatatttatctttttttaagaattaatatacttacttattgttattacagtgatgttatgagtcctctagaagtgaaagatgactgtcagatagagaaggggtggggaaggacagataatatgcatattaatgttagagaattagagaactgaggagtctcactgaagactccagggttggaaaagaagatgagtagacacagaattcaatgatgaagaactctgtgatacggaaggcaggaagaggaataaaatgttggctatttcataggtaagcattggaaacattttaatcctttccattgtttaaaataagtaaatcagataatccagatatagtgttgagtaaatcctagagatgagtgacatgagaccacaggaaaatatttagtcagaaagagaatggagaagctgccacatgaagaaagaccatgactgttaaggtctcatctctcttttaaggggcagatactaagaggagaatatgaaagacaaaaatcaggaagtttatgtttacagaaagtttctgagttttaaaaataggtatgttaaaatttgaaactttaggctgactagcaggaaatattttaaaattttgttggaagaaattttattaaagtttatagtctaagaagttgtacatgtttataattagatatatttatatatctaattatgtatttataatagactgaataatagatatatttatatttctcttttatatataaatatatataagtataatataatagatatatttataatagactgaatacagtcagtctattacttcatagaataaagattagaaggaactgaatatattggaaagaacagtccattagttttgtcatttttttaagagtttcattagcaatcttctaattcaagctgttccaaagaaataggtcgttttcacagttgtcccttttaattttgggaaatgagacaggagagaaggaaaaggaggcgagcaaatttttactcacacttaacactgggctggaagttgtggtcactctgagcacatagagcggattaagggacatttttgctttcaaggagctcagagtctggttctaagagatttttctcaactacccctaatgtaagcgtcttctagattttataatgcttacactcaaaatctatccctctcctaaacaatgaaatagaaaaaaacaaaaattcattgaaatttactactatgtgttgtggctataatttttttctttctccttttcttgtcaaactgtgatatcattacctatatgattgagtttagaataacttttattgagcatttattctaaagtagttattatgctaggttatgatgttataaaaatgtgtatcatctgattcagcgtttggtctcttctaaatcagtgttctgaaacaataccagggactcccaaatcctgaaatctgtgcatttttctcaggcttcctttttctctgtggcttttgaccccattgtccaacccatgctccttaaaattttaacctcatgggctgccctttcattcatctgctttacctctctatttttaccaccgcgtcctttaaatatgaagctcatgaaacctgaggttcctgaggttcctaaagttgcattgtctcttctatttttttaacttttctatttcaattgtcaccatcttaaagactttgatcctacttcttattcattctaaccagtagtcgtttctgatagtagggtttaacccagctttctcatctataaaatgaataggttgatcaggactgccttcattttttttcctctaagttcttttatttgggatctaactccacatctctaaacttcaaccttttcatagacttcaggctaacatttccaaggtatcttgcaactatttaagtgtaacagatttggaagttgaccctccaatccgccacaccgcaagacttcctcctcctcctgagtttctcagttctgccaatgcctctctcccaaacatgcaagcttgacttttgggttcagttctgtctctgttgtcttctttgttgtgttcttttgtccactctgtcaccaagttctgtcttttcccccacctactttttctcatttttaaagtaggaagcatcttttcagatgtatttttttttcttccataatgcctagtgtaaacgttgcacagagtaagtgcttggtaaatatttgttgaatggagtctctcttcttctcttcttgtctgatgcttagtacttgttaagaaatggtgaatcccaattaaagtcaacaaaatgtgaatcagagcaacattctcttttttcgacccatcttaagtacaacattttttctacccatcataagtacaacatttaaaccatctgaaatagaataaactggttagaaaaatagtgttcttctttgagcccctccagaatctgaattcagtgaaaatctgttcaaaccataattctaattaagggttttagctgccaaataatatgttctggttaaagccaagttagtattatggagtgtttcatgaataacagcacaagctttaaacttgctgttgattttctcatgggaaactcaagtaaaggagaatgatacctccctgttgactttaacttttagaaatgcaaagcatgctgaaattgtacataattctcttctaaagaaaaggaaatagcatttcaatggttttcctcagtgtcttattgagttatggtggggcacaattgtgtctgttaaactgatttaccagatggaaggttacattttatatttagctgattaagttgtaagagactggaattgtatctcatactataaaggtcatatataaaattaaaaaatattttgattaactattttgaagcaattaaaaggtttaaactgttccccctcctcttttacttacattaaactaaaaatgaagttattcttagaaataggcctatcacagagttggtatttggcttaataatatctcaaatggaatgtgtaaaacaacagcaacaaaaaaagggaaatactcccattcaagttttggaaattgcttttcttggctatttaatgtattcttagtattttatggttaaattaaataatccttaatttatatacttataccctatggaacttttacagaaatatttaaaggaaataaattatactttttgtcttttttctcttttggatcttctgcaagtaaacaaatacattaataaaacctttaccgtagaaaattaaatgtggcaaagtgctaagtaaatttttgtcctggcatttttgctgtgtgatcatatatcattaatactactctttaattcctactacattacctaaaaataatgcattaaaaatacagcccagtaaaatctgatctagtcagaaccagtatttcagaatattcagacttccaaaatagcaccaatcttggaattcattcaactactgtattattttcctgtggatgctgtaacaaattactgcaaacttagttgcctaaaccaatctatatttattactttacactgctggaggtcatatgtccaaaatggctttgcctgggctaaaatgaaggcatcaccctggcgtgttcttttctggggactctgggaatgaatccctctccttgtttattctggcttccggaggctgcctgcaagctctagctgtgggctgtcccatcctcgtggccactaggaccaaccaagcctttctcaaatggcattgcactgacacttctctgcctccctcttccttattttttaaggaccccttggataatccaagttaatcttttttaagtcagttgattggcaaccttaaatccatttgtaagtttacctttaccacctaatgtgatacagtcacaaattctggggaatagaacatggacatctttggagtggggcattattctgcctaccccaagtgcttagagttttcgttaagatggtgttttctgcagtgtactttgacttactacccctttactattttatgtgaaatttgtttgcgatgcctttatccgggcagtcatccagagaaagttgactaaatagaaggtgtttaactgatgatctgtctagaaaaggattcaggggaggcctgaatgaatctagaggtgaaattttgccttttatatccattcaagataggtaatagtgtttccttataaatatatattataaagagaatgtatgatatagttcagtaaagttataaatgctattgaggtagaattgaattaccaataacgttccaaaaccataaaggttgtctaaaggttataaaatcaaaacttgcaaagcaaaataaataataacagatgcccaggtgacttggaaggttctgaaacaggacaagagcaggaagcaaagtggtatttgaactggggagaggacagtctcctgttggccagaagtcactgctgaccccttgtcagtggtgctgctgatccatggtacctgaatgtatctgaggggctgtgaagagttgaatagacttagaggttacacctaaagacttaaaattatattgtgagagataacaattattagtaacagtaattagacgtttaaaaaatgtacgtgcatctctttattaagctgaacaatgtgattccctaaagaaataaatggaaccatgttctgtccagaaatctcagaaccacaccaggtgcctagttttcctttatttcatccagtactaacttctgttattgcttgctgttaaatctcccctttcttatcgtgcctactgttttagttcattccctattttgttcagcctccattccagttattaaccactgattccatcatactcctgtccagtcaatcctttgactttctaaagtttaagtctagtcttcctaccctctaaaagagccatttactgcctcttctgttatgtacaaggctaaagctcctccatcgcaagcatgatctctgtctccttattccctctctgacctctctcaactctccccagtccactacctcatacccctttgccctagcagtaatgaaaaaattgaaattccatgaacaaatctttctgtttcccattcacacaagccattctcatctggttttccagatgctccttgctcttaaagtgccctcttcaatagttcatactcatctttaaatgctcagatgatatatatacttcctctctgttaagctttacctggtaccttcctacccaccaggccaccccagatagtcacttcatattttatgccaaatgtatatgcccaaatatgccctgacatatctctgtgcatatatctctatattaaaattacattctactcagttgaggaatccttgaggacagtatctttagcctatttattattgtatccccagcatcttcagagagctcataattggcactgaataaatttctgttatatgagtaaatgaatatatgcactaaaataggaactaatacacatttatttgggtatttaaaattctagaagttgttttgctaaataatttttaagaatttaatttgcaataacattttggaggtaggagactaactgcttccggatgactgtaactgggtaaatcagaagaaaacaaggaaacaaaatttttcatgttagcaagttgatgttatagtcttttaaatattattttattttaattcttgtggaatgaaatgacttgctagaggatgattttgcaatttaatgggaattggctaaaaattttcagataaacatcagagagacaaaaacctaaagtaatatatttgaagaagataattgtatggcatttcaaattagacagtgatttactatacttattgtagtcaatgtattccatttattacttctgaactctttaaggtcaggaatggctgttattgtccacatttgcaggcaagaaaattgaagcacagcgacattaaatattttactcagatgttatggtggtagagtcaagactggaaaacaactccagactcttaggagggtaacaagatgaggttcatgctgagagaaccaataagtacaataaagtttaggtttatgatgatacccaggatattatcaggggataggtattgcctttctggaccatgaaatcctgacctataacgttttctgggagtaattccatgctgtctccatgtgtgtccctatcaagcactgggatgcaccctaaatagatctcacctactaaaatggccccactctctcacgcagtcagttcacatgtagctcttatgaactgtctgagtaggagggacattaaaacattatatatccacaataaaattacttttcatgccatttctatttgaatggtatataaaagatatatctagtacagaattttgtatatatatatatatatatatatatatatatatatgtaggaattcgtttgttacagaaagattcatagcagaataattacacagaattttagagtgaacaggacttgtttacaagaaaaaatacataaacacatgtatgaattcagatttcccccaaagtagcatgttatttgtgaaataccaattcagaagtatactttataataaaactttgggattcaggtagaaaagaaaattattttagaaactggattgaagactgaaacatgtttataatctagttcgatttattgaaatgataattcaaaatgatgctagatagatttttaaatttgtcttaggtaaataaaatatatttgaaaaattaaagcatataaaggagttagcatatgaaggcattctggcctgtatgagatatggatttccttgactccaaaatgtagtatttgtgatgcttgccagaaaagagaaattccttctgcattccacatctgatctatgagacctcttgccatgacattcagcatcaagaaattcttagaaattagggtagttgaggttcatctagttctcttctcaacaatatttgagactcagccttttaatgtaagtttccttcatgcttggatgtatacaggcatgtattattcattcagcaactgtttatggagacccatcgagcctatgttcttgctaagtactggaaatagacacaagatcaatgattacattatatttctgctaagcatcaagggctggagccatattgcagtgttttgaggttaggaagtggtagtggcaagtataggctatttctttaacttgactatgaaagtgcaatcacaggaagtagctcataagatctgtgtctatgggggcttatttttatttgaatgggaaatatttgagcctgtctacattctgagaaggagccagaagagagagggaatttgaagatacatgttgcataacctctataagtatctcatagattaactaaaatgtgtttgatatttatctttgaagttttattttttatttagtattccttccctcaccagcatacttaatctccattctttgaatgtgtgggctctgtgcccttggacgtggttatttcctctgcatagaactgcacttctcccacctttacctgtcaacatctcactaagccctggaggatcctctttcaaagcaaatgaatgtctgcctttcagccacaacactctgcttatacctatcacgtggcactgatcccagttagtatattattcattcttgagaccatgagcacctaggagaaaaagactctctgtcttttctctgggggagttgcctcagcacttaacatgcactttttcccattccttgattccttgtttgaataaatagctaaaggatttattccatgtagttggcactgtataggtacctgaacaatgaaaatatggctacacatgcttccagtctgcatgaaacttgcaaccttgtttctcaatattattattcaatagctgttaatcgaatgtaattaaacaatagatctaattaaatagtaggttttaattttaactataaaataattagaattttataacttactattaaaatttatttttaaactgaatcacactgattaaagtatttttatgttaaaaatgataatttgttaaaatgtcataaaaattttaggaagttattttttcctgtttgtcctagtattaaaaaaacagtaatgagtagtactaaaagtagtactaaaaaccagtgttactactgagtggtactttttttttttttttaatactagaacaaacaggaaaaaatagcaaatttgtacattcattcattcactccgtaaacttttactgagtttcacctgagccagccgagtgccaggcactcttgaggcacattggtgaggaggaggaaaagtgctgctcttagagggaactgagtgcactgtcatgagctttagatgctaaggaaaaatgcccacctttccccttctagaccatgctcctgttacttacggccccgatattgtcttcccatcctactctgcgatgcttccaatgacttggtagttctctttcccatgtatgaccattttttttcccgatatgtaaagaggttatcattgttgtttccatctgtgataaacgttaagaattaaatttctatttacattgatagaaggaaatacaacttcctagaaaactcacacaatgatgtacataacagtgctgtctttcgaagcaaaacaatgtgtagtacacccaagtgtccaacattgtcttattcttaagtgaaatattgtgtattcacatgtaagtgtggatatataatatatagtatatcctcataatgtatttttaaaagaatatataattgcttggggaaaaacataatagatttttaagtgaaaaacataataaatgcaataattttaaggaatacgtaattacctgggaaaagacccataatatattattaaatgaacaaataagatataatcataaatataatgattctcattttcaaataattttacctacataacacaaagggaacattttagagtatacacaaattttcccattcttaaaaatctcaaatatgtatgacttacataatcggaagcaagcaataaaatttattataaaattagcacttttcaaaagatcatattgtaaattgattaacatttacaaatatggattttgaaaaatggtaatcttaacaagtagacaaaattggtatatttgcaataagagaatggatagatgcagtagtatttctcaaaaacaaatagtattataatgtctttaggaaattgcattcatgtattaccatacatgtgcctagaaattcccccaaaattattttttgaaaactttatatatgaattacatactgttaagtggttataattagaaatagttacattagaaattttgctccttagtgtcaaaatatataaaatctaattcataacattaaaggttcattttatcccagccagaagaggcatacattgtattatttattgtagtatgccaagtagtacttttgaaaatatgtaccttttgtataattatgaaacttttaattagagtaacctgtgtattttgattaactagactggaggatctactgtgttcccaaagtgtctttcataactgtagtgattactgatttgaacagtttctagatttctacaatgccagcctgggttataggagagatttgggcaggaactgtgccaggaaatctaaccttcagaaagaacagagagtgaatgaataggtgatagattataataagtatttggttccaagtaacaaaacatttaaatatggcagctcctaagggatccctgagaggaggagatagcaggagaaacccaggggagggagaaactgtgtggagaagttgacagatatccagtactgcagggaagaatagacaatgccagaaagggatctgaagctggtggtgaagacttgaccttcacctatgattacagagctaaatgttcactacaggtggaatcattgtatatcccaaatattcattattttaaaaacatgtatgtatgtatttatttatttagagagggagtctcgccctgtcacccaggctggagtgcaatggcatgatctcgactcactgcaacatctgcctcccaggttcaagcaattctgctgcctcagctcccaagtagctgggattacagggacgtgccaccacacccggctaattttttgtatttttaatagagatgggttttcaccatgttggacaggctggtctcaaattcctgacttcatgatctgcccgccttggcctcccagagtgctgggattacgggtgtgagccaccgtgcccggcctaaagaaacatttattaatctagtactcaatcttggttaataattaatcatcttaatatatgaaatatgttaaaatatttatataatattaacacaatggaaaattttccattttttccttatgataattttcaataagaatgaagaacttctacataccacacaatgtggtattgaaattttttaatctaaattattgttgtaaagaatattcacaacctaggattaagagtgaacagaggccgggtacagtggctcacatctgtaatcccagcactttgggaggccaaggcaagcagaacgcttgagcccaggaatttgagaccagcttggacaatgtggcaaaaccccatctgtataaaaaatacaaaaattagctgggtttggtggcatgtgcctatggtcccagctacccaggaggctgaggtaggaggatctcttgagcccaggaagttgaggctgtagtgagctgagatcatcccactgcactccagcctgggtgacagagtgagacccggtctctggaaaaaaaaaaaaaaaagtgagcagaggcaaaatacacatagtaggtggtccttcttaagtggatgatgatctagttaagacttagaactaaacagaatacaatttataagcaggcaaattagaaagtgagaaaaatatgtgaagtcagttattaaccaaaagttattttaagtacactgagtcaaagttcagaaaagggctattgttatggttatggtgttttcaaacattacactaggcaaaggagtgtaccaattgcagccatctctctctctacttattttttattttgtttaattttaacataacttcatcttacatctgcacttcatgaaacattcattcaacatctatgtaatgaacaattttttttttatgatagacaaccaggtgagccaagaaccaggatgtgtggtaggcattgttaccattcttttgtagatgataaaatgattcacagagatgaaatcactcatttggggttacagttagtacatcaaagagttagcattggtggctgggtgcagtggctcacgcttgtaatcccaacactttggcaggccaaggcgggcggattacaaggtcaggagctccagaccacccttgccaacatggtgaaaccctgtctccactaaaaatacaaaaattagccaggtgtggtggcacgcccctataatcccagctacttgggaggctgaggcagaattgcttgaacccaggagggggaggttacagtgagccaagatcacggcactgcattccagcatgggcgacagagcaagactccattgcagggggggtaaaaaaagcattgggatgagaggtctggtctatttgtgtcagagtcctgtgtgcttctacacaagatagtttgtgtgcctgtctgcatgcatgtgtatacaaaaatcacgccccgcaattatgtacacagtcacacatatcaatctcttagtaaaatgacaagtctgggcagtgtcactcactgtaccttggaatcctaattttttaacctttgcttccgccacctaggtttactattcctctcccatgttttattctcatacctgccaccctaagtttattgtgtaccatggagactagtatgagaatgaagatttgaaatacctttagttcatgaggcattcttcagatattttctgtttccttttattgaggatattttcttttaggtgagaagagaaaaaggtattgggtctgttctgttttactattgattgttttcacttaaataatgatagccaatttttatacaaagttttcatctcagcaggcaaatgtattcagatgagcacacacactaaaaagcttgccttctgtttctatgattaattgagatgtagagaatgatgggtgtggggtaaaaatggaaaggtaattagtgtaactaggcatgaaatacattcatatacaagcagaacctctccccagctagtgatctttttctgggctctgaggatttgcatcccattagtaagtcactggcatggaaatcttcagcctttggggagaccagagcattaaaaatagaattaactctaactgcaaacggagtcagcacactaggccattaattcttctgcttgggtatatatcatgctgagcttctgtgtgtgggcttctgaaatgttaggagtgagttttatagagcattgccaggactaaatgatagttatctatcatctcatctctcaccctcactactgagattttaatatctctcatgacccaaaacctgaaatacaggcagaaggttttgctagaaacattaagtaggggcctttctttagagaagttgtatactgtatattttgttaacataaatctatgttgtgctttacagtatgtcagagattccttattttcaaaaccttatgtcctcagatcatcacaatgcctcaaatgttatcctttctaaaactgagaattatgcctttttgcataactccaccaactaatgataaaagttgcctagtgttattatttttagaaatattagtggtattggaaacattttaaaatcaacttccaagtataaaatttattgaaacatttaatatatacaagctacatagagtactctcaatttctaataatctctcttttcttttcttcccttacccttctccagcttctttgggaatctctgacagatattattttctttagtcatcccagagcagtacaattattaacagctgccattgactgattgcctgtcccagggtttctcatacttcgcactattaacatttgggtaaagataatactttgtcatgggatgctgtcctgtgctttgtaggatgtttggcagtacccctggcctgtacccataccagatgcctgtagcagctctccatactgatgaccaaaaatgtgtccagatattgccaaatgtcccctggaagagaaatcttccctggttgtgaaccactggcctattctctactagtcactatttcatttgatcctatagtagctgcaagatatgtgggactggctgggtgcagtggctcacacctgtaatcccagcactttgggaggccgaggcgagtggatcacctgaggtcaggagttcgagaccatcctggccaacatggtgaaaccctgtctttactaagaatacaaaattagccaggcatggtggcacatgcctgtagtctcagctacctgggaggctgaggcaggagaatctctggaacccaggaggcggaggttgcagcagtgagccaagatcgtaccactacactccagcctgggcaacagagcgagactccatctcaaaaaaaaaaaaaaaaaaaaaaaaaaaagatatgtaggactatattaatcaggatcctggcagggaacagatctttgcagcgtgggtcatagacttttatgaagggactacttaacaaggaagttagtaaggttaaatgaactgcttagggaagtgggggtacccagaaaatagcaatagtgggaggtcattcccacaaagaagagaggggaggaaatttttcctggagtgctggagagctggagccctggaatagtggcttccagagggagatgaagtcaggaagagacatagccatggccagttatgcagcactgtgacagggagagtgtaggacagcctggcctctccctcctccttaattctttggccaccagcctgtcctgccagtagattaagcccaagtgaaatccaaccagcaaagaactagagtgttgcagctccaggattcagcccccatgggcttagagaaggaaggacaattgaatctgttggggggaaaatgaagaaaatccctccaacatccccattttaacatgagaaatcgaggtttaatgatataaagtaattcatccaggcatctatttgactccaggcacaatgaaggtatcatcttagttggtctgtgtgaatgaactgatgttcagcaagactgtgaattattcaaggttactgattttagtaggtggtagatacaagactaaaacccagttctcattcctcttctggtgtttgcttttttatgttgaccattgaaagaaatctgagagctctatatctggctgattctcaagtagacaaacaggagtgaaagctatctgctgaccttaaaaatcatttctttctgaaaatcttggaaaattctaggtttcatctagaatgtttaaatggcatatgctatttttccaatctgtcagcacatttttatcttgattgcagacactcagccccagctgatgcaatatattaggagagggaggaggacaagactgagaataaggagatttggggcccagttctggatcagcccctcttagctgtataactagccttcagaaatagtaccaataatatgtttcataaacccttcccttctacattcacccagatcttcacagttattctcaggtatctaattggaaaggctttaagctatgtttcacaaatgaagaatcaggcttagaaagcactataatctcactgcaaatttcataacaggaaagttgtcccatgcagactgaattcacatccctcaatgaaaatgcatggtcttttctagtccacccactgccttttgaagtgatcaattgatttactccctatggactgccagtttgcagcatttaatccattaggttgcattataaaatcatatctccatctaagttctgagaatctatgatttcctatggttattagcaaggctacagaggataccaatgtagttagcacctagggattcatggttctttatttttcctttctaggttttagataaatatatttattatctataactttttggaggcaagatcaatatttttgaagtaatttaaaaatacatgtgtacatgaaaacatatctaagtacattaatacagtcccagtatctcactttattcctgggtaagttgggggttagaaactgagatagattcctacactaaggtgaagtgtgttgccactactggaagatctggcaagaatcctaatcctttcccaaattggttggtttgtttgccttcatgtgggagtcccggcaagtgatacatttcagatctctatcactttgagcttgtgctcacccctgatctctgccccaccttttgacaccctacttttacagcattttcgggcttttggtttttttatcttttcagtattttcaagcataaaatcaggtttacaatacaaaaaaagtagctttattttttgtatctgaacttcatttttaagttcctatttcaccaagccaattccaagaaaacatataatgcaagagttctccatcgaagcttaaagcaaaaagtatagatatttgaagactaaaacaacaaaaaaagtggagaagaattgtaagttctacctttgatatcccttgtggtctgtcaaaaatataaattccctcaaaaatattttcactgataaaatctggctacattataacattgtgtctgctctagatgattagtggtgctttgggaaaaactattttataatttttatgatgataatacataaggaaagctggaagagcaacattttcagtatttagaatagacttatgccagactacctgggtacagagcctggcttcatctccttttacctctgtaaccttgggcaagatacttaccctgtctgtctgttttggtttcctcattgatctaatcaaattataaataggcataggctttccagatgtttttatggttaaacaagttgatattgataaaacatttagaatagtactggaacataaaaaagactatataaatgttaattgttatgagaaatatccttttcatgatgatcattaccaccaccatcaccaccatccacttctgctgcacagagatgcaatccaatgtttccattcttctaaagtataattattttgaaataagtggtattattttaaaaatagtgaagctctgtaataagcttcactgtttagaatatgaaataaatggtaacatacatgtgaataatgtgcatttgtattatggaatatataacctaactcagaaccttcaattcgaagacttagccaccttttctttccagctgatagtatactgcatgtatagaatgtcttatttgcattgattctagttggtttggtgtcattacactgagtatgtttccccaaggttttagattagaaactactgacaaagaaatattccaggagtcagaattagacataaattatatgctgcagaggtgtcttcttattaccacaagccaggtcagagtctctaaaatcacattcagttactcttttagtggttattaagtttcacccttgagagaattaagaggcctgacaatgaagtataataaatcttactgtgacccaaacacaattagtaattaaacttcccattaacaatcccaaatctgctagataaaataagtagaaaacttatatttttgtttactttttactttcatatttagagaagttgaaaaaagtttcacagatttcataaaaataattgcaatatttgcctgtttcattaatgtagagtcaatgcctcatttatgtgcttgggtttttcatttgagaatgagaatggaccaagaaaagggtgagactttttttttttttaacacatgagcaattggctctctatttttttaatttttatctatttttttttttttgtctcaatccccagcctctgagcccaacttgaaggtgcggtccaggttaaaacagaaagtggcagagaggagaagcagccccttactcaggcggaaggatggaaatgttgtcacttcattcaagaagcgaatgtttgaggtgacaggtaattgaggactgggcagacctatgaatgctgggagtaggaatgaaaaaaaaatagtttagaataaatatacctgctgcatattaaaagttattttgagaagaaatatttcttgaaaggaaattatattgaaaactcacaagtagttcaataaaccttgctatgcattcaccaactgtgttaaacaggaaatgaatgaaaaaacagaagtatgtgtcaatcaaggcataactagggaacaccaaagctcaccttattcttttcaggaacaggcagtccattttgggaatgccaaccaggagaatataatttttaatgaaatttgatcagaaatgagcagagggaggtccaagaagaacactttcccctgtactcagacatgaatgtacaaaatacatctgggaaaattaaactacatggaacagcaaaaccttgacttttcaacaaatttacagaactcataaatgactttatgtgtttactagtgaagtgggacttatggcaggagggggatatattgctttttatgaaggggaagaaactgtcattttcatgggtctcaaatggaagagttatttttttagctgcctgttttagtagaggggttaggaaattcaacctgaggtcttacaacacccctagttccagttgtacctggtttgaaatgaaagacctaaggctgtaagaaccaaaaatactagccaaaatacttctacttactactgttttttgagtacctacttagagtcaggtactgtatctagttgtttcctttggttgcatgaagaaagaagtggtaatctgcaaccccttttttttcccattctcaaggaaaactgtgcttataccaatgtgggcagttggtattagttctccaagatcagatcttatttttagtaagttttaaaaaaattctttattttctgtataactcttttggccatgacagtgtctacaggaaggcaatatagaggaagactgtggaagtggtggtagaaacgtgtatttaggttctaatgcaacctgaaagtttggccgataatttttggaaaataatatttagtctcctattcaatctggacaactttatatgcttatctgaagaaaagtgttagtgatttcaatggaaagtatttccttgggataagaaatattaaatctgaataataaatacaattattttactagagtttatatgtattatccaacattaaatataatcactaatttagacgaattgaattctaagtttggagttacagacttttttcccaggaaatactattgtatgtaagtaaataaaaatcttaggtttttctaatagaggtctttgatgggggtgggcagttgaggagtgaatttgttttaatgaatgtgaagaattataaacctatcaggtgtctaatgtaaatgtagataggtggtttttctaactgcagaaagtaagccccttctaacagcaaaacttctagaaaagacaaaactgaatataatgctattttattttgcttcatagtcttaatgtctgaagtcatatttatttatcccaatgtgcttttctgtgttcctgtagtctgttttcttgatcatagctttttctacacagtcactttttcttccgtaccaaattgcagtggcatttagctcaatacctatctcagtaatgattggttcttatttataaggattatgatttaccagagttttactcgaatttccttaaatttaaaatatatttctcttcttaatttcgtgagataagcactcgccctttcacctcaggaaacaatatgtattggaagagagacttgtacatttattagaaagacatttctggtgagtggacttacggatgctttggtagatatttttaactggtataccgcacttactcgaaatgtctttggaggctccggactactgacacacagctgtcttcacctgtactccttcccattgctctgccaactttcatctagtttggatgagatttgtttggatcttaatactaaatatttttagtatctagtcagagactatcataacatcagagcagttcagttgcttttgctgttatcctcttacctctatgtcttttctctcttccccatttcatagattaaagtgtaagctcttttcaaactcattccactcattgacatgggaacccacttgccatctttttttttcaaattcaagtattttctgccccctacaaaaagtcctgttcttttcaaatgttaaaattgactccccctgtgcctgcaatgccttctctgccattctccctactccaacatccttatttcattggctacccttcttcaagctccagttccaatatcatacactgagatcagagatctcagaaaatcagttgctatcttctcccagatcccatccagtgtcatgtcatagaatcctctggtacagtagttgttgccctgaattctagtgcttatcacagtgatttctacataaggaaatacttcagtcttaatatcataaaataatataaatattataatttaaaattggtaagacagaatgtttaagaaagtagtttttaaaaaatatggaaatggaaatgatatggaaatgagacattaatgagaaatcagtcatattgtaaagacgagagttaggagttgggaaaaagaagctcctgtaagaatttttaaattctacatttcctttgttaaagtaaaaccagaggtgatgattaaaaaaaattaatcaaaatataaaccagatatatagacagaaaggcagtgagcaaaatgtgtttaagtattttattatactaataatttgctcaaatcccacagtaaataagtggcaggattagaattcttacattaacctcacattctttccagtggtactgcatttctgagtagagatttaattataatacaagttgagagttataggtgttctgagagagggtaagaaaatattgcttggaaactgggtgttccctttctctgagggacatacgttatatgagccaggcttggaccttataggtgggattcggcctgcaatgaaatggaaagaaaggaggatacaaaagcatgaactggaaaagtatttggcatgaaaggagaataggtgatttaatttgactgagtgtagagtacagaaagggcaatggtgggaaataatattaggctctattttggagcagagggacatggtgtgagttatctctgtctgatccttttgcaagagtttgaaagaaaggtttgagagactactgtagtgactcagaaatatgagcagacttttgctatagttcttgacagaataacaaggccttaaactgaaatgattgtagtcagacatagatggagagatagtgtaaagatcacattaaaagggcctagtaactaattagatttgcagtaaagagagagtgaggatgactctagggtgatgaaaaaatagagatatgcaggaaacagttaatattaaaatacatacattgagttttacacatatgtaggggagcttggaaggtccagctttcagaggaatttgggctggaatttatgagttaaaggcaagaaatgtgactttcctgagataattctgccccaaaatgacatatgaagtcatgatactgagtgattttgacaagggaaatagaaaagggataaagtcacaaacttaggtgaatgtctgaatttaggaattggtaggaggaagaaaagtcaaagagatgggaagacaaacatggatgtagagaatgccactgtagaaaggatgtggaaaggaatgttttctctgaggccttcaagtgtggtggcatttgagagaacagttgcagttaatagtgggtaagctatattgccaaggcttgaagaagtgagtggacattgtgagagcacaccatttctcaagaattactagcatgctgtcagactagaggggcaattccagtgtaggaggagggcctgaagattccacctaactaatccttttaggatttttttaaggggatgggatcatgggtaagactaaatgtgtgagcgttagagaggaagagaaatgccttatatttgaaatgggaaaagagaatgtagataacataatcatgagtagaaagaaaagatgctggtggaaatcatatcaaaaatcctgtctctgaaaagcatgaggcaagatcatttgtgcagagttgggttgacaaggtgtaatgatgaggcagctaggaagattttgaaatgagtgaagtgtagaaggtggtagggaattaattagagctgaataaataatttgccaaagcttgataagatgacttctctagctatatttctaggaaatggaaatttatatttttgattaaatgttttaataaatgcattagtttctgcataagttgaggtacatgtgaatttcatatctgaagaggaaaggatgggttaaataaagaatctgtcttgttgttgcctgacttttgctaaaaggaatttcttgttatattggtatttacaaatctacatgttaaatttaggcaacttctcattttctggaaaataagttgagtagagttaaagtcagatggtcttgtacaaggtcatcagtgcaatgttgagattttacattctattgtattttcttcatataacttgaactagtatatgcaataataaggtatagccttagtatattaaataaaaaacaatttacagcacagcatttgaacaatttttttcagacctaatggaatgggtctgaacctcatgggttaacgacttgtcttttgatgtgcacaagttcattgtcttcattactgttattttctgtaatagcataagagcaagtaagaaaagattcctttcttcagttttttttttttttctcattcaaagctcctgtgaccctctctaactggatatctttacttctctagaaactgttgaacactatttagtatgttttgccatgaaaacaaaggaggaataagtggtatgaaaattcagagttactgcagaaatttttagttctttctattttgtgaaatagtgcttgcatttacatagggggaaaataacatgcccaatgttacatgttacagtaactaaagttcatctatgtatgttcctcatgaacacatttgtacttcacaatatttttcagaatcctcagtcagtagcagttctccaggctctggtcccagttcaccaaacaatgggccaactggaagtgttactgaaaatgagacttcggttttgccccctacccctcatgccgaggtaagacccttattattttgtttcttttaaaaactgaatttctgattagctacctaatacaaagtgatatttctgagttgaccttcaatatccaaatgatatttatgaattgaagtttactcagttccacatattgtaaaccaattgaaaaaaattgatatttactaactaatgtaaatattataaacctataagaaatgaactgatatttattagctgacataaataaatatcaatttttttcttacagattttttcttatttatggaattcagtaaaattgatcttatttataaatcagacaaccaaagatgtttggaaggcaatctgggcttgaaatgtaatcctcagtcaaacattcttagtgatcctccgtgcacactgcctgacaattatgtaacttactagtccctctgcttggttattggttgtgccgatgtgagtagacacatcagtaagtaaaaacaactcgtacaggcctctcagaggaagaacctagcgaggtggatttttatccatttgaactgaaaagtgatgaaaaataattgcagtattatagttgaagggtgtgaagcttcactgagcaaacattttttgagcacctgctatattcaagtcattttgcctcacagtagggatataaacatggacaagatatgaactctatgtttgaagaatgacatattaaaggatattagtttaaagtaacacatgatttagtgtaaccaatgatacaagactaagaggaaagttaatgtaaaagtcagcaagaatttgtctatgtagtttctgtataaggctatcaaaggcaagagtctgaaaatagccactcatgaaatcacctgttttgaagtcatcaacaattgactgaaagccttatttttgtttctgttattatgccttcttcactgtgcattgctctgtgcaaggagagctggtgcgttaacttctaatatataacatacttcttttgttatattttatagagtcatggtaccttgagacagaaagggactggtcaagtctcttattcttggatcatctccatagcttttctaccatgtggttatccagcctctgttagaacacttctgcttatagggagctcacttcactgtctcctgaggcaacccagttgattttaaatagttattttgactgatatgtctctgtacagctattgctctgtaatttcatatattttatacacacaaacacaatatgatatgtataataaattatttataagttatgaaattatcaggtcagaatataataagtgaaggcagaaatccagaagttgtctctgatgagcaaaggactgaagccagtaaagtcagttttgctctaggcacatttgcacacttgagttttgagctttggttttcagggcctcagaaactcaagagatagaagataaagcctagtaccaaccagggaggataatctaataggagatcctgcaaacactaagctgacaccccagaggcctgtatctatgttacattgattagttgactgcccctcttactgctgtgtcccctgccagccccccctgccctgggctgtctgatgtggaacagagcagagggcagatcctctctctcagatgtcgtaaccacaagctagtccttgtgtagatctgtagcccaaatcatataacctcaagctgttaacttgacttatcatggcaccacatttgtagttcccacgttaggagtctgcacaaagcaaacaaaaactcccctggaggaatataccttccttctagatttcaaaaatttccctcaaataagtttccaagaaacatgagcaaaatatctagatgctgtcgtttgaccattttcagctatttaaagaatagtaattctggcctctacatggtcttcaggtcccgcatctatttcttacttactatcctgttacccctctttatctttttctttatcctttcaaaaacatgatagcagatggaataaatactttgtttatatttgcagccagagacataagtggagttattgggttattagttgtagatagcatctttttgttagtgcagttatatctggatattggtccattctctgcaactatttagtaaatttccaggaaaagaacaacttggttacaattttttttttcaaaaaattttagattgttgttatctctcagtatgaagagtgtaattcttagtaactgcaaaaacagcaaaggatctgggttctaatcagtccctggatggattttgtgccattgaaaaatgaaaacaacacactagactacattcagcagcatgtatgattctgagaaatgcattgtcattgcaatgtttcagaagaccacttacaacatgggaggattttattaggttcagaaatggtaataccatactttgataatatgtagtaatagtatatttttaagaggcgagagagtgatgaacacaaaatttagcatgatgattacctttcaggggggaagaagggggaaaacatgatttgatagttactaaagaagatacatatattccttcattgtaaatacatatgtatgtgcatatagtatttagtacaacatattggaacaaccagtaagtatacatcagtgaagaaagtaaataaaagattttgcttatactgttttaatctgttttatatttctaaagccataacttggcacaaatcatctgtttaggtaccctagcttttcagctaattgttgaacatattctctcactgcaaacctttcctttcacccccaccattaaaaaaagaaaaacaaaacaaaacagagggaaatgtgatttaatggagtttaaaagggtagaggtatttcttcaggtcagtgacaggacattcacctccaaatctggaaagacgagttcaaaagcaagcagtgacttacctcataatgaattaattgtgtgcctgaactatgatccaaaaggccaggtgggcagacctttatgcactgatgagtagcctctctgtggcccagaacaaaaaatgcaaccctgatggctaacatgtggttttctgctgtattgcatttacagagatctatggtgtaattcattctcgataggtgaggagacagcggaatttagactaagactgtcagcaaattaatatcctagctttttagcactaaatgtttccacccaaactggagaaaagaaaaaaaaaatttcttagccatagttgagtaaccatcatttagaatttaggatgatttttacagatgtctcctaagattgatagtagtacgggatttcatagcaacaaatattttgggggtatgaattatttgcataatatattgcactctaaaaaaatggttgcatactttaccgtttacaaaattggcttattttactgtttttgcttaagcaacactggtaagttttcgtattaaagtagtgtatatttgaatgaagtctttattttatggcctgtaagtagaaaagcatgtcacctaattcagagcccatgtaaatgaatgggattctatcctattgtgctgcttcagaagtaggaaagtcaggctatatctaaagatcttgagccctagatgaaaacaaaattttctatcttgtaattcacatgtcctgcctaatttagataaagggaagacagaagtaggaggagaatttactcataaattgaggttcaggaaatagcacattgtagtagaatgtatgggtgttccattcagaagactcagcctgaacctggctccaaaaccggctaccttgtcatcattggtcaagttgtcagacttcccctgacccccagattcctgatctaggagaaggtagtaccgtaatacctacactagcagctttgttttaaggaatcagtgtttggaaggcaggtggtaaattgtgaagttcggaacaagttcattttttgttgttattatcagcgctgactcctggtagggaaaactcattagcatgtttgtcttcaagccagcagctctcatgtgagagtgagtctccatctgctctgaccacttctgttccatttcttctatttcctacatatgctcagtcccagaactcagattgttggagctacttgctttactcatttgtaaacttggttggggagctgaaacctcaggggtttctatttccaactccagtcaaggatgtctttacctatctagttactttattgttaatactgtgggcctgtgggttcaaatatgtttccatggatatcaacactattactttagattcagtagatttatttgatagctattttaacggtagccaagctgctggtttatttctagttgaacattagtggctgtctctgctatgctattttttaaaataaattttccagcagatacaaatgcttttaaaaaaggattctaataataaggttaagtgttctaaaatcatctgtaatgtcacttgttttgccccaatctcacatgactcatctgcctgttgtttcataatagttgttgtgacatttgcagtaaatgttatgctcccttctgagtgggtgtagagctgtggttttagatagcagcaaataaaacacgttccccccacccccaattcagggaaaggaggttgctatgacaaaataatcatttactaggaataacatgagtcaatattttaaagtaagatctttaacaaaacatcagtgcctttcaaatgctaaggaaactctgtcaaatgatctttctttttttgttttttgttttttgttttttggtctcacaatatgtctcaccattttatagtaacaccttctttggtgtccagtaaaatgaaaacttgagagatttctactgcttcaacaatttttttaattacgtggagattttaattttctatgagctatctgaaagaagagtagaaaataaatacaatcttgaaaaatcccatgaaaaccataggcaaatattaaatgattgaggcttttcttttttaaaacgtggctatgttctttttagatagcctggattcagggacttgggaccttgtaaagccaaagctgattgacactcataaggatgtcttcctgtatgccattctaatagacacacatgttacctgatagagctgggcagaggtgcttcagtctcaggctgaaggttctgaagtccagggaagttgggtgctgcccagggttacaagctatgagtgggagagctcaagtataagacacttaggccagacttcgtttcacaagtccaggctgctcctcaccaaaattctgtgtgtatatatatattttttctttttctgattctcatgcatattgtagataatttggaatatacagtaaactgaaaattctatatccacatttctgtgagctttttaaaatgtgagtgattactggccaggcatgggggctcacatctataatctcagcaattcgggaggctgaggtgggaggataacttgaggcctggagtttaagacgagcctgggcaacatagaaagaccctgtctctacagggagaaaaaaaaaaacctaacaaacattagccaggagtttgagcccaagagtttgaagttacagtgggccttgatcgcaccactgcactgcagcctgggcgacagagcaagatcctgtcttaaaaaaaaaaaaaaaaaaaaaaaaaaaaaggaaaagtaggtaattatttacataactagtataactagcattctgtcaagggctatcattgacttttttgtcttcttaagagtaagaaaagtatttgtttatcttcttctctttcccttcctccttttttccctgcctccctccctccttccttggttccttctctccatctcctttccccactttcattttccttgctcctggaggcatcattctctcccgtgttcttgtttatatgaatttttacatcatatatattttttactttgcatccatgagttttaatgggatataaatggcacaatgttatctgcatcattccattttcttgcttttatcactaagcctgtgtttttacatccagacaccatgtctttatggatgcagaagtccaatggtgtgctttcaatcaccacaaaaatccatcgtgggtgctgccgcgtactgatgccccgaggtagatgtcctggtgcccttcaatatataccatggcccatcatcctacagcttaatgagataatttctcgaagttagaattcccagcaaagccatcactgggtcatggtatacagaataattattttggtttaaagttcagcagaattgctgtaccagactactgtcccaccagcatcatatgagagtttttacctttctgaatccctgtggcagttgacattgtccatttttctaattatacccagtgtcccttctggaagacattctcactcttttaattgaaatcagtggcttaatttaaattccacataaatagctctattgagaggcataatgttccagtccatgtgttttgtattcatttgaattacaaatattatttatgagatgcccctcctattgacataacaggagagaaattaaataagattttgaagagccttagtaaaatgtgagtaggccacccctaccccagcacttggcccatttcatatctcatgtcccaacataatgctccttcctctaattacagtaattatcacaagtcaaagaattagctctttacttttctgtgcacctaactaccatgtgaattggtgttttataggacatctttgtacgccttgcacccaacaccattaatctaagacagagaagttacccgttaattgttttgtgaaggttaaacaatagccattcatacatttactatattcattttatctaaccacaataaaaatctttggttctgaaaaattttcagattaaaaccgtcatttccatgttctaaactgcaaagtattggcatcatagcaaagcactgatttaagggctgggccagattcaaaacttcttcttggaaaaatcttggctttgtctgaaaacacttgtgagctcactgcaatgctaaggtgggatggtcttccagccttgcaagaatgctagtcaggatctttcattgtgtcaggtgaatggtacccctcccaatctgttagtctgactttaaagtgtgtctgtactcaattagcagtgtagactatggctccaggtcttattaagagataaacgtggaacagatagactgctccgatcaaaaagcatagttgaggaaagctgtatttaaagaaaataattcaagggaaatggtttttcatttctctgaagtcatcctagaccttgaaagtctacataaatgctatgcctgtttccttatctgtaatccaaggagataagctaagcaatgtcccggtctgtaaagtttctatgaagacgacataccagttaagagtctttgggaagaaccaactatacctagtagatatgggggacacagaaccatccttgcttcatcaagaattgtctccatgacttgaagatcctgacatttataaagtcaccggagcttttttcttgtgccaagtcccctgactcccagttgcactcctttattcctgccatgagcttcagagcctgagtttgcttcctcttctcctccaaagccaccaccattctccctacttttctgtggttcccctgtcttccagcagtggctgcagagtcatactccctgtagcagcagctgtcaacaaatctcatagccttggtcagtttaaaggttttgttgctggtcccacatggaagcaaaattggggaaatgactcagtttcctcatcgacagcatgagcataatggtagcttgagagtgcctgtgaagaataggttagcctccaaaaaattctggcccaggacaccatggtaggtgctgaatatcagtacactgccagaggaaatggagccactcaagttttataggaaactacaaagatctgcaatcccagagtaagactgtccccaaatctcttcactgtagtcaaagccagtgtgaggagccagtgtgttgctgccattattacgtctgagaagataatctatttctccttttagtttaagtctggttcctgtgatgaggtgggaggatatcacagaaattctctctgggaaacaaagaaaactcttttgtgaggtctatggtattttttgtgccattctcccagtccgtgtcaaatcccctagtccatatcttagtgctgtgagaagcagatataaccttgaatgaatattatgccctatttaaaatgcttatttttccacacttattttctcttcaatgaatacagataagtgaataacatatccttttattttaaattactatttactgccaataagctagttaaaatatttttacttccttatatgttccttttgttcttgtacaggtattctatacttacaattttcgtgaaaagcttattatttgtatgagtaaaagagtagcttgcctttttgtgtacagcaagtatgcaactctgtctgatagctcataaaataaaattgcaaccccacacattgtaattttaaaatctttcccaacaatcttcatgctatgtcacttagacaactaattttttaaagggctgcatataaagtcaatgtaatgttattgctttcaacatacctcttggttttcatgcacaaatatctgacatgttcctttaagaagtaacaaaatctgaactagctttgagttccaagttgcaatgagaaaactccacatttaaccttgtgctcttattatgttaagactaagactcatctccaaacaaacgtatgattgagatgatgttttggaataacatcctgtgttttggtggtgcatcactcttcagtgacattctgaggttgcattgtatcagcacatgatattttccccggttaattgatatcccaggtttgtccaggggaaaatctacagctcccccaaacatgcttgacaagttattatatttactttagtcaaagcccgtgtgtgcaatatccctcttggaggtggtctattattggagtcccatatgctttttgtttgggaagaaagcagccactgtgtcatactgttacatggagtattctttttcagggatgttgttcccttggggaccatatcaggccagagttccttagtctaataagacctttgtaactcttattgtataaaagttctgggagggaggcaagagttaaacagaaaatgtaattcaagcaaccatattaggccacatgtgggaaaacatgactcttagtaatggattaaaaaaaaggtatttgttgtaaaaagcacagtgatgccaaaacgttcagggtatttcaatgtaaatgaagcctactgtggcataggactcataacattttaacatttactttagtttctgaatatgaatgatctaaaaatacaccacacagaattgtctattcataaatgtttataagtaaaaaagatgtgattactatggaagccctatatggtgatatttaatctaagatttttcttgggtcagttttcccatcaataaaatgacattaaatgaagaatcaggtgaagataatgactgtggtggcattatatacatatttttttcactgagtaatacaaaagaagtagacatactaatcagaattatccaattttatcattgtactttatcagcagatgacaaacatgctgaccatattttgtatagccagaattttataaatgaatttgcaaaaaatgaacatagatgccttttattcagattttataactatgtctttggaagaaattttttatttaaatttgacattataacttttggatatagaagtcataaaataaatacttaaaatcttttcttaattatggtaagacccattttctgaaatgagaacattttacagtaaaatttgtgatactgtggtattttgagactctcctctttttttaacagcaaatggtttcacagcaacgcattctaattcatgaagattccatgaacctgctaagtctttatacctctccttctttgcccaacattaccttggggcttcccgcagtgccatcccagctcaatgtaagtcattgcacagcatcagccttaatcaacctaagcaatatcttttcacaggggaactctctttcgtgttttatgtatttagactttagaaaaacttgacagagccagcatctccttcactgtttgctatttgctgtgttgttcaaagacattcagtctaatttcaagtcagaattatcctggttcacataatcatatgtaaacataataactaacatttgtataatggtttatagcttttaaaaaaaaagcactttccagatatattattttaatagctccacacagccatcctgtgaaacagagattacagcccacgtttttacagaaggagaagctgagacttggagagtttcaaagcacaagatcacagagccagtaagtggcagacctggaacacaagccagggcagtgctgagagctacagcttcgaaagcacagcagcatatgtttatagaatttattttgtgaatgagtttattttgggaatttaagttactgactctctggtactggcgaatatgtatctggaaaaactctctaagaaaaatattaaactattcccagaagattcaaagtgaatcaattagtttaaaagtcctgacaactgaaataggctctttcgggaagaaagcagtcactgtatcatactgttacatgaaggcctagaagtgattccttgttctggactctttgccttaaaatttcctagtactcagcagagaaaatggaatactagagatctctttgccaaagcagagctaaacttgaaatgttattgtcatactagcagaagatggcaataattattctaggcatattccctgaaacagtgtcaattttagttgtaaaaaatgtgtgggccttatccagaataattcatctctgaaatgttagttaattaaattgtatatatacaggggtcatatgatacattaggtttagagagaaatttattccaactctcatcaccagtttggccaatctttaccttcaagtcttccactgagttgaatgtgtcaagttcacttgtatgttcaacacatagtttcaatgcgtattttaaaatcaacctaagagatattatatctggtattgtcaatagactataatgtcattttatgtggtactgtgttcttataccaatgaggaaaaaacaaaatttggatgttgtcttatatctggggattataaaagaaagcattgaaaatacagaattcagctatgctcttaaaattccacatgaaacatttgtaaatgaaaaacaaaaaaaggaattaggaatgaaactaaaaataaatattcatggataatattttacagttatcactaattaaaaaatatttttccttctctatttcctgtctcttctaatgataagtaaataccaacccaaaaacttcttatgacacatgaataggcattttatttttacttatttttgtatgttctaagccactcctctcaataactcacacatggaccacttttaatgtggtcagggaaaattttttcccaaaggaccaagtactaaagccagaccagttaatgtttcagaggtaatacgatttggtaccattggatgaataaaccaatgtggtttggattaaagtttcatttttctttgcttccattttggtgtggatgaggccatcacaattaatttttcaagtttagcattgctttgccaacgggatttgtagtactccatttctacattgaatactgggaaattttaaggaaaagaggccaggacaaggaatcacttctagattaaacattgcattgacttactgtgtgactcagacaaaccacttacctctttgtccttcagtttctccattgctgaaaattgcttcgcctccctggtgcacagcaattttgaaagatgaaacatgagttttgaaaagaaacatgccacataattttgaggtattagagtcctgcttttgtaatagcaaaatgaccaccattcattaaatcctttgaataggataattcattattgctattgatgatataattattattgccttattactgtgttatcatacatttcaagttcttaatagcattttttgtagtttattatacaaaatatctagagtgtcattttcaatatttagagatttgggtatctgttatgaattaatataaaatgtttaaatcaaatttctgcatatttttacctcctttcattgggttattttaagaatttaatttaaaaaattaaacattggacacttacagctctgtgaaattattagaagccatgtagagaaagggtaaattgttccttttgcttgcaactccaaaattacagtccatcttatctccagcttcttaatccccatgatatagtctttgaataaattttacctctccagtatgcctttaacttaaacagtgtataaaatattttagaaatgtactttccacttattaagcctgaaataagcattttttgtttttttattgacatataaaaggtacatatatttgtggtttacaacataatgatttgacatatgtatacatcgtagagtgacttaagctaattaacatatgcattgtctcacatacttattttttatggtgagaacactgaaaatctattctctgagaaattttcacatgtacaatatattgttattaactgtagtcatcatcatgtacaacagatctcttgaatttattctttccacctaaaattgtgtatgtagcatcacttctgattttaattataaaacctttttatgttcaatacaatgacaatattaaattgtcttcagtgctccaaccctatttttattccttcttttttgaactgagttagtttaaaaagtccattttccctgctcagccattgggtaagatggggcttttgttttgggaagctacagcataggaaacttgtctaatgatttagagacccagtgacccacatggatgaaagaggattaacatctttgttatttctcaacacaggcttcgaattcactcaaagaaaagcagaagtgtgagacgcagacgcttaggcaaggtgttcctctgcctgggcagtatggaggcagcatcccggcatcttccagccaccctcatgttactttagagggaaagccacccaacagcagccaccaggctctcctgcagcatttattattgaaagaacaaatgcgacagcaaaagcttcttgtagctggtaattcattatggcaccatttgcaggtcattttagggttttattttattagtgatccaggataatgtctcttttactcaagaccctgatggagatccacagtgctatacaaaagtttccctgatacctggtactgtgggaaaggctatcatctttatttattccttcagatccacttggggtaggaggactcacctcatttaacctttattcataccagactaggctgtggtgagtcgtatggtcagatgcgtacctgtccaatgccttgacatttctctcttcccacacctgacctattcttctgttgtttgcctggtagcatcactaattcactaattttcttacagtttataccatgtatctgttttctttggcttcttatcttttcttaaaattgtgtgtgtgtgtatgtgtgtgtgtgtgtgtgtgtgtatacacacatatacatgtattttttttttcaggtggagttcccttacatcctcagtctcccttggcaacaaaagagagaatttcacctggcattagaggtacccacaaattgccccgtcacagacccctgaaccgaacccagtctgcacctttgcctcagagcacgttggctcagctggtcattcaacagcaacaccagcaattcttggagaagcagaagcaataccagcagcagatccacatgaacaaagtaagcctccaagccaagtcaaaatgttctaaccgccagtttggaaattgggtatctcttcactgatatgggtgtctaagaggaatgttgatgggagtcacagcaaaaaggatgtgatcatcctaagcctgctttcttggctcaaggacaccatcacaatatcagtgttttaaccaccattatgttcataagacatttgtagcaaaattgagatgatacattcacaagatctttttatgatcaggtatatattttggtacacaagcccatacgggcatatgtatatggagcctcattttttagtgttgcagaaaaagtttgaggcagacttgaatgtggtgtgttgacatgtcaaaaagtttgtacaggtgatgacagataggccaagattagccagtaaggcacttctcagcaacttgtatgcatctacgttacatttattttgcgaatgccccacttcattccaataagcgtttggagtagtttctcggaaacttgtgatcatttcttcctggaagtcttaatgttgctaaaatagacagcggatgtctgtaccgtaccacatccttaggagctctcctgctgaggcaactacaaagaaacagtgattgcagcataatatcagacaggccagtaaaggattttctatgaattcgtaagcaaaatgatattaaagaacctggtctggacagtttttccactactttttgctgtggtaggcttaaaaaagcaccatcttctcattcctggaaaattcctggaaaatattaaggtcctgagtattaaaattctattcccttgcctttgtgctgtatcatctacaagttatgttacagaggcatgagaggcatgatattgcaaactgatactttgtttactgataaatggatagctaaaacctggcttagtaataactttgttgtactatgatgtaagaaacaaacaaaacaaaacaaaataaactctcatgggcagaggcttaatcatctttctaacggcagtaggggaaagggatcttcatcacttgctggttttatggcaagtgttgctggagtttttctcttcttttggcctccatcgtaacaagggcagagccatgaaggaagcatggattggataccatgcttccgaacagaaagttttccagcctagcccttcgctactctcaaagtagcaaaagtatgtgtgggattggggtgctagagatggggtggctggcagggacaactctctctctaaccttttagtatgcattgcagaccctttctgtgtcattagataatgcctattttattgctgtagcacttctctaaatttagcaaatatttcggtttcatatcaaattattttatatcaaatcagtatcttcaggagagagccaatttccttctctgactaatggcataatactcactgacttgtatgtgactctgcatatgttttctatattatggtagagttaggtttgtttatttgttttgtggcctttcagcacaacttaaaattattaggtattcttgaaaaattgtccactgtttagtgcaagaaatgtatgtgggagggaagattagggatcgtatttttttgccatatagtgttttgatctagaattaggtttgtttataaaaccagtattagatagtagatagacttttctgctatgcttggttctatttcctagaaacacatggatgtatatattttactatggtaaagtaggtaaattactcactttgaaattgtgatccacaaatggtttctatgaatacctttaagaatattttggaatacagttttttattaactaattgccactgtttcagattcagatggtgtgctaatatcagaatctttccttttcagtatcaaactcgagattttgacaggcgaatgctaacctcagtcacactggataaaactcagatgaaaagcaggcatttgcattttagcaatgagaaaagcaaatcttatcagagaccttttcccatgtggagctgattcctttgaatctgttaagaattcttcccagaattagaaacaaacctatacttttaggtacatgtttgtacagtggtttgattattaaatcttgtcttaattaggcaaaatgaagaccagaaaacttcaaagtccaaagctgatctttatatgttaacctctctcagcttgggtgtttagatgactcaagcaggtcgccagttggcttttctccaaggatgtattccatatgtttcatcaagttggcatattcacgttgggtattctccagattttgaaaatattttacctgccctcagttgtctaaggggacagagaggaagcttattaaagaaaatatcaaacccatgtcctatcctgaaatattcacaatagaacgcttaagaagtgagtggctactgttcacctgcttccgtgacgtgacaaggatgtttatttcacattgggtcagattcataacttagatgcccaaagctaacatgtttctgtataatatattgctgtatacttgatttaaccatttagaatgcccattagtaagaaatcaccacagaaattttatcatttttccccatttccatggatgaacctttatgaaacccattcatactgaagcgatggtccttactcttgagatacttatagcaggaaatacaggcacacatgaagatgttgacatacaaatgacatatttaaatatatcttcttttatttcctttttatgattcttttttgaggaatttagagaaacaaaaaatgaagtgggaacaagaaaatataagtaggattatttctaaacctgtatcagattaaatatgatgggcttcctggtataaaatttgtagtaatgtgtttgaattactaataatctttagaagaattagaaacaaagctatatagttttaggggcatgggtgatgcaaggattgacttattaaatttgaaagagtttttcatatcttgctattattttaatgtgtttataaaatattcatgttcagtgtaactacataatgtaactgttattaatcatacaaaataatttacctacttgttgccttatactttaatatcatatttgggatatttgtgggatagttgtgtgttctaagattatttgcctcttacagttacggtgtaagtgttcaagggcttagcagaaatatccctggaatgggcttgtatagtatttatactgttatatctgccagtaaataatggggaaagtcagaaaggagagtgctgggctggagaggaaaccctgtgagaatgatttatctctgctcatgagtttgaatattctatttttcactgaaactgttttgagaagtttaatcataaagaaatcaaggcttacaacatttgatcttttgttttctgagacattttacaaatcagaaatgcattaaacaggttctattgctaatatatggtattaatatttttgtgcaatgatgtcattgcacattcatttatatcatttttccccaataccatggaagaaccttttcaaaaaatcaagagtttctttataccagcatcaagggaagactgatgcttttgccagtacaccttgcttttctgattggaggaaaaaagagtttctaaagtagaacttccctcaaatacaaaatatcaaacaaaaagtaataaggtattggtaattttctcctgggcccatttcaagtttaaatattaccacaggattttttttctggtgaaataaaactgtaattgattaaaacagaatacgtaacagttgtttagacatactgatgattttaaagaagtattctaagcactgcctaaaaaataaaagggcaaatctctagtcacttcactatttgaatgatatatagaaaattttcaaaatctctttaggcatttttgttgtgaggtaatttgacatagatctctgccatgccccatccccttgacaacattattctttatttctctgttatagtattaatagaattgcactgattcatgcctagcagtttctattttaactagaatattaatatctttattaatatctgtttttcatattcattccattaaatccataagagcaggaattttaagaaaattcatactttgtttagtagttactttaatgaattattaatctatgtatggatgcgttaaacaaatcattaaatactgtgtgcagacacagttttaagcactaagaaaacaaccttcagtgtcctcatggagcttataggatggggagcaggaagtgaattattgaaataaacagtaatacaggccgggtgcaatggctcatgcctgtaatcccagcactctgggaggccgatgtgggtggataagctgaggtggggagttcgagaccagcctgaccaacatggagaaaccccgtctctactaaaaatacagaaaattagccgggcgtggtggtgcatgcctgtaatcccagttactcaggaggctgaggcaggagaatcgcttgaacccaggaggcagaggttgcagtgagctgagatcctgccatggtgctccaaacctgggccacaagggtgaaactccatctcaaaaaaaaaaaaaaaaaaccagtaatacagtgtgttaagtattaggaaaggagacataagaaagaaaactgatatctttaaggaaataaaatttgagttaattacttctctggattatcttgttcttattatatctcactccctttctttttctttcttgcttgctcgcttgttctcttgctttcttcctttcttatatgctctgtgataaatatcttgtgcattcctatgactggctatcagccaacacttttttaaaaacttacataaatcatgagatgatatcttatatatgccaaggttcggtctagatataagtatttattatatatttattactgtgatacttaggcattttgacatgagtgctattttatcataataaaaatatatctaagacaagaccagtaaatgtgaggtcaagcagatgtactgtgttgcccttattaaaacaggtagatgttatgtttatgttctgacaagcaaggcatgaatataattatgctcaaatgctggatctgagcaaatggagagctttcattagcttttggaagagaatttgactgtttatttgagtagtatctgtattattccttttttgacataattttctaacatgaatgttatatattctctgaaatcctcttgatttatacccattccctgtccccaaccctccatccacagtaacctaagagagtatattccttcatgcttgtggtcacatacaaacatagcatgcatgcctgtgtgtgtgttaatgtgttgccttgtgaagtgtccctgaaggcagttataatgtagaactattttgtgcactattgaaaaaagtataagttttgagaaggagattaattagaagaacaattctttacatgtgtctgtattccaaaagtttacatttttttaaagttatacttcatattctcaaacagatactttatattagctgtattctaatgtaattctatccatggcttacttgtaagcaaattaaatgttaagtataattacacaagggccatttacccacttttgactttttgctgcacctacttcttctagtgtacctcttcctccccttgttttaggcactgtgcatcttttcagcaccttctccatagataccttagggtagggtcatttaaaaactatcagctcacttttatatggaggatctactataagctggactccataccagaattcttacgtctatcttcccttcaaccttaacaactcactcttttttagttcaagaaaattaattttacagggctgaagtagattgagcaaggtggcagggctagtgcagagctgaaatcctaacataggttgtatgacacaaaagcctgtccttaatcatttgtgcttatgattacagtcttattttatgaccaagcaggaaaccggcttttcctaattttatttttgtctaaaagtagaaaattcacagttaaaaacaaggcaaacaaacattaaaaaaaatagggtgatcttatttttcttttgcaccggtttagatttgccacgatgaagaaatcccctttcccagctctgcctcccaacttcacacacattgacctccttcaagttactcacttggcagtctttgcacgtggacctgacggtgagacattcagatatcctgttggattataaggctttccaaacggtgcagagtgaatgcagtacagagccaactacagccaggccacatttcattcctttctcgcatgttgtcacattgccgttgttttagattggacaaacatcttctcacggaagttctgggcaagcctgaagctggaagttaccgacttcatcaggttcaactgaaatgcaaatgttggcatctcatctatgggtggttggaaaatgccttgttttatgttttgaaaaatggatgagtagaaactggaactgggctttcatttaggaaagtaggcattagtgttgtcaggtttaatttctctccatccatttgacagcttgtttccatgcagggtcttttaatcaccaatttaggattacattttgcccattacatggatagtatgtccaaaaactttagcaagcattgaaaggcagtcttaattttataacagtaaaaagcctcctagattatttatctatctatagaggtttataaaagaaactttgacgttacccttaaatcgatgttattctgagataattggcccaatataaatagattcttttaaatacgtagtactaggtctccaaaaaaatccacttatagaataccagcttatatcatcacaaggaattcatatagatgtatttcactatataattacaagttgatggtttctaacatacagaaagtggcttgttgctttattattagatgtgatgaaatcctgtgtttggaaaagaaacaaaatgaccatttcagtggattaatgtgcagcattcataaacattcccagtgctgctttcataacttggagaccaagggaagggacctagacctttccttttcactctgcactgttaatctagtcagagacgcttttattgaatgagaaaaacaatagttggacatgactatgaggtaagaaaacggggggaagaaaaatatctggggaattaaaccacgtgaattgtttgattgatgttgattccaggcagttcaaagggaaagggaagctaaataatttggttgtttcccaaccttgacaagtagtttcatgtgacagaatgaaaaaattaggtcttgctaaggaatttttaatatagttaagtgatttgtagacatgaaaactgccagtgggtagcagtctcttttttttttttttgcatattttggtagcttgcaagttcctggttttagttcttttttcctgtatctttcagctcttcctctaactacttatgaaatctgaggaactacagtgaccctgaaatgtcatctggtctagagtattcctcttcctgcaggcagaattgcatccagagctattctctcatatcttaaatgtactgctgctctcttgctattaacctagttgtatcagctagcaatataaagtcctgcaacagtctccggtcatggaataattgatgatgttccacaaagacttatctattaacaaccattacacttcattctggaaatgaaaataaagaaggcatgttctttcccttgagtggctcaaagacctgtaaacagatcattataatcaaatatgattctatcaaatgcatagctcacatgaattgcaaaatctatcatcttgatagatttttcaagagaagtttctgaggtcttgcacaattatttgttttgcaatattggtcaagatattcaacctttttgtttaataattccataaacagcaaatttttgaggtttacagtgaggattacatgagagaacatatctgaaaatgctttgtaaacatgataagcaccactaaaatcttatacagtatttatattcttccaaatcttagctattgtggacagtgctgtgacaaacataggagtgcagatatctctttgatatactgatttcctttcttttaggtatatgcctagcagtaggattgctggatcatatggtagctctatttttagtttcttgaggaacctccagactgttctccatagtggctgtactaatttacattcccaccaacagcgtacgacggttcccctttctccacgtgctcacctgcattcattacgggtccatcttttggataaaagcattttaactggggtgagatgatgtctcattgtaattttgattttcatttctctgatggttaatgatgttcaacattttttcatatggtgttggccatttgtatgtcttttgagaagtgtccattcatcttttgtccgttttaaaatcagattattagatttttttcctgttgtttgagttccatatatatcctggttattaatctcttgtcagaggggtaatttgcaaatattttctcccatcctgtgggttttagcttcattttgctgattgtttcctttgttggtcactgtgtttaattgggtttgccctgctttccagtttaccaaagtaaggaattgatcaatgggggaaatggcgatgtttatgagttgggagagagtgattcattggtttgagattttgtctattctgagacccattcccaaatcatcaatgattagcaaagaaaataaggatgcctttccacactgtgcctctattttctactcttaaagagaaaaggaggaaaacttgggcagaaagtatactgtcacctgaaggatcctaaagattatcagggaaagaatcctattaggtaatttttaaaaggacataaaattatgcagtgctataaaagaagggaaaactgcttatttttgtcctagttaagaacactgccccaacccctgccaagaaatcttggttaagaattccacactcttgctgaggattgtatgttttgaaaattcagtcttcctctttctacttttgctccctaaatccagtcttccatagcagccagaatgatcatttcaaatgcaaaccaaatcatgttatggttaaaacaccctacttgctccctcttgtttgtaggataaaatccaaacacttttacatggcctacaaggctgtcatgatctgattcttgcctcctcccttgccttcatcatctcctcccttccctctctctctaggctccagccacactggccccctctcttatctttgaggaatctccttccacctccaggagctgcgccagccactattttgtgtggaaggctcaacctccacgtcttctcacggtttgattgtgttttggggtctgtctcagctcaaaccttacctgttgagaggggtctttattgcccatccaaacaagagtaaacacaaacacccacctgctcaccccttctttcagctccctatcacttcgagtttcatttttcagttgctaattttctgcctcccctactgtgtgctgggatcttgcttgattgacctttcttttcctaaggcctggcatatagtaaacgctcaataaaaaattattggaagaatgaaaaaatgggtgggcaatgttctcaaactagttggaacaaaccttcagtttccttcccagaagggaacacttattgaagttactgaaatattagcaagttttgagaaccagaggaaaaaaaatttaattgcaggcattgttttggacaatcatttagagttaaaaagatgaagcagcatttattaaaaattcacttcatgctgagattaattttgaacctctttaatattgcttagaaatggtatttttcagtttagacttcaatttgtgtgaataatgaaccaatatttagaaaatctttcttctcttgttatttaattttggttcatctgattacttccctaaaatacacagaagcaaaatgacatggagtattattttggcttgaggttggagttctactccaagtagacctctcaatttgaaagccctccaagctctgcatgttgttttttgagaacagttggtccatacctaatctatttgtgaattcaaacagaattttatcattatttttaaatctagtttccttggagcttaagggaaatgttttattttccaaaggaagaatattacatttatttaaaagaaaaaaaaagcaaaaaaaaaaaaaacaaaacaacaacaacaacttctgctattgccattccccaagtacaatctgtcttaaaatctgaggcaaaataagaaagtgatgagttgcattgaagttcactttgcatagtttaataatcatattcaaacacttgtatttaatggtatgttgacaatgtcagaaaatcagatgtttatgaggaacagatttattcttacatgatcctgttcttagttgatattttgtatctgaagatatttgttgggatgcaaaggatttctgtgggaaacattaaaattatagaatttaagcatattttatttaaaagtacatatgcttatagagacttatagacttgtatcaagttatataatttacacagaggtgaacttaaagtgctaacatataaacattagtgacagtctttaattattatttagtgaatttttcatcatgtgccaatagaatatatgatgttaaacatggaatgtgagattctgaaattaaggagtttgctataattatgacctgagcagggattgataagaattgaagtttagttgtaatccttgaagacttttgaaatttggataaattacgatggtatctggcacacagaacaacatctgtttgagtatatgtaagtgtgtgtgtgttacaaactcagaatggtcataggctgcccgtggcatgcttagtgttcggcccaattgctatacagtagcacagagaatagagagacagcctgacagatgagtatgagcacacacaaaaggcaaaggagaagctgtgcagctgccctcttcttcatctctgctgggttccccactgaagtaactcacctggtgtcagacgagtggcacacggtgtgttttacagatgaggcctcagcagagattcacacaggcttgcacatttatctgtcccacagatgtttcgtcttctgttatctagccaacaaggcaacagctcgactttgctaggggatcacctccagatgttcaaccaaagagagaccctgccaccccactgagagtaagcagacatctcctcactacatctggggccactcagtgacagtacaaattagaaaagggttagcccataccagctttgcagtggtcatatttgtagttgagaaacacatagaaaacaaattccaaatactcattttcctagtaaatagtcggaaatttacaaatagcacaaagtaacttttataggaaataattcaaatctggcaggcaagaatttctctgtgacttttgtttgtaagttttccttgctgaagttaattgaaaatttttccactgtgacaaatttgactgtttaaacaaaaacagccttagtcagatacctaaaataagaagtgtagattaactccctttctgcatttatattttgcaacactggcaccggatgtcccatttgtcttttttgtattttgtgaatctttacaaagagcatattttattccagagaagatgaaaaacgggtagttattgctcttttagacattgactttgttttgtaacgtaggagaaaaagtgtcaaagcattgttactaagcattaataattttttcagaaacttatgaagctccaattaggtgttatgcaatgtatcaggtactaggatataaaatgatgaaaaacatatagcttatgccctatgagatttatattatagtctgggagataactatattgtaaacaaagatagcgatatgatgccagacaacaataaggactctaaagaaaatatattaatgagataataacagaggtaaaatatgataagaaggagccagtcaggcatgtaaagatttgagggagtagagagagcacggcgtagactcaggccttgtgggcgaacaaactctgcatgtttttattcacggggcaaccagaggccagggtagctggagcatgtgagaaagagagaacaagatcccaactaaggtcggagaagttggtggtgccaggttgtcgaaagtctatggaccatggtaggaggtttgaattttattataagcataataggaagtcagtgggggattctaagcagagaattaatgttacctaaattatattttaaaaatcattattagagctactgtaagagattgtactgttgagggccaagagggcaatcaaggagcccagagtagggcctttgggtagtttagggtgaaaatgatagtatttaggagcacagtagtagcagcagaaatggagaaacatgttaagataaagcctttatttttggaggttgaattgccagggcttgctcacaaattaaatgaaaaagatgagtgatagagaaacaaggataaatcccaaatatttggctcatgcagttgggtaaagctgtttactcaaatgagaaagattgggtgatcaatacaattgggttagatgggaataaaggttatttttgaggtgtttaatgtttatgatgcctattagatattctagatctaagaaaacaagttaagtacgcagctaactatgcaagtttggagctcaggggagagattggaattgctcctattaatccagttgtcatgagaatatatagctatttcagagcaaaatgtggagtagaatggtataaaaagttctaggtttctactctttttttttaaatcaaattcatatcttacaatcttagagatgacttgtcttttttgggcatgagattccttatttaaaaaataaggtttttaagaatgttattaaaagattttcaagtccagcattttatatctatatgttttctactcagaagttactgttttatatcaagaaacatttcttttacaaaccatgaaggaattctgctcttggaaaaagatcacaacgttatttattctggcttttttcttccccatgtttcctttgatagatcagaagtgtagatgaagccaaagaaactgaccggaacaaatagaattatttctgtattgcatatcaaaaattgttatatatactgtcatatgcatatctgtgtcagtgaggttgtaaatactgaccagatttgattaatggactgaacaatgtgatttctgggtacttcagtgacttcacaggtcagatttcagaaggtcttctgttaaaatgtacatataatacgttccatggaaactcaggggtttgttaatattagagattttccttaacttgctaacgatgggaaattatattctagtaaattaacactcagtttgtctggtctttggctgcagtggtaataccagtctcttattttcaaaaatgctatgatttttgtgttatttccctttctaaaatgtttcacctttgctgccacctattaatatcatatttaaatggccactggatttggcattattgcagtcattattgaccttaacaagagattttggttaaatggtgtagaggaaagcctaaagagaaggggaaaagagaaatgaagacagtgaagagcgataactcaagaaattttattgtgaagggaggtatgtaatggtgtggtgggggaggaggtcaaggaaagttttagttaagatggatgatattgctgaaagagtactagtgagagcattccagcagagaggggatctgtgtgatggaggacacagtggataattgcaggagtggaagggatccagagtgtaagccaaggggttgactgagataggagtgcagacatttcactcattgcaacagcaggaggggtggatgggatagcttcataaatgtgctggtagcaggaggctgagtttctcttctgatgcttccattttctcaatgaaatgagaagcaaaggtatcagcagggagtgaggaaaaggggagaatgttagagatttgaagggagaggaggtagtacgagacggtgaaagtaaattaactagaaaagtggaatagggttgctaggcagcactgagaccccattggagggtgtagtcatgaatttggagaacactcagcatgatcgtaatttgtttgtttgtttcctagctcattcagctgcttgggtttggcagagatttagtattgaccaaggttagaagtcttatttgtccagtaaaacccatattgaaaggagcaggagcactgatggtaatataaaggagtggttttcaatgaagtatggagcctagtccagaaaggagggaagtgagcaaatgaaggggacaatatgtagtgagaatgtggcttggaaaacccactagaatgaggaatggttggagtcagactattctgagaaagagccagaagaaaggaatgatgtttgaaattgagatttagagtaatgcagggttactgataaagataggtctcaggtaaggtcataatgttggggaatgaggtcaagtggaggacaaaaccattggaggttaggaggttgagacactgagaggccatgttgtggccagggattaggaaggagaagaatcgcaacagaagagtctttttacttggtgggtgatatttgtggcttcctcttagttattgaatatttcctgtagtgtcagacatccagaagctagctaggttccaagtcgcgccctccctccccctcaccccccagtaagcagggacttccgacatagcatttcctggacactggctctctggctaatctttcatccggtactcagttcctattccatgaccacacatcccgtatagttcttctgctatcctcaagaggcccttattggcaggatcctttgaacacctctccgggtatctacttgaatccttagtgtcattggtccactagctctactgagcaggttcccagtaacttttcagctgtgctgtgttagtgagagggagagtttctacagctcagtgagcatttgtccagtcttcttacatttggtttctctgatgggctcctgcagcctccttcacctggcttgtatcttttctcagataaatcccttcttcccacaagctcccctcacctgctcttatttgtagtctgaggtatgagtaagggttgcagcactgactgatagtctctgtccctctctctctctgaataatgagcggatgtttgttacccagtgtccttattcctggcatcccagccaaaactaggaatttttctttaatatcttgctcgtttctatgctgttgcatattctttcttaaacagccaattaaatgggttcctacaactttgtagtcaaaatttaggactataatatggtctcttttctccagaatctcagtagtgtccaaagtactatgtattaaagaaaagaagagctgattagtattcagaattgggacaaaagtcctgcaaatagtttcctaaaatatacttaaagtcatctaaaccatgagtaaatgaatgtcctccttctcccgactgcccagtaacaatggatgttagatggtaggcacaaaggaaattcatattcaaatttcttcattgtgatatgagttttgattggtatatgttttcttagcttgatcttgtctgacttactttggtgatatttaggtcttatatgtgtttttcctaagttatattttatttctctagattcttactcttcacccaaatatattataaattgtatcatctactttaacattatctttcggcatgttcctctggttctcaaactccactagccttttggtgacttagatgcgctggtctccttttccaatccaaagtccccacagactctgccttctaccagaaatgctccccacccttatttccgcccctgcttcccacccctcacacatgtaacttactcctttccatccttcattctttgtgtctaaacctaaatataacacttcctcagcttaactcccttaacaatccccatttccactgctatgccaagcagtatgtgctcttataacaccttgtgtttctttcttcaaagcattttgtcatacttgaaaataggaataagtatttgaagctttctaagacattcactaaaagctccatgagggcagagcagtggctatttttctaatgcttagcatggtgtcttgaacatagttggcactcagtaaatatttgttgaacaaatgaatgaaaattcctaataaatctacctacagtgaaatcaaaggactttgttagtgtgttcagggccatttgaggttgcgtggactgcaggaaagtctataagcctaaagaggctgaggtgtccatctaagtctgagtacttaagtattcacattttaaaacatgtattttgtaattatgtgtgagtgggaggtaagcatgaatttgacaaagaaaaatctgcattcatgtttatggtggtagtattataagtgtgctgctagttacaataattggcatgttgcttacataggcactgacttagcagaaaacttagcaactcttgaaaacacagttcaaggtctgcagatgatttggtccacagggccactgtgaaataaaacaaatgaccagtgtgagacaaaataatcttgagactttttccccatttattgagctttcatgttatgatattttgctattgtttaagttaggcatattgtcagttatcttttaaaatcattaagcagttaattcattgacttctgaaaactaagttcaatctaatttataaaataaataaaatgtctaaataatgatttccaaattaaaaaataatttcctgattcttttctaatatttaatttccatttgagtctgttcataaaacatcttattgttaattttttttaaatcatacacctctttaaagttcagaatatcaaaataaatatttctagttcttacaaatatatataagaagatgctttttcatttgactgtcgtttctctgtataggtacaagaaaattagacaaagactattagcatttgtgttctggctttcatagcgtttaacattcgttgaaaaatgatattgacaacattttttatcaccccctttatcttttgagaaaagtattattcccaggttcaactttcaaaacatgtccttttgaaagtttcagggtttccatggatagtttatttacctttttctacaccatgttctaactgcattaaagagtgatccattaaaaagaaaaaacaatccaacacttaaagaccttattcactgcctactggacccatacaatatggaataatgggactactttagatttagtattactgaggaaacttgttgcctacaagttcattctgaaatttatgttcaatgattagaaatcacagtgtatgagttattagaaatcaaagtgtaatttgcttctctgttaccatgaagaactactgaattttgaacccctgaacactctcttctagctgctttcgaaatctattgaacaactgaagcaaccaggcagtcaccttgaggaagcagaggaagagcttcagggggaccaggcgatgcaggaagacagagcgccctctagtggcaacagcactaggagcgacagcagtgcttgtgtggatgacacactgggacaagttggggctgtgaaggtcaaggaggaaccagtggacagtgatgaagatgctcagatccaggaaatggaatctggggagcaggctgcttttatgcaacaggtaataggcaaagatttagctccaggatttgtaattaaagtcattatctgaacatgaaatgcattgcaggtttggtaaatggatatgatttcctatcagtttatatttctctatgatttgagttcagtgtttaaggattctacctaatgcagatatatgtatatatctatatagaggtctttctatatactgatctctatatagatatcaatgtttcattgaaaatccactggtaaggaaatacctgttatactaaaattatgatacataatatctgagcagttaataggctttaaatttatcccaaagcctgctacaccaattacttctaaagaaaacaaattcactgttattttgagtttatgtgttgagatcagtgactgctggatagtctcccagtctgatcaatgaagcattcgattagtttttgattttttgcaacatctagaatttaattttcacatcactgtacataatgtatcatactatagtcttgaacactgttaaaggtagtctgccccttccttcctctctctttttttagttaagtagaaatgttctggtcaccatgccagtagtcctaggttattgtgtaggttgcaattgaacatattaggaatacaggtggttttaaatatatagatgcaaattgcagcactactttaaatattagattatgtctcacatagcactgctcattttacttttattttgtgtaatttgatgacactgtctatcaaaaaagagcaaatgaagcagatgcaaatgttagtgagaagtaatgtgcagcattatggtccaatcagatacaatattgtgtctacaattgcaaaaaacacagtaacaggatgaatattatctgatatcaagtcaaaatcagtttgaaaagaaggtgtatcatattttatattgtcactagaatctcttaagtataattccataatgacatgggcatataccgtaacattctggcaaataacaattagaaaagataggtttaacaaaaaaatttacttgtatataatgcaccttcaggaggactatgtcctttgatgctataaaatacaaacaactttgaaggcaacagaagacactgtttattcaagtcagttctttgtcaggttcctgctgttctcctacagaaaagtgattctgtgagggtgaacaggaaatgccttgtggaaacaggaagtccaagtgattcatgtactgaggaatgtaggaaaaaaaatctgaggatagtgctttactctttctgtttttaaagggcactctatgaattgatttattgtctaagaaaataacaccacaagtagggaaattgttacggaagcttttcactggaacatttccttcatattcccttttgatatgtttaccttgttttataggtttacttttgttaagctagttaaaggttcgttgtattaagacccctttaatatggataatccaaattgacctagaatctttgtgaggttttttctattaaaatatttatatttctaaatccgaggtatttcaaggtgtagtatcctatttcaaaggagatatagcagttttgccaaatgtagacattgttcaactgtatgttattggcacgtgttgtttacattttgctgtgacatttaaaaatatttctttaaaaatgttactgctaaagatacattatccttttttaaaaagtctccattcaaattaaattaacataactagaagttagaaagtttaaaagttttccacataatgaaagtccttctgataatttgacaaatagctataataggaacactccctatcaccaacatattttggttagtatattccttcatattaaaatgactttttgtcagttgttttgcattaaaaatatggcatgcctaagataaaattgtatattttttccatctcataaatattcattttcttcaaagtcttttttcaatctcataaaaaagggatagtgcatcttttaaaatacattttatttggggaggaacatgtggctgagcagacttttgtataatattacttcaaagatatgtaatcacaaacaaaaaaaactattttttataatgtcatttgagagagtttcatcagtacagttggtggacgttaattgtttgaatttgatagtctttgaatttaatcaagaaactacctggaaccagtgaaaaggaaagctggacttaaataatcttagaattaattgataaatgtctcttttaaaatctactgtatttattataatttacacccttgaaggtgatctcttgttttgtgttgtaaatatattgtttgtatgtttcccttcttgccttctgttataagtctcttcctttctcaaataaagttttttttaaaagatcccctttcatacacttggctttgtgtaaacttgccgtatttaatcgaagttgaagcttgcacactagatctcatatatcaaaatacattgccagtctttgttgaaacaagaaaataaagacattttgagcagttacatctaataccattaaaaacaataaattcagcaataatgactttcaactatttacatccaaaattttcaaatagctaacacatgtaaaatttgtttcattttccttttgccagtgtaaactttttcatgatatgttatcatgtttggtatttaaattaaaatgtcaacttctaaatataaaactttatctaaatagatgtcagttcctaactttgctcaacttaaaaaattatttttaaaaagcttaacacaatcccttgaacataacaagcactcaataaatattaaaatgaataatattccaagtgtcgtaataattatgtctattacagtgagatcttgaaatacaagtagaaagtgacagcacataaatttaaagagaaaatagtaattaaatgatctccccttatatggtaacaattattataataccagtgtgaggaataggagcctgattcaagtaaaggcaactctgccgtattctaagtcacatcagtattgcattagagtatcaagaaatctggagctataattattgactgttacagaatggattatcattttatagtgccataaatttgagaatacagtcacaattctggaaataccattattgctaattataatttcctgaaatttgcctttgaactataaaattacaggactaacttggtaccagagatcctaaagtatgagttagagaaatcaattaaaaaatggttttatagtgtatatctgatttctgaagtgttatatagggtgagttttaaaacaaagcatcaatccagcattagaaaacttttcattagaaaaaatagttattgccaagtcttgaaataaataatcattagattttttttcttctggaagtaaaaattcaccttctcattggtgaaggtggttgatgaagtgtagactgctacttttcatagatctgagaaagatagtcttctagaaattgttatatattgttttatgctcctttttttcaaaggatgttgaaaaggaattcagacactaaaccttttgttgaaacctagtacttaacagatagatatatatagagtattgtttttaatttggtgtttcattgtgtttttttcaataattgaagtgtacaattttgaatcgctgtaatatgtataaattgtaggtgtgtgattgaaggtttacaatgataaatagtttgaggtctccaattgtaactgattatatcaggaacttggagatacaaaagaaggagtttgagactattattccctttattattgatcattgcttcatctctgttttaagaagaaaatattgaaggcaatcaaagaatttgagcaaacacaaaggaaatttggaatgtgacttttcagtcatgccaacaacatatctatgtaggcttaaaaacgtttatattcttgttgttacatctaattttataataacatctttgaggctataaactgtgtttaggcaatgcaacttttggggatcattttgatttagaaaaagatgtttacttttatctattacaaacacacagtgcgcaagcacttcatatctattagctcatttggtcctcacaataacctgatgaaggaggtattattatcatcccactgtagagatgagagcactgcaaaagagaaattaaagatttaggaggtctagctttaatttgaacctaggcactttggcaccagagtccctgttctcaacctttaccattgtgctgtgttggtgcaacgattctttatatctgcccgatatgcttacttctgtccaatttattcagttgtttctctctctctcctcattagcatttaccaaactgtcttgatcaataatctttttttaatagcttctataaattgtgagattagtgattagtactcttttttttttttctaattctaatgagggttagggttagatgaaggttctaatcctgcacacattttattcaaccatttttaatcgtgaaaatctgtagccttcttttttctgaccatagccggtcctaggagggactgaaacagagtggccacacttggttaacttttaggggaaggagaaaggatttcagcaggttcagagctctcctttacttcttagcttcattcccaaactaacgcaaagaaagtccagtttctaagccatcaggacgctgccttttacagactttttaaacctatcaaggacacgcttgataataattttgacttaagtagtctgtataaaacgttgtggaagggaaaaatagagacagttgtcacgttctagacctcctaagtggtattctaatagaaagatgcataacaatcctctcgagggaaacaggttctgaccacacccctagaggttctgagtctgttgttctgactggttgctcagtcatctacctttttcaagccttttgaagagtccgattcagaaataatgttttggagatggccaggtgccctaaccacttcctgaaatctggcctgatttttaatagcttttacctaagttcctcagattctctgattcatagttttcaaaatatcttgtctcctatttttgtatattgttctcggcttcttctgcattttaactcaagtataggcaattctcactatatttactggaattactccaatacgttttagaatattcatggtgctgtgcagccatcactagtatctaattccaaaacacttccattaaccccaactcaaaaaaaaatcttgtaccaactaagcagtcactcccactccacgctcgttcttgcccctgacaaccactcatctgctttatatctctgtggatttgcctattgtggatatttcatataaatgaagtcatgcattatgtggccttttgtgcctggcttctttccttatgcagaagattttcagggttcatccacagcatcagtacttcattccttcttatggctgagtaatattcccttgtatggctatacaacattttgcttattcattcatcagttgaacacacagttttcacttttttgtctattatgaataatgctgctgtgatcattcgtgtacaaggcttttgtgagaagatatattttcatttctcctgggtatatatctaggagtgaaatttctgggtaatatggtaactgtttaacttttcgaggaactgtcaacctgttttccatgtagctgaactattttactttcctgctagcaatgtatgagggttccagttcctccacatcttctccatttgttatttcccctgccttattgatggtagccatcctagtgagtatgcagtgctatcattgttgctttgatttatatttcattaatgactaatgatgttgagcatctttttatttgcttattggccatttctataacttcattaggagcaacatctagtcaagtcctttgcccattttctagttggcttgcttgtctttttgttgttgagttgtaagtgcttttagatatattttgtgtagtagacctttatcgggtatataagttgcaaatattttctcctattctgtcagttttcttttcattttcttaagtgttctttgatgcacaaaagttttgaattttgctgaagtccagtttatctatttttccttttgctgcttgtgctcttggtatcatattttaaaaactgtaacctagtccagggttataaagatttacacttacgttgccttcttagagtttcattaatataaatttagcacttaacattaggtctttgatccattttgtgtcatacacattgtttttaaatattcttctatgcatttaaattattttcaaagagatatgaacttcatgattattggacttcattttctcatactttatcttcattttccttattatatgagttgatgcaaaagtaattgcggtttttgcaattactagttgcaattactagttgattttggtcttgcttttctgatatttctgtggctgacccttgttgctttctaacttttgatactgttacttttttcttcccaaaatatcactgaaatgttacaatcttgatgtttattattcctttttttctggtgctctttaaaaattaaatcaattatttttcttcatgaatattacttttaaaatcctaccctcgtcactcagttttactaattacagttgaattttatgttgaagccaggtgtggaaggatgtctgtagacctagatacctgggaggttagggcaggaggattgttgagcccacgagtttgaggctacattgagctatgatcatgccacggtgctgtagcctgagtgacaaaacaacagcatgtctttaaaaaaattatgtcgaactaatgttcatgtcttagctttgatcttcatgcctctgttgacagaatttctggagaaagaaccctaaatttgctctgtccaaactagtagccacatgtacctattgaacgtttaaatgtggttggcaagaattgaggtacagcctaagtagaaaatgcacagcagatttcaaagatatagtacaaaaagtttattaatattccatgtctattgattacatgttgaaataatattttaaatatatattaagtcatataacatcattaaaattaatcttacctgttttactttttaaatgtggctattcgaaaagaatatacatggtttgcatttgtgactcacatatttttatttgtatttatgtttctgctttagatcgtcttcatctcattttgtattttgttaattgatagatctcatcacatcaatttgaaaatagatgggctataaaacttgaacagatgaatttttgctcttgccagtatctttctgttgctcttaattaacatagaggcataaaatgttagtgttagcagagatatgaggcatctgaatggtttaagggtttaaagatccttctcctttaccttaaagacaaccgaaagtctgccaaatgttttattaccaatattagttgtaaggagaattcacttaccgctccattctcatctcaaagttagtaaattcatgcataatgtgtgctggtttttcctgcttttcctttttgctgttgttgttgttgatgagaccaccatttagacagtgggatagatgatcttgtagtcatctttgattatcttcattcctttatctcctataggcagttggtcctcctgtttctgatttcacatcatcatatttctttacttcaccttcagctttgctttctccagctactagtgaacagtaaaacaaatccatggtgctctcattgcaatagcccccttttacatcagtgtgatatttatactacttcaattaacttactgtaaaatgacaataccattttcccattttctgtggtcaacctacagtaattgctttctaatatttcacttaaatgatatcagagagctacagtcttcataattcaacctttatactctaaccaggcactcacttctgccatatgccatctgtgatttctctagcccttctgaactccccaacttgaaatcagttccatagtttcccatgtaattcttatttatcattatctgtgtggcattatgtctttttggtttttgaggtcagggaaaatgtactctattgtgttcatcattgttcctagagccactcagggaacctatgaaatgttcagctgaactttattttaatggtttttgttttacattgttcttattcagatgtaaatggttaaaggcattttcttccatactatgattttattctcacttttattttcgatgtgaaatgtggagtcatattttacttgatgggctatttcttgtcctcagtgtcctccctagtaatatattttttaaactggctttagtaaaaatagctactatttttcattttcagcccatggtaaatgatggaaatatttttcttgatgaatttattatttaacagtactcacaccatattaatttttataatttatatttgtatatgaattattgactatgacttctaatatctagcatacatttttagataaaaatataatatctagattaatttgaatgacctctttatagtattaatttttctatttccacgtattctatagataattttttaaagtgagagcttggaaagaagacaaaatgattcatattaatctttcttagagagtgaatcagcctcctccttgtgcatatttaaagaaaacttactaaatgtggaaattgatgtgttgttttgactaggtatgcatcaaaccctatgtatgcatcaaaaacagtggcattttgcatcgtctttgagatctatgcatggaactgcctcgtacggtaatattgattttatagttaggctgcaggagttgcaactccaacttccccacctactagcaactccatgtgaagtaaattaccgaattctgccaagcctctgtttactggtttgttaaatgtggtcaggaattctaaatttttctgttaaggaattgtcagctttaaatgtgttaacatgtttaaatagtgtaatgagtactagcataatgggtacacagtaaaaattagctattgttatgaaaagtagcattaatatatcttggaactttagtaactttgttctccttggtaggagctgaccttacactcaatatcaatctttaataatgaataattttctcttctgtaatcaaaaaaaattatagtacagtacttcccacctttttcatgtcctagcacacatagaaaatggcaatatgtatacggcccaggtcactgcaggaggctgctcagcctctcctccctgccccaagagttgagaaccgtctagggttgattcagctgcagccctttcatgacttacagggaagttctcaggctggaatgttctttgggagaccctgtgagtacattactcctcttcttcctctccactgccttttcttctgtctcctctcacctcccataaaaagaatcctggattttttttcaccagatttcaactaatgattcactaattttaaaacaactctaggtgtgaatgattaacatgatcattgttccgaaggatgtattaagaatatgtgttgatcacggaggatctttggataagctatgtctgtgcccaggtctcctctaactttaattctcaccctattatcagcaccaaaaccatcaatcagaaagcaaaactcagaaaattggcattgtctagtagcctatagggggttctcttgtcatatttgcactggactctgcctttctttcttatttttatttttatagccagtcaaatttagcagtgcggggttgtatatggactctttctttggaatcagcatgaaataaagaatgcaaagatttttctgtctctgctttttaacaaatgttctgggaaacttcccccctcccccacctactatctctagttaggtaaatgctcaaagaacttagaatgggaaatcttgcaatgatttcttgatcttaagtaatttgactgcataattttgcatagccatttgtcctctctctattaccttcttttaacatggtgaagaataagtctactttacactatatttttagcatcttagatatattttggtcatgaagatggtgctatcaaatccttttttaaaaaacttaaactttttgaattatagcacatttaatgtttatttttctactgtaaattataaattatttgacttttgcttaattatttcaattgtctgacaaactcataaaaatatccaacttggttcctttattttatattttctttatcacctacaaatcttaaaatgtatatattttatgtctttatatgtttacagtggttagttgtatctcattataacctttttctggatatggaagcagataatattttcttccttaaaagggactctcttagggattaaaaaaattctaatttttaatgtcctggggtttttggcatgctgtttaaattaaaattttaaaatgatatttttgcttttgtttacacacaacttcctaaatcttagtgatttttagtctactttttgaactataatatccatacaaactccacttgatatatatacatagagtttaataaactttgagaaatatatatgccactatctagatagagaatatttatgtcattccagagaattccctcctgccctctttatactcagactcacatcctcactctcctcccagccccagtcaactattgatctgttattctgacactatatattagtttttatttttctagaagttcatttaggtgaatcatataaaaaagagtttgtgatattttcagtctgaattttttttcaatcagaaaatgcttctgagatccttccatgtatgtaccagtgatatggtcctgtttattgctgaatagttagccactgtacagatatgccacaatttgtttatgtatttgtctattgatggaaatgtaggttattttcaggtgtgagtaattatgaatgaaactaccatgaatatcttaaacaagtttctgtagaaatttattttatttcgtttgagtaattacttaggagtgaaaatgagttgtacactaagtataggtttaactttataggaagctgccaaattatttgtaattaattattgtttgacattctcatcaacaatgtatgagtttctattactctgcgttcttgtttacacttgatattgtcgggtttttctaactgtatgcagctaatgactgcattaggtggctcagtttttaaattgaggcatgtctttttattgttggttatcaaattatatattttggatacaatctatttctacatatgtatgttacaaataatttcacctactttgtcattggccttccattttgaagagcagaatatttaagcactaacactagcacttgatgtgttccattctatcaatttgttcttctatggttagtgctttagtgtcctttcaagaatgatttgttttcctgctttcttcctccagtttaaacatttaaatgaaagagcaattttgagttaatttttatatgatgtgaagacaggttgagtttcattatcttacaggattcgatttttcagcacctctttttttgaaaagattattcttgctcctttgaattattctggtctatttgttagaaatcaattgaacatataaatgttagcagatttctgagctctttattttattccattgatctctgtctttacaccaataccacagaatcttgattacggttgctatttagtaactcttaacattaagtagtttatttttatctgcttgtttgtaagattttttggttaatactagtttttagcaaattgattatgatgtcccttaatgtggttttctctgtgtacatccttctttggttcactgagcttcttatatctgtgggtttgcactttttaaaagtttagaaaatgtcaagtgttatttcatctgatatttttcctgctaattattttctctctctttcttttgggactccagttacacatagagtagactgcttgatactgtctcacgtatcaagtttccatatttttttcttcatgttttcttctgtacattttccattgctgtacacatcttttcttcctagtggatgaacttctgttaatcacatccagtaaatttttaatttaagatctggaggttttcacatctagaaatatagatatgttttccatttgtctctgcaacatattcacatttttctttaaatccttgagtgtatttttgtttactttaaagtccttttctgccattttggggtctgctactactgcttaatttttctcttgaatatggttcatattttcctgttctgtttaatgtctagtaaatttccattcaatgttagacaatttaaatttgctgtctttctttaaagaatgttcacttgaaacattcaaggcttgtgttaaagttttgtttgtgcaagtctatcataacctttacactcaacttggtttctctcttgctccctaatttgtgagttctctggagcatttaacaggggtggatgacaccagggaataatcaatcttagcctaggaccctggtgcaggaatgaagatggagagaaaggattggatttagtaaagatctgaaaaaataaatccagctattctggggggaatgagctgcttcaactaattcttagtcctgtattcactttagaagctagtcacttactgggtcctaccaagtcagttctccagtgtggcttggtcattttcaagcaggctttgaatttcttggattttggtactctttacattcaaatattaactttaaaggcagatatgagggaacaaccattaacaattgcctatacatatacagacaaacacagactgaatggacatttttacccaagttttttggaggacctgtgcatcctacaattacattggttaaactatgtgaaaacaataatacaatctagtttaaattttttttctaatctccatttaaagaattagactttctctttcttccttccctcccaccctctctccctttcttttcttttctttcttttctttcctttctttctttcttcctttcttcctttctttctttttcttttcatctttctttccctctttctctttcttctctctctccgtctctttctttctctctctttccttttcttctctgagtaacattgatcctactaaatttattagaccgtgttctgttaattcagttactctttaatatagtaagaaataatatgtcttatgaaaaattttaattccagtatgaagcatagataatggactatttataacatctaaatactaggtaacgtaagtgtaatttttattttaaaaattattatttacattttgtatattatattttaatgcttctatttaaagaggtaagccatggatgttctgcaatgattctacattttctatgtctctaagttaaaagtgccttgcagtcttctaatttgggatccctgttaagcagttttcttgcatttagttttccaccacagtgcttagttcctggtttctttatccaggatgacaattactatggcatagttcatgttctttgcattagaaatcagtgccaatataaaccatgactgataaaaatgaatgggacctacgaacccaggggaacttttctagaaacatgaaagtatggatatgtttaaaatgttcttgaccaaaagcctagaactgcagtggcaaacttagagaaaattgtgccattggcctaaaaattgtggggagcctactaggagagttttctcaaaagattccaaaggcttttatgccttttaaaacatttatctcttcatcttcagttgcgtaatgaggaggaagaaattaaaagtggtggaaagtgagcaatagattttattttaactttgattcagaactattcaggttttgattttagttggtatagaaatgtgttcttaaagcaatcagaatattagctgaagttagtgttagtgaaccttgatgggcagaggtgtttctttttcatcctctttaattaccatggacttttagacggcccctaaagtgaatttggaagttttcaacatttggcattcaagttcaggcccagggaggttatgtggatgtataacttctgattcttggatggtgggttgatactgtatattttttaatggttacacttttccttgactagtataaaagatttactgttacagtttgtgtgtggccaggcagtggcatatggaaaagctgtttcctgctatttaatttaattagcccaatcacgtgccagccttcgggcatgtcactctggacctctgaggctctttgtctgtcaaggagatgaacaatatcttggctttgtttggttgcttgggatgctgaagatacaaaccactgaaattttgactgtttgtttaaccaaatctttgcatttttaccatttggctttgattttgttttacaaaaaaggatgacatttggccttggggaagtgaaaaagaaatattgagtagatgaagaagagctgttgctttctatggcttaatacaggattgagatgattatcattttataatcaggaagttttagttttctactattttgttggtaaaaactgaggacaattttcattgcatcactttagccctaaacttagctgacaaactgtcattctaattcaagccttcttctttggttcatgtgtgtatttttgtgtgattttcttcatcttgccaaatctcgaaatctttcagtgaattcattgttgaaaaagaaaatattttgtttcgtttttgaattagaatattccagtttggtcttgttttcataaaaaagatggtgattaatacatttaggcaccttcagaattgttctcaatattttagcctttcttttaaagttaaagtacttttaaaacttttttcttttatagtcaatatgttcagtttttaaaaattatctttaacaatatttgttattattatatttctttagtttcaaagctttaaaattaataaagaacatttgaagaaaaacagaagatttgaaaatatatgctacagtataggaacttgatttgcaataaggacttctgcctaaatttccagcagaattaacagcaacttccatgagtcaaagttacttgtcccaggtgatcaatttctttgaacatccagattttaaaattagttgtcccagatttgaggttcttaaccaattatagatacatgcacagtttagaacttcaagaagatgtgcccatggacttaatcctgcactaagaaagttagattaagtcacacagagcatccattccatatgagctactgtcccaggtgccaagatatcgccccaccctctgacatctcttggcctttggagtaacccataggacctatactgaataaatgacaatctgtcccaaagaaaatatcctttgtctaacgctaatagaaccattgcttctcagtagattgggattttttaagcaaattattatctatttcattttgataaactttgcaagaaaagcccttacctctaattgcatttttaaatttagaataaaaggttaaatttattaagaaaaggaaatgaaaacctaaaaatttaaattctctttaccaacacaattctcagaacataatttacattcacaatacagacatttaaaatgaccttataatatagtttccacatgcaaagtataaatcttacttacaaacctatgatctgcatagattttgcattttgtttaagggcaagtaaacaatcaataacaaagagaacattgtgctttttctcttctaatgctttctgtcatcatttcttctgtgtaattgtacttaaaacttcaatcattgtatccattttgggattcattattgtaatttatagttctttgtgtatgattaatttttcatttttattttccttatatgtatagagcgtgatatttctgagggtacacacatgcctacacacattcacactcactctacatattgattttagaataaagttgtatccatccaagaaaatttgttttgctggtaacttttaaagaatgaatatatttttaatattgggaaacacccatgttctctaaataaaatatagccatggcagaaatgcagtccttttttttataaaggtcttttttttcactattgatgttttgttgaaaatgttataaagtataacaagactaaaggttgaaatcaaattaatcgtgaggtgacagttaattcagaaatagagatcttaaaaattttctgggaggtggaggtgggtggatcatttgaggtcaggagttcgagaccagcctggccaacgtggtgaaaccctgtctaataaaaatacaaaaattagctgggcatggtggtgggcgcctgtgatcccagctacttgggaggctgaggcaggagaattgcatgaacctaggaagcggaggttgcagtgaactgatatcataccattacactccagcctgggagatagagggagactctgcctcaacaacaacaaaaaaaatttaaagacaatttatttgttagccaaacataaggccctagaatataggtattaaaatggtacaaccttgtttctgctagaaaatgtaatccttgtgaaattctgaacttttcttttttttacaaaaaacgaataacaatagtgaaagtaattgtgcaatttcaaatagagatttagaaacagcaaggtgtatagaaaaagtccttataattaaacttacaaattaatttggcttgtagtaaacattactccaaattttatttgcacattgtcctaaaattctaaatgaaaaaaataaaaaatacagtgtcgtttgtgccactatggtcaaaatatatataaagcacaaaacctgcaccagtcttgatcaagatcttccagcttctaagttgcagaactgtgatcaaaacctacatccagttccatgttctttccattaaacatcgctacttctgagcagaacccacagttcagcaaagggtttgacatcttgtccctggttcttctaaagactgaaagtaggaaggatctttacttccctacactacagtttcatgacctctgttatccactgggttactttgaggaacagcttccgctgataattgtaatagtttattttttgtttgttttatgataatggacaaaatttattgaagcgcttgcttacttcttataggtatattgagtgagctgttgtattttttcactcaaaatggaaagatagtgctggcagaaaccaatctttacattgttttatttcaactctgcttgttaacaaactggaggcatcaaagtctgagatattgggagttgagttttctacgtgtaatttctatgatatgcttccatttttcaaacttttttaattttcaagttttatttactctaaaataaaactaagaatacttaactcatgaagaccagaaaacaatatttgatccatcttactttttaaaatcaaaactatcatgttagaccaggcgcagtggctcacaccaataatcccagccctttgggaggacaaaatgagctgatcacttgagcccaggagttcaagaccagcctaagtagcatggcaaaatcccatctctacaaaaaaatacaagaataagccatgtgtgatggtgcatgcctgtagtcccatctacttcagaggctgaggtaggagagtcacttgagcctggaggcggagattgcagtgaacctatcatcccactgcactccagcctggcaacagagccagaccctatctcaaaaaaaaaaaagtaagaatatttaactcatgaggaccagaaaacaatatttgatccattttactgacaacaaaaactttcttttcatcaaaactatcctgttaggccaggtgcagtggctcacacctacaatcccagcactttgggaggacaaggtgggcagattgcttgagcccaggagttcaagaccaacctgaggtgcaacaactcacaaacaaacaaacaaacaaacaaacaaacaataaaactatactgaaaaggctttaatacaccaactgataacttttagatggtttaaaggcatcttctgatgaactgtgtcctaatgagtgtgaatggatacctttgagcaaggtacccagatttaaaatgacatatctcttaattttaaacgtaagatcaaggtcctaaaatttgatatagactaattattcttcaacagcttgggaactttatttcctaccccaagagacagttggtttatgaagtaaccccctacacacaatatatatacacatatatttatatgtatatgtatatttatgagtgaacttttttctttgcacacttttcctaatggtgtcatggaaaactcccctccacctaagttatgttctaaagccaatcttctagttttttatcacatcatttctcttgattttaaacatttgaaatttgaaggaaaatggtttcttctgtaacatgatcctctctattcagttttatgtggttttcttttccttgttacttttcctcctcaaggtcctcccacttttttgttgttaaataaaattcgtctgaatctctctttgaagataatttatggagagaaactgtcctccaccctcactgtggcttaccacaacctctagaaaggttagttggagtacactgaaataaaaaaagactgtcaaacagcagttctctagctatggaatctactggtgttttgctggaaagctcataaaatgaagtgtcattatgcactgtgctataccatccattgtgtgttctaactatatcactcccttttccacttacccatgggaagcagcttacccaaccagtctggcctatgtgatggagaagcaaagatctgaagagccagttttttttttgttcttggccagctatacaatttctaggtgttctatgcctcagtttcctcatttgttaattgaaagtgttaatcctgatcttcatcgaaagactatggtttgctcacccatgctgacatgtaaagatgacatatagccacagctttcttgacagttatcaggaagacagaccaatattgaatgaccatcttagttttaaaaattatttttcttttatgttcatataatttcctttaaaattctaactagtagaaaaaagatttgttcagtgtttaagaaaatgtcaagtgaatgctgatttactatttttgaactagaattggcaaatagatttcctcctaaggggggtggggtgagatggaagaaacattctatgcgacagagtttttgatattcctcaggaatgaaaataacctaactaaattagtcataaaatatatgcagaaatagcgtgtgccagtatttaaagtttaaacactattaaaaatagtgtagaatggcaaaattttattgttggtaggaatgttagataatgacaacaataacaacaatgaaaggtagtagggattgaaagctaattaattgccaaacaccatacccagtaatttatgtttatcatttaatcaccatttcatatttaccaaagaaaaaatgaagacttcagtgtggtaaagcagaagtcatacatctgaactatgatagagctcagattccatccctgatccatatccagaaaggttgagaggctggcttggagtctcagtcaatttgtggtgatacagtaacagacactcaggtctgactcataaactattcaatgtaacttcaaaatacagtactttcaacatcaaatcagaaaagccatttgctactatgctaacttttcaaccaagtcttctttactccctccaattattttcatggtaatgttccagcacttgtagaaagcaaaggcaaagatggaatgtgaaaaactcctatcagtcaggaagtcactgtatggatggcttcacagttgtggccctgcttttttccttcatactaaacacatgtcttagcatttttaattcttctattcatctctagttcataaagcttacatcttgtggtcatggcttggaagactacaaatgtcatttatgaaatccccaactcttccattcttatattacatacttgatgtggaatttgccttatgtattaatgttttaaagtctaaatatatattcattcccttcacctcttagaatatctagagaaacacgaatttagatatatagcctggcataaattcttcacaaatggctgaagtctctttaacctacctggtggattctgaaattttaactctgtcaacatttatacaaaactttttcctcttctccgtacatagttatagtaaaacactatgtttaaaagaatggttggaatcctctcaccttcatatgtaaaaatcctcataaaataattcaactaatctaacataaaccttcatttctttaattgcttatcacacatcagaatgtgcaaggcattattttaaatattggacatggtcccgcctggctccaataagcttataacctgataagaagagggtaaattatacatatataaaattattagataaaagatgttaggtactacatgataggaacagatacagtatgctttgagagttcatatttttataattgtttaaagtctgaattttccaagtaccatgtgctttacataaatataaatagttaataaacatttatgctttctaatcctatcaaaattcttagtgtagcttcttaatgttatttctgtatatacacatttcctagggcaacacattttccagcataggcaataagctgttcaatatgtaacataagctagtaaatagtacaaccgatttaagtaggtaccatttaaataaatcttctactcaatgcactggccatgccagatccctttatgtgtatttgcttgcaaaaccacaaactagtttactcttcttgaaataacagatattcaaaggtgtatgatataatttacaacaatatttttatgttataattgatactatcatagaaccctcattgatgggaaataaatgtctatattgggataaataacatctatacttttcaaaagtccttcagtgaattttgcattcttttatttttcacatctccgggtatagtagtagatgcaggacatcattattttggcaatattcaggtatctttgatattcactatggaataaattatttcaacatatcgagaacagatccaaggaggtgacctcaaagacctgaaggttaattaatggactaggctatcctgactcaaaatgaataggaattcagaaagggaagaagagggaaagctgtgtatttctgcagggattcatgactagttagatggacatattttattatgttttttcacaagggaaacatttttcttcattgtatattgaggtgtggtctcttataataaagattgttttagtctttacccaataaattttccacagtatctggtataaactctggctagataactttttactttatagaatttttccctaatgtaatgtgtgaaggagtgaggtagctatcagatttccatttataagctaactgaaaacatggaaactccacaaacagcccatataacctgaaaattgagcaaaatgactatatatacacacacacacttatatatgagctatgtctatatgtgtgtgtattatttagaatactatttttctatacatcagtttgttctactccattactcttttagttttcaacaagtggaataaaaaataggatttcaaaagcaatatcataaagaataatattctcagagagcaagaaatgatggaggaaaaatgctgttttataaagctcagtctgtttagtctagccttagtttgactgctgacaccgggaatgcatttctaaacttctaaatgatgaaggttccatttctagtatatttatatacaaattttatgaataatgtgcaaatttacaaaagatgatttgctttactccaattccagtgacattttccaaccaattattttagaaatatttttacatatgccctctatattgctgataaaagctgactcctgaaggttacatgtttattctctaatagttttcattttccaattttgatactgacttctgggttcacttatagttggcacatcctttttttcctgtttacttctttgtaaaccttcttccaatacacaattacccaccccacatgtcttttcaaataggagataattggttagacaagtagatcctactgtttccaccgaaaaactagaagaagcacacattcacgggaaatgtctttaagtttatctttaaattggagcagggcagaggtcactagctgaaaggaagtcaaaatgacaaggaccctaatggttacagagaaaggttaagacaagtaaatatctttccatgagacacttgggctgttgttagctacctggcaaaaaccattttccactgaaataagttaaaatatcactaacttagaaaaagtaaaggaaagacagtttaacttaatggaagttttaattatagtctactttaaaagtgatttaactttattgcttctgaacctgtattctgtcacataaattaaaactaccaaatgggagcagataaattaaaaatacagtttacaaagacttacgttgaaaaataacttacaaacatacacaccattaaaacattaaaatgggttgctagagactggcctaaccttggagaagaaatcctggatttggatttgggggagctttcttttctaaacattattgcaacttccaaatgaatacattatttccctcccaccgtaggataaataatgagtttaaactaagacatgggagacagagagagattttaggtactacagccttccttacaattttcaaaattcagaaacgcccattggcttttctagtaggatatggctaagaaacaatgtcacaagggtcaatggtaattgctgcagaggatctagtctgagaggaatgatttaaaggcaaagaggaagaaaaatgattataaccaaacagtccctttaggaatgttttaggaatatattaaaagttctcttaatcaagaaatttctcttaaccagatagtgcctgatattcttggagattttcaaactaaaggtaaagttttgttggcttacggttttacagcaatgttgtttctaactggttttatgcaaccacagtagcaacaaggcctagtgcttagcatgatggatttatggtccattttgggcttacggccattaggatcactagcagcctagtttccctttgatttaaacaggatatcattggtttggttggtggcatatttcttctgtggctatggttggcttaaaataagcatttttggtgtacttgtcaactgtatctagggagagggaataatccaaattgtccaaattttattaagaaaagaaatcacattcttgcatatatctataagtcaggacacaaattccattatgatgtgtagaaggtattcttccatgggtaattttatgccttaaatcaagatttattgacatcaagcagtggtgtttcatcaaatggcctaagcatccttgggaaaggaacagaggcggtgactgtagaatgaggcacaaagtttgttgagcagtcccactggttcatttccagacagcatattgctgcttgtctctcaaccctttttgcaagagccccctcatctgatggtaactaaagaggtttttatccatattttatattcctgagtgttagatgtgaactttgagtagataaagtgaagagatattactggttataatacgccaagatgcaacgactgcaatttgcatttatgaaactaaaatatttgtaaattatatcccataactgttcataggttatatgataggtgtatacgtatattttggttttgttttggcagaggctggtatttttaaactttgactctcctttgcagagattgatgctgaaaaggtgtctgtgagcataacttttttagccaatccatcttttgtgggacaacaatccctgccagacatttctttaatgtttggcacaatctatgtccctgtttcttttctggaattagagctctttttttattctttctgctgttctgaaaatgagaagcagccgcctttctattttcaccagggtcaaattgctaaagtaccatttattttttttaaatgtggctatagtacacattgtgcatgaatttattcatagaaaagagaagtctaattattttgagagaaaatcctctcgaaatttgaataaagacaggacaaagtaaccaattttgcaaacaagacgtacggcatgcaactagcacattttggcattatgccttttttctgtacaatattaaaagatatattagatttgataatagagttgcttaatgtcctttatggaatttgcctctcctcactcagaaacaaaagcatatttctgtttgatcatataccttgcgattatagttttccactaagggattgtagggaaaacaaaaaaaactaatattatcagatgtctgtttaatgtatatttataaataacttctgtggaattcttctgtcttggaaaattctgagcaaaatgctaattttatttgctttgcagtatttacacatgcatagaaggtcttttcttaactctgaatgaaacccatctaattaatgatgaagaaaaagtgtctgagacggtgcattcaggagataggagacatggcaaaccactgagagcaatttgtgcactcaagtttatgttctgcataagagggttacctgctacttcctaacaaaaaaattatttgcaatttaagtatttaacatgtcctcattaatgctaacagacaataatccagaagtttaaatatgttttaccaaaacttttctgagaggttggtgggtcactttgtattgctctttctgatcttatattcatttaagtaccaaagagtagagggactttcgtaagcagtataaaactaaattatatgttgatttttccgtgggctgttaatgtcttgttaccgtgaggtggaaagggctgcttcgtggtttctggcttggtaatatttggcttgtaggtaaaggggaagaaaacacagaccacctgtaacatgaatgttgacctccaattgctctttaaccaaaattcctttcagttatttccaaatttatctttgattaattttaacatttatgcattcttcaccctactctgtgtgtcataaatggcagtcctttagaatggataatgttctaaataaaattaacctgtgtgtaatttttttccacaatagatagaattcaagctaacatagactgcagtggtcaaagaggaaaccatcaagattgccaatgtggggtagcccatattgatcccaatcaggtcatatgaccttggcataccagagaagtcactaaagagtgtcaacaaaagagaacagtctgtgtaacacaacataaagaaaagagggcagaccctgcagtgatcacatcttgtgtttgagacctgccttggccacttacaagtctcaagttcctcatcaatgagatggagttaataatacctgtctcctggggtaaatggtgaatgagtctcagaaaagacagcatatttcagccccattcacagagttaaggcttaatgtgatagctacagattggaaaggaatgaaccattactcttcttaagaatactcagaaggaaaaagcctggatgacttaagagaaaactttccaaattgtgttttaaaacatcagtccagggagatgttctcttgtctgatgagttttgtaagcttcacattctatgtaagctttgtggagacacccggagtactttagcaaactggtggctctgagaaatcctgcagcacagcaacttatttacattattgatcgcaacattaaaaaaatgaccatgacatttttaaaatgttacttttttatggaacaaactttttgaaacactgacctaggacataggtaataagcttttaactcctcatatctcagactttaggtaacaaaactgaagtgaactgtaacttaaaacaaaccgtctttcctttttctgtgcatttgagaaaaagaagatttggatgtaaatctatttatctcagactaagtttggggtttcttgttaatttctgtttaaagagattttgtgggccacgcaaactaatggagatctagttagtatataatactttctcacatcatgtggctaagtttacttgtttgctagtcttgtatataaacagggctctgacaatctaatgtctttcgccagccatttataaaagtgaccatgtatattttatggtaaaaagtaagtgcattttttgggcactggtaaataatgatttgttttgtcctgttatttttttgtggaaagaaaaatcttacatttcagtcagatgtttgtagtaaaagaaaattgtcatattcagtagccgatgataaatacattttttgtgttgttatgtatactatactgttttaaagactaagctattttttggctttttaattttttattgtgataaatttaaataacataaaaactaattgtgccccataaatatagacaattattttgtattaattaaaaataaaataaaactttaaaaagaaaaaaatttaaatagtagctgagaataaaaactagatcaacttagatattattaaagtcctgggactcacagaaaacaatacactgagataaggttatatttgacacctaattgttaaaaggagagataaccaaaccaaacaaaaatagcattatttctatttagcctattgcaatgtttttgtaatagttattgaaattcagagtacatttataaagctaaaggaattctttaattattagatacagaaaatgtccttgaatgggagaatagattgagaaaacacagtactcttcctattttaagaaggtcaaaatatttttagaggacatatttggtgtgtttgtttaactaaatattcaatatgagcaaagaagttacacaatttacttttaacgaaaaaaattttcaaatagggaggagagagacgaggagagaacagatgcttctggtggtgcagcagcacaaattgagcaattgtccagtaggggttgctcatagagcaggaaggctgattgttccagctacaagtttcacaacttcaagtagactgggatttcaaggccactcaagtgtcttagtcgaaataacctctttatgtactccggaagtgacccagcctctgatatctattaggataaaatagtatgtgtgaaattaaagaattgctaaataaatcatttgaagcttgtcatctgccttaaaatgacattttacaaaccacatttaatatgttgctgtgcattagtgaggggagctcataactgcttttccaaacagaatcaaagtgtagttaaattgtttttaaacacagatttagagaatgaaattgagggtagtaaactagtagccaactaaagcaaaacaggctggaatgttggtaaccgattgtacacacaggatccaagcaaaacatcttgaattgctagtacagtaataaattatagttttcacatttgtattttgcaagtgaaaacagcactaagtcaagcttgtgaaataaagaccaaatgatgacgtttttaattcacccacacctatgatgacccagtagacctgcctcatcatgcaataaatggaataactgaggctgaaaaaagaaaagaccagtagacagaaactccatagtttttgtatgcaattgtagatgggaaaaaatggttgagagaggcaaagggttaattgtcacaaaggatctaatgaatgtgttgatttcttctccttcctttgtccctctctcctcacaagatgacccataccacattcagccaacagtcaaggagctatctcattttctttagggttaattttctcttcttaacgtaatgagataaatggctaaatggggttggtgtctcgggagtgttcagagggcaagaaatggtcaagaactggtttatctccaaagttcattagcctattagataactgacgcagggcaccccaattatctcaaagaatgagagacttctaagagatgggagtcagtccttataataatggaacttggctgcctgcttcagaaaagagactcgcaaatccctttcgtggagcaggactcttctgggtggagaggatgggctgatttatttctctgtggtgtcctggagtgtatctgccctgattgactcccttggtcttgacatcagtcactttggagtcaagataatgaaaactacattaaagaggcccctccagtttatgcaaatggaactttttcttcaaagggacaatatccttgggagaatttctgtactattgaaaagtattaataaaagaaaatgtgttggatatttcctccctcctactcctcattttctctaatttacataggagtgggagtgacattttttattttgtttcattaaaaccctaaattttcctcatgctttatctaaggaagtcaaattgtatttagtctgaaggttgctgcatggaattagtaaggacataagtgacacttaacattattctaaacaattaaagttacacactttaggacatcttgggactggatcaagatgactggaggagcatcagttttgcatctgaacaggtgtgccttaggctaacagggcaaaaatgataacactattagcaatgacatctgcagttgtagcttgggttgccactcaagttagaaaagaatattatgttatgtctattcagggactctttgggggagggaacacgagataatgctcaaggagggaatattggaatcatgtgggaatgttgtgtttccctatctttcctacgatgctaattatttaacaaataatatcaacataaatgtgacaataaatgaggactgtgtttatatgacacagtccatgttgactcaacatttttggagattgatttgaaagagtagaaggagtttcttaacacagcatagtgacacttccaatcagtgaccagaatgggacttagcaagaaatcattaaagaatgaatagtttacttggtaatctctctggtgttttcaaaatgttgccaaggttagagatacaggatttagtttgaccttgatgtcaggtttgtgttccttggtattctaaattgagaatgaacgggtggtttatgagtgtccaacaggagcttatcctcacctgaactttctttaacaaccaaaaaaagagcacaacttgaaggattcttcctttttcttaagaaaaatctatacctagagaagagtgtctcagtttttcagttttctcacacatttttatttattttctggctagtattttgaatataatggacctagatgcagttttgtcacacgtttttatttattttctggctagtattttgaatataatggacctagatggtaaaaagttttatgtaactatttcacatatgactattttccaaagtgaactcaaattgttactttatttttgaaagttgaaatctgtaatatcattcgtactaacactatgctgtatgtatgaaacatggttaaaatgtgatagaatgctcttgcttttaatatcatttttgtcttttccttagtattgccaatcagatagtgatcactaataggatacatttatatagtattccaaaatggtggcttctttaaaccaaatagacgtttaattcaaactaatcactgaaatagattggctgtgaaattatagttaaattatcttaaatgttgtcacaagatgcaaaactacattatagctgcataattacataactatattataattatatacttgtatatattatatagttatatatgttataattatatagtataataacatattatactatataatgtataaaacttgtatgttatacattatgtagctatagttatataatgatctgcggttgcttttctttttttgcttttttttttttgagacggagtcttgctctgtctccaggctggagtgcagtggcgcgatcttggctcactacaacctccaccttccgggttcaagcgattctcttgcctcagcctcccgagtagctgggactacagatgcacgtcaccacgcccagctaattgttttgtgtttttagtagagacagggtttcacaatgttggccaggatggtctccatctcttgaccttgtgatcagcccacctcggcctcccaaagtgctgggattacaggcgtgagccaccgtgcccagccagttgttcttattattacttgacttaggaatctatggctgtacaattacaggtgagattcacaatattgaacaaccatttggtttggcacttatcaaacagaacagaacagatagtggcaataacaatcatcacattctcggtgagcatcattggcgctgaggaagagatatgattgcaaagatatctgttggaggtattattcttcccacacataagcacaaacaacttattacggagaaataaataaaagtaacccagagacttcctttgctagtgaaaacacagaggcaaattcttagagttaagctaagagtaaacgatgcctgaggaacgcattcaaagtcccaaatacttaacttggaagactctccttgtaaggatggcctagcagtttcccttcagcagtagtaaatctggatgagcttctctaggatcacatcctggcagatgagatgctcatcatgacgaggcccagcctatgggagatgggatcattagcctgtttttacattttaaaatggcctatgtgttttcttccttttattttttttaaatcaggaatgcatgatctttgtagaaaatttggcaaaagctgacaagtataaaaaacaggtgaaacatcacccataaaaccatcacccagagcaagcactattcacattattacatgttttttccctagtctcaatctctctttctttgtctctctctgtgtctctctttttgctgaaaattatcttgctgtttggaaagacagtaaatatttcttcctttgggtaacatctgaagctttttgtcccactcccttttcaactgtaataccacctatgttaagactgtttaagatggctaatcttttagacactgatattcctaaagtgttcaaatggctcttatcccttgagtcaccatggtttgctcagtcttcatgggacctgtgaggaaattcctttcaggggtcttggcatgagctgagagtttagagttcaaacatttcttactttggatcgaaatggaagtaaacagtagatttttttttttgttatgctcatgactgccaagatttttattttagggttggatgttattttagggttgaattttagggaggcatgatgagggtgatcagtactaaagccttgacttaataaaaagaattttgatggtagtcatggaagtgttcagtgaactctaactactcatgaatcaatgatatcatgagtaatgctaaaattagactcaccaggagaagacgcatgaacaaaaattatgtgattatgagaaaaagaaggaaacttatctgttatcataaacactgattataactctggaaatgcttcactaaacacatcaaaaattctttttgatcagaatttaatataagctcaatgagttgattatgtaagccctctgctacttttctccccctacaccaaatgcctaaataaactttatttttcaagttgaaaggaccgttctaaaattcgtcattcttaatgctctaaaacgcccgggttcagaaaattaaattacgccatttttatccgtttgagatcagttctgtttcctcctttggtttgtgtttactttcctgcagtagctgacatcaaaatgttttctggaatgctgggactaaataagttatgcttaactcaatatctaatacaaatagccctggggagcttcagcgacacaatcataaaagctatagtttcttttaatagcttgccacactttgctgatatagtatttctctaatcaccaatctttatgtgccttcctgaccttggagctctcagtctaaatggctttatggtatcaaaggcctgtgtcattggaagagtgaatggctttcatttttccccttgaaacttccagttcctggcatctgtaaagaattattccaagtggtattttgctgccttgcggccactgccctgtccaatggaagtgacttttcccagaaaggtcacagtggtctgtaataggtggatattgcattcagggaggaggcaactctgatttctctatttttttcttttacaatattaattattcttgtatcacattagttatcaaagatctacatcacattttgtttgcaaaatattttggcaaaaaatggtacactgtcatgttctaagcatgaaaggttagcaacaagcttcataaagtcatcctatttgttgggaaaaagacttttcatttacacttgatgggggagattatagcaatgcacaatagttcgtcttcagactctgttcctcttcagcacctcaaaagcacaccaaaaagtgtgacacagcagtgattctggggtctcaaatccacagtatctctccctaactgtgtcaactggctggggcaaccattgagaaccaagacttctgactcacaccttattctaaatttgcatttctcaacataattatgttttaagctttgtgcacagtcaatagagggtgatcccatggatatctttccatggcttagacaggaactttgggtaataggtaacgtttccaaaccttctctgtgccttagaatcttaaaagcacagagagcagtgtgggcaggggagtctgtaggtgtgtctgtgtgtgtgtgcgtgtacgtgtgtttgtgtgtgtgtgtacgtgtgtgtcgaaataatgtagaatactagcaaaacctgtgaggcaatttaatatgtttccaatcagaattccttagtgcaaataagaagtgtaagaagtataaaatcagtacagaagaacatgacaacgaactttagaggttcttgtatatcatacaattccatctatttatttatttatataaaatctgaacatgttttccctgctatagtgaacaccctcccaattactcctaggaatgttcattgtctgttatttggtctacatttcttgatttttcctaaatggctcttagaaatctactttatatattaagatattccccattgattccagtttatgctaatttgtcttgtattttatatgcattttaatactactgaggattaagactagaaaatagaaatctcctctaattccataaaatcttttactatttggtacattttcttcaaagtcctttttttgtatttcatatataaaatatgtatattttttaaaaatttgattcatatcagatgtacaattttgtaaaatgattttttttctattgacatgttaacgttgttctgtgttcctaaatgttcctcaaagccatgttttgtggaatagccaaaataccttaaaggaatacctgtttacgaaaattagtctcatagatgatggttatagagtaacaggcacacttgtcctggcattggaagctacaagaagaaaaaaaaatgtctcccttttggagaggtaacgattctaaaggttttgagatcttagagcaattactagatttggatgtttcctctacttcaacaatcatatgtttgtgtatggcgatggggagagggagagaagtagttttgaagtcctagaatttctgtgaaatgcagttgcatcttatgaatgagttgtctttatcgtcttaacttgaccaaccctttaacccctcactgccccctgtggccttttgcgtgaataacggtgacaatgcgactgccattctagaatttagtttcccagaagtaactgaggtagttggtctgtttatcaagatacgcttgggagtggggctatctctcacctctgtgtgttggtaacagttttcagtcactctgagcctttgctagatttatatttacatttttggaggaacagtattgagttggcaaccttttgctctgtaacaaatcagcccaaaacataatgaaaacaataaacacgcattattacccaggaatctactgatcagctggtggttcttctgttctgagtctactctgctaggtctaggctggccttgctcacacgtctgggaaagcttgcctggctgagaatgctagggcctctctccacatggttgtcatctccaggagactagccttagtgtgctcacagggcatggcacaagtgctcccagtagccagaagttgctggccccagctggcaagcactttttaagtgtctgcttctgttactcctgctattatctcattggtcaaatcacatcccacggccaagctcagggttatcatgggagggagctacttaaaagcttgtgtgtagagaggaatgcttcactgggtacctgtactgctacctttactgccactttcttcctagtttctgaaatccctttcagttggacagatacaggaccaaattaaaaagttttcatgactgttgctgcaaaatttatgtttctgcaaaattcatattagaatcaataaacctgaatacatagaaacttgttcataaaaaaaaaaaaccttgccactgtgaggtttttttcctcttaagcaaaacaaaacaaacaaacaagaaaacaactctccgagataagtgaatcttctcccagttttggtgtatcattctagtcattggagatatttaggagaataataaatgcatgttttacaaactgtaatctgacatgccaaaaagacatttcaaaattctcatgtccaatacagacattgattctgttgtggcgtctgatttaaaaaaaaacaaaacaaacaaaaaaaaaaaacacaactgtactatagtaccacagtacaccagtactatgaaactcaactggttagtcttaacatgtattttcagataaaggcaatttcctaaagatgagttattttttgttaatgtccgttagatatatactacacacccatatgttgcatatttttaatagaaaatacaatgctgtttcaaaattctgtctttaaaatcagaacccattataaataatttcgtcatgggaatacagaactttgaataattagtagataaaatcatctgtcaatgtcatgcctaattcacacatgaagtgaacagggaacatccattacatgtccaaagacaccctagattcccacatatctgtgatgtcttgtacatatgatttcccataaattcacctggagagagtgtagactaaggatcttccatattggagacgcacttggattaaaattcttgctctattaattactgtttaatcttgagcaaaatcctccagttttctgtgtttccatagggatgacatagagtcaaataaggcacagagacagtctcctgagtgttagtttcctgccttctctctttcactctttttcttactgtttaacttcagctactaacagcagttgaacactttctgctaagttgcaagccaggcaccatttggaagcaaagaagcaggctgggagcgtggctgtaggttagtcggatctcgctgacccgtgaaaagggacaggctgtcgcttgtgccagacccatctttctatggttgtttgctcctctctccaatttccctgcatctgctttttggagacctgctatatttccgtgcttactgacaaccaaattgttctgcctctagtgcttattatcatacttcaaggaaaaggcacttgggggccgtaaggagaacttaaggcacaaaagccaaaaccttgagtggatttatggacgcactggtgtccgcagcacctccagagagtggatggagtgaggaggataaaagtcggcgactgtccagtctgcataattttgggatgcggcctgtaaggctttaccatttctgtgactttaatttgtgtttttgctaaacattagatggcttaatttgtcagtggatcagaatcaaaaacactttgggacaaccataatgctatcctgagagaacccagggacaagctaattaggaataaagaggagagatggagaagagggtgtatctgggtaacttcatggggtgaaatcccctcatgggaggtggcagctcggaaatctgcatagtaacaaacctgtcacgattcaaggacaactcggcggaacaattagaattaccatttccctctggcctttaccaaaaatctctgcccacactttactctttgcaaccaacactgcggttttgtcttaacatttagtaagctgttgttgaactttaaacatcctttgtaaggtatgcattttctgcctcaagagtaaaaaagagttacatcttttgaattctcatatctcatatgaatcctacactgtttccatttgaatgacaattgtgtattttgaaatccacacatattatatgaatcctaaacattttatttgaatagcaaatgctataaggaatcaagagaatattaaatattttatggtaaataacatctgtttcaatgatttcttcaaacctgtttcattttattctttcctgaaactttaaagccaatcaaaaaaaacagatacactgagtatatatattgttgccttataaaagaaacacgattcttatttttaatgtttcttctatataaaacaatactttgaatgtttcatttctgaacaggtgctcaaaggaaacaaaaaaattaatgatattatggtattttgtaagttgtaattatatccctgacttcctattttcatcaaattattatagatattcatatatcaaaaagcacagtttccccaaataattaattttttaaattaaataaaatatatcaaaagtagcaataagggtaaaatctcattggtgaatttctgattgtacgaattaatattaataactgacctttaagaagacaaatatatgtgagagtaaatctggtttgcacttctgtctgactttcttctctatctttctgcatagcagcataatctggcatgtttcctattctatcattttaacattttccattttatttagacgtagtgaactaatgcatgcatgtttatgaaggatttcaaattggaagagttagaaaacaatgaagagagatcaacacacagttctgaaaacaaaaggaagaaaaattatgatatttccccctctccttccagaaataacccccaatccccatccctgtcccccagggccctgggcagtgtcacattcctacctcttcctccaggcagaactatgcaagtgtgaactgggttggctcctctgttttctcctttttcaccacaacacaggcacacattcagtccattactaattttagctgcttccttttgcatactcccacaagcagatcttaggccaagccctgaccttgtcctgccttgactaatgtggcatctctgccattcctggactagaggaggagggtggcttggagaaaaatggtatcaaaaacagctcttaaaaacaagaagtacactctgctactaccatgtaactggcatttgctagattctcttgagggcccacaaatgttcttggtataatcaggacccagtggcacccaggcactctggcctgcctgcaaaacatagccttagccagatttaatttgtgacacccaaaagaagaaagtatcggattcaccaaggtgcagtgtgtatactgtctctacttttgcttacacacttcttcctccatgacttgttgactttggaggatttgggacttttccttgcttaggaatattagaagtattgtgggctcttccttacctttagtgactttaagcatcagcattcttctgtgtactgcagaaaactcttattgcaatccaattttcctcccatattttaagaagccattctaggtacttaactgaatttgtgtgtttggaatctccttaagtgactgacatcttccctttgatagtcatatccttaagtcacaaatggacattctcaaatggcattctcatctactttgaccttgatagtctcttacttttagtacttcaaaatggggacaaacataagatttggagcaaagataaaatgaagaatttgaagtttaaacatactgctgatttcagtagctgatgaaaaattaaatttgattttaaacatctgaggagcaggaaaggtattctcttgcatatacacagacttgataataatttttaaaaataggtcacatagcctacatatcacaagcagttaaatactaaattatactttaataaactaaaaaagaagaggaaattgaagtaaaacatccattgccattagttaaaaatggttttcagcattttataagaaatggaatattttgttttattgatatgaggaaatgatatacatcagtactgtctaatggaaatatgtgggccacacatacgatttttaactttctagtagtcaattaaaaataaagagacaagtaaaattattttcaataatatatgattttttaaattaaatatgcgttcctgtgtttaaacacattaaatggggattgactgatgtacctgcgggacttctggatccttaacttgctaatttgtgttgtgcatctatcaacaggttagagtaggatttctcagcctaagcactaatgacactactgacttgccaaaatgtcagccccttgattccccattgcgggagctcttctgttcattgtggtattttaacagcgtccctgactcctccttactaagtgctagtaacacccttcttccctacctcacacccattgagataatgagaaatgtctctagacattgtcaaatgtactctgtggtgcaaaattctcctccactccccacccgagccacacactgggatagagtgtggagcaggatctcacccgtttgctcacacctggtgatctaaatgggtgtgcatattctattccaatgattaaccgaaccctgtacctatgcttagtaactgaattgaattaatttgaaatgttttaggctgggcacagtggctcatgcctgtaatcctagcactttgggaggccgaaacgggcagattgctcgaggtcaggggttcaagagcagcctggccaacatgccgaaaccccgtttctactaaaaaaatacaaaaattagctgggtgcagtggcgcgtacctgtaatcccagctgcttgggaggatgaggcaggagaatcgcttgaacctgggaggtggaggctgcagtgagccgagatggcaccattgcactccagcccaggcgacagagagagactctgtctcaaaaaaaaaaataaaataaaataaaataaaagaaatggttcagacccataggcattatgatatgtttcacaagaacaaaacaagaacatatattcaggacctaaattaatcctgtagtggaaaggaaccctttcattgatgtctgggcagatttgtgtcctaggagacctagatactgacccacagacgtgaatcctttccccagtctttcccacatgaatagaaaatgtcccatctttcttgccttaatgctaaccaggtcgtttgtttacatgtggtaaaattttgatcctctctgaaagttttccttttttttttttttttttttttttgctttattctccctgagccgcaataaatttccacagcaaacctaaacatttcatttgcgtaattaagtttccatatggatgctgatggcttgtttgcctcatttctttccagcaaaattgtaagcaccctgaggttaaagacttcgttgatttttttcaatacctaccatggatcaaggaaatttgttagtaataaaatatttgcttaatgattgacaataaaattgaatgctttcataaaacaacaagctgttcccactaattttaactttttcctagctttaccttgtatttcactcaaatagggaaatgattctttatttgacatcatttatgtgctggacactggacaggattctgggcaaaactgataaacaaagaactcctgcccttggcaaagctcacagttgagcgcagtagttctcaacctgggaggactttgtcctgagagacatctagtcatgtctagagacatttttaattatcacagttggggtgggttgctactggcatctagtgggtagaggtaaagggtgctgctaaacatcttacaatatataggacagagcccaacaacaaataattatttggactagaatgtcaagagtgctgagtttcagaaagcttgggaagaggaggataaatcaaccgatgacagcttaatggaaagtgatgtatgccttgatagagttaggtcgagggtgccttgagagctcacaaaaggaaaaataaatccaagtgtatggctgagagacagagaaggctccccagacgaggttatggaggctgggtatgcagcttgggaaccagcagcagaggagtgaacaatgaggcactggttacccccaagaagaaagtgtggaaatagagccaagagctaggggtggagccccagagaagccaactgtcaaaaggaagcccaggaagaaaagccacaaagagagggaggaactggaagggtggaaagcagcgagatggcgtggaagccagtgaaggagactgtttcaagaaggagagaatcactaacaatgtcatatacctcagagaagctgagtgagataaacacagaaaagtatctttaacataggtaaagaggtcactagtcactttaaagagagaaattacaagtgaaggaagtcttagaagtgatggaggatagattgtcctaagcagagaagtcaatgtggggagataaaaagtgtggatttatcttcaggaggaatgcttatgattatttatagagcagaaaaattgaaaacagtccaacagtctaataaaaaggtatgaaaatatttataaatatatgcaggaatatacagcccctaacaggcatacttttcaggagcatttaaggtgaagggaatatagtcggaatatatgaaaaaatcaagatgccaaccattattcagtatgacacctgctctttttttaggtagggaagaacaaaactacaaaaaatccaaaatattaaatattaacagtttattcatgcatggtggatatgggcaattattattttcctctttgtaaattaatctccaaatgttctaaaatgagcatgtcatacttttaaaatgagaagaaaactttcttaaaagaagaaacttgactgagaaagaacagagaaagttttggcagtaacttgaagggaacacagggaggggaaaggagtgtgtgtgtgtgtgtgtgtgtatgcacgtgcatacatgtgtgtgtctgtatttgagttggaagcgatgagagcatttttgtatattgaggggagacagacagtacatgctgagaggctgaagatacaggagcatggatgattgatggagcacatccctaagggagcaggaggggatgaaatccagatcacaggtggtgggattagccttggctaagaggagagacatcgcttcaactgaaaaatgaggaaaagaggtaaggatggatgtgggtgctgataagagtgtagaggagggggcaggaagttgagggagttactgtttgttggcgtctatttcctttgtgaagtagaaggtgaggtcatttgctgagtggggtcaagggtttacagagaatggagaatgatggagatttggaagggtggttatggagaaaaagagggaggaaggggacttgggacacagagattgcccagctgccttgaaaggccagctgaggctgaagacaggatctttaacaaacagcacgtatttgtgtgtccacatggctttctctaactgtcacatgtttaaaaatagacaaagcaaatagtgagactgatcataacttgcagtttttgcagaaataatgagactgatcataagggctttctgcataaggccctgtggaaacatgattattttgagtgcctgaagtaataaacaatagagtttgtactggaaagggagagaaataagccagaagaaggctgaagggaatggaagccaggtgaggtctacaagtcccagtattgggagacagggagtgagagaacttgaatggtgaaaggtttgggctgtgaatggaatattggacggcaagattctagttatgaaagagtgcttggtggaggggagaggcctcattagctgatgtctctatggactctcccagcaagtgtggctactggactgtgaaaacacagtttcttatcatatgtggtacacagaaacactcacaaaaagaagcaaaatcctctgtgtagattaaatcacattcattctttctcctctctccacacacacccacacacatgcacacacacacacacaattcatacacacatgtatacatacatatatatattcatacatatgacttgaaatattattcagaaaataacataaacgttaacaacagattcccaaccaagaaaaaagaacactggactttgtttctttttttttttctttttttctttattttattgcagaatgtgcaggtttgttacataggtatatgtgtgccatggtgatttgcttcacctattgacacattctctatgtttcgtcccctcactctctacctccccagcaggccctggtgtgtgtgtattgttcccctctctgtgtccatgtgttctcattgttcaaatcccacttatgagtgagaacatgcagtgtttggttttctgttcctgtgttagtttgctgaggaggatggcttctagcttcatccatgtccctgaaaaggacatgatctcattcctttttatggctgcatagtatggagtttgtttcaattccagatatttaattgctctataatttaacatgacactttcacatcagaaaacttgattttctcattggcaaaatgggttaaattatatctatttaacaagtatttttttaagaactagattaaaatttagaaacatatctcagagtttttgaaaccccaaatattatagcttaattcacttattcaacaaagattgattgggaactacaacatgtttgtatttgtgcttggggaattgactgtgaataaaccagacacattcttctcccttacaggtttagaatcaaatgggagaatttaagggattatcatataataaagcacctttcttgccctgtgttgtcctggcctcaagcaatccttccaccttggcctcccaaagtgttggcatcacagacatgagccatgacacccagccttgccctgtgattctatgcttcaccctcttccaagacttaagccagagttctgccagggtcctcctacactcaggggtgtcttctgagaaatgtcagtgtattagtttgttctcatgctgctgataaaaagacatacccgagactgggtaatttataaagaaaaacaggtttaatggacttaaagttccacgtggctgaagaggcctcacaatcatggtggaaggcaaagaggagcaaagtcacgtcttaggtggcagcaggcaaaagagcatgtgcaggggaactgcgctatataaaaccatcagatctcatgagacttattcactatcatgagaacagcatggaagaaacccacccccatgattcagttaactctccccaagtcccacccatgacacgtgggaattatgagagctacaattcaaggtgagatttgggtggggacacagctaaaccatatcagtcagggaagaaggattttggttatctgtgatcacaatctgttaatgtttcatcttatgttacatttatattggtttaattattcaaaatcttaaatgcaagctcctaattttacttcagaatgattattttcacatgcttatatcaatcatacacacatgcacacatatacagatatgtacagaaacacacatatatgcatacacacatacatacgtatatatatacacacatacatattctggtaaaaaaaatttcacgcataatcaaagcccaaaggaggttaaatattcagaatattagctcattaacattcagcacattggggataatgtctatgttaatggtatccgttcatctaacagagggttggcattcatacctaggagttgaaagtacatcaaatgctccttgatgagctaagcaaagtgaaaatgtacgtgctattcccctaacaaggaaagccgctgaagtttaaataacagaaaagagcacatggatagagaaaaagttaatgcagaacattttgttgctttattattcagtgacagagattagccagtggggaatatatatatacatgtgtatatttacccatataaataaatatagattttaaactaacagtcacaaaggatatcatacatttcaaatttgcatacaaatagtacttcctaaaattggcaatttgatttactcatcttctgaatatcttctgcaggtgtagtaataattttcagtatgtctggatgcctagaatatgtttagcagtgtcctaagtattttaagtggatcctctcatttaatttcgacaacaatctctatgcagtagatactactgttattgaaaatttacaaattcaaaagatggggcaactgaggctttaaggaattaagtaacttatctgtcatcgtcattgctcctcattgccccaaagtagagagaacatctcaattcaacaaatcatattgattccaccttctaaatatctcaggggtccaccttcctctctccaacccactgctgcaactctggttccggctgctgtcaactgagttaatgtaaagtctctggtagtctgactactggagtttaataacccaagtggttgactagtgtttacaaataagctcatattagttttgattactaacctcctgctgtcacaatagtcctaacaccataatcagtgtctctcaggtacttccgggtcttcctcgagggagtcttgcacgtgttgaggaatgagtctgtgctcagttgagagccaccaataccagctgtggtctgccacacccaccacccctgcccacacttggggttgctgcttcacagttctcaaaactttacaatcctcagagtgcaaagtgactcttcattccttttagccctcaatgacttttttgtcacaaatgagaggaacgctgtcttccaaactgtttcattttgccacaaaagaacagcacttgtgctataaatctcatatgacacagttctttctacttcttcctgaaggccttttctcttggagctcaaatagccattcaccaggctcaacagagaacacactttgttcggggctgtccattccctgtcttttcccatctcttctctcatttctcaccatacttctttttttttttttttccttcgggaaaacagtcaaccaaacaaagataaatcaaactcatatcaatcaatgcaaatgcccagtggatgtagtgggccagtgtgcaggatgaaggatgtgtagtaaaccccttagtagtgcactggtcatggctcatcaggtttgcccatagccagtctttgaattccaatttaaataaataggggtactttaagtcttccttaaatttaaatataatcacattttttcattctttaatatacatcagcgacttctcattgttttctgattaagttaaaatccctaaagatgttgacaaatttttcattaactgctttcagttttttctctttcatcagcggcaacaaccttctctaccaaccttgcttcaaactccatgttctagagaagggatgggctctagcatgtgggactattgcatgataaacaaacagcagtgcatagagctattgtagaatgccatagtcacttattctgcaagtttacaataattcctgtttcagtgtcaatttataaatagctactaataactaaaagcatgattttaaatctgcaggtataagcaataacaagcttagttaacatctaagaatgatgagaactgttttagcctttactcaagttgtgaacaaatattatgatgatgactctgctgaagaaccaagcagaggataaacaatgccagtaaatcctaggtattgcaggttcattgacatgttataaatcaaataaagttaagcttgccaataattgaatataaccactttaacatattatttatattgcttattgagcctacaagtataattttgaatagcaatgtttgatactttacaaattataatagcatgtgcataaatgtgcataataatattattttatgtctttcaaggagatgaaataacttttatatgcaagagtttattcatgtaagccaggaactattttagtgagatttactttgtttctattgattctatttagagctgaatctgtagcactaaaaccaaataataccagacaaggtcttaaaccaaattgttaagccttgtctaatcatattatattatccatttgttctttgttccgtttgatgagcatagttaaaatcaggtaactgaagttaacataacttgacgcaaaagcaatgcaagttgtatagcagaacagaaaagtctattttgtgggcagtgaccactaaaaataattgtgagaaatgagtgtcataaaaaaaaaatttgactgttgatagatgtgacaatttatgacaactaatgagaccacttagcagaatctgcatacctttggttgctataggccaaattattaaacagtgttgttaggataatagtttggtgatgagcattgcagatgagttgataaaaattattgacccatgagactaaatacagggactatctcaaaaaccaattgttagaagatatgtaagaacagagacacaaaataattaagtacgtgaggtaacatatatgttaattagattgatttagctattccgcaatgtatacacagatcaaacatcatgtttaacaccatgaatatataccactcttatttatcaattacaattaatttttcaaaagaatggagccatcacaacagatttagaaagatttgtcttgtcatcctcataaggatgtagggcatttatgcaagaagatttattaatataaaaatattagtaaattataataaaaatatatgtaagaaaaatcaacatgtgcataattctgcataaggagctaaatgatcatggaggctgagaagcaccatagtagatggttaatgaagtggttaaagactgttaaacaatatctagttgtgactagtcataactgatgactgtggcattggtgatggatatcagaaagaaggcagaagtttggctcaataacaccttgttataacgtattttggtaatagagtcaatttgagttttaaaaaataagtcgttgataacaatgatatattaatgatcaatttccttatcctatttggagaaatacctgatactatgaacgtttaaataacaatgctaattagattagtcttttttgcagataaaccacttattctggaagaaaaagtgcttatcaaatacactgtcatttctttattttatagatgtgctctgagagttcaaataaagttttcctaatttgcatctttgtaaagtggtagagctggagtacaaaccaaggagtttgtttttttctgaatcctgtgcactttttaataacgtcatttaatttgcgtagcaaggtgtgtgaagattaagttgcctactctacgcaaaacataggttatttttctgctggaataatcatttctaatgcaaatttgttcttatcaaccctgttaaactaattcaatcctcaggcccaaactcctggaatctaaagctatttgctgacttgctgttgctgttaggcttgagagtcagcctccttagatagggtgcaagtactgcatggcctccacaattctattcattccccagaatctccataaccagcagtcttatggagtcttacgaataagggctattcacccttatgaatagccatgctgacctgcacctgctctgtggcatttaccaggtgccctgtcacgagagtgactttccacatgctatgctgtctacatggaacattcttctttctttctttgccaagctaaacccttctcattcttcatctcttggctcagaggagcttttcttggttgcttctaatttaggaccctgtactactcttcataactcttacctccattgctcttttataattatttgtgtggaactgggtgaatatttgtctccctcaccagattgtaaattcagaagaagagtgactggatctgttgagtccaccattgtatcttctaatttctactatgattcctaacacctagtaagcgcttaatataatggatatacgaatgaaagaatgagttccatgaaagccaagaaataattacaaaagtgttttaaattatcaatgcctttttgtgatatttatttttaagtttgaggaaatacttagaaaagacattcttttcaaaaaccaaagtatttttagatattatgttacattcatctcagcaaatacaccagagtattattgtttaaaggtttggttgttgagacaaccacagttttcaattctgacccacagtgacaagttttcattctatttaagacattttcttacatgctatgagttgagctgtgtgcttcctcaaacacttatctattttaaggggaaagtgttttttttttttaaagcggatacttctgtttaaatgccaaaataaatacatgttaaacaatattctctctgtcttatttttatttttaaaattttttgttatccaaacatcttaacataaactgtcagtaattggctcctagttcaatgacaaaagatatttggaatatctttactttgacccatgcatgctttgggaggaagggtaaaatagagataaagtcaaacttttcttgagttagacatgcttggtaatttatacacaagcaattgggtctagacgccagtgatgaaaaatgtgattctcctaatgttatgtttagtaagatgttttcttggaatgagagggtataaagattaatgtctgatcctgaaagaattgggatcctacttacttgacccagcatgtgatatgtctgaacccatgggttttaaaaaatacattcatgacatattatcaatgttaaatctagtatattaacagagaaatctaaaagttgtaattagtgagattttattatggccacttactccattttttctttaaagctgtgtttcgtaatattattttttaaattaatgacctctgatgaaaactatagactaaatcttcagaaaaattcagagatgcacactctcatataattttacacacaacttcaggagttttatatccactagaattcttccacagatcctagactgagaatatctgttcaagataaatctatccaattcatgtgtcttaaatagaaatgatttatgttacttgtcatgtctctcgttatgatattttatatccagactctaattatcaaaagggaggaataaaggaaatgctcaagagatccatcttattcaaacgaaacctctttttcccctccttctcttcaggctattatctctagaccagagctctattgttcatcctgtactgtccattggctgccaaccagacaagggatgctaatctaggccattgtacaatttcatccctctctgggctgttatgtaattaaaataacttcagtgtgctctcttgaacatttttttctacaggcaattgtaaaaatatagaagttaaaaagcaaatgaaggaagaaaaatataatttgttttctttacttttctattgcaaaagacattacttattgtggacttgttatttatttaatttcaaaattggaatatagtttcttttgtattttgtactgcagaaaaatatctattgatttaaagtggtcattttccaagaatgcttcaaggcagttgaattttaaacatttctaaagcaactagttttcatatatatatatataaatgcatagtgcaaccaaattagtaatttattttctcctggaacctttatgtctgaggataccagaagcaatttaaatattctgtatataggtagtaacttttaccaacattctacccaattgagaaacagtgttgttaaataggtgcagcttcacataggtcaatgccaacactaaactaagtccctaaacctcaatccagaatcatgggttaactaaacatacacactctctcccattgtgtgtgcatacaaacactggttactcttgaatccaattccctctgcttctgttggtgatacttcagctgaaagctttgtagcattcagctaccaacagtcctgtcttataagtcacattattgttttggattcttcatgatttgaaaacaagaatatttgatttgcaaaattttacctctcgttagcacttttttttttttttttttttttggtattttgttcgctggcatgaaaaatgtgctaggcaaaaactcctgtttaaaatgagaagaacgtgagaaggagagagtgacctaccctcactggaagtgaccagtgagtacctgggggcaatacttcatctccttagaggctcaccactgttacaaggggccaccacttggccctagagggaagactggtagaaaacagtgagcgcattctgttgctggtgagcatacacctgttaatccagcttccctgaactgtgcaccgcacttgcgtactagaattcagcaatgctatccatagctagggagaagggggaataataaagatcctcacacgtttgttaaagataccctctaccttaaccaaatttttactgagcacttcaccttccacctcttatggattgatttacaatttcctttttttttttttttttgagacggaattttgctcttgttgcccaggctggagtacagtggcgcgatctcagctcactgcaacctccgccccccaggttcaagtgattctcctgcctcagcttcccaagtagccgggattacaggcatgtgccatcatgcctggctaactctgtatttttagtggagatgggatttccccatgttggtcagactggtctccaactcctgacttcaggtgatccacccgcctcggcctcccaaagtgctggggcaatttcttaaaatcacaagggataaaaatattttagcataaacacacacaacatataattgtacagatgtacaaatataaaaatatatatacaaactatataatgtatcactacataaatatgtgatatgttacaaaacatgcacaccaatagaaattaagaaaggagataaaaatgaaataaacattattttaaaattaattttgagatagtgggatagaaacttttttactatgattttaaaaagtgtttttaacaactttattaatatattcatatatgctatatgctttactcatttctatgtacaattcagtggtttttcgtatagtcactgaattgactggtgcaaccatcaccagagtcaatgttagaacattttcatcaccgcccaaaagaaactgtacccattagcagtaacttcatcctcctacaaccctaggcaaccactagtccactttttgcctccataaatttgtgtgttctgcatattttatgtaaatcgtattgtatggtatgtgtttttttgtttgtttttttgtttttgagatggagtcgcgctctgtcccccaggctggagtgcaatggcgcgatgttggctcactgcaatctccgccttccaggttcaagcaattctcctgcctcggcctcccaagtaactgggattacaggtgcacggtgccacgcctcgctaatttttttgcattttagtagagacggggtttcaccttgttgcccaggctggtctcgaactcctgaggttaggcaatccacccgcctcggcctcccaaagtgttaggattacaggtgtgagccaccgtgcctggcaggtgtgtggtcttttgtgactattctctcatgttttcaaggttcatccatgttgtagcatgtatcactgtttctttccttcttacggctagataatattctattttatggataaagcgtaatttttttatccatttatcaattggtggacatttggattgtttgtactttgggctttcacgaatagtgctgctatgaacactcaagtacaagtttttatgtggaagtattttttcatttttcttaggtgtatacatattattgaaattgctgggtcatagggtaactttatatttaaccctttgagggagcacaaactgtttccaaagtggctgcatcattttacacccccaccagcagtgtatgaaaattccaatttctctgcatcttccacagcatttgctttttattttttatttataataaacattctaattggtgtgaagttgtaaattgttggggttttgatttacaaatccctgatagctaatgaagtgagcatctattcacaagcctatcttttttagacaaatgtctgttcagaacttttcccatttttaaattgggttgcctgttatctttacctgttcacctcattttcaattggattgcctgttagtattgattattgtgtttaaggattctttccatattctggatacaagtctcttgccagatacatgatttgcagatattttctctaacttgtgggttacctttccacttactttatggtgtcctttgaagcacaacattttttaacctcaatgaagcctaattaacctatttttttctcttccttttttttttttttttttttttttttgagatggagttttgtcttgtcgcccaggctggagtgcaatggcacgatctcggctcactgcaacctccatttcctgggttcaaacgattctcctgcctcagcctccctagtagctgggattacaggctcacaccaccacgcccagctaatttttgtatttttagttgagatgtggtttcaccacgttggccaggcttgtcttgaactcctgacctcaggtgatccacccaccttggtctcccaaagtgctgggattacaggtgtgaaccaccttgcctgacttaagtaacctatttttttgggggagggggtctcttttgcctttggtcttatacgcaaaaaaagtactcctctatttcgtctgagaatattatagttttagatcttacatttggttccatgatccatttggagttaacttttgtgtatggcatgaggaatggagttttactgtattcctttgcgaaaatgcgatggtggttatgcagttgtccctgttctatttgttacaaagtccttcatggaggaagaatttttaaaatattttgccctgctgaattgtcttggcacctttgttgaaaatcaattcatcgtaagtgtaagagtttatttctggattatcaattcagttccattgatctacatgtctatccttaagcaaggaacacactgttttaattactgtacctgtatagtacagtaagttttgaaattagactcttcttcctatattaggatatcttcatagagtttatatatgtgacctttgatgcaggaaatgggtagaaatggtagtatctatccatatatcaaatactggtataatttatgttctttcttatattttaatttaaaaattaaatatgagaagctctggtattttcttctgcacctgaacaaactggctcatgctattgaattgaattattttcttaaagtttgcattttaattaatttatttaattttaattataattacatttaattttaataatgttttaatggatttattcttttgtttcaaatcatcatattaagttcccaatttatagtcttcttaatttttcagtccctttagtgtcattaacggctttcttactgagtgaattcaaaatgataatatgttgaaattttaaagacaaaatatacttaattatacatattactgtgttcatttatctatcagtgaaattatttcatagttggtacagattaatgtatatcttatgaatatatgacctgaaagtaaattcacatactttaccttagtaaaaaaaaaaaatgtgttaccaaacgtatttttatgctcttttcttttttttttttcttttcttctttttttgagacagagtttcgctctgtcactcaggctggagtccagtggcctgatcgtggctcactgcagtctcagcctgctgcattcaagtgatcctcccacctcagcctcctgggactacaggcatttgacaacacgccaactaatttttttgttgtttaattttttatagagatagggtctccctattttgcccaggctggtcttgaactcctgggctcaagcatttctctgccttggcctcccaaagtgctgcgattatagtgtgagccgctgtgcccagcctatttttattttcttttttcatttatttttacattttctctcttaatttcttcttcttctacaaaaatgtagtgtttacagtaaaggtatctgtatgtggaaggttagttattataataatattggtgttttatgtatgacaaacatgccataagcattaattctatttttgaaaaattattaaacaattaatatgtataaatattacaacaatgaacactcataacatccagcttaagaaataaaacactacaggtacaattcaagtttcctatgtatctctctcctattgcccctctcattccttcccttctgaatttgctgtttattttttcatgtatgtctttactttttattaatttcattaacatacttaatatgtgatattaatttgcaaattttggaaataaaaatttttcatatattcttttgctttttttcactcaccatatttgcgatagtttatagtaaatataaactatttgtactaaatgttcgtgaattcttctttaaagtgttaaaacaatttactctcctccaagtagtctatgagtgtctcttgctctgtattttcagagtatgcattatgatttatgatttctgtcatttgctcttgctaaagtccatgatgatattgattctagcccatgagtaaccacccacaggtcaggaagcaaatgtgatcatccagagcaaagtgaaaacccagaagctatacatttggtccctgtgcgatagcaacaagaaagcaaagcaaaacaaaacaaaacaaaacaaaacagaaaaaaatctgttattacaaaaaacggaaccatgtaatttccttaactcagggaccttagcacttcgtagtctccattagcaggccacccccaagaaaatatttaattctaagccagaacattatgcttgtcatacaaagaccttctagaactatccctacccactttcaaatgatggcaatgcctatgccctaccacttagaatgatggggccacaaaggcattgatgttttactaggcaatattgaggaatttacaaaatagttgcataacaactcttctgtcaaagtaattacatgaattttatcagtgggagtggacagatgtttgagcacagtggccttagaccacaccatataatgaaaagttgtcttacacatctcagttagctgagagtattttccagaatgaccatctggcaaaataacccatcaaaacaaagtccccaggtgaatcagctgaaaaagaaagacgaatactttgactgcataaaaaatagactcaatagagaatatgtaaaataaatgttaataaaaaatgcttttgtggagagcatgttaactattcatttaaggggggtaacacattttctaatggtgctcaataagtaaaatgttaacttgggtatttatctaatttttattaacagtagattctgaactgtttgacatttaaatttttcagcactgtaagagagaagcatgctctttcatacttacttagatgtataaacatgaataaaattatctcagtaaaactactaatggtaaaaaaactggcttagtgaaacacttcaatcagttccagagacaacagaaaaatgtaatttcagctttcaagctcaagaaggatgcttttgttaatgaggctgggtatctatcctaaaataaaagtgacctggcatttaatgataactcagtgattaatatgcagtataataacatgtggtttactggattattataactctccttatacattgaaagccatatttcatttgtaaaagtgtataattgcaatcaactctttgaataaacttctctcttctatagtcctattttgaaagaaagttcaaaaatgtttggcccatctctgttcatagttccaataattatgaatctgtcctaataaagtgtttggaagatttaactgtttagtttaaataacatttaccattttttttaattacagttttaatataggtaatatgcagaaaacttggaaacgacatgaaagttcaaaggaaaaataatcctcaaatcactggaccttttctcacattatctcttggctccaacacaaaataattttaggatttcgtcccttggtaatcattttgtctggactctatttctcatattttttttctcagccatttcttggttattttgtgttgtgattgcttataatatgtttccttgttttatcctatccttataataagatcttaaggatgattttatatatatctctctccttattatgcattcatttaaaactgaaaaatatatattattaaagcccactatgtgtgaaacactgcatgggaatgatatgcatgggaatatataacagccaaaggtcatctcttcatggaacttactaactacggttaaggtgcaagtgcctaaattttgttgccaacccacaacatccttaatctcctttgctgtctgtacagtgcagcacaaggactgttgccttttggttgagcaatagatattggatgaacagttataagtaaggaacaaattaatattagacaagtagttatttgtttcttacttatattgccatattccttctggtagacactggacaggtaggatgctgcttactgaattgtgaaattttatactatgatgtaacatttataaaatgcttttgagttagcaaactgttttatcttacagggtttcagtgaagctcaagtagaacaatacttacttactattaaaaaaaaagaaaggtagcgggtggtgttatttaaatggagtccttacggtatcaaactactcattaacaggaaaaatatttagtaaccccagtcatctaaaacatggccatgtgataaaaaaagaaacatggcctttcatttccaaatatctattgcattttcttaatgcacagacaaaataatatggcttctagaaagtatgagaaaatatataaaatgcagcagaaaataagttaaaagatgagttatatccagtttctggttcaacgagctttcaacgttatacaaggaaagatcatgttacacacacacaaaaatgtgcatgcacacacccatgcaaaatgtatttagagcttctccttgcatttgtcacctggttaattccaatttgtctttcatatttaaaattaaacatcactttcttaaacaaaatttccctgaacctcttcaacaggtttttcttaaaagtttttcatatcatcccgaatttttcctgtatagcactcactgtatttataattacattgttgtacgaacatcatagagtatacctacacagacctagatggtatagcctactatgtacctaggccatatatgatagcttacttttcctagcctacaaacctgtacagcatgttactatactgaatactgtaggcaatttgtgtatataaacatagaaaaggtacaatataaatacagtttattataaaaggtaaaacataatatacctggataaggcacttagaatgagtggagcttgcataactggaagttgctgtgggtgagtcagcgactggctgatgagtgaacatgaaggcctatgacattattgcatggtactgtagacatcataaacactgtacacttaggctacactaaattattaaaaataaagtaattgtgctatgacattaggaaggctcatacgtcagtaggtgaaagggatttttgtgttccattataatcttctgggcccagtgtcatatatgtggtctatccttgaccaaaatgttgttatggaatgcatggctgtctttagtatctgtctccttactagagaataagcataaaaaaggttctgcacactagcaaagtgtccagcatggagtgtgagctcaagaaatagttactgcatgcaataactctaatatataaaagactatggcagggaaaggagagagaaaaacaaaatgtgatgggaatgtaacagaaggggaaagcgcaattaatgtgtgttcaaaaaacactgtgaaattttaagtggaccttagaggatgtgtgtagtgctgaatgtggagcttcatagccacacatagaggggtgatctagaaaggatggcttggaagaagcatgaatgttcatggtcaacatatccatgagacacagcagacacagtgcccaaagcctatgatatgcttgctgttaggggcccacaaaacattttaaattttaatttcttaatcagaaaaaaatgaatctaatcatatgaatatataataatgaatccaatatatgccaatgtaggcttaaaatgtagtttttaatactattttttgaagtccacaaaggtaaaattgcacagggcccctgaaagtcatactgcagccctcggaatgatatctgatattcagtagatagtattcggttagaacttagaaaagaataaatgatctaaggcttaaaatgtaggttagcctcaggtaaaggagagtacaaatgacaggctgtagagattcttcaaatttgggttgacttcggagtctttttgtgttaatgtcttgcttactgcagggcttcaggaagagaattcttgcaggaaggaataggactggttggtattagaagttgggtgatcagttaggagctttttgccatgtcttacatgggagctgaagaaattatagtagaaagaaagggaggagatggatattacaaaaaatcagataaacatgtacccaggaattgtagatcatatgtggaaaagcttccttttcccgacataaccccccaaatcataattatatatttgtgttccctgtaacagtgagttccatatgaggaaggactatattaatcttactgctgtgtcctcagaacactgaacacaagacactcaagaaaacaggagagttagactcttgtaaaagtgtataaaccattgtagctagaactaggtccctgaccaatccatcccaatcatcgaagcgaatgcccaaagcctcaatatgtgaaatataccttccaattgattgatggtttgattattctgtagagcaaaacagaagtaacaacatacacattagttataacctattttaaagttgattttaaatcattcttttttctaaattcagaaatctctgcttatggtctgtaattaaatctatatttataatccaaatttatagatttatatgcagcattaactcatatcatgtacagagaaagctacaattacgtaaaaccacataatacgcaatgagtacagttgtgttgtatacagatttgttagctttctcagtaagtttctcagccagtgtaatttgtacacttagcatgtaccaagccttgagtgaaaatacaggatgagtatgacctgtgatggcacatattaggtagaaggggagcacctagtctagcaggaaggttaaggcaaggccttaactaaggagaagtaatgtctgcctcaagtcttgaaagaacaaatgctagtcagataggaagcagaagcagaagagcacacacatttataaaattactagaattagacgtttaaaaatactttggtaacatttggagcaacagtttctttatccatggcaagagagtattatgttttttaccactgttcagctatttttcacattcgttaggaaagataaataaaaacagcataaagattatgaactccctcatgttgaagataaaatattcagtgtagtatatatatttttgataaatatttttattaataaataaataaattctttattaataaataaaattttgaaagaatatatatttaaaatatatattttgaaatacatacctttttttgcacaaagctcgctgtgtagcattgatgattaaataagctgcctatctgtgtttgagaatatcttttcttggagacagaggaagagactaactgaatcttccataaaattccaaactgtgattcactgattcggtaagttgggaaggatgaagaataataacagcgttaaatcactgaggatatatttaatagtatattaaaaaccaaataattttatagtgttgaaattataccatacaaactatgaaatattcattttcttctataccaatatatgaagactgaaaggtgtcaaaatataattgtgtaattggtcatttttagagacatccatagaattcataaacaatattcactgaaataaattcaggagagaattttcagaattaggcctcactggcagtttgaaagtgttgaattgttctcccacgttgtgtggcagttctggggctgtattcaaaacgttggtatctaggtaggaaatgagtcaaagtcgacgttactcttgaggttaaaggtctgtttctttcaatcagttcaaactgacaggcctcctgccatcacctcctccttagccaggcagacaggccctggccgtcagtgtgaaaacatctgttgaatggatttattgactggatcttgttttttctctccctttctctattttttttttctttttccttcacaccgtttattatgtctctgacctgatgaacttaatttgttgacatgtcgctcagtgtctccctcaatccttgtctcacatttctttctactgtgctcttttcttggcaacagcctttcctggaacccacgcacacacgtgcgctctctgtgcgccaagctccgctggctgcggttggcatggatggattagagaaacaccgtctcgtctccaggactcactcttcccctgctgcctctgttttacctcacccagcaatggaccgccccctccagcctggctctgcaactggtaggaatccctaaagactctctctaataggcaggctaaatgccccgttcttgtaggattaaccgatttaaatgctctgaataactccaatagcagaacactccattttaacccagtgcaacccaaattttacgaggttatattggctataagacaaacagcacatctgataaatcttgggcttagtactaatagcctcataaattgctatcatccaagggcctggaaaatacatcaacaggtgcatgagttttttggaaatgaaaatccctgcaacattctttagcagtgttcctcaatctctactcttaccttctgcccagtcactaggaaattgatgatgcttggcttcctcatttgactccaaagagtaccctttaaccagtttgtttttttgtttgtttgttttatttcactgttttcttctggttccccatgcaaatgactcatgggattctatagtaccaaagcaaacttcacttgattctatgtatgttactttcatttctattcattatggaatctctgggtgggcttttcgaccaacctcttcctttgtctacagctgtgtttgatatttcagaacctgactacagaggaaaacaagccagataattccaaggccaaaggaaggttaagtgtggaacacacacacacacacacacacacacacacacacacacacacacaaagggtgctattccctctgcaaaggaacagtgctgtacatatatgcgtggataattatttctttttgtgtactctactccattctagttccgtgttctcaaactgtggctaatcaaatgaaatatattgtagccctaagagactcataacttggatactgcagaaaacgaatttatatgtaccttccccaaaggctcttttgagttctctgatttattttaaaatccattttcaggattcagagcttgtttttgtggcttctgtgacctcatgcaagccttcgtgcttggaaaagttaaatctattttctaaaaccatattcccaagccttgatattatctttagtttaaaaattaatgaatgaaatagccaagttaattacctttggtaggcatctttaataagtatgcatagaagtgactttttataatgttttatgccataagaaaacattccatactaggagctatgagctgggtctatttctttctccgtactagccattgcctctgactcttctacttccaggagcatagcaaaactgcccagatattccggaaaacccaggaacactgcccagtgttagtggcagccttttgaatcaatcatgcctggtgctatccctgtggattcaccgagtttttgctcaaaaccagatacatgatacagaggaataattttttgcatgtagaaagagcaatagcctttaagaattacttactctctattctttctcctgaaagtgtcttttattcaaccctaatatttcagaaaatacagagtaacaaccattctatcaaaataactgtttccattgactgaaataatttccttaatattataataatattaaaaattaaaaataatattaaaaataaattccttaagtaagcttaactacaaagtttcctgttgatgtgcccaagtttgctactgtatattactgtaatcctatggataaagtttctttccttggttaagaggggtggcccttttctgacatacttcagtgtcttctagttttcatatgttcctttgaatgaatgaagcaagacatctgaatattagagagaacctggagtttaaggaaactgtgttgccaaatggatagggtttgtagaccttagaagaatccagatgcaagggtagactgtaaacccagcaacataaacaggacataatcctaccctgatcattcaaacaaagactaggtcatttcagagagttaggtttttttccccctcataatgtcaacattttagtatttatcaaagcatgtattccaaaaacaaataggaaagtgaacttaagattctttttatatataatggatttgataaggcaattccttgtccacatgagatattatataaaattattttagaaaacacaggattttgtacttaataggcattcaataaacattttagttgaatcaatgaatattaatttcataataaacacgaatttactagttcaaatttgaatacactgaaagtaaaaattacattgtaactattgttccgctaaaggatagctaagttatttacaagttacaataactaagaggaatatttgttagctcatttgaacttacaagaatgttgcatctttacactgaaaatcttacaagaaaaacgcacaatattttaaaatcatgcaacatatgcaatttataataatagcttctccactggcattgggattaaaatatatatatacttgatatgtaacattcatttagtactattccaaatcctaaggaaatgaaatgcaccatcttcactctgctattccacatattgctctggctttaatccaatcttaaatttcccctgtagcctgaaaactactgtaatccacatgatctcaaaaatcactttagtatttctaatgatcttgatttcagatgagaactgtaaggttttcattctagtatgattgaaaatatatcttttaagcactaatctcctttcttttgactttttaatatctatttgttgcagacatgttaaacaatctaaaggaacattcacctatgttctttaggaatacagtagaccttcttatctgcatgggggctattctaagactcccagagaatgcctacaacagccagtagtattgaaccagttgaggtcaataggaacccatttctgttcatgtcttccacccataaatttatggtcttttccatcttaactaagcacttttcacatgctgtggccatagcttttgtagtgtgaggtgtggtgggacagaaaacaatcacaaatttcttttttcttcatcacaacttcagggatagaagattccttcttactgtagagcttagcaactttagcatatgatttttttttaaatttccttaagtcaagaacttaaacctttcattcaaaggaagccctttaaggcttgtctttggcacatccaaactgttagcatcactactcttgcactttggagccattatgaagtaaaaaataattaaaagcatgcactggtgacactgccacagtcaacctgtcatccagacagctactaaatgactaatgggcaggtgacatagagagcatggagctgctggagaaagggataattcacatcctgggcaagccggagtggggcactgtaagacttcaacatgctgctcagaatgatgcgcaatttaaaacttagaatttggttgttatataattgtgtatttctggaattttccagttaatattctcaaaccatagttgaaactgtagaaagagaaactgcagatgggggaggggagaggctatttgtatttgtattttttttttaaaataaactcatacgatctcacattctcaatagctgttccactaaatagcaaggtagcggacacagacacattataaagctaggcggctggcttaaatctatcctctaagagctatactttttggtgctactaagaagttatttaacacaaaagtcacataattttcaatgcacatcatttaaaccttcaccatccatgtgcatcctccacagcccactggattaggcacacaactccctttttgacaagaacaaaaaatgttccaagggagaaatattatctgagtttagtcagttttggaaagatgctgtcttcattctatttcctgagagcagaaagtaggcataaattgcataaaattatttttaaagataattttttttgagacggagttttgctcttgttgcctaggctggagtgcaatggaacgatcttggctcaccacaacctccgcctcccgggttcaagtgattctcctgcctcagcctccctagtagctgggattacagtcatgcaccaccacacccagctaatttttgtatttttagtagagacggggtttctccatgttggtcaggctggtcttgaactcccaacctcaggtgatccgcccatttcggcctcccaaagtgctgggattacaggcatgagccaccaggcccagccttaaaaaaatgatattcttaagactatactgtaagtttttcccccaaacaaaagacataattgaatttaaactttatcactaaatatttggtgaatatgaatacatgtatttttagtagagacgggatttctgtatgttggtcaggttggtctccaactcccaacctcaggtgatccacccgccttggcctcccaaagtgctgggattacaggtgtgagctactgagctgggcctgagataactgttatatattaattgaactttcgtggtaacatttatacttttgagaattataaaaattgatacaagttcattgaaggcaatttggtaaatctagaatattataatggaaagtcactcattattctcccactcagaggtaacctctattaaaatatgtttatacttatttttcaatcaatactttttactctataagcttctctttaatagaataaagaaaagtgatttgtatttgtatacatatctatgtgcatgtgtgtatgtgtctatctgaaagtatgtgtgtatatttgtatgtgtgtatatacagtgtatatatgtgtatatatgtgtatatacatatatacactgtatgtatgtgtatatatgtgtatataatgtatatacacacgtgtatatatgtgcatgtgtatatacacacacgtgtatatgtgtgcatatgtgtatatacacacacgtgtatatgtgtgcatatgtgtatatatacacacacacgtgtatatgtgtgcgtatgtgtacacacacacacgtgtatgtgtgcgtatgtgtacacacacacacgtgtatgtgtgcgtatgtgtacacacacgtgtatgtgtgcgtatgtgtacacacacgtgtgtttgtgtgcgtatgtgtacacacacgtgtgtatgtgtgcgtatgtgtacacacacgtgtgtatgtgtgcgtatgtgtacacacacacgtgtgcgtatgtgtacacacacacgtgtgcgtatgtgtatacacacgtgtgtatgtatgtgtatacacacgtgtatgtgtgtgtatgtgtatatacacatgtgtatgtgtgtgtatgtgtatatacacatgtgtatgtgtgtatatatgtatatatacagatatacatatatacatgtgtatatacgtatatacacatgtatacacatatatacatgtgtatatatacatatatatgtgtatacatgtatatatatacacatgtatacacatatatacacgtgtatacacatgtatatatgtgtctatacatatatacacgtgtatacatgtgtctatacgtatatacacatatatacatgtgtatatatgtatataatgtatatatacacaggtatatatgtgtatatatgtgtatatatgtgtatataatgtatatatacacatgtatatatgtgtatgtgtgtgtgtatgtatgcctgtgttaaggccttctagagtagcttctgttattactcatattagaatagagagactaattttttcttttgtcaggaaatctattttttaaattgctgtcctcaaatatatatgcttgaaatttctttcaaaaaactcttccaaaatttactcatctaataatcactgaagaagataaaaagagctatcttctttatttaggagattaattcaacttgatcacatatatcatgtatcacatatcataacataaacattaatgtagaaaatatatttataaatatagttatataatacatattatttatgtgtatctcatatgtatacatacatacacacacatatatatttttttgggggtatgctttttatacctaagaatttcatcctattaccttcacacatgttttgaagacagacttattgggacacaagttttttgtctgaaaagtctggaaatgtgatcaaatgttcaaggggtttagcactgaagagtagaagtctgaggccaacctgatatgcgtttctttgtgggaagcctggtttttcttttctggagataagacatattttgttatcttgttaatttaaaaaaatcatctttgtgataaacatttgcaattacttatcaatgcacaaatttttttctacttacggaaatatcctcaattagtcctatttcacgtataccttgttttattacattttactttaaaaatttaaggtttgtggcaatcctgaattgagtaagtctattggtgccacttttccaatagcatgtgttcacttcctgtctctgagtcacatttgggtatttctcacaatatatcaaaacttttcatcattattatatattatagtgatgtgtgatcagtgatctttttcattatactttaagttctagggtacatgagcacaacgtgcaggtttgatacataggtacacatgtgccatgttggtttgccgtacccatcaacttatcatttacattaggtatttctcctaatgctacccctcccccagccctccacctctagacaggccctggtgtgtgatgatccccgccctgagtccaagtgttctcactgttcaattcccacctgtgagtgagaacatgtggtggttggttttctgtccttgtgatagtttgctgagaatggtggtttccagcttccagcttcatccgtgtccctgcaaaggacatgaactcatccttttttatggctgcatagtattccatggtgtatatgcgccacattttcttaatccagtctatcgttgatggacatttgagtcgattccaggtctttcctgttgtgaatagtgctacaataaacatacatgtgcatgtgtctttatagtagcatgatttataatcctttgggtatatacccagtaatgggatcactaggtcaaatggtatttctagctctagatccttgaggaatcgccacactgtgttccacaatggttgaactagtttgcactcccaccaacagtgtaaaagcattcctacttctccacatcctctccagcatctgttgtttcctgactttttagtgattgctattctaactggtgtgaaatggtatctcattgtggttttgatttgcatttctctgatgaccagtgaagatgagtattttttcatgtatctgttggctgcctaaatgtcttcttttgagaagtgtctgttcatatccttcacccactttttgatgtggttgtttgattttttcttgtaaatttgtttgagttattcatagattctgcataatagccctttgtcagatgggtagattgcaaaatttttctccattctgtaggttgcctgttcactctgatggtagttcctttgccaggcagaagctttttagcttaattagatcccattcgtctattttggcttttgttggcattgcttttggtgtttttgttatgaagtccttgcccatgcctatggcctgaatggtattgcctaggttttcttctagggtttttatggttttaggtctaacatttaagtctttaatccatcctgagttaatttttgtataaggtgtaaggaagggatccagttcagctttctacatatgtctagccagttttccctgcaccatttattaaatagggactcccttccccatttcttgtttttgtcaggtttgtcaaagatcagatgtttgtagatgtgtggtgttatttctgaggcctctgttctgttctattggtctacataactgttttggtaccagtaccatgctgtttttgttactgttgccttatagtatactttgaagtcaggtagcatcatgcctccaggtttgttctttttgcttaggattgtcttggctatgcaggctcttttctggttccatacaaaatttaaagtagtttttccaattctgtgaagaaagtcaatagtagcttgatggggatagcattgaatctataaattactttgggcagtatggccattttcacgatattggttcttcctaaccatgagcatagaaaggttttccatttgtttgcatcctctcctatttacttgagcagtggtttgtagctctccttgaagaggtgtttcacatcccttgtaagttgtatttctaggtattttattctctttgtagtaattgtgaatgggagttcactcacgatttgactctctgtttgtctgttattggtatacaggaatgcttgtgatttttgcacattgattttctatcctgagactttgctgaagttgcttatcagcttaaggagattttgggctgagacgatagggttttctaaatatacaatcatgtcatctgcaaacagggacaatttcacttcctctttttctaattgaataccctttatttctatctcttgcctgattgccctggccagaagttccaacactatgttaaataggaatggtgagagagggcatccttgtcttgtgctggttttcaaagggaatgcttccagtttttgcccattcagtatgatactggctgtgggtttgtcataaatagctcttattattttgagatacattccataaatacctgatttattgagagtttttagcatgaagggctgttgaattttgtctaaggccttttctgcatctattgagataatgatgtggttttgttgttggttccatttatgtgatggattacgtttattgatttgtgtatgttgaaccagccttgcatcccagcgatgaagctgacttgatcgtggtggataaactttttgatatgctgctggattcggtttgccaggattttattgaggatattcacattgatgttcatcagggatattggtctaaaattctctttttttgttgtgtctctgccaggctttggtatcaggatgaagctggcctcataaaatcagttacggagaattccctctttttctatttattggaatagtttcagaaggaatggtatcagctcctctttgtaactctggtagaattcgggtgtgaatccatctggtattggactttttttggttggtaggctattaattattgcctcaatttcggagcctgttattggtctgttcatagattcaacttcttccggctttagtcttgagaaggtttatgtgtccaggaatttatccatttcttctagattttctagtttatttgcatagaggtgttcatagtattctctgatggtagtttgtatttctgtgggattggtggtgatatcccctttttcattttttattgcgtctatttgattcttctctcttttcttctttattggtcttgctagcagtctatcaattttgttgatcttttcaaaaaaccagctcctggatcattgattttttgaagggctttttgtgtctctatctccttcagttctgctctggtcttagttatttcttgctttccgctagcttttgaatttgtttgctcttccttctctagttcgtttaactgtgatattagggtcttgattttagatctttcctgctttctcttgtgggcatttagtgctatacatttccctctacacactgctttaaatgtgtcccagagattctggtaagtggtgtctttgttctcactggtttcaaagaacatctttatttctgcctttttttcgttatttacccagtagtcattcaggagcaggttgttcagtttccatgtagttgtccagttttgattagaatatagttttcattagaattaattagaacttaatcctgagttctaatttgattgcactgttgtctgacaaacagtttattgtgatttctgttcttttacatttgctgaggagtgctttattccctatgatgtggtcaattttagaataagtgcgatgtggtgctgagaagaatgtatattctgttgatttggggtggagagttctgtagatgtctattaggtccgcttggtgcagagctgagttcaagtcctggatatccttcttaaccttctatctcattcatctgtctaatattggcagtggggtgttaaagtctcccattattattgtgtgggagtctaagtctctttgtatgtctctaaggacttgctgtatgaatctgggtgctcctgcattgggtgcatatatctttaggatagttagctcttcttgttgaattgatccctttaccattatgtaatggtgttctttgtctcttttgatctttgttggtttaaagtctgttttatcagagactaggattgcaacccctgcttttttttgctttccatttgcttggtagatcttcctccatccctttattttgagcctatgtgtgtctctgcaggtgagatgggtctcctgaatacagcacactgatggatcttgactcattgtccaatttgccagtctgtgtcttttaattggggcagttagcccatttaaatttaaggttaatattgttatgtgtgaatttgatcctgtcattatgatgttagctggttattttgcccattaattgatgcagtttcttcatagcatcaatggtctttacaatttggcatgtttttgcagtggctggtaccagttgtttctttccatgtttagtgcttccttcaggagctcttgtaaggcaggcctggtattgacaacattactcagcatttgcttatgtataatggattttatttctccttcacttataaagcttagtttggctggatatgaaattctgggttgaaaattcttttctttgagaatgttgaatattggcctccactctcttctggcttgtagggtttctgcagagagatccgctgttagtctgatgggcttccctttgtgggtaacccgacctttgtgtctggctgcccttaacactttttccttcatttcaaccttggtgtatttgatgattatgtgtcttggggttgcacttcttgaggaatatctttgtggtgttctctgtacttcctgaatttgaatgttggcctgccttgtgaggttggggatgttctcctggatagtatcctgaagagtgttttccaagttgtttcccttctcctcatcactttcaggtacaccaatcaaatgtagatttggtcttttcacatagtcccatatttcttgcaggctttgttcatttctttttactcttttttctctaaccttgtcttctcacttcatttcattaatttgatcttcaatcactgattccctttcttccacttgatcaaatcagctattgaagcttgtgcatgtgtcatgaaattcttgtgccatggttttcagctccatcaggccatttcaggtcttctctacactgtttattctagttagccattcatctaatcttttttcaaggtttttagcttccttgagatgggttcgaacaagctcctttagctcagagatgtttgttattaccaaccttctgaagcctacttttgtcaacttgacaaatcattctccatccagccttgttccattgctggcaaggggctgaaatgctttgcaggagaagaggcactcaggcttttagaattttcagcttttctgctctggtttctccccatctttgtggttttatctacctttggtctttgatgttggtgacctacagatggggttttggtgtagatgtcctttttgttgatgttgatgctattcctttctgtttgttagttttccttctaaccatcaggtccctcagctacaggtctgttggagtttgttggaggtccactccagaccctgtttgcctgggtatcaccagtgaaggctgcagaacagcaaatattgcagcctgatccttcctcttgaagcttcttcccagagaggcagctgcctatatgaggtgtctgtcggtccctactgggagatgtctcccagtttggctacatgggtgtcagggacccactcgaggaggcagtctgtccattctcagagctcaaatgccgtgctgggagaaccacttctctcttcagatctgtcagacagggacgtttaagtctgtagaagttgtctgcttccttttgttcagctatgccctgcccacagaggtggagtctgtagaggcagtaggccttgctgagctgcagtgggctctgcccagtttgagcttcccagctgctttgttttagctactcaagcctcagcaatggcagacaccccttccccagccaggctgctccctcacagttccatctcagactgctctgctagcactgagcaaggctctatgagcgtgggacctgccaagccaggcacggaagagaatctcctcgtctgccgattgctaagaccttgggaaaagtgcagtatttgggcagaagtgtcccgtttttcaggtacagtctgtcatggcttcccttggctaggaaagggaaatcccccaaccccttgtgcttcctgggtgaggtgatgccctgccctgcttcagctcgccctccgtgggctgcacccactctccaaccagtcttattgagatgaaccaggtacctcagttggaaatgcagaaatcccccatcttctgtgtcaatcacagaagacctgcagaccagagctgttcccatttggccattttggaatggacccaatcagtgatctttttatagtactcttgtaattgttttggggaaccatgaaccacacccaatcaagacagtgaacttggtagataaatattgtgtgtgttctgactgctccactaagcgggcatggccccatcttcctttctctttttggccctctctattcccagagacactgggaatttagaccaatttataaacccacagtccaattaggccaatttataaacccacagtccctttgtgttcaagtgaaaggaagagtcacatgtctcccaatttcaatcaaaagctagaaatgattaagcttagtgaggaagtcatgtcaaaagctgagataggcaaaagctgggcctcttgtgctggttacccaaggtgtgaatagaaaagaaaagctcttgaaggaaattaaaagtgttactgtagtgaacagacaaatgataagaaagcaaaacagccttattgctcatatggagagagttttagtggtcttggtagatcaaaccagccacagtatttccttcagccaaaacctcatccagagcaagtccctaactcttcaattctatgagggctgagagaggtgaggaagttgctgaagaaaagttgaaagccagcagaggttggctcttgaggtttaaggaaagaagccgtctctgtaacatgaaagtggaaggtaaagcagcaagtgttgatgtagaagctacaacacgttttccagaaagtctagctaagaccgttggtgaagatggctacactaaacaacaaatttcgttgtagatgaaagagcctttcactggaagaagagatagagagaaaactttaagagatagagagaaatagtcaatgactggcttcaaagaataagctgactctcttgttagaggctaatgcagctagtggctttaagttgaagccagtgctcatttcccttcctcaaaatactgtgcccttcagaattatgctaagtctactctacctgtgctctataaatggaaccacaaagcctgggtgacagcatatccgtttagagtgtggtttattgaggattttaagctcaatttttagacttactgctcaggggggaaaaaaagttccctttcaaaatatgactgcctaattgactgtgtacctggtcacccaagaactctgatggacatgtgcaatgagattaagttttcatacctgctaacacagcatccattctgcagcccatagatcaaggagtcttttaaatttttacatcttattatttaagaaatacattctataaggctataccttccatagacagtgattcccttgatgggtctgagcaatgtacattgaaaccttctggaaaggattcaccattctagatgccattaagaacattcatgattcatgggaggaatatcaacattgacaagtgattgaaagaagttgattccagttctcatggatgacttcgagggggtcaatacttcaatggaggaactaactgcagaagtagcaagggaactagaattagaaatggaacctcaatatatcactgaattgctccaatctcattataaaacttgaattaataaggagttatttcttaggggttgagcaagaaaaatgttttcttgggatggagtgtactcctggtgaagatgcagtgggcattgttgaaatgacgagaaaggatttagaatattacataaacttagttgataaagcagcagcagagtttgacaggattacctccagttttgaaagaaggtctactatcggttaaatgctataatactaagcagcattccatgctacagagaaatgttttgtgaaaggaagatttcatggatgttgcaaacttcattgttatcttgtttgaagaaattgccacagccactccagccttcagtaactactaccctgatcagttagcagccatcaatatcaaggcaagaccctccacaagcaaaaagattatgactcactgaaagctcagatgattattagcactttagcaataaattaatttttaattaaggtatgtacattggtttctttgacacaatgattccacacttcataggttacagtataatgtaaacataacttttacaagcataagcaaaccaaaaaactcatgtgacttgctttattgtgatatttgctttattcggatgatttggaatctaaccagcaatatgtcccaggtattcctgtatttggttagtcagatttcctcctcaggagcaattacaactttttatttggttattttttttttctgaccactgtattttcatcttattatgtacatctagtagtcctttcctttatattctggaggcttctcaagtttgtattcaatagcgctgatctggctttctgaaatgtaaattcctttctttattgcctccagtatagattttaattttgctactctttaatttccttgcaatccctgtttatcatatccagttttatttttattcattccattgtctttttaatttagttctatctctgcctttagctttggtctctgatgttataggaccagtgtcttttgacttttgaagagaacaaaacattttctaaaatcttattttgcttcctatagtaaatcatgttcactgaacgaagcagtatgaatgatattttcttcataatatccgtagtatattctcaacggccctgtttttttttctcactcattcttgaatgtagaaaagctttccagatattttgccagcaaatgtgtagtgaattgtgtttggcttcactttttgccaacttacatgctggttgaatctccttcctggctttacagttaaatggcaacacttaatctaattcctaggccttaacagacactcatatagtgttagttggaaggcttatgttgggaatttcttctacccacttcctttctagctgtctgatactctgttaagatgacttacatgaaaaaaagacaaacagacaaacacaaagctgtaaggtttagaaaatgcttcttatctagtgagagatacaatttatcaatttttttaaacagaatttttaggcattatatcatttgcttgctggatacatcaagtttcacaaataatttaaaaattacactgtttggtactttgagttctgtgttcttgttaaaaaatgctgcagatagttatcacaccactacactccagcctgggcaacagagtgagactgcgtctcaaaaaaaaaaaaaaattgcagatagtaaaatataaactgcacttcagcctaggtgacagagtgagaacctgtctctaaaaacataaaataaaaaaattaaaattaaaattaaacaattaaaaaataaattaaaaaaataagacaccgtaagtcttatggatagattagcattatggatagaaatagtaacagccactatgcatgagatttgacggtcattagacatgaaccttgtttcagaatagctttttttatcttttttagtaattctaccatttgaagatcattccgtctttaaaaaaatttttgtgtttttaggagatctttgattctctagcctcacaaattttttctttagcagagttttcaaaagtgtcatatttttacatctcacttttactactagtttttttttttttttttttttgagatggagtttcgctcttgttacccaggctggagtgcaacagcactcccaggttcaagcgatcctcctgcctcagcctcctgagtagctgggattgcaggcatataccaccacacctggctaattttttgtatttttagtagagacggggtttctccatgttggtcaggctggtcttgaactcctgacctctagtgatctgcccgccttggcctcccaaagtgctgggattagaggcgtgagccaccgcgcccggcctttactactagattttaagttaaatgtggtaaaatgaagctgctagaatctggaacatagtgagcattcaataactgtctactgattctgcatcttccaggagaatgccatgtcatatatatttgtgctgtgctagtcctttgtccagtcccttgccctagaaggagtttaataagtgttgtttagcaaacaccttgggaggtgtgaaacctcaggtagttcccagaaatgcaatatgaagttgaatgttaggaactacaaatcaggatcaataattttagtccaaatgttctaaactcagctttctttatagacaagataaattgtctataaagactctatagactcagactaataggtcttactagactgagtgtaaatttgaagacagaaatagattatatggctaaaaaatgacaactacatgcaataaagaaggaaagatactacactagatgctacaaatacattatctcatttaataagactgagagaaagagaaagcacaaagtccaagtttatctaaaaaatttatcaagaaattttaaggatttcttgtatgtaaaaaaatatatatataatacgtattttctacatatatacgtatatatgtggaaaacaaacaactgttgtttaaaatgcaggtaaatattttaaggctcctttgtgtatttttcaaattctaattttaactcttgtcccactgatcaggagaaaaattaattaatctattggcttatgttatattgcaaatggtaatcagtgagccagaaagggtcaaacaaaagtagaattccatatgaattgcaaagaaaagagcaggcttatttctcaccctataagtccatgtttctgagaagccaaagagagagaatgaaagagagagggaaggaatgaagatgaaggatgaggttaaagtttcattttccagtctacctgttaacacctcagtgatacatcattaggatgagtcagtggaagtttggggttccagattgtatatatttccctttaaattcaaatggccttccaagagcccctggactttgaattataatctctaggtacctggcaaaaattcccagctaccattacctgtttcacaattatttttcttggcagtggattatggggaaaatgtcattaaaagggggaaacattactacagaggtaagcttagatatgtcaagagatgaaatagtgaaaaagttaagcaatgtaatgattagactctctactcttttttttttttttttttttttttttgagacggagtctcggtctgtcgcccaggccggactgcggactgcagtggcgcaatctcagctcactgcaagctccgcctcccgggttcacaccattctcctgcctcagcctcccgagtagctgggactacaggcgcccgccaccacgcctggctaattttttgtatttttagtagagacggggtttcaccttgttagccaggttggtctcgatctgctgacctcatgatccatccgcctcggcctcccaaagtgctgggattacaggcgtgagccaccgtgcccggcccgactctctactcttgaagaatatatttcttcttcttctttttttttttttttttttttttgcccatgcaagttctcaccctgtggcccaggctggagtgcagtggctcaatcactgctcactgctgcattggcgtcctgggctcaagcaattctcccaccagcagcaggcacaccaccattcctggctagtttttaaaaatttttgtggagacagggtctccctatgttgttcaggctggtttcaaattcctgggctcaagcaatcctcctgcctcagcctcccaaagtgctaggcttacaggtgtaaggcaccgtacctggccaaaaatatattttcaaaatgaggtggatgttatactttttgtttccatgttattaaactatcactttttattttatgaaactatagttgaaaaaaatgttaaacagttcttcttatatagtagtaactcataaatacttgatatatttaaattgtgaagacacgtcttacacatctctgtattttaaatgttattcttccttcctgcttgcctgcttccttttctgccttccttaatgtcttccttctgactttatttaaaaatatttatccttattggactttatagaaaatgtaaaaagaggactttgtgaaattccatgtagaaatataaagctaagtaaaataaatgcctatattagaagcacttagggtaggaagataagggacataaaataaaaggtagaagattaaacaagtaagactacccttcaggaatccaaggagatccaccaattaattcattgaggaaagctttagtggaaatatctgacctatttttgggatacattcattcatttacagttttcattcactcattaaaacatattttttgaggaccggctttatttaagcttgtttatggccactgaaatttcaaaggtaaaaacacgactatcatctgcactctcaaagatctcaccatctaatgaagaaaatatacaattaacaaaattatacaacaattatataattgtgacaaatgcttgaaggagatccagaggatgctaagagagtatatagtaggagacctaatttagagatctcagggtatgcttggtagaggaggtgacattaaaaactgagccttgaagagtgaaaaaagattagccaaatgaggactggagttatggaggtcaagaaggaagaatttccggcatagagggaatagcatgtataaatgtcacaaggctgctaggattttgatctttttgaggaaaggaaggaaggcttttgtaggcgaaatagagaacaaaagagggagatatatgaattgaagctggaaagatggggaggggcctatgtatgctggcctggaggaatttcagtctctttagtgaaggccctgaaggatttaaacagaagaggcgactgttgtgtggcaaatggaatagagtgaaagtcaggttctgcattacaaggcaatctcagaagtccagattagagataataacaccttggattgtgtatggttttggcagtggagataaggagaatgaataattcaagatctgttttggagggaaaacagacactgctttggttctttggagggggagcgtcaaggggacattaaggtttctcgtatgaacaatggcagatcttgatgtcttttgtaaacatgggtaatatcgtgtgtggtttaagatcatgaattaaaaatcagagacattttcactttatgaaaaccatgagacaactaagtggagattttggatggatcattcaatggggaagtgtgtaagtaagctgctcataagggaggtcagtcctgaggatgaaaatgtgagaatcaggggaagaaggatagagtttgaagccatttgagtcctaagaatagatattatttggaatggtaaaattatattcttttgttagacataatttctaccacatggtttcaaaatgcaggtgccattcttctgcattatttgagcacactcaaggaaaaatattttcttctcttgagtaacatttctttaacacaataatgtaagccaaaaggagaataaaatgtactttattaaacttcttttacagcataaattactggtgcttatctattcctgaagattttttttggttgttgttgtaaaacttcttataatgggtgttctccccatctacaaatatacttcgatggtcatttattggaagacatttgatttgttaaataatttcttatgtcaggcaattttgcaagtaacatgtttccacctcaaggaataggtttatgggtagaaatcttctttaaatgagccagagttataattatcatctaacttgttgctttaaaaagtcctattttaagttctgctaataattcatcttatcatgttattatacagtctttcccatcataaggcttacttgaaaatgaaatatgctaatacttgataatttaaaagaagattgtattcattagtatctgtataatctctagtagtggcattgtaatttacatttattttttaaaagaaacactttaaatgccccacgatattataagatctacaacatccatattggttacataatgacataaattatggggagaaacacaaataaacaaagaaactgtttttgaacaaccttgaagaaattactaaacaggataggcagagtgggaaaatcttccgttttattacaaaaatgaaaccttgatctgaagtcaggctagaatgactcatggaagatttaaagagacagcttgtttagtggctccaatggtgtggtgaaattaaaacctctactgaattaaattatctgcctaaaaacaattcataatgatttaaaatactggtaagattacaatatgtatattttaaaatctgaagtgtcttaaaatgtcatcatcttcatcactttacagatttactaaactagggtctgagtactggttaatgcgtaagttcgtgtttttgagtaaatatccagatagacaggtctcaatagttcttatgtgctcctgagaatttgctttgtgatatttcctcctttgttaaatttattttaagaataatgacttttttggagttatcatattatctcctaacatgtgtcattatcttgtactgttactcaatcttgtcctgtatttcccttgtcttaaaggaattgcctatgaccccttgatgctgaaacaccagtgcgtttgtggcaattccaccacccaccctgagcatgctggacgaatacagagtatctggtcacgactgcaagaaactgggctgctaaataaatgtgaggtaatccagaattggacacactcttttacttacttaaataaatcatgtaaagaggccagtattcatttggggagtaatagaaaaatattaaccatatagtgcaaacaccatgattgatgaaccatcatagattcaggtagcacagagcttaccacctgactctgggcggggcacactgtaagtacttggtcagtgttgatgagctgagcagctgcctgatgtgtgtgttccaatgctgcagtattattacatatacatggtagcactgtttgtaaacagacattatttattgagttgatcttctgagaaactctttgctaagtaattattatttttggttataaactaaactttggatttagatatatgccaattttgccacatggaaatgaatcaatttaaaatatcaactgtcctcttaccactaaaagtcatttctttttattgaaatgattgatgtgtttataacttgatgaagggatttgaatactttgattttatcattatttctttaaactcatttcagtaggcgcttggtgaataccatttttatttggaaaaatatacctttttatgctttcaaaggttaaaaacaacagtcatatcaattcagaaaggctcccatcatcaaatgtgcaaaatatgtaacaaccagctgctattcgatttagttgctataaatgtccattgttgtctgaaatccagtaacattctgcatttgaatctaaggcatttttaaaagaaaaatgcccttcatgggttttctcacattattttaacatttactaattatttcttttactgggtctctgttaggttctaaacatgattcaagtactggaattataaaatttcacaagacaaatatggtcccaaaatgtagtcaacaaaattcctattcaaattcaacttaggtttaaactgagtctgtaaaatattttacttgaaatagaaatgccaaagcagacagaatttttcagcaggtcaagtgcacttgcctacgtatgatagtgtgagttacatcaatctgatccccttcctctgcaaactactaaaaataattgacttttgaagatgcaaagccattcattcagtttgttcatttctatggataaaaaaattttctttatggatttgtttctttaaagggtggataatatattctatgttacaagggaaattaattggtttttaaaaacatcaaaacattggtagtgtcttatggatcgctcagtagttgagattgtgaatgaatataccacaacaccatgtacagatttagtctcacaagttttattatatatttatggtagaattatcaaacagttttcatatttaaagctctgcttttgattaaatgtatcctttacctagaaaccccaaagtgaaggaaaatgaactagatttatttatctggtcctttcctcagtgcaagtctattactcatttttttttgccagtggcattcatattgtatggcagaaggctttcatactctggtcaattttagagttatctttaaggatttcatgtttctgatactgcagtttggaggccaaaccattctcttttctatgcaatcccatatggagtccataaagtagaccagcaaggagaattatttgtggtaggctggtcttaatggacaaaatgcatttattcatgtgaacattcctgtctcaccttttcatctgctctgcaatttttgtgtgcttttgccagctgaggcattgctgcttacattttttcacattcacgtttgtgttatatcctgcggcagctggcctggtcctaactacttcaaattgtcagtggctgatcatagccttcgaatgccttgttagatagtggtattcctaaatcctattacctgaaggagaactgtttatgaaaggaacagagtacagaaataaatggaatttgatatgattcacactggtctaaaaattagaaagtctattatcatccttttctggttagtcttctttttcaattgcttatatacattacattattttcattctttattatttgaaaccatacaattcagtttgtatagcactaaccgacgtaatatcaaacacaagttgagatgtcagaaacactatcatacaactatgggtttgaggagaatagagtctccttggtatcacttaatcacaaaattaacaaataatacactcacaagcccaggtcagcagatttgctcttaattaagattaagcacaaacatcatatccaaaacatggcaacaatgcaaatagaagccacttttcctaacatagtttgatggcagttcaccaggtgtttgctttcttaagtgaagattatgttgccgatattatttatcattatatatgataatgctcctacattatcaaaacacccatattagcgaagaaagtattgcccatataaatttatttactttatgaaattatgagatgctaacctaaaccaaacatgaaatggaacttctaaaactgctaaaaattaattcacttttaagatacctaggactttaatggcagatggacatctgcccatgtgtgaatgatattagaaaaattcaaaattaaattttagaaagtattaactaaacaaatgttacccttgtgtagagaccttttgttcaatatgagataaaacagaactaaaagggaaacactattttcataacttattttctcttcctgattggttttaccagaagagtaagggagtaaataaaaagggaacacacagagattattccaaaccaggttagccccctcagaaatagtagaatactacctagtgctctcccaagtccattttttttttactaaacacaatggaagcaactgatatatgttccttgtagatttcttctaatatttttgatttgacaaattaagtatatatgcaaatattttactatgttattaagccatcttacaaagatgctaaactttctatttcatgccaaattattttcgaatgccgtgaaaaatacaacacaaatttatcaacaaatactttagcaatttgccacatgtcttaagaatcagagttgttgaagaatcaggagaaaagcacaccatggaggcaagtgatctgtgtgcctggtgggtatttaggctagttgaaagcgcaagaagggtcctacccaaaagcctactggttagtgtttctgagccttctaaaggaatcaaagataatgacagtatctgcccactgaagttcacttattcactcgacagaggaagttgggtcccagctcaggtgtgagtaacttatttaccaagataccccaaggacccaaataaagagaatcaaggctcaagggcattacttctaaataggctagaaggggctatcagaagttaaacttttgttcctttgcctagttgtgtctaaaacacgctaacatgaggaggtataatctctgctaactgggactccaaggatttgagtaccaggcgggatgtcttaggttatcattctctcctaagcagtatgaacaatttcctctctttgttgtgggaaataagaactcagttgtttcaaaagagaggatttattagattccacaggaaagggtataatcaaataggaatataatgcatacaagccaggtcagtgcattgtttttcagtatccacatagtcgtctgccgtctttgggaactattctcccaccacgtctgtgtagccacttctggtaagaagggtatcttgaatgttgacatatttcagaatcatctgaggggatggtaaaacacagattgctcagatctaaactcagaacttctaattcagtaagtctggagtggggtcagagaatctcgttgctaacatgtgtctgggtgattctggtacttttggcctggacaccacacgttgaaaacagtgatgtatccattcgatgatgtttatcaagaatttgagttttccaggcatctttgttaggagtagaagatacaataccgagtacaaaatatacatcccctgtcttcaagaaggttactatatggtgtgatcagcaggcattaattagacaatcatacaaataaatacacaattacaaatttcaaaggggttttgagtcattcattttatattgctgtgattttgaagactcttattgattgtgcttgagcaagaaaaaaatgaggaagattgtggtcagctgcctctatagtcttgacagcatcagtggggccctgtgaccaagagacagaggaggtaatgttacatgtgagagtgtgaaaaggaaaatatcctagatcttgtgatgaataacttgccctctttgtgttttcatttgtgttctttgtttattggggttactatttgaccaggacaaaaaataaggaatctcaattctgctgacatacagagaagggtcagctttcctcaaccaacagagcagtcaattttacaattaatgaaataaaaaaatacataatagaagagatagcactttgaaaatgctaaaaggattccttcatttccaaacagtagactgatccacaactcaaacttttggtttatgtcaattcatttagcaatgtcgcaaattaatcaaaatgtattctctcaaagatgatcattcaatattagattcgaccttagttttgccattaattatctgtgtgcttttgtcagaccatttaactttgctgatctttggttttcctatgtttagatgagggtgttaggcaagatatttgctaggatctcttacagctgtaatactgtctgacactagaagtgttaagcagttcttttggaacataacactctctttggttaagagtagactaaatttttagaatgtttcagtaaacatattgctcttagtttgtaagctatagtgtaaattggctctgcttactaatcctgattagtagccagagaaaacattagtcctcattatattagattacagtggttacatgggttaacttttttttggcctgacgtggcactgtttttaataagttgaggcagttagtagtccttcatgccaataccacttaattttttcccctactgaatcattcatacttagtttagtgattctgttgggagcaaagagcaaaaccagcagctttcttatcaccatgagaaatggatctggaggggttatttggtgtcctcttcagaaacaagctatttgattaagtagctgggtttccaagatgtgcatgctcctgaagaaaagaaatgtgctcttctgtggtcaaaaaaaattgtggaggttgacccatcatctgttagaaatgcacttgcagttgttttttccagaaatgctcatgactcccagccccaccaagccacccacagacatttgcttgctctcacatttgttttgagaataataacattttataatgcttttgttggattacacattatgtggaatttgcgttgcctttttgtgactaatattgaataactttgcttcgcttaattcataagtaagaaccataagcaacatacagtgctgaaatgtttaactcgtttattcaagtgccaacacaaagtaattacaaaacaattctgggacgcaaaaccaagctactgttgtcccttcagggtcttctcggcagttccaatgagaaaagtggagagcaagtttagtgcagaatcttatgatgccaagaagcagggattccagcatatcttcttgcacacataggtgactgtaaaatacctctttgttttaaatcaaatctaagtaaggaaatacattcatctgtggtgaaacactttggaatgtgcaggttttctgatatcaagactgcaaagcgctgaaaactgcaagttaatggaaattcaattagacatttgttttatagagtagtctaactagatggcagcacgtaacagtgtactgttttgcttagtttgcaaaaaaaaattttatgtgtttgtgccttagaatctaaccacaaaacagagagaaactcaaacagggaaccctgtgaattgtctctaaaggatatggcagtcttggaaagaagtacaagtgatctagatttgatgagtaaaccaggctacattgtcattgttctaaaagatatttgtatatcacagagtggacccaggcagataaatataccaaaactaattgtacaccttatagtcaaatgatttaggatttcttttaacaatgtctgctaaacagaaagaattaatgtggaaaacaaccaacaaaaggaaataagagaggctgttcttctgagtccatttggaaagtaatacagagcttttgaaacagcagcgttgaagcttattaataaaaagagttatataattttcacccatttgaaaattgcagtttttgagtaacaaaaaatatttgttgaaagtttgtttcatacatgatgaccagtttaaaaaagcaaagctttaaattcaaccattaaaatatttatttacaatttttagaaagaataattgcaatgtagggggttcagttgcataaaggattgtgaaaattgagcagttagactaagggataacatttttttcttgctttctggtgaggacagtgatttgaaataggtggaagtaaaacttaaaaaaatagagagtatatatgctcgtcaccatttcagagctttattattgaactgggatttgctgttttctgaagtgctttagaaatggctctatgtcctaaaatactttaaaataagtcgtagtgactgaatcaagcagtattaagacacatgaaaggcacttaacattttgaagattgataatatttttactcatcaatcttccgtccaccaatattttaaccattccgtagtcccaagtgttggtcagtacagtgtcagtatcttgcactcagttatgagcagtaagtatggacagctccctctaacacgtggttcttgacctaagctacccattagaatcctctgggtggttggaaacatctgggtgcccaaattgcacccagacaaaggtaataaggtaggacccaggcatcagtaacttttaaacttccccagctgattccaaggtgcagccaatgttaagaactactgaaacagaaacacaacttcttaacataatcttaacgagatagagacaaataggcaagtgaatcaaatatttggagatgggaaagtaacagaagtaagcattaacctgagaaacaaagatgacactaactcacaagtgtcgtacataattttcaaaaattattaaaagcgtttattattttgaagttgtcacaggataggaatatgagctgtgaaaaattctcttatttttcaattatgattaagcttataagaaacaagcatcatggaatagctggactccttttgaaaatccttattcaggtttcctgtttggcctcaacctcagtaatttatcattgcaattattttatttgcttgcctaaggcaaatgcataaatcaaagcgaagcgtgttttattgcatttctattgcgtgtaaggttatttcacatagaatcctatcatcttaaggctaaaaatgagctttgacataatttagtcaaacatctttatgttcatagatgaagaaacaaaggcccatagagatatctcatggctgactataggcacattaaggacacgtgggagtcaggaccagaagtcaaggctcccaacttgcaattctctttttttccatgtgacccacagaaaggaccaaaagcctgttaggccacctgcctgcttgattgcctccttccttctttcactccccaacctttttttttttttatgagaaaaactctgagaagtacaggttattacacgaggagggttgtgtggaagattgtgcagttgcaggggcagttaaaaaccatttcttacgtaacattttaagaagcagttggttggagcattttaaaactccagtagttgtgcttaggcataagcaatgagatcatatttttatgtttttttttaagaaagacagatagataaaaaaatcaataagaccatgaattgactcattaaatattaagtatggtatttgtggcagagtgtaactttgacactaagaagtcatttatgattctttattttcttcatttttttaacctttgaatttcttcagccctggatttttggagaaaataaatgaaaccacatccctttatttagagacaatggatgaaatattttcagaaaatgggatatttcagtggaaattcttgcctggtatgtcaccactttgaaaatgattaaagaaaatggagttttccccagtggaggcaggtactctgacttgtcaaatttaagttggacattttctcttagtttggaactgccacaaaatgagccctttcatgtccacaataataccaaaccaatgcaacccatctgttctgctaaattatttctagttccctaaccaaaggcactgctttttcatgcattttatcatgattttttgccctttattatattttacaaaaggttctgattcctccagggccaatgagaactgattaggacactggcctcaatccaggctttgaacacaggagggaaaggaatagaactgtttccttttttccctgctccttggcagaaaaaaatatgaatctatatcgtgtgtgtgctctgtgtgtgggtgggtgtgggtaggctgcattttatcctgtcacagtatgactttgtagatcatgttcagaacatttcttctataatcgggatgcattaacgggctctctttcagaaagactatttctttaagaaagaaccatggtgtgttgtgagactcaatgatatggtcattttaaataactttagtcaaactcccaacctgaatatagactgtttagggttctgaactaaacatgatcatattcctaaccacagagtaagtgctcagtgagcatagctccttttcagactctcagggaagaaactaagtgcacgtcacagggaacgataaggtaacaatgaacacagtcctacatcacaaatttctttattaagaaggtgacaaaagctatgaggtttcattcctaggcctgtgttggtaaggcatttaagacccgtattgactccaggtgagaaatccccagatgaaatccattccttatttgcattgtgtgccccaatatgctcagaattcttaaaaatctttttgggcaggctatcatagataactttacgtagatatccttcggaccaagtatctctgagaatagaaatcagtactccctaaattaagattatcagaaaactttagcctattttttgactctttatgctattgacctttaactcaagagagccttgagagagagaaatgaaagaataaagggtgcgcagaaagttgaaaatatgagaagtgattacgtgggaatatctatatttaagcctacacaaataaaatactaaattactgatggcaataccagaaaatgggaactggtgaagatctcaatatgaaaggaaaagttgaatgtgacaaatttaaggcatttatacaagtgaggcaaaacggaattactccaggagatcctatgtgttaaggaataaagaaagctgttgctctttcagaattttcagcttaatcatccaccaaattctcctagcagtgtctctgtgagatacaaatttcaaaacatgctttttccagatcctgtctacaggtagaaacatttttttttttttttggtactgaattagttttcactgctctctttctgtagaaacatgtgcactatgtttgtgggctgttctctagcaaccaaagaagcagaaggtgattgccaagaataagtacttccttatatttagtgaaattattttttaaaaatacttttaataataataataagagccagtgtaaaatagttgcttagagtcaaaagaaagaataaggagaaggagaaaaagataaatcaaagtgaaaacttaggaatagtggtacattttaatggcaaggatggggcctagagtataactagcggagaaaactgttagattaagtcaatgctagatagctgggccaaatgagctgtctttactgttagttgactgatcttacacaaggggatgaccgattcagcaggtttcttcttatcaggggtccccaaaccctgggccacggaccactactggtccatggcctgtaaggaaccaggctgcacagcaggaggtgagtggcaggtgagtgagtgaagcttcatctgtattttcagctgctccctgttgcttgcattaccgtctgagaacagcagcgacattagattcccagaggagcgctaaccctattgtgaactgcgcatgtgagggatctaggttgagcgctccttatgaggatcaaatgtctgacgatctgtcactgtctcctatcacccccagaggggaccatctagttgcaggaaagcaagcttagggctcccactgattctacattatggtgagttgtataattatttcattacatattaaaatgtaataataatagaaataaagtgcacagtaaatgtaatgtgcttgaatcatcctgaagccatctcctccactttttttgtcttccacgaaactggtctctggtgccaaaaagattggaaaccgctgttcttatgacttactagcacttcagctactgtcaattacagtgaatctcgttagcagatgagtgtttaaatgtgtgattgagcattcagctagaatcagtgggattgtgggtgaataagcaaaggtgttggacaagcatagagtgcatggtatgcaaatttacatgactagtgtatgaacacatcaagatatacttaatggtatttaatgttataccggaagtaaaaatttaatttatagatgaaacgaatctttatagacatgaagaaaggaggaaaaaatcaatgaaagtttatgatagtcatcaaaacatgggtctgatcattagctgcagagctgacattgttgaaaatactgatgtttcactgtatcagcatatacgatgttagtggctatggatttcaaagacccatagaaggaggagctcgaagccctcttatttcatagtgttcattattctgccagaattggttgccacattctgttttccaatgccctgctcagtccaattttagatgactcaaaccatggacttaccattatttatcttgagggattctccaccccctgaaatctcacagttaaaacgtttccctttaatgttgccttcgaattttctcatgcttatttagtctctttacatgccatcctactctttggttgttctggtctcccataaactttccgatattgaatgtttcccagcaagctacttggttcaagatgttttctaatcaatcagaaagatggctgaccagaaggccatcattaaatttttcttagtcttcagcatcagaattctgatcttacccacctggaataatttctctaaatcatacttttatttttatagtaatttgaattgggttagacaatgctgaatgatagcatcaaaaacagagaacttcaatgatatacaaagaaagttccataagtattcatgagtttgttcagcacgtcaaggcagtgttaatgagattttgctttaatcactcccttcctgttacccctgcagacccccaccaatcctccctcactgtgacctgatcatttattttcagtgacaagcacagctcggcctccggcccagtaaatgctgagaaattgtcagatattgaagttgtcctggcctgccccttcagtgaaccacacattaacattgaagagtctggcagcagctgcatcaccttaaactagggaggctgaatgtggaattgtcctcgtcctgagagaggtgttgtcacctgatgtttccgggttacctggtggttccttggtcaggaacatgaaaggacagcattccctgaacagattctccttgaatttcactgttgttctgtacttcaatattaacttacagctgccttgtggttatatatatttttaagtgaaatattaacactgtctctgtaatactagaaagcacagccatttccaaaagttaaggctaattaacttcgtgcaccagcacaatatttatcaggctcacagatgtgccagctgaggaatgtagccagaaagaacactttgcatactggataattgaggtttgacctaatgaacagttttgcctgtgttgaagggctgtaatttgttagctggagtgaaagtctctgcctagcctttttggaaaaaattgatggagtctagagtgtctcaaacagtgtctgattaaacagcaggttttgtttttgtttaatttccaatctgtcagagactaatacgcataaaaaatgttaaaaatgaaatacggcaaaagtgaaataaatattgaagagaggtaagattatagtagattcaaaagacataaaaatactgtcaaattgccataaaagtttctaaatattgatctgaatttctgtactgacctcactacagaccattaataaacagatattgacgtgttattgatcccatgggacacagtttgaggaacattggttttaactaatactactgtgaggtgcacacatgggaagtcattagcgtatctgtgatcatcaagttcattaaaatgaaatggtatttatttatgtccttcaagaaggaataaagagtgtgttctaacaacttctttgggtaagtgtaaaataagattgtaataaatttaattatcagctaaatagtagccctgttggtttttaagctgatactttacaaaagagttaactattaatttctgtgttatagctttctcttccatgccaaataagaatatactttatgtcagttgcccatttaggtataagcaatctgttggatctgaaccttccatacactcatttttcaaatattattatggtactttactaagcaaatcagtgtcacattcctacatgatgaaattcagcccattattaatcatcttaaatgtgacttggggtctcattttcttctaaatgttgtcagtggtgtactgttggcttctgctattttcttgcagcgaattcaaggtcgaaaagccagcctggaggaaatacagcttgttcattctgaacatcactcactgttgtatggcaccaaccccctggacggacagaagctggaccccaggatactcctaggtctgtacgggcctccactgtactgggaacagcacattccagcactatcattagtcaacgctggtgtcagttcaaaatacttggcaagtagtgcaacaaaaaatcagtttttccaacagctttgctctgtggagtgagtcatttgcaacagaagccattgtagattaagaaaatcctgcattagaaaatgacaatgtaggttccatggtgtttactttagaattaaccttcatttgaataacatttgtacaatgtgtttttgcatatagaaaaaactacattgctgaatttattgtgttttcaaacttaaagtagaaatgatttacacatgctttatgcaaatttctcttcaccgttcccatttttttgtatcttttagttctttgttctatgaccttaagaaacaaaggaaatagtacaacttgtattaagtgaaaactcattattactatgcccatcacactacattctatagcaagattgcaaatctatttattgccttacctttggaattaaataatacattaaatgcaaaactagaaaactaataaacagttttttgttaatgtatgattttttgaaactttatcgtcagattttaaaataaaatttatattgcagaactttatataagctttatatgagtgatagaaacaacaggtttctggaagaaaaattagtgacaatccttattttagctgaaatgataatattgttttattaactttttataagtgaataacaatatctaacattggcaatagatgctgatggggtcatgttttaaatgttttaactaaaaaagacattttaggagtttttccttcaaataaatgtattgtgtcagctctaagttattgaactctttcacctaattcaatattatttcaaaattgttttatattaactggtcctaaacaatttgaaagcaagtagataacatacagtaggtaggtatcttggaaagcaattgtaaggaagaattaacagttactcattataacacaatatacctttttaaacaagtggcaagcatctcttaaatttatgaagtgcaggcatatgagtgagcataaatatgcccacacatgcgtgtagcagtataggtagcagtagcttggggagaagtaagaccagaggggaatacataaagattatccaatttttagaaagtacattgctaatatttgatgataaaaaataatgtatactatcgaattaacattgtatattaatatgaatacaaataaatcaatctaaacatatatgctcattttttcctttctattttagaaaccagtctctgtacatgcagatactttacataaaatacctcttttgctgcaaatattgtataataaatgttcttattttaacatgaatcaataaccctacccaactaaccaacaagatgaagtaaaccagacattttaattgtcatgattttatgaggtcataatactcaagcatttaaacataggagactgtgtccatgtcattattttttaattgagttaagaaaaaacaagtagaaaacctccccccactttttaaaaatctctggtcctaaagtataaatcaaccttccaactttattggaacaggctgggattgatcaaattgtgaatataaacacacatttgatatttgagaagtgctccaaaacaaccattgttccacattttaagagaaaggcatatttataagataaatgaagtttaaacttttgcaacatcaaacttttattcataaaacatggcgatgtttttttaaaaaatttgactcttttgaacaaacctattttttgtaaaatatttgatgtgcatatcatttttaaatttgatgattttaaaatgaaattccatttataattttaacttggacaaaggttcttttcatgtatgtatgtgatgaaagcagcaagtacctatgattcaatgtttaaaattttaatctaaataaattagccatttatctcattaattttgaacatatgatgtgaaataatattcctacagttgataatcttagagttagcattctatacatgtgtggagtttcatatacacttctcagtgatcattgcaacaatttcaatattgtgtgtgggctacgtaagtacacagaaacagggatgttgcattctatcaggccttaaggtcgagcactaaagtcaactgtatcaacacttcaaaactacttctctttccctagtgtatccaaaagtttagctaatttttctcaatctcagttcaaagtgaataattctgttctttttaaaggttaacttttaatactttttttgctctttgtggcatttgcattcttctggctttttttattgttgttgttgtttgtttgtttgtttgtatctggaagaccggattgaagctgccatatgtgaatgtatagaaattcataatcgtcaagatgttttctctctttttatccattcctttcacttccatatatcttactacatcccccagttcctcccaacacatatgggagatgtcttttctgagttaaattaatgctatttcccttgatagttgtgttctagagttaggaggaagggtttaaataaaagttcagtatgatgagacctgtcagtctttgtatcttgaaagacatctatagatgataaaataattggatttgaaaatgaacatcatttatctctttaaatactctagaccctgtaaggttacatggagaagacattctctccaattatttctggtgcaaggctttccttagcattaatattcctgtcgctcttatgaccagtttccagtcgtcttgaggctagccaaatttcagtgcattgataagacaacataattaaaaataaatccagtcagtttggtgaaataaaagtttcttgcccatttctaaatttaaagtatcaattatatgcctgttttgtattatgtaaacattctcctaagtaggtattaaataatagtattaaataaaactctcccaagtaggatacttattttgctaattctcttgggggttaataatttttttcaattactcttaaaaattaatttattggctgggcacagcggctcatgcctgtattcccagcactttgggaggccgagacaggaggatcacgaggtcaggagatggagaccaggctggcaaacatggtgaaaccccgtctctactaaaaatacaaaaattagccaggcatggtgatgcgcacctgtagtcccaactgacgggaggctgaggcagaagaatcggtggaggctgcagtgagccgagattgcaccactgcactctagcctaagcaacagagtgagactccatctcaaaaaaaaattaacttactatgttatcatattatcttcattcctgtttcttgactattaagaattcagacactaaaatgtacatatatattttaatttcacaggtgatatatgaatatactcttgcaaaatattcaaggatacagttatatttttgttaggaacaacaacataagaaaactttactcctcccccaaaattttgatgtgccttttactggtgccaatattgcagttttaatattattttatgatttttatttgtaattctattgacttctcatctttttgttaaaatgaagatctctctttataactagatggcttcatttgtacatatatttttctttatcatcttccatcttttagtaattacatttaaaaaaccaactaatatgatttattgttttcaaaacaaactgtcttctgtgacaataaaagctatttagacttttactgacgtggtgtatgaattctactataaacctgttttcaattttaatttctcatttcattgagcatcaatagaacaaattaatgggataggtgaattggaaatttgtacctggttctaccactgaactgctgagtgacatgtcagagtcccttcagaaccatttgactatgaaatagaaatgttcactgcccttccccatgattactccacagacagattttaatgttaaagatgtaggagcagttactactgtttttctctattcatgtagtagataacgtagaaaataaaagtacaggtaaacaaaataattactaaaaatcccatgaaacaccagttctaagagatactcacaattcagttttgggaatatatttttaaagaagatattttatattgatattgatgttatatagatccccaaatgggattatttttcatagtgtactgtttaaaaaattgtggatgttagaagtggcctatggtgtacttggctttagctctatcttaaagttgatatagctacttataaccagctatacttagttatgtcttaagtagaaattaagaataagtctgtacatttgagaagatatgttaatatttgaaatattttttaaatgacagtatatggtggcataaaccttgtagctcaaaacatcccattgaatgaatatactcagtgaagagctgaattggttaaattttaaaaattgtaatgtataatatagacatggagaccaacttagaaaaaaatcttgtgacccaaatctcatgagcatgtgtttattcatgtggggcaatagactctacatgcaataaaatttatattgatttgcttttagttcttatttgtgtatacagataggcagaacaatgatattctgaaaattgtgttgaataattggtctgaagttttattaatttatttttgcatcaaacgataaataccatgtgacatattattatgtgttaataaatgccaacattttaaaaattatataacctccatttatctatattttttatgtcttcttactgtataggtgatgactctcaaaagtttttttcctcattaccttgtggtggacttggggtaagtacaagttggtttactgcctttaaataacataaaattacaaaaaaaaatcttttttgatttatctattcagttttagggttatttctcagtaaaagttatgctagacttcaggactgcctacttaatttgcagagctaagtgccaagtaaaaacgtggcagcccttgttaaaaataaattcttaagaatttcaagatggtggcaatacagaattaaaccaagagcaaggcccttctaactgtaagttcccgtgtgactgcacaggtcacacactcatgaagccagctttgctaggcctttatatagctggagaaaaggtgcttcaagagagtttaacacagatttgcagcagaattccattttcaatagaatcacattgagtacgcacatacattatattcctggtgaaaatggcataaacttcacaaagtgctttgcattatgggacattttgtttgtgaaccccttggggacatttttgtcttcaataattaaggaagccttttgactcaacatatttagaccacatttcaaggacaaatttgttagaacccagcaacacatgaagaaaaatgtctacatttttgtagatgattagaacatatcctataacctgaaatctatttaaagttaacccttaccagtaacaaaccatcatcctgtagaactaagtgttatgttagaacaacataattctaggtgaagttttcaaagactaaggtatttaagtcaattaaattgactcgatcttgaagggaaagaacaaaactagtcacatgtatatcacgttttaaacaattgttttgtgagaactaaatttgatgcaaagaaatcttgaatatttttagtttattctatcattttgatgatgccagatttagtgagttgtagccttttgttcctttgcttgtgattctgcttactctggaaaacagaatggtagctatatccatttgcctccgtgaggacttacagtttgccgacaaacaagttccaaaacaaccttgtgaaatagtcattaacaccattttgcaaatgagaaagtgaaggctgggagaagctaagttattttcctgaagtcacacagtaaaggataaaaagctgaaagtatgggggtgatgtacacatccttgtcgaggagttccaaaagagctttctagacactttcatggctttcatctttaacaatctagtctcagcttccccccactccctctgggtaagcagcgcagcagtgtggctgatgtggtataacccctttgtgacagctcaccagtgacttttgctttttgaccaccagcatgggacagtcatcaatcccacattaatccttgcttatttttagccaacctcctgtggagctgggagcttgcaaaatcattctggaaagcagaggataagctgacttttaaaatgggtttcattggctttgtgcttattttctaacatctcaaatggctgttttatgagaatggctgcctacctgtaaatggggcaaaaaaatgaaacaaacctaatgactacttaatgggaacagtgatgtggaggaaatcaaagctattaaaagggtggcagtcatcaaaccccactctttagaaatatagatgatccctgagttatgatggttcaatttatgattttttgattttatgatggtgcaaaagtgttatacattcagtagaaaccatactttgaatatacagccattctatttttcactttcaatacagtattcaataaactacatgagatgtttaaactttattataaaataggctttgtgttagatgcttttgccaaactgtaggctaacataaatgtttggcatgaataaggtaggctaggctaagccatgatgtttggtaagttaggtgtattaaattcttttttgactaaggacattttcaaactacagtgggtttatcgggactccttcataagtcaaagagcatctgtatatttaatgtatgactcaggactgaattgaggccatctccctaggactcacctcccaaatctgacctgggacgtgcttttaattcactatcccttcaatgcgaagttcctctactcaactgctctaaacccaaattgacttcttatttctcacctagaactgctttagtaaactcttcaaaatgaccaaggagtgaatattggctgcttcctctggaccagtatatcaaacataatgcacagtgtgggtcatagagtaagtccttagtaatgtccctagagctgacctcacctggatggtggcagcagtggtggtggataagtctggggtaggccagcagaggcaggagaaggagccctgcattgttagtttgactccatcagtgctggagaaggttggagagatgtgatgcttatgtaggtcagggtgggtgtgaatgtgtgtgtgtgtgtgtgcaagtttgcacttgctgatgctcttgtgaactagtttgactcagtatttttgtttacaggaatgaaatagttttctcagcctttcaaaagtcttcttgccctctcagatttttggttttggtacaagccctaggagaaaccctggatcctcttgatttaagcctgtctaaattttcacctccaggacaatcccagacagattagctatacacaagatccccagtatgatcccggaaggccccaacttggcagcatgggagcaccctagagattttggaaattaccgaaatgacttttgtcttaaggcatggttctgtctcaaattacttaagagggacctgttggtttccattctgaaatactcagtgatccccaattgttaaagtaaacgccagttccttagaatatataacttcattctagaggggtttgatatatacctacagaatacggatgggttaattggcttttgaggaccctacctgggacattatgaaatcagaacatctctacttctcattaaaatttcccctaaaattgcacatggtaatttactgttggtcaagcagctcagtggataaatggtatttaaggtgctgtgaaatgtactctccagaactgcatttcgagcaacaatgtcaaggtttctgaattcctttgtgtttgcttttctttttgttcagttattatggctgactcatttctgattcctgtgtgattgcactacaagaaaatgcaccagttgaaaagaacatttgaccaaatcccaggacttggtcatggtgtagtaaaatagataattaagggactctggaaacaagagccagtgcaggatctcttcagttctcactcctcagggtatatcactaaaaatagtgatcattttcctggccatctgacctgctgctgtgtgaagaaatcttgaagtcatttctcagcctcattttcccctcttcacttgataggccacagaaaaacccacaaaagcaaggacgagcaggcttttatgataatgtcgtcatcagctcccagcttcaaacgcttctgcggcttttgagttgtcatttataacttggaactgaatcgacccataattcccctgatacacttagagaaattgataacagactctgcgcttcttttatggctcagaggaggcaactccaatcacatcactattggcaggcaatattattttttgacatggttgtaaaagtataaaggggcttatggcatttgtttagatgaggaatgggctctcaagctgtgctggggtttacaggaccagatcagtgagaagcaaagggaatatgatgtttgcaaacaggatatgattttatataagtttgggtttcatgctctgttccctggggaaagccctgcagacagcagagaattccacttttatcctacagcagacaagctcccagggccaaaaggcagaaaaataaacgtggtcaatgggtagtgtcagacccttgattggaagaggaggagctgtggacgagggagaacaatcccctaagaggactgaggatttgcagggcacgggcagaactgggacctgactaagtggttgaagatatgcaaaaagaggctctaaaaggtttaatgaaggcaccttctccagcagtgactcagtcaatctgtgaacacaaagctagctttttattacgacttttactctgttcatattctgtttggttacacctagatctgacacacttaggaatgtcatttttgtgattggggaaggggagatggggagaaggattaggtgattatgagagggtagtaatttaaggcccatttcaattgctctgaggttttctgcaaacgtttcagttgtatatcaactatactcactacgcgagaggcagatttggatgaaatgtcttaaattttcttttatcttgtcagaattaaaatgtaagctctcccctcttatttataaatttacagatatgtgtgtgtgtgtgtgtgtgtgtgtgtttatatatacaagaaacattgtatatacacatacataatcaggagaaaaatctattttacaccacatgtgtatcttcatattatttttctaattattacaccacattggtccttcacatttattctccccagtaccagtaaatagtattctagtggcaagccctacaaagagctgctctggtgtttccctccattataatactagggaatggattttgttttatgaccacatctatggacatatagttaaactcaatgcgacaaaagcttggttaataatgcattttactgctgtgatttaggatggtcatctttgaaacaaaaccaatattttcaaagccataatgtgtgccatcagataaggcatgaagggcaggaagaataagataaggcttgttgttgatgactagacaaggtgcagcatgcaaaaacgaatgagcaatgagacaagaccactgctctcaatctcaattgctcacagcctagccattgggctggttcagaaaaatgctaagctatgagagcacagagaaggaagcttttaaaacagcaaagaaagaatagggtgtggaggttactcaagcagttataagctaaattttcaagaagaattagcaataaatgtgtgagttgtgtgttgggggtggtatgaggacaggtcatgggaggcagccaggcattgactgttcaggcaatagaacacaccgtatttctgacaattgcaccaagctgttgccaattagtagagaatttttttcttccaaaaaaggagggaaaaaccccaccttctgtttatgccaaaactttgcatgttcctgaggttttgatattgactcaggaacctctttcttcatatgttatttcaacccaattatcctgagcaagcacaatgccttttgttacatcagcagaaagaggagggggtagcatctgcttctcacatgcagtaatcagggtaatgttaatttccctcctattaatgttcaactcaaacctggcttgcaatcagtacttcatttcctccactgttgctatcaaagaggtatcacaaactttttccctccagcacaataaaaggatccaccctgatttagaatctctcttttttatatctcctcttcctaactgtatctggattttcatcagcttcagacttgatgcaattgatactagcaagaacaccccatggcacctggcaaaattaaaactgataagccaccttaatgaaactgagaatttagtttcatgctgcaaattctgtaaaaagattatgttgcctcagacttcgaaaaaatgcatgaaatattattaaagtcagggaattccttctaaattgcaaaggaagtttccagtattgcatagattatgctaattgtgtatactcaataatagttgttgggatgtagacaacactccctacagagatacacatgtatacattactctgtgtatgggacaaaatgtgaaaatacatagaatcattaagcatctaatgtccattgcaggaaagaagaaaatgagagaagaaaaccttaatttcctccttaattcacttacttgcagcatctcatctgtgattaaattctttctattgctttgacattatggctaagtacaacgagatgcattttgaaataagaatacttcattttcttatttaaagtaaacatgaatatcacaaagctgttaaaattcttctgttgccaaaatgagatggctaaaaaaatgccatcatcaaagctttatttgtgttttttacattactggggccataagacctatttttttaaaaaactgtatacacacacacacacacacacacacacacacacacacacacacacacaaaagcacctatttccaccaaagtaatgtcaataacagggaggaagaaaacgattatgaacattgagacaagaagaaattcagccttaggctctgcagttgctgaaggtaaatggatttgatgaaatttaaatttctatctaacttagaagatctgtggctcgattaaataaaagctgagaaagtaaaacatacttgaatagatttgaaaatatgatcatctactgattgctacttctgactgccaaggagacgttaggcttaaatcaaatgaaaatttagagtagacaaaggaaatggtactacctaaaaaaaaataattcttgtagcagcctgaaatacagctatattcaggcacacctaagcttttcattttaaggtgaagtaacagcatttgtatttttcatctgtcatatttccactccgaatagttagttccagatccagatattcacccccgtaacaaactaatattcaatatgtaaaactgatgtgtcattattggatttgtctttgtgaagtattttaaccacaaacttagtaaagcataacttctaaactttcattaatggagaacaacagtttttttttcaaaattcaaaaccaaaataaattagctcactgaatgcttgagccataagcaggcagttcacagcagaatccctaggatttaatcattccccaactcaagaaaaacccatagcttctgagttttagactagcagtatcattattgctatagagtgtcttaactttaaataaaaaataataagtaaaataaaggaattaaatgactaagcaatgattctcttagcaatagagcatgcattgagtcattatttctatgaagactgataagactattaaaggactaatatattcgatatttttatgctcctgaaatcatttggtgaatttattctgttatattctaaatattatgatttatataatctctaattgatatttactatggatacacacagacataccttggaaatattgcagattcagttccagagcaacacagtaaagcaaatagcacaataaagtgagtcacacaaatgttttgtttctcagtgtatactaaacttatgtttatactgtcctgtagtctattaagtttacagtagcattatatctttaaaaatgtacataattttaaaactatgtttaaaaatcctaatgatcatctgagccttcagtgagtggtaatctttttgctggtgcagggttttgcttcaatattgagggccttattctggataaagcgttggctcaagggaatgtggttgggttgatcttctgtctagaccactcaaactttctccatatcagcagtaaggctatttcactttcttagcatttgtgtgttcactgcagtagcagtttcagtttcctttaaaaacttttcctttgcattcacaacttggctaactgttgggcacaacaggtctagttttcggcctgtctcagctttcaacatgccttcttcgctaagcttaatcatttctagcttttgattgagagtgttgagagtgagagacgtgcaactcttccttttacttgaagacttagaggctatcgtagggttattaacttgtctaatttcaatattcctgaatattagggaatagggaggcctgagaaagagaagagatggaggaaagactgatcggtggagcagaagtcacacacgatatttatcaattaagttcactgtcttatatgggcacgattcatggtgccccaaaacaattataatagtactatcaaagatgactgatcacagatgggcataaaagataaaataatgatgaaaaacttttgaaatattgcaggaattaccaaaatgtgacacagagacaggaagtgagcacatgctgctggaaaaatgacgcccatagacttgcttaacttggcgttgccacaaaccttcaatttgtaaaaaatcaaagtatctgaaaagtgtaataaagtgaagcacagtaaaacaaggtgtgcctgtatcgagtatcttcctgacgatctgtaagcacttctcaaaatgacttgtatcattttgagatgtgaccatttaaggaataaaaaccaagacctacaagtagcgaaattctttgctgctaaatagattacttttctttccttaatctattgcctctaaagacaatttaccatccattcattcattattaaataagcatgtactgtccaataccatcctatgtgctaagtgtgaagcaacatgtagactcacattttttcttatgttgtgtttttttttttccttttcaattcccactcatgtatcttgtcatacctatcacttagactctgcattgattttcttctattcataattgtcaactctggtaggaaaggcctgggagttcataggactaaggacagaagatagtcagaatatccatactcagttgaaccagattcaaattcagtagtctaatgaaacagttctacgagatggccttcttgtctcagctttctttgatgggggcatccaattttttgtttgtttgtttgagacagggtcttgctctgttgctcaggtgggagtacagtggcacaatcacagctcattgaagcctcaacctcctgggctccaaagatcctcttgcttgagctttgttaagagctaggaggtaggaatacaggtacacaccaccacacatatttggctttctttcttttattttgtagagatgtggtctcactacgttgctctggctagtctcaaactccctgcctcaagcaatcctgccaccttggcctcccaaactgctaggattagaggcctgaaccactgtgcctggcaaattctcattccaagagctaggaagcgcagtatccagcatcaatccacaactccattaatagcaaatgtggaagaagttcaaagaccagtgctcactggtgcagactattctctgtgcttctgaacttactatactcacaatttccaattttcacaacttgggacagaattcatttgctcacttatttagtaatttatttatacagcaaatgcttattgaatgcctattgtatgcctggaactgcaaatacagtactgaacaaaacagaaaacgttttatcctactggaacttatattccagttgaggagacaaataagcaagaatgaatgactttaaatatatgtgcatgtatgtgatgatgatgaatgctatagagaaaaggaagcaaggaaggggtgtggagtcttgtagtgttggggcagagaactagtggttaatgagaagtgttgcttttttggatattaggatagacaggtgaggggtgacctgggagccctggtttcttgtggtgactgacttaaagaggggtacagagaataataagatccatactgagggtgcaaagcagagtggtggggaagcaaggaaagttcaggaggtggagaggaggcttgccaagactgctcagagtttggggaccccatctcactctcactgttaaagatctgtgtgtctagaggtagggttgttctattcagaacacacagagcttctggtcttccttctgacaactggattgaggtgtggcaatagatgatgagagggcaagttgaatttctaggcacacgctgagatgctgacatttctcttcagagctggctatggaggtatagagaaggttgggggtgggggcacacttactcaggcactcaaagatctgggactcagtagcaggccctgggctgtgagatatctctctgggtagttccagatcttagcagcactgtgtgctttggggttccaagtccctggaatgttatgtggacatacttttctttttaaattgggcagctgcaaattatatacagtactccaacacctgcccattttcaagtctaataaaaatgtcctgacatttgcatgacctttgcaagtgggttggtttttttccttgtgcattttagtgtcttcttgaatgacattgtcacattatggcctcagttgctctggctggtccatcctgatttatatctgaactgtgagatttggggtaactgatttgttggtcccattgtgttggtgcatagaatggaccaaataatgatgacgtctcaatttctatatgcccagtttcgtgttgtatttatatagtgcaagagagataaaagtctgaattccagggtatttttactattgacaatcagtttctgatcctcagcatcctcaatattaaatgaatagaatcaagaaaaaaaacttggctaaattttttaggattatgctttaaccattttagcaaaataataattctcgactttgaccccagtggtattcagaggattgaccttaatgatgggattatccatcaagtaaagggacaggtaaggtgccctagattaggctgggcaatagagaatcctgcaaaacataccctcctgattctcacagaaccaagagggctgattcacagcctcacagcagagactagccattctttacacaaaccttccaatgataacctgcctcaatctcttttaaatcccaaataatcccagaggttttattgctaaagatgcaattgaagtttcctattctacagaaaaggaaacaaaggctcagagaggtgagtatcttgttcaggtcatagaattagtaggccatggagcagagagggcctgattcccaagcttttaaccacaatactatgcacacacagcacaactcaccataatttcaacctcatatgattgtcaacactcctttcccaagtgagaatagccctagccgtaagaaaaaaacaattgctatttttgccaagagcattctcttttttattgaaattcctatgaagtattaaatccatgcactcaaacatcatcaattctgggtaaaaaaaaaaattacacagctatacatagtatttcaaccctaactagaacactgaaaagtctctgtccttggaccaaaccactgtgggatgagatagagagaatctcatttcacacacctactgagtcagagttaattttattaagctacactctgtaggaatgaggctctaatgtgcactgtccagtgaataaaaagattggcatattttgaagcaccctttacacagtgtggacatcagattaaatgaagaaacagtaggaaagtactaaaatggtatttcttggctctgtctctaactcagtcttggtagaactgaccagcagttcactgaaattggataacaatagggactctcaaattcctttactggtctttactggccacataacccacaggaatccatatattacttggtaaatctatgagtcccccggatcttaagtaaggatccttagagtctcaagatgtagccctttcgccagagcaaacatattcctctccttattcttgttactggcaagtaaatagcaaaaggcagatttttctgaagataaagagtgactagaaattgcacatgcaaggtcaatggagctgccagaaagcagttgatcataccgggagatggtttgtggtagagcattaatgcacatggcatgccccttttctcctccagctgtcacattaatatttcacaccttctttccatatggaatatcagtcacagtattcattcatcatatccatggctttacttggaatctgaacgtcttccctgtagctgctctgtttctttttcatctcaccatgactaaagaagctaaggtgtgggcattataacctacaactgatcccaaaggaatgggctgtcattcatgtcttccttccaatgttgaacaaaagagagaatgcatgtgggttcacccacccattgttatcataaatccatcccagctccatttcaagactctcagggtttcagcagaacatctaacacgaaatgaatatatacattcaaggagctggcatgttgtatcacaagggagaagggaaaacacccattgttacagcctcagagctgattgaaaaagaatgcaataaagaatatcagaggttctcagaccagaatcatgattctcattattatcccacaggaggagaaaagggacagtcacccagaattagagagggctctagaagttttgaagtgttgacacctaagcgtccacaaaactgctcggaatagttttattttagaagtatcctgcccagcctgagtctgagaaaccagcaatgcaaaggctctgttaattattatttcacttatctgagacttggtttctttatctatgaaatagggctaagcaaggctcccacatggtattattgtgaggatcaaatgtgataatgtaggttatcactggcagctatatgtggtaatgagcactgcaccaccctgtggggtcaccttgagtagattcaggtctgcagagggtaaacagactccctgatttaaaggttctccaaagccctgcaaccctgaggtctccacctgacctacctatccaactaatagtctaccattagaatcaaggcactgcagggagacaaataaagggagggaggacattgctttcagaaatcccagtgattaggcatctaggcagagagccttcatttaggaactccggaatctggattcaaatctttacgttgtcactgctccaaaagcgctttttcaactctaaagtgcagattccaattcagcaggaccaaatgcgagctgagattctgcatttctcatagcactcagggatggcattgctactcatccgtggaccacattttgagtggtaagatcctgtaagaccatggactcacaaatcattgaaatgactgggcctcagttccttcacctatgaagtaaggtgataaatgaaatgtgatttattgtcttctctggggatcaaatatgtcattactgtgtgatagtactttatccaaatttaaaacagctttttacaaaattcatttttcttgagagatcagatagcaggctcccattagcttgtcactggggatcttgttgacttaagtcttacacagtctgtctcccttgggaaaatagtgagtggggaagcttctgtgagagacaggggtgatgcatgacaacagagatccagggcactggggacatcacagttgttgttggatgattcagtgaagaagcatcattgtaggatgatgcaccaaaggaagcacccaatgctggcaagcaagagctagtaggctatacctggtgcagactgaagatgagagaagcagtcatcactacatcatggatgtattgcagggcccaaacaggggtggtgtttggagtttagatagtttagccacagtaaagccctgtaaagaacagtatcactataggattctttggttctcatccttaattcattccctcgacaaaatttgttaagcatctattatgtgtcagaccttgaagaaagagcagtaaagacagacacccataaccctatgcctaggacacttgcactagcccattgtgttctaaagaatcaacaacacagaatatctttttaaagttcacatctgtatttggctagctagggctgtcataacacaataccacagattgggtggcttaagcaacaggaattaattttctcacagttctggagcctagaagttcaatatcaaaatgttggcagatttgatttctcctaaggcttctctcctgggtccttggatgaccttcttctcattgtggcctcacaagcttttctctgttcatgcgcatccctgctgtctctttcttttcttataaggacatcagtcattttgtattagggccccacccttatgatctcatttaaccttaattaccttttcaaaggacttattgattgctgaatacagtcccattgggcttaggacttcaatatgcgaattctgaggaaacacaattcagtccataacgatattaatgtccagggttggctttggttgaaaccccagctcttcatctcatcaactatataactttggtcaagttacttaacctctttacagttcagtttactcttctgtaaaggtgactaataatacttttataaagctctcatgaggaattaaataggtagtgtttgtaaagtgcttaatagggtccagcacctagtaggtgccccaatcttacccactatgctgttctttaaatactgaccaaagatatttactttttgctttctttgggcaatagatttgactttattaccttttcttgtgaatctactaataaattaggcttttctttttcttggaacctcgcaactcacaccccttttcttaccatttccaaaaacaaaatatctactggaatcatcagctttagccctaattgtaaaggatcaaggataggaaaatgttgagcttatcaaataccacttaggtgggaaaaggtaattattttgtttcccaaggcaaacacaaaaagaaatttggcattagaagatgaaagtagataatttttaagttaccaaatcaagatgctgtttgcagaaatatttggtccacagtagatgattcatttaaaaaatacactttacctgacacagtgcaaaagttaaaatgatttttattttattttgcggtttagctttaatacaacctgctaaaatggcacagaatcaatactgcaatgaaaaacctctgtttctttgttgagtctggtgtctgtcaataggtttccaggggcatctgatcattatttaagcttaaactcaattattcagaaaatgccctgtggccctagcgtcagcataaaatagcagcaagaccttactaaactgctcagaactgggtgaagagtttcatttcccaactttcagggtgaaatgttcaaggcatctgaggaaggatagtgtaccacattaaacatgcacagtgcatatgaaacctgttttgttaatgggcacaatagtattatatttaactctgggaatatttccaccaggaagcaacaggctgcatttagattatacaaaggagactgtgcctaaattccttttcttttaagtcattccctttccgttttaaataccttcacatccactttcaggacaggtagcttaatttctatcatgtgcggcttttcagagcattagctttgtttcagattccaatgattgagctatgctggatgtgcttggaaaagcctgcaaagacccacattcactcaggaaactacagttgaactagatccatatgtggctagaaaacatgtagctttctgattggaggtagttcctggcttccagcattatcacagatgatttttgtcctttgatgtgctgcgaaatagaaagtaatgttagaagcaaaatgcggggatttttttttcttagttaccattgactgagagcttactgcttccagcatcgtcttgtgctgtgttaagcactttatatgtattgactgattgaatgctaacaataatcctatgaggaaggagtattattccatttttcttaggtcacggatcggtgaatgaacttgcccgtgtttgaatagtttgcaagtggaactgctggtttacgaggtctctaacgctaaggcaacaaaatagataaggtgccattgcaccaaatgtcaatgatgtccttgccaatgctaccacctaaaagaataggataaagtagaggaggatttgcccaaagcttgcttccttttaatgtctgtttaaaagtatatttaaagcctaacaatttctcgaaatcctggggttaaaccagtctgtaggtaccaaattttggtgtatgactcaaacaaattattggtagtcattctctcttggtacaatttatgttgataggtgtaacttattaatacaaattcctaaagcatttctaattttacttctggcttcaccttttctttctatccttttatccaaatagaactctttctttaaacagtttgcaaagaaaagcatttctctatgaagttaatgcttctcaaattattatgtggtaaggggcaaggttttgtttacttacatttcatttcctatatctgttgtgaagaaatacttgtatatgaggcaataaatacaaattactaaaagtgagatacaaaagacatagaacataaaaactccagttattttttattagattcaacagatcatgtctggccttgtcctcaggcagaggctggaatccttcagtaacacacctctgtaagagttagaggacttctattctcccagggcactgccctgagaaacctccttgaattaagctttgatggttaccacacaaggaatcaactcaactagttctgctgagactttttttttttttttttgcctttcccgctttagaattttcaaactttgtgtgaaaataaatcaccctgggtagcagaagttatgcactgccaggccagaagccatattcaacacatacatagatttctcttagcttggctggggatttttaagtgaattattgtcaatatttaagatagaaaaattgcacctaagaatacaatatttagggctactaataaataccatgctatcatttccttaagacaaaaattgtttggaactgtgtagccattgtccttttagctgggacacaaacactccagtcaaccatagttccaaccagagaacctgtccctcatccccagttacctgacattatgtctatgtccccattgtggctttcggtgtcatttgaacacgtggctacttctttagccctaatctgtaccccttctatattcgagtctttctgggtattattattattattattatttggttctttgtctctgtctgtggactcatggacactacttgattccaatacatataagacaattaatccctttaacaccaaggaaatcctctcctctcctctccttttcttctcttttcttttctttcgtgtctcaccttgttacccagactggcctcaaatttctagactcaagtgatcctcccgcctcagctttctgagtagctgggtctgtaggcacacaccaccaaaagctagctcaagaattttttttttacaacctagtaaacatttaatttattcctgattcaaatccgaggaggcattttagaagagaaggttgctactattgctctcagtgtgaacaataagaggacaaaacaaaaaacaaaaaacaaaaaaaaaactgaaggccaccaggtgcttgccccagacatttgcagaagcacagagacttctggataggagagcactgaggaagcatctttatgttcttgcaaaatcctgagttggtcatgggtttttatcatttaattcatgttcttaactcacagtggaataaagaaatggtgtaaacaacggttttgaaatgttatacccatctctcagctgctcagaatctgtttcaaagatagtgaacaattagaagggtgggttactcagaatcagtgcccacatatatttcacttaacagaatgaatcatggccactcaaaggcagcagactttccatgtactcccagcctgccacgtgtgtagtatgaacccaacattctcatgaacaacagtttctcaaaaacttggcttttaataggtagcaattgcttgtgtgtgtgtgtgtgtgtgtgtgtgtgtgtctgtgtgtgcatgtgtgtgttttgtatagactcataaattatatgatgttccttgaccctttattttgccaatgatattatataattatttctttttgaaatcatcagataaaattgcagtactttcctttggcgtattaaggagtggtaaggtgagaatgaagcaaaggaatgggaagaactatgaagagtttttactggttctgtcactaacatttgtgacacttaagaaaccaagggcagaacaatgcttaaaaataaatatataacagcattgattctgttcagtagacagaattatttggacaaattcagggaaaggacactgattaaagttatttttggttgtataccaaaaaaaaaaaccatgcatcgtaggatgcgtagtggcattcctggctctatgcactagaagccagtagcacacctcccttactcagtcatgacaacaaaaaatgtctccagaaagtgccaaatgaccccttagatgcaaaatcactgtcattgagatccactgctctaccataatagcagacaaatcacaacactcaagaaaagctcaactcttctaggtaccacttgaaacatttgatttaaaaaaaatattttagcacttttaacagggtagggtttcaataccgtgaaagaaaaaacattcttgcaggtcttagctaatttatttaattagaaaactctttatgcatatatgattagaatctgttttttaaaataccattttattatttattttactttttggattttgattttactagcataaaaattactatgggctaacagctcatagttttctcagttctttttctaccttctctaattactagctgaataacctctgaatttcatatataaaactgcttaataatagcatctacattaatggtcgctgtaagaattgtattagttactatgggcaaaagctttgcacagtgcctggatcttagtaaatactcaataattgctagacaataatattattgttattgtcattattatttctaaataaaaagaaaataactttatagagtagggaagtatataataaaactgaaaacatggactgttaaattttagttttttattactttctctatgtattttctgaattgcattctgctatgactgagtaaacgaaatcatgtttctgctattcatgttccctaagttatgtttaactcagcactcatcctttttatcccttattctggatcaccactagtaagagagattgcaacatgttattcttcttttaaatgtgaacagcattatgtagtagctaagttttaataaatagatgtataactagcgctttactggccctaactctttatcctcttgtagtccctccatgcctccatagagaggagtatcttcctaattattttaggagcttcaggtaatgcctaatgtgaatagtaccatgtgcttctgaatgcaagatgttttttcccatcgccctttccttccttcctttcgtccttccttcctttcttccttccttccttccttcctctctctcatgtactttttgctcacatacacttcctgtgtcccctgtttctgtcacacctcttgggtatggctggctggcttccttccttccttccttccttccttccttccctccctccctccttccttcctttcttccctccttctttcctcccttcctcccttccttcctttttgctcacatatccctttctgtgtcctcggtttctgttgcatgcgcctcttgagtctagctttctttccttccttttcttttttctctctttctttcttttctttctttctttctttccttccttccttccttccttcattccttccttccttcattccttccttccttccttctcttttctttctttgttcccagtgagtactgctggcccctgctgatgcacattaccgatattctggggtctttacattgccaagtgctcaggattctatgaggtttatagagaaacagaaaatgtgcttccttccctcttttaaggtcataatttttcaaattgataccaaagtgttctacgtaattctcatgtttttagagggtttaaaatgttttgcctattttagttacttataatctcctgtgtttctcaacccctttctaccctattagatagacaggactctgggagtgtgggttgggagagaatctcaatgagagattctgtactacttcagattgtgcctcctcctctgatgactaaatctttcttatgggccaagctcctgtgactctcaccctaaagtggggttctactcaatctcaccgagtgtgtttgttccctcacacagaaagactttttgtggaatagcttcacttacacttctcaaccccagttttggatgtatgttaggtccagaccctcctacatatttataaagtgagttgaactttgggatgcctatttcaaaactgatagattttaattctggcaataaaacaaggcctctgtggacctatttctcagcagactactaaagctgccttcatgcttggtacattagttacatcattagaaacatttgaaagttaaaagcatactgtttttagaatggtacataaagcaaggcttggtaaagattccagaggaatctgaaggtaggaatatttagggatttccatactgtaaaatacagttaaacctcactagcctgtgtgtacagcatatccttagagacttctgcccagaatcctggctagatttttatccctgccatttggcaaaataaattcctgaccttggaaataaatgggacacaatatttcccatgctccctcagatgtgtgatgaatatgttatttattttttctcccaattatagtgatcctctccataattaataatctatcagcctcttccagtttgaataacttcctttcagtttagaaatactgtcttttcaagatcaccttattattggacttaatgtctttaggtaattgcttagcctctcagattcctctttgaagatggcatttgggcacctgagggagggatggagagctgaaggggtacctggatcctcctgctgtcctctgaacactcagggttccatggcaacctctctgcaccacctgactcttcctgaagttgaagctgaggtcggcagcagattaactcctgattactgacttctctgccagctggagcttggcagggttcccgggctccagtagcctccctttggctcacattggtaatggggttcctctgaacccctctgtggactccatttggctccacccatagttaaaccatttcacaggctctcccatatcataccccttggaggattgtgagaacttgagacttccagctgcactctacaggaaccaagagcatctcaggaatgctgtagcttaatcttccattagtttttcataccactctgcagactttattatatggtggccacagtttagtgtagacatgacttcaaaaagtcccaaatattggctgaacgcggtggttcacacctgtcatcccagcattttgggaggctgaggcagacggatcacctgaggtcaggagttcaagactagcctggccaacatggtgaaaccccatctctactaaaaatacaaaaattaactcagtgtggtggcggatgcctgaaatcccatctacttgggaggctgaggcggaagaatggcttgaacccaggaagcagaggttgcagtgagccaagatcgagctactgcactccagcctggatgacagagcgagactctgtttaaaaaaaaaaaaaaaaagacccaaatatcaaccaaagtgaaggctcaccgaccattttgtcaacttacctgaaacatttttctctctcgtttgctcacatgtcgctttctgtgttccttgtttgtgccgcaccccttgagtccagctttctgcagtctttcaggaccagaagagatggattttaggttttccttccactcaatgtattctatatgtaccctaatcaacaagcatgcctggttgtcacaggtagaaggggtctctactctgaatcattcagagaagaaataatcatattctttcgatgctatcactaacacaggaccgtgatctgagacaaccaggttcagttcttgatatgtaaaggaatttgggaaaatatcatctctcaccacaaaatctgtatttttatgtatattgaagcaaaatcctgttttggtcatcattttctttacctttcttctatatccatcctaatctccctttcagctcatgtactattactccttaatgcacacgcagacacatacacgcacacacacacacacacacacacagtctctctctctctctctttctccctttctctctctcactgggaaaaagaataagttgttggagagacaaaggagaatttatgtgcatggaaagaaaaatgacaaagcatattttttcagaatatagtagttctatttttaagaatttgccttgcatgtcttctcaactttagcaagaccttagtagtaggccactgtgctcagggtggctccctgctccactgtcatttatttcctttccagcctcatctattacatcttgcattatttttccatttccagagccaactttatgccactgtccttcaacttccaaatgtgagggtgcctgtcttcttatagttccaaacccttctgatctctactttcatcattattgcattgccatttcagccccttaatcctgcatatctgtatgcattccaagcaaatccttctttcccttttttcttcccctccagctccaaaatatcttattctatgcaaggaaccactatcagttgatgaactcaactgttttctcttacctatagttttttcctactgtcaagatgttcttcagcagttgaaatcagagctctcttaaggaagtggccctcttgatgctatcactaatatagggaaattggttggagagattgacaaccaatgagagggacaaagagggaggaaaaatatttttaccattgagaatattggaaagtggatatggatgttcttctagtgacacagattatagcataattcatgagttatgtatcctgttttatcattgaagttcttatgaaactgtaacatggaaaatacatgtggggagcttttggcagctaatttggccctgaaccccatttggatcatcatgccttaggaaagtatgcttgtaatttgacttatgaacaagattttgggatttaatcttactatgaactgaagagtgtgccctcaaaatttatgtactgaagctcaaatcgctaatctgattatatttgactaccttttgaaagtaattaagattaaattaggtcataaggtactgtgtgctaatccaataggactgatatccttacatgaagaggaactttagtacaaggaaagggcatgtgaggatgtagcagatgtggccatctgcaagccaaggggagagtcctcaccagtcaccaaatgggttggcacctttatcttgaacttcaaagcctccagaattgtgagaaataaaatttcttttgtttaagctacctaccccttggtattttgttatggcaacctgaatggacaaagacaaacttgtttgtaaattcagaattaagtacaattacctatttatgaacagattatatccacaaaacttgaccattaccgtttataagcatttataaactaaatgtaggtaaaacataggttgaggtggtattgagataaatattgtttttgtttaaatataaataaattaatggatgataaatcccatagtttcctaaagagaacttctttagggataagcctaaacattggttatgagtcaaaatatcagtcatccactggatacctatgtgctcaacattctttatgatcaataaacatagctttattataaaagtaacccccacccggcaactcacagtaggtactcaatgaatgttaactgaattaaaacaaaactaccattattagtagaagtttagacaccaaaattaatgtcacaaacatctttggcagatagaaaggtatggacaggcatatgggtatcacgcaaacgtatttgtggctacctaatgccctttagtatggtcaaagatacagcactctctgctgctggaatgtttttctaatcaagttcagtatttataattttttggaaggaaatttgccactgctttaagaaataaagaaagaaacaaagcttatgatgtactccaaagttgagtaaaaagggcttaggaattttacatggttcttgagtcaccgaatacatcttttggaatttatttattttatttttttgcttgcttccccagtaacttaaattctgattaatgcaggcttttctttggtactagtagctctgtagtggtgggaaaactgactaaaacctatataatacatggtaaataatggtttttatttttcaacttgtgcagtcatcttccttaagaatatagctacacaaagcttaaacaactacttatttatattggttcagtaaaataataaaaccttcaatttagagggcaaatgattaggtctcagtgtccatttcaatgattccttcactctttagctgacagtgcagaccatgatggtatcgactatgataggggatgctggctcctagaaagcacgggtttcttcaggagggtgatggaaaggcatgtgctgacagggtcagagttctgtgtgagagtcccgtggtcttcagaacagcctttctaagccacagtgtactcattcaatcaacacgtaggcctctactatgtgccaggctttacaaaacaggtataacagtagctgaaatggtagtagctagcttttgtttaccacttagtcatttaatcctcactaaaatcgtatgcagatggtactttaaaaagttggtattttcacagataaaggaaccaaggcacagagccattaattaattaattctccaatgtcactcaggttttaatgatgaagccatgattttaccccaccagtttgattccagaaacttcactactatactgctgtttataggatcttgattttcttttattatgtatgcacttatttactgttctcatttattatttttgtattcattgttcttggtagtatttaagtgtgtaagaacctcatgagaaaaaggcatgtgaatattcttagaaaactacttagttcactgtgaatgtgtgttgttattatttattgtatttgttccatgtgattaggccccttgcatttaattctcttttttttttaaaaaaaaaaaaaaaagctttgttttatgcagaatttctcccctttgatccatttgggaagtcttgctatttacagtcacaaactttgtattctatttcctggtgcttcaaataacttatgtgtcctaaaattagagacttctaccatctggtactgtttttttatgttatgaagtattttatatattaaaaatataacatatgataattataaaccaccattgttgctcttttcatgtatgcattattatgtgttttcattgcattcatgaaaaagggtaaacagcattttataaagggaaatccagaatattggtacatgctttgttttgataataatgttctctagtagataagcaaccatctattttactggcttatccaattttaacaataccagtttgaactgaaacaatctgacaaattatactgaaagttagaaatcttaagcttatactttgaacatcacatttctccttgcaatttgctgttattgttttaagtgtgaggaccacacactccttccatttagttggagaacctgacttgtggttgctactttctactccctgactgctgctgctacctgcctaataattgtgtttggctccctgtaaacctgcagtcagaaaggtatttgaattttccccctctagcacttgcaaatccgatttttatgtataactaagtgctcttagtttttactctatctactactggggcctggtttctagcaggcctgtaactaagccagatccggcctatgtaatgctgtttgtaatgagaaatctaaacagggaatggcagtgaggcatggcaggaatgtgtttccattggagaagtcagtgtagagaaaaagtataagcaaagccatgtccagaaggccttttcagctggccaagacggaagactaatgttattgtacataggctgttaccctgccagcccttcctcacagatttgctttctctctctgtccctcttcccctgcgacctcttccccttttacccctttcatctcttccttctctttcgctttcttcttctgtcttcggactctgctgactgtttgctcaggtggacagtgacaccatttggaatgagctacactcgtccggtgctgcacgcatggctgttggctgtgtcatcgagctggcttccaaagtggcctcaggagagctgaaggtgaggtccgggttgcattaagtgtgggaaatccagagaagaaactgaaacagagatgttgttatgtgggaattgcggggagtgtggcgtggtaataaaaggaagggcagaaggaagagggtagagatggccactaaggtgtgataataactcatctgtaggcagggagcagctcatcctgctctcagggccttcttctgcctgagaacactctgcagtcagggcccaccggtgtgcatgtaagagcacagagataataagcaaagctatggttcaggtaaaaaatacctttagtatatacatgtctgtcatgccatcctgagattctcttttgaggcaattttaaaaatatgattactgagaagtgtgtataagctcagaataccacccagagagagggaggcagagaaaggtaaataccagacgggaaggattgggaggaggaaggaaattgttgattagaagggtaatgatccagagtgtgtttttccatgaaagaacttaaaaaatgagctatgctttattgttcttttctttttatggtctcttcttttctacatcgtatgaaaagaacaatgtccaaaccccagcgtttcccagtctaaacaatttataaaagctagagacctgacagacgttgacattttatttggtattttaacagtgctatttaaaggtacgccatgtgcgtcttgaatgcagttaccccaataaactttgttggtgctaacacggccttttaatgcactagttcacacacttcatgacgcaatctgggtcgtgattgattcggtatttttagcaattgcggggcttagggaaatatattatgaccaataacatatgcactgtgagttttgtgaaaccaagataaaatgtaattaggattacttttctttatgtctagtgaatttttattcaattacatgggactcttccagttgtgattaaaaatgtggagtaggaatgtgcacttcacaatgcaacgtttgtccaagaagtctttactcttaactctttaaagagtcagagcctacggaaatataattttgatagggtgagctctatttaaaaagtagatgtgcctgtatatatttgacataagtagtattaggacattgctcatctcaggggatatatggggtcattaatgtggtgcttactcttcagtctttacctttgaaaatgagcaaataaaaagaggaaaggaatcagcctgtggagaggttttggctatctcccagtagaacttgaggaaaaattcttcctatttgagtgcttgtgttgtacttgcaccactgcaataaattaacactttaaaataaaatttgaacatcttattttaaaaagaatccaaatggcagaaatcagccaggccacaatattataattttaaagattatgctggcacagctctttgataacaaagataattattatgttagctttcacaatttctaattgttttaagtttgtgtaagtttaagcaataattcagaaaccttctcaagtagaatgcccacgtgtttcagtcatcagaagcatcattattagcttcactgtgtgcagaattgccaaatatatgcacgaagatagttgaataaaaacataattccatgtttagaagttatccatttaaaatagccagttccaaacaatgtgtcaacaacacatagtatgggcatgctgaccaccagctgtagtaacatcaggtatttatattgagaacaacgattggtacaaatttcttcccttcctctggttaaggaatcagcaggcatggtttaaaaagaaaagaaaacagtaaaaaaaaaaaaaaaaaaaaaaaaaaaagaaaagccagcctaagaatcaagaaatcttagtccaggttccaccacttgcatagtgtgtcatttgtggcaaatctgtaacttttctggggctcaatttctggttctgcacaatcatctaggtggaattgataatattgaaggtcatccatggcactggcattttgagctatttgcaaatgaaaagtggatatgaatctcaattataacactatggcatcccaagcggtagatattctgaaatttcagtttgctttgatgaacattccagattgtgcagctgggttatctttctgattgccaagtccattgtaaaagtccaagataggcagaatcataacagaggcactggtactatgctgacaggtcaagagactgaagccctgggttgctaataatttgggtaaggctacagagatgccatgggggaaaagtagaactcacaaatgatttggagccatagtaaagaacatgtgtaactgaggtagacagccatgtttgtggaccgctattcaacaaccacaaaaactacccagtgcctacgtgtcccagactcaaatatgatggggctgatatacctgcaggccaggagcattattactcatggtttgtggattcgattcattcagaacttggaagaaaatagggaagcttattcaaggacactggtaagtaataagaaatgtgaaaagaaaagacttgagcattttgttattcatttttctgcatctacattcagttctcacatattctatcccattctcccagtaaatcaacatttaattaaataaaattggcatgttacgataccacatcgtatgagattgcactaatttttcttggaaaatagagtaaaattaagagctttatttgaaatatgatgtgcctggatatagtgtggaaataagagatgagagctagctagaggaggtctctgagatcacagaggatgaggacctaaaagataagaaatgtgcacaaaaaaagaaaatgccagaaaaaattgtatgacttggaaattttgtttgatgctgaacttgaccatggctaacctcctaacttttgataggtcctttcctttcttcccccaggggatattgatgagctgaaggaattagaagaatgaaccaggcacagggggtgggtttcctgttaatgcttaaatagaacatgtgcagcaaactatatcagcaaattggtatattttttggcacagcatagacctgctcagtggagctcagtgaaaatcatggggactttcagactttccaagtttttaaacaatacatttttaaaaatacataagaaggaattcctcaaatttacaggtattcaaattggctatttctcagattctcttacaaaggaacaaaaatattctgaaattgttggcatgtttggtgtattggaaatcataattggaagaataattatctcaaaatggttttattgttttataggacattttagaaagtatgtcaaagacatagaaatagctctaaaaggtgaacattttgtaatcataaataaaaaaggattgatacttattgaagtttaatataaagattcactttggtgttcttttgacaatgctaccatgtcttcataaaatagtcaaagttgcttttagcttctggacatatttatcaaaacaaacaaaaacaaaaaaaatcctaaacacctggttatctgagtgatggatgaatttgagcatatactgaatgaatatgagtttgagtgtgtattatgatgtcatgttgctaataataactgctactcattgagtgccttctataggcagccagtttatatgtaatttactattattctcacaatgtacccttgaagtaagtacaggatactggctcaaagacattaagtaaccttttaagatcctgcagataggttaataaataataaaatatgtaaatctgataatcctctgttttctttcaaccactctatcaggacattcttttacagatagcacaaatatacatttaaaaaaggggctaaaactatctattttaagtaagcaaaattttatcttttttattattataaaacatttgagacatacaaaaagacaagaagttacattcttacctaacaaaatataataataaaataaatacccacgaactcctcatccaatttaagaattgaactttgctcacaatattaaaattctctcagtacttatctcattcctatattttaaaaccagatagtcattaatctattatatttttttaaattatggccctgcgcagtggttcatgcctgtaatcccagcactttgggaggctgaggcgggtggatgacttgaggtctggtgttcaagaccagcctggccaacgtggcaaaaccccgtgctcactaaaaatacaaaaaattagccaggtgtgttggcaggcgcctgtaatcccagctatgtgggaggctgagacatgagaatcgcttgaacccaggaggcaggggttacagtgagccgagattgcactgctgtactccagcctgggtggcagagtaagactccatctcagaaaaaaaaaaaaattcctttcgtcttgttaatagctttaaacatgctttttgctttataaaaatggaaccttatcgaatatattcttcttcagcatatttcccctaaaaggtatattatgaggatttatccatgtggagatatatatatatatatatgaatgattaattcattttcattgctataaaatattccctttgcaccataatttatatttttattcttctgcaagacattgttgttgtttccaggtttttgcttttttgaataatgctatatgaacacccttgaacatggctgctctttcactagagtataacaaagagtaaaacagtccgctcctaggctactttcacagtaaatttcaggaggtaatgccaagtggaattccaaagtcattttaccacaatgacatcagcaaagtgtcagtctaagagttcaaaaattcttttctccataaaaacaatgataaaacaggcaaaatgtgtcaggatgaaatttttcaaaactcaggaaagtaatcaaagtcttccaacaactcaggaagcatgtttcaaaaaacaaaccagctgaattttggtgagaacagagagatttgtggtgttttaactcatcgtatttccatcttcccctttctaggtccatggtagccttaccaaatcacagcctgcattcttagcataaactagtaacttgccaacctctgatggggagataagggagtggataatggaattggaactccttcaaagcctcaatcctagagaattgtcattatttgacctgtccagtgcttccctgcataacttacttgcaaggctttatttggcttcatgaggttttcacacagtgtgaaagcctttttcttagaagtatttgttgtgaaaaattagtggcgatcactcaactttatggctgcttgaggtggtggataacaatggggcaaacagtaggttagccaaaagcatcaaagaaaacctgaggaatgtgcataaggactatgaaaagccccatcagattcctaagaatctagaaagccacatgtatgatagggctatatgcatactcagatttgtgttcctactcaggaaagacctgaaaaggccctaagctcttatgtcaaactgattttgaggctctgttcaaacaggaagtgaaggtccgggtagagttgtcagctgcctggctaaatatttaaaatgtgccctaagacacacacacacacacacacacacacacacacacacacacacacacacacacacagagcccctcggcaaaggctgggggagtgctggttttaagcattaaaagaaatatatttatccaatcattgactgaccactaagctaacaatgcaaagacttcagtagcatataaaacatagaacacagattttacacaacgatttcacaaaagtcactaagaaaatgacgataacaaaaaggaacaacaacaaatcctggaaagaggtgagaatatgacttctagttttaccatactgttttgtttaaaatgtccagttttccacagaaatgtttgagacaagcaaagaaacaagaaagaatgccccacacagaggaaaaacaaatcagtcaataataactgtccctgagttagctcagttatcagacttactagacaaaaactaagctagatatttttaataatttaaagaagtaagttaagccatgtctaaagattgtatgaggatgtatgactctataaacagaatactaataaagacacagacattgttaaaataaaagaaccaaggaaaattctggatttgaaaaacacgataacttaaatgaaaaatttactagaagggcttagtagaaatgtgagcaggcagatgaaaatgtcagcaaacctgaagatatctagtctgaagaccaggaagaaaagagaatgaagaaaaatgaacagagtttcaaaggtctgtaggacatgatcaaatgtaccaacatatgcataataagtttcagagaagaaaagagaaaggggaagaaagaatatttgaagaaattacggctgaatatttcccaaattcaataaaaacattaatcaacatattcatgaagctcagtgctccaactaggataaactcagagatccatacctagacgcaccataatgaaaccattgaaatccaatgatgagaaaaaaatcttaaaaacagcaaaagagaagcaactcatcacctccaaaaatcctcaataaaatcaacaacttaggtctcatcataaactatgtaggccagaaggcagtgggatgacatcatcaaagtgctgaaagaaaaagaccatcaccaagtattctatgtccaacaaatctgtccttcaaaaatgatggtgaatttaatacatgctctgttttaccccattagtccattcacctatctctgaatcagtaccacatactactcattacttcaactttataagaggtcttgactatctgataggaaaaattttttcactttcttattcttcctcactagatcttgacattttctttgttcttaaatgtatagtttaaactcaccgtgtcattttgcatgaaacattccatgagaggtttttttgcattgaatctacagatgagtttgacaataattaacatttttagatgattgagtctatttgtttctgagcatatgtttacatttatttatactttctttgaagtttcttaatcaagttttataatttcttcttgggcaagggatggcggtgcatgcctgtaatcccagcacttaaggaggctgaagtgggtggattacttgagctcaggagtttgagacctgcctggacaatatggcaaaaccctgtctctacaaaaaatacaaaaattagccaggtggggtggcatgtacctgttgtcccagctactcaggatgctgagatgggaggattgcttgagcccgggaagtcaaagctgcagtgagccaagatcgtgctgtctcattccagcctggaagacagagcgaggccttgtttcaaaataataataataataataataatttctccaaagacaaaaaatatatatatgtaggtaatttgtgtttttgaaaagaattttagtggcatcttattacaattacattctctgttctgatgtacaaaggggctgtttattttttgctaattgtacatcattattattgcaaaactagtaacaatttataagtcatttggggtttctttctgatatcatctgcaaataatgacagttttatttctttttttccaataattatgccattttaaaatttgtatttccttattacatgggctaaaatctctgatataatgctgaagacaattgaacatggtgagtattcttgtgtctttctagattatctgtttcaccattaaatattatgtttactacaggctattgtaaatattttatattttgtggaagaaattacctttcatttctacttttctaagaattttctttctcctgtgagagaattttacattgtatgaaatgttttataggtggctattggtattatgaagtgaattctatttaatttcttaatgtgataagttatattaattaaatattaaaaatttttgtattcttgagatacatctaccttggttatgatttattatcattgttatgcatttccacatttggtttgctaataatattttggttggaatttttgcatataagttaattactgaaattggtctgtaattcttataaagacccatcaatctagtgcatcagggcttcataaagtgaatatgagactgtctctatatttctctactttagagtaatagttcggtaaaaattgggaaatttgttttctcaacgtttggtaaaactttcctctaaagtcacagagccttgttatttaggaagatttgtaactactgattcaaattctttcattattatgaaactatttggaatttgtatttctttttgagtcaatttaggagtgttgtattttttcttgacatttacatattggagccaaattttcaaaattagtcatatgaatccgttcataatatcctcttttaacacttcaatgtttgcaggagctttagcaatatatctttttcattatcataccgcttatttttcctctttttcttgatcaactctgtcagaagtttgacaattctctaattcctgtagagcaaactttggcctttgtagatgtcatatattttatgaatttcttctatttttattatttattttatttggggggaggtcatatatttcttttaataatttcttaaattatttagctcattattttacaacctgtagtcttttctacttattagagctataaatttttctttaagtactatttgagttacatgctgttttctataaagaattctcaagagtttagtttttaaaatgtcttatttccattatctccttttttgagccattagtgtattaaatgtgtatttttaaatttccaaacgtatgagtgttttagtcacaatttttgttattgactcaatttaaatataagacattcataaaatttgatctgtatcatactagttcctggaagtttatgagacccgctttattgacaagtgttcttgctatttgtaaaatgttctttgtgtgcttaaatagaatcggcatccacatattattgagtgtaatattttatatgtccattagcacaagcttattaattattttgttaaaatagtccatatttggctgcaggatttttgcaagattctataatggctatttaaaaatgtggtgttgaagtttccacatatcatgatagatttttttatctttatggaactgttaatttttgctttagatatttaaaaactctgttattaggtacagtaaaattaagactattatatgcttataaatcctttattaatatttaataattatcttaagtaaatatttttatcctcaattatatttatgatattaatatagcaaaaacagctttttttcttttctagtattttcctggcttatcatttaccattcctttactttcagactttctctttattacatactaggtctatctcctataaacagcattcctggatttgttttctaatatgactgtgtattttaattggggagttcaattcacttatatgtgttatgatttataatatactgaaacatatctctatcatcttattttgttttttctttttgttccattattggtttgtccccttactttcacccgccccttgctttatttttaattaaattagtttattttttctctatgtgacctcttttttcagaaaatgcacactttttttctattattttagtaactacctttaaaaatttaacctacttataacacatcctaaacttcactatcttttttttcccaccaacaatacaagaactttatgttttctttctattttaaagcaatagtcatgtcctaacttacatgcttaggactttagttgtatttataaaagactagtagcactgacgaggtatgattgtactgttttaaccatcagtgtttctctatacttgctcgctatttaccatttttcttatcaccatttatgattgtatctgaaacctctgttctgggattgttttctttcttccaggacattttttcggattttccttactgacggtttctcagtttttatttatctatgatgtcttttaccctcattcttgaaagacagctttgctaagtacacagttcaaagttgatagtttctctcagcactttaaatatcttctgtgcttttctggcttccaattttgatgaggaaaaatcagctgatagtctgatgatcatttcttgtagattttctattttttttctcttggatttcttttaatgtcttctttttggatttgttatactgtgtcttgcttgccatgtatttttagtggattttactcagtcaagttgtttaaaatatatacgtattaggaaaatcaaaatttaatgcagccagtcagtgatattttgtgatatatcccttgcaatagactgcaagcaaccttgctgatttcaataatcaatgattaatttatttaaaaaaaacatgtttcaagtacctatcatatgccagaaactactttaaatactgaaaatactgtggtgatccagacagggaaattaggtttcctgctgaagagcaatgataaagagataaacaaatggacatatgatacaagttcatgtgaaaatgtgttatggataaaagtaaaggatgaaagagagctagaggaaggctgagcaagaaggctagctctgttagcttatcagaaagctttactgataaggagagatttgtgctgagtgaattaagggaagcattatgtagatatgtggggaaagaatattccacacaggaaaaaagcaaatacagaagctctctcagggtggggcaaataagcaggtcttgacatgtttaagaaacttcaaggcctgagcgtctgaaagtgagatgaggttagagagatagtcaagtgctacatgatgggatgcatgtacacgtccaccctcacacatacacacaaacacgctgtggttcatacacacgtatgcatacgtaaataatattaaaaatgaagggtctatttctaatagggcataaggatagcaacggtggtaagtgctgattgtgaataaggaaagctgcattgcatttcatatacattttgccacacatttggcctttcttaaaatgttatattgctgtctaccctaaaatggttcaacaagtaaggtatgcattgaaatacctgtgttgactccaattatgaccaaatcctaaactgtggacaatggatatttaccatgcatactatatactgcttcagtgaattccttaaaacagccaaagaagactgcaattatcttacctaatccagttcacattacaaaagactagagaacatagatgtgattgatggaagattcttttcttttcttttttattgagacatggtctcactctgtcacccaggctggtgtgcaggggcgtaatctctgctcactgcaacctctgcttcccaggcttaagtgattctccagcctcagccccctgagtagctgggactacaggtgcctgccatcacgcctggctaattttttgtattctttgaagagatggtgttttgccacgttgcccaggctggtcttgaactcctgagctcaaaaagatctgcctgcctcggcctcccgaagtgctgggattacaggcatgagcccctgcgcctggcccagtggaagattcttaaaaggaatttaagtattctgactatcctgctcagtccccttcctaagctttggtcccacttaaactaaatgtgcaagagaaggggaaggacagtaaggaaatcactcatgtccacaaacaggaggagtagcttttcagtctttaacttgttgcatgttgagctataggaatttgtaggttcactttagactgttaccagagtggggtaggacgttcactagaaggcctgataaatgtgtcaggagtttgagagcttatgtaaagatcgaggaatactcaggcttgtcacctggagaagagataagtggagagctggctgaacgtgcccatgtggataggtccaagagagagaagtcagcagctgcacagatgcaaaaactgttggtggggcaaggatttttccccctgcgggccagtggacactgcgcagaagccaattttaatcatgaaaggatttcaccaacaatggttgcctgcaagggaaaagccaccagtagaatgagactggaggcatgtgaaagagctgatgaaggcctgcaaggtcagccagtgagtgcatgacgcatctcagtgaacttagcagatacaggtcactgacagtggacctgagagtgttcccattcataaggaacagtgtttggatgtctgctgtgactgaaggcctttgaagaacccagagagatcaccaacttgcattgctaatccagtctttatgatttttccttcttcccagtctccagagctgtaggatctgtaaagtaagcaggaaggaagtggagtaagaaggaaaaaatataaactataaattatatagcctcctctccccaacacacagagatgtacacatcacatttgcccactgctggtccctgatcctgtgggtcagctgaggagttggggaagcttcaaacaaaatgtgacattaaggttttcaatgaggctgaactggactttttaacatctaaaaatgagactatttctatagtaaaagtaactgaaaagctgtggaatacatcagataaaaactaaagaaagactagggcttggagaagaataatcccacttccatttcaccccattcaatatatcagtgcattattaactttctattgctgctataacaaattaccccaaatttggtggcttaaaacaatgcaaatttattcttttcagtcctggaagtcttttgacaggactcaatgggccaaatcaagatgtcagcaggactacattccttccttattcaggggatggcagaattcctttccttgtggtcgtgagacttgggtctccattttcttgctagctgtcagctgcaggctgcccttagctcctagagtactctccccattctttgtacctctacatctcagagccaacaatatggcatggaatcctcatgttgtcatttttctaaccctttctgtcattatgtctctctgtgaccacggttggaaaaggctctatgcttttaaggatgcatgtaattatgatattagctgtgctcttagatggtcttcattatatgaaaatacatttattatatacctaatttgttgggaattttattcaggaaaggatgctgaattttgtcaaatgctttttctgcatctattgagaggatcatatgatttttatccttcatcctgttactgtgttatatcacgtttattgaattgcatatattgaaacaaccttgcaacttagggataaatcccactttatcataatgtgctttcaatttggtttgctagtattttgatttttacatccatgttcatcagggatattggcctgtagttttcttgttttgcagtgtcccggcctggtttgggtatcagagtaatgcttccctcataaaattagttagaaatgctcccttcttttttaatttttgaaagggtttgagaagtatttgcattaattctttaaatgtttggtagaatttaccaatgaagctttttggtcctgggttttactttgttgggatttttaaatttttgattcaatctccttgctgttgcctgcttcagattttctgtttcttcatgaagactctgtttctcagcaggatatatgtggctaggaatttatctgtgtctgtaggttatccaatttgttggcatatagttattcatagtcttttatgatcctttttatttctgtggtatcagttgttaagtcttgttcaattctgattttatttgagtctgatatctttttttattagttaatctagtcaaaggattgtcatttcattcatcttgtctgaaaccaactgttttgttgaccttttctaatttttaatgtttttatttcatttatttctgctgtaatctttattatttccttctttgtgctaactttgggcttagtttactcttcttttttttagttatttgtaaaggtttgttgtttatttgagatctttcttttttggtactgtaggcatttattgctataaacttctttcctagaactgcttttgctgcatcccttgttttggcatattgtgtgttcattttcatttagattaattttttatttatgtttgttttcttatttgacccattggtttcccagaaatatgttgcttaattgtcacatatttgtgaatttccaattttcctctggttattgattcctagtttcatactcttgtggtcagaaaagatacttggtgtgatttcagtcttcataaatctgttaagacttgttttgtgacctaatgtgtaatctgtcctggagaatgttctgtgtgcacttgaggagaatgtgtattctgctgctgctagatggaatgttctccatctgtcttttatgtccatttgatctgtagtgtttttcaagtccactgttttcttattgattctttttttgtggatgatctatattctgtaagatcagtaacaggataatcttgctacttcttgagatcatgtttggagattctatcagggaagtgcagctacttgtgtacccttgatcacagaatggtactcctctattgaggaacgtcatcctcttcaactaagtgctcagcttcaggagaaaagcacgtgaagcagtgaaggaggaaggggatctctgcatagccagtgatctgccaaatcaaccctggtgatgaatgagttgacagatgttgcagtcagattgctttcacataccaatctttctattgctatccaatattgtactgcaagcctagttagagaaattagataagaaaaagaagtgaaaggcatccaaattagaaagaaagtagtaaaattgtctctgtttgaatacgacatagttctatgtatagaaaaccctaaagactcaccaaaatactgttagaactaataaatttgggaaagttataggatacaaatcacatacaaaaatcagtggtgtttcaacatactaacaatgaactgtccaaaaaaaaatcccacttacaatagctacagaaaatacttagaaaaaaattaaaccaaggagataaaaaatttgcatactgaaaactataaaacattgatgggagaaattttgaaagacttgaataaatggaacgatatcccatgttcatggactggaagaattaacattggtaaaatatacaagataatctatggattcaattcaatcctatcaaaatttcaatgacatttttcacagaaagagaaaaaaaatcctaaaattcatatggaaccaaaaaagaccctgaatagccaaagtaatgttaaacaaaaacgaaacacaacaaaaacccaaaaaacaaaacaaacaacaacaacaacaacaaaaacgaagatgaagacatcacacttcttgatttcaaattctgtggcagagctataataatcagaacagtatgatcctggcataaaaatgaacatatagaccaatggaatagaatggagagcccagcagtaaaatccacctaaatgtggttagctaatcttcaataagggtatcaagaatacaaaatggggaaaggataatctcttcaacaaatgaattgggaaaactggatatccacatggaataatataaaattggatcctcacttaatactatagaccaaatttaactcaaaatctattaaaatcctaaacataagacatgaaactataaaactacttgaggaaaacttagggaaaccctccttaacagggtcttggcaatgattttttggttatacacaaaaagcacaggcaacaaaagcaaaagttgacaaagggattatattaaactaaaaagcctctgcatagcaaagaaaacaatcgacaaaattaaaaggcaacctgtgtaatgggagaaaatagttacaaaccatatatatgataagaggttaatgtccacattatataagaaattcatacaactcaatggcaaaaacaaaaacaaaataacctgatgaaaaggcatgcaaagaacttgaataaacatttcttaaagaagttatacagacatatatctggccagataaaagaaggcatatatctggccaacagatacatgaaaagatactcaacatcgctaattatcagggaaatgtaaatgaaaatgaaaatgatgtacctcacacctgttgggatggctgtaatttaaaacaaaacacaagtgttagcaaaattgtggagaaaagggaacaatgttacactgttaatgggaatctaaatgggaaatttatcattatggaaaacagtatggaatttccacaaaatattaaaaatagaactgccatatgatccagaatccaacttctgaatattcatacagaggaattgaaatcaggatcttcaagtgtcatctgccctctcatgctctttgaagcattactcacaataggcaagatacggaaaaaacctaaatgtgcattagcagatgaactacaaataaaatatagcatatacatacaatggaatcttattcagcctttaaaaagaaggaaattttgccattttcaacaacgtggatgttcctggaagacaatatgttaagtgaaataatccagacacttacatgtgggttctaaaatagttgagctcatagaaacagggggttgccagaaactgcagggagaaggaaatggagaggttatggaattaaaaacaacaacaataacaaaaaacaaagaaagaaaggaaaacacaagattttattgagctcatgtgcataattcggagtattcttcccatctcaaagtctttaatctcaatcacatctgcaaagtcttttttgctatttaaggtaacattcacagattctgggagttagtatgtgggcacctttggggaaatattctgcttaccacaaccagtttcccaagattcaaggtagagttcttctttaatattctcactgtatatggctataagcagtttaacaatccattgatatttttcagaaatcgatgatatcatttatttttaaattacagtgtaatgtacactgaatagaacacacagattttcataaaacacacataatgtcttttgacaaatgtctatacctgactatcaccacaaattataaaatatttaaatcaccccagaaagttccttcatgtccctggtagtagacctagatcataggcagacactgatctgttttttcatcataatctatttgttcctattatagaactttatataaatggcagtatagagtatgtggtcttttctatgtggcttctttcacttaaaatgtttacgtgatacatccatgctcttgcatgggagtttgttaacttttactgctgagtagtattttatgaatatgaactaatttgttgattcattctagttttgggctatgatgaaaaaaactgctataaagaaacttttccaaatttgtttttggacatatatttttatttcatgtgggtaaatgcctagcagagaaaacaatgttacagcttaactgtatgtgtattttataagaaaatgacaaactattttccaaagtaattaccactttatttgtggaatctgtaatgtcagctttcttattcctgagagtggtaatttgtgcctacattttatttgccttatcagtctggctagaggtttatcaattttattgatcttctaccagcctttagttttgttaatattcgttactttttttctgtttcctattttactgacttcatcattattatttctcttttttctccagacaatatgttttatttgctcttatttttctagttttcaaagtggaagctgaggtcatagatttcagatttttcttcttttccaatacagcatttattgctataaatttccttctaaatccagctttatctacattctgtaaattttgctatgttatattttcattttcacttgtctgattttctctttgagttcttttttgacacgtgagttattttaaagtatattatttagtgtctgattacttgggcattttttcagctatctctctttaattgatacataatttaattccactggggtcagaaaacattttctgtagagctttaattcttttacatttattgatatttataatggtataattttttatctcttcctacagtttgtattactttattgtatatttacttttatgcatatgtagattctcacatttaattattaattttcttaaaaagttgaaaaattttaaacaagtttaaatgttggtatatgtttatatgtgtttgtgttgtatgtttgtgggtgtgtgtgtgagagagagaggaggggagagtaaaggaaagaaagggagagggagagggagagagagaaagagagagagacaaaatatgtacatattcatcccttgatatattcacaggggattggttttagaaccccccttaaatagctcaaatcccttacataaaatgttgtaatatacacatgtagcttatgcaatcctccgtatactttgtcatctctagattatttatcatacttaatataatgtaaatgtcaggtaaatcgttgttatgctgtgttttctatttgtacttttaaatgttatattgttgcttttttattttttctaaatctattttatctgcagttgatataatccacagatacagaacccatggatacaagggtcaacagtatacgtataaaataaagacaatttatggaatgtcttttatatttgctcacatatttaacctttctagtgttctgtattcatttgagtcgatccaggtttccatttggtatcatttcctttcaatctgaagtatttctttcaacatcgcttgcaccactgttctgctagcaacaaattctcttatcttttgtttataagaaaatatttttattttcctttaatctttggttaatattatcatttgatatataaaactatgttgacagttatttcacactctaaagatatattttcaatgtcatttttttatttttgtctttcctttttttgaaaattagaaatcggctgtcatgcttgttgaaaagatgtatattttttctctggttctttttaagagtctttatgtagtttaatgattaggtagaattcctctttttttttccggttgaagtacattgagcttaatgtgtggcttgctgtttttaataacaattggaggacttttagctaatatttcttcaaacacaattttctgccccattttttatgtcctctgtttctgagggtcctattacatgtttatttcatcacttcggtatggcccactggacattgaggactctgttcattttcttgagtctcattttcttctttgcacttttgtttttcttgccctgtctttaaattctttgtccttgacctctgttgtgttcaacctgctgctaatatcatccaaaaaacttttcatttcacacattgtactatttacttctaggattcccatttagttcttttttacactttccagttctcttttgaaattgtcacttcaccattatattcatcttttcctgtagattgtttgacatgcttataattatttttcagatttttgtcttatacttctgagtcatttgtgagtctgtttctattatcttatttttcacttgattatgagtctcttttttctgcttctttgcctgtcttgtaatatttgatcatcttctaggcattgtgttaaagaaaaagaaacagtggaggcttaaaagagcttgtttctttggagtttaattcttttaaaagtttctttgtttgtgaagttattcaattatttaaaggaaaacatgcttctctggggcttctttggttatctattgttactttggcagactgaaggttttgcacatccttcttcttcctagtcaggtgtggatctccaaaacagattcatatttgagaggggtgttgaagctctttgttgtttccaattttatgggtcatactcataaaggacaaagtcaagtgatgacaacaggggcacatttatttatttatctatttatttcttcaacttaaatggaggataggacaaatatgttactaaatactttctgcacatccactgctgaaaagctacctaaatatctgagaaagggataaatcttggcagttatacatttactttgtgggaaactaccttgttttcaaccttcttgcctcctgttgtaccagtgctccaactctttctgaaagcttaagttagccaaattatggactgacttacaactctgaaaagtttcaaacaaataaacacttaaaaactttgggtgaagtaaaaggcgagagtctagctattactaagattttttgttcaggtaccaagacctgtcagctagttgtctggtctatggtgttcccacaccacagtccatttccttctaggatgttagtccctccgtctgcatttctgaagactaaaatgtcagtttctcatttgtagttttaactgcctgctttatggtaattggatctgcctatttccagcctcttcatctggctcttggcttcagactgtcgggatttcattacttatatatgctttagcttatactgactaaaaattgctgcatctttcttcagactctacatcactccccgctctaaaccttgctgagcttttctcagtacctgacacctactttgcacttttaaacaaagtcctgatattttaaaaataacataaatgggaaataatggttcctgaaataaattatagtctttagcatttacttacaaggttttctactgctatatttttacctgaatatttaaaatatagaacaaataaataacataaaatgaaagatatcttccaagtaatttatgtttgtttttatctttgatagtattaaatttgatatctgctggtttatgtatattgcggatgttccttgcttttttgtttcaatctctgcaaaagacattgtttggcttttttgataccagtgttcagattgtacatatcatacacacttggagaacattagtatttttcacctctgtaattttatatggcagcaaatttcattcacatgtgcatgctcaccccccaccccaacttgctataaaatgaaaaggctggtcaattgctttgatgttctttatatataatgctattatgtacctaatgccacataatttaatttctgtggtcaaaatttgtattcaattgcctagtttttactaaattgatcacatttacttgttggtagctattctactagtgtatagccttggaaaattagagtttaatgcaggaagaacatttagaattagaataatataatcaaaactaaaatcatctatccaaagaacctagacattttgataatagttatacaatgtacattgcaattagttactctttaaatttttgaaattttataaatctgattgaaaatgtttataggtaacgaatgatggtgaaaatatttgtattactgttgattgaaggcacatctattgtagtaaaatatgagtataagagaaagagatattacaatggggcattcgttggtacagtctttatagcccagtataatctttgttcaagtcatgattattactcttattgtgtgttatgatcttcaaaaaggctatgaacttctgtcttaaaaaaatagtgtcttaaaaacaaaaacaaatcttcttcttccctaatttattttttttttgaagttttgcatacttgggccatatttatatgacaaaaaatatctgatttttttttgatcaatgtgatccaaaaatcagtcatgtttcaaaaaatttggccaattgaattgttgggccttatgtcaaataaaaccactgcttgaaaactaaacaaattgctttcaatgggttattattgccttaccaagaccacatcctgatgatttcccccgtcacaacaagactttcttcatagtggatccattgttattattttcataaaaggctcaacttaaattacatgcaatagaagcaccatcatcaggtgccctgtctccttcctaacagaagcctggtttttcacgaatgcatttagtcctgtctgtagccccagttttgacaggctgaaggctgtaggcatgatgggccgcagatgccaggcttcttaagaactgttttccagtgctgtcaacaaactccctccttccagattctttacagagcagggctggcagctgtgcataggctttgggatccaccatccagttacatttctaatgctgggctcttgttttcctggctcccttgagctggctcaaagaaacaaaatggtattcccatatgtcccttattgttttcttggcaaatatccctacttccctgaatctcccagattccagcatgtgagagacaaattttctttgtgaaaattccctccctcaaaggctgcagattaatagcattgattctaaagcaaactgtctttttataaggtcttttgtaaggctgaagttagctgggtttaggggctatgttagcatattcggaaatattatgcatatggtaaaccatagcaatacaatacaaaggcaatacaaataactgagcttgatttactaatttgaatgtcaataccaatagttcagatatgaagagatgcctattgactgagtgatcctctttccctttctcataaagatttatgtgttaaggcaaaacaactatctacaatctttagtagacatatgcatttatttttacttctaagtaaagcttaattccaataaattgaagttaggaaggaagcattcaactttcatattattgttgccataatataaatcacgtggaactatttttcatcacagagattagtgtagctaaagaggaagactttagaacacatcaaggatccatagttactattgaacagcaactttgaatgtgagctagtataggcatattgaataaatgatgaactgtatcatattcatactggttaatttgagattgccagttatttaacaggatattaactgtagctatatctgagccatttctgaaaagaggaatcggagccaattgttgcacaagctcttacaaggtcaacaaaaccaagggaggtgatgcaggaggaaagacttcgttttctctctctgctcctaaattggtttctggtcatctaaatcccccaatccattaccagagagtgagagcaggggaaggcagtattcattcattccaattttcatgcatgatctaactcaacaatttttaacgtaccagtgacttcaacaaagacactgtgtttaatttccacggaacaatgttcagtttctttagataaaacaaaatggaatcccatatcactatgttaagtgtaatcaacaccattttggatggggaagcagtcacatataaatgacctatcagaggtattccacaaggacctaaagaattttgattgtaattttttgggccctattcaactttacccgaataaaagggggaaaattcttataaataaacgacttaatatacctaggtgagaagttttttgttttttttttttttgaaatggagtctcgcgctgtcgcccaggctggagtacagtggtgcgatctgggctcactgcaagctccgcctccggggttcacgccattcttctgcctcagcctcctgagtagctgagactacaggcgcccgccaccacgcctgcctgattttttgtattttttagtagagacgggtttcaccgtgttagccaggatggtctctgtctcctgacctcgtgatccgcccacctcggcctcccaaagtgctgggtttacaggcgtgagccaccgcgcccggccgagaagtattatttatattgtaaggcctgttacaacaaatatcacacactcattcccccaaaacaaaaacaataaaaaaaacccaaagagggttcaaccaataacacaaatgcttgaagcagtgattttccagaacaaaattttagtgtaatagaacatttggatcttttttccagttaaatctttcaaaagcattatgtcctgaccatgtttctgatttcttgacctctgtacaacttaatataaaaaatcagaagtttattgctgtaaatattttaaaatatgttaaactagctaatgtatactttattttcattatgcttttgttctgtcatcaggtaagagacgtgtacacatggcaagcaagatgattgggaggttagaatgggcacttgctggcaaacctatttttgacggagaaaaactgtactatcccagcatagtcatagaaactgcaggttctggctgctttcaacccttcttttttaaaagacccaaattgcctatgcacaaatatatttaataattataattatcattaagtagcaaggtagattaaatatcctcagtcattcttcttaaaaaataaaaacaaaaacctcaacctacatttaagcaaaaaatgcttcttaaagtcattttcaaaattgataatgcatcgatatgaatttgggtagctgaaattttggcttccagtgaaatagttcacacacataaaacatcgcatgcgaattttgaattcagcaaatgtattggaagtagtaattcaaccatcacatcttcacttggaaatacatgctgtagaatttttccatactgtgcttgcttttgataaatattattttactgagcattgatactttcggacatttagaagtaccttagtgctgatacttaagcactgggaggtaattattgaactctaaattaccagtacactcaaagagaaattttaaaaacagaatcccgatcagctggtctgatatgctcaattagtttttggatagtaggcagttatattatacataaaacatttttctctgtatgattttttattttgttatagtttcctaaaatagttatatttataaaacttaagtaaaaatctaatatttgatcaactactttcaacaaagaaacacaatcatctcatctcttgtcagtttataaatgtcacatagacttactattctctgcactgcagctatacctttaccaagaataagtatataaaaattagtaagtagctagcaggactactgggtattaaaggtagtattaatttaagttctggctcattgcttagtgtttgttaaagtctgaatcatcttgacgttttgttctgcattctgtatttattggctgattctggtacacgatgtgttcttactctcatcagtggagatttgacccttatttttcatgattttgaagcctaaattactccatctaggttggaattagtagcagttcttaccatccaaatactatttggctatggggatgttagagaaatggaaatatacgtttctgttgcccatgggacaatcttaatgaatgcagcaagtaaaatgatcatattaatttgcactttcttattttctgtacctatccttgccatagcaatagacttagtttatatgaaattaaaaaaaaaaatgtctagccaggtacagtggctcatgcctgtaatgccagcactttaggagactgaggtgggtggatcacttgaagtcaggagttcaagaccagcctggccaacatggcaaaactctgtctctactaaaaatacaaaaattagacaggctttatggtgcgcacttgcaatcccagctactcaggtggctgaggcaggagaatcacttgaacccaggaggcggaggttgcagtgagctgagatagcaccactgtactccagcctgggtgacagagcgagactccatctaaaaataataataataataaataaattttaaaaaccaacaaaaaataaatgtttaaattggttccagtgatttgcttactgcctgccctttatttgcctaggcagagtttcactatgtatataaggaacacaaaaataaatctgacattttgataaatttgcccagaaaatgtgaatttcatcagttatgaaaatagactagtctaaaatgatcagattctttttttttcaaatccagttttgcatatagactatgccatagattttctttcctggataccacatggctatatttggcaatcaaatattctcttgtacttccgcatatggtcccaccggaaaacatcatttcttccctttaaactaaggagaaacatccataacaccaatctaaacaacagcaagaaagtaggaatgtgagtattcagtccttgaaagattaattgtcacttttggtgacattaaaatactgccaaagttctattattagtcatgttcatgcctgaagagaaagtaaaacttgagaagaaatgttacaaatcagtttattaaaataaaatctatgtcaccattaagttgactgaaatccacagaaaggtactataggatatatttgcttagattaactgcttggtctttgtaacttaaaataaaatataaagcaaagagtttttccatgttattatgtagaaaaaaatctaaattgtattgcataatatggcatttgtgggttttactacaacaatctaagatgctcataagtttaaaaaggttaaatatgaatatattcccttcaaagttcgagaaacagatttgttttcataaaatgaaaaaattttctatttttattaccattaaatgagaaaataagaaattaagtcactgaattctttcttgcatatgtcttctgatagttatattttgtgagactagtagattttcaagtcctttgaaaaacagtaaattaattatttaaaaaacttgttgagaaattctcattgaagagagacatgttcttgagccaaggagaaacttggttctagtataatatagaacacatctttatgtcagaaaaatactatacaaattccctgttaggagactcagaattcggtgagaaaagcagatactgtaagaatagtaatcttattttaaaacattttcacagtttcatcaaatcaatgattttattcattataaagcacaaaatattttatgtgttttaagaaagaaggtgttgtgctcccaagtctaaacagcaaccttctcccaaaacctggggtgcaaaatcgggggcccttgagagaaggaaaattttctagcaaagcccagagtagaggaatggccagagggagaggaaaaaagctagggtagtagctactcataaatctattttatcatcctttactggccactatatgtcagatactatgtaaatctagcagctaaaatggtgagcaaaaagtagatgttttggggagtggggaggaggacattaatcgtgtaataaacataataacaacaaatgtattaaataatcacaccaagaggtgtatcattagaaatagagatgagttctcagaaatcggggttggcaaatctctaagggcatattatagagtgtcttagtccatttgtactgctgtaacaaaataccacagatgcagtaatgtatgataagcagaaatgtatttactcacagttctggaggctgggatcaagtccaagatcaaggtgccagcagatttgattgtcttgtgaggtctttctctgcctccaaaatggcactttgttgctgcagccacctgaggggagggacactgtgtccttacagggtagaaggcgaaagggcaagcccaccaaaggctgcaagaagcctattttataatggccttatccgatttatgataggaaatgctctcatgacctcatcgctgcttaaaggccctaccatttaataatatcatattgacccttaagtttcaacacctgaattttggagggaacacatttaaaccagaacacagaggaacttgatggtgactgatagaggcttaggaatggtttctctggtgaaatgatgttggagctgaaatgtgtggataaggaggcattattcaggcaaagggagggagtgggtaagtggaagacatcccacatagaactaggagcataggcagagccttgtggctgcaggaaccaaaaggccagtgtggctgcggtggagaaagcaagatgaatggtgatacaaaataaaactgatgcagcgggaaaaggaagatcaactgtttttctgtatattcacaattaacatagaacacttcagacaccatatgtatgtgttttttcctacagccagcaattctccaattatctgcagacactgactggatgtcctacagtttaactcaattctgacactctctacctgcagatagaatcagatctcacaagttaagggctcaatcccacaagactgtccccacttcagatgctggttgcatgtccaggttttcatctgtgcctctgcccagttggctataaatcagatgttattacaaccccctctttgtgtttgattatgctaggataacttccagaactcaggaaatcagtttacctactagattactgttttactatgagagacacaactcaggaacagccagatggaagagatgcatgggaagaggtatggaggaggggcacaaagcttccattgcctctccaagtgtgccacccttgcagtttctccacatgttcaccagcctggaaactctctgaaccttatctttttattctttgtggaggttccatcacatgggcaagattgatcaaattattggcccttgataatcaactctacctccagcctctctctcctccccagaggttgggctgtggggataaatatttcaatcttctaatcatattgttggttcctctggaaaggagccaccatcctgaggctatccaggagcccccagcccccagtcatctcattaacatacaaaaagacacctttcacttcagagagtccaagggtttggtttttgtttgtttgtttgtttgttgttgttgttgttgttgtttgagatggagtctcactcttgtcgcccaggctggggtgcaatggggcgatcacagctcactgcagctgccgcctcccgggttcaagcgattctcctgcctcagactcccgactagttgggattacaggttcccgccagcacacctggctcatttttgtgtttttagtagagatgaggtttcaccacattggccaggctgtcttgaactcttgacctcaggtatccacctgccttggcctcccaaaatgctgggattacaggcgtgagccagcacacctggccacatatttcttttttatgtcataggtgaacagagaccagatcaggcagttgactagtcttaaatgacttttcttctgtgccagattgcctggaataggatcccagcactgtcacttgctagatatgaactttaggcaagttctttcatctttctgtgcctcaatttcttcatttgtgaaatggggataataatattatctgcctaacacaagttgttaggattaaatgggcaataaaatattagattttattatgtatcatagtatttgtattttgttatttttgtattatatattctgctataacattatgatataatacttttatttgtcattttgttctgtttttattaagacttaatatgttttttattctgatggaaataacccaataaaagaaaacacaggctatcaaagagggagagaggaaagctgtgagtgagatgtccttgaataggtgagagggactaagattaagtgcacatgccaattaactgttctcacataggatcagggatggtggggtaggtgggtagaatttctggtggaagaatgtagacattgtatttgaattgctgctactatctagtgaaataagaagaaaagtcatcagcaaagggtaaggaatgagcagggtaggagattggaagaacgaaaggaaggtagaaatgctcatctgaaaggatgggagagttcattgttaaggactatagtatgattgctgggcaccacgtagagtttatttaaggttttgtggttgtgaatttagacaagtcatgtggcttttagatatgcttaggtgcggggacagagcaggtgtgacttgtgtttaatcaggatggcaattttaccatgggagtatgttggagggagaaagtgacaaagtgattgaaagtatgtctgtgcctccccaaaattcatatgttgaagccctaatctccagtgtgactgtatttcagtacaggcctatgaggagatgataaggatcacatgcggtcttaaggtccccagtgagataggctggtactgttgtaagaagtggaagaggccaggcacagttgctcacacctgtaatctcagcaatttgggaggctaaggcaagtgatcacttgagctcaggagtttgagaccagcctgggcaacagagcaaaaccccatcttcactaaaaataccaaaattagccaggtgtggtggtgtgtgcctgtagccccagctgctctggaggctgaggtgggaggatgactttagcccacgggttgagactgcagtgagctgagatgatgccactgcactgcagcctgggtgacagggcaagaccctgtgaaagaagaagaagaagaagaaggagaaggggaatgggaaggggaagaagaggaagaggaagaggaagaggaagaagaagaagaagaagaagaagaagaagaagaagaagaagaacaagaacaagaaggagaagaagaagaggtggagacaccagagcccgctttgtgagtgctcagatgaaaggcacttgagggtggcagagggaagacggctgtctgcaagccgcaaagagagctctcaccagggaacaaaccctgctggagctgatctgggacttccagtatccagaactgtgagagaggcatgtctgtgtgcaagccacctaacctatggcaacctgagcagaatacacaaaggaagtatgctggtgggagaaagagacaagatgactaagtgtatatgcaaggaagtaaatttaatgatgggtctgaagtttaacccagataagaaggaaggcaaacatggtggtgggggtgattgatggataagcaaacataaatgagatgaatggattggaagtcccagtgcagatgaagctataactggaatgataggataggagagtaggatgcttgacattgaaatcatgaaagtgatgttgctattggtaattatagggtctaggaatatgactgtaaaaaaagactaatgtattgaaagcaaagagtcagagaactgagaaatcaggatattgaatggattgtgtgcatgttggaatcatatagtgagagctctctttgtggcttgcagacagccatcttctctctgccaccctcatgtgcctttcgtctgagcactcacaaagtgagctctggtttcttatccactgtgtggatgtaagaataattactggaggagtaattcaaaaggcaggaattcaaaaggcagcatattcaatgaatgcattcagatataactgcatacatttgagtgatatataaaaacaaaatcaacaggaatttgtcatgaaataaaaggggatggagaaaagatagggagaaggtgccattaaagagaactcattggtctctgacttgagccactggatcaatcatggtaccatttctaagttagagaaggctggcagaaggccagaagtttgattttggtatagagtttcaagtgactttgatatatccaagtgatattgagtacatgggctaatatatattgggctggttcccagagaagagtccatcttggaaatagaaatctgtgaagtgtatgagatgggtgatggctgaattcataagactggtggccttgcctaggaggtatggaaagagcagaggaaaagacaaagacttggacttgagtaatttcagtatttaaaaatgagaagacttagtatgagcctccaagggagattgattaggaaggggaaaagtagaggaaaaccaggagagcatgaaattatagaagccaagaaaagtcttgtgaaaaggaagatgcagccaatagtgttgaaagtttagggccagaaggctgagaggaaaaaaaaatgaccttggagttagtagcatggcggccattggtgacttttgtaagagcttctttagtggactaatgaggttggaggagaaattagaggttgataactgaagcagacatgaggaaaaggagaaagtaggacagaccaccttttcaagaatgttgactattaaaaggagaagaagaaaaacgtgggagctggagggattgatgggattaaggacaaagattttatatatatataaattataaaaaatatatatttgtatgtaattataaaaatatataattatcaaaattatatagatatataaaaccttcacatacacatatatacacatataaacaaatacacacatatatacatatatgcacataaatatacacacatatcgtatattatgtaatttatatttatataatatatataatgttatatttatataatatacatttttaatatcagaagcttgagcctatttgaatctcaatacaatgtctataatttggaggggaattatacaaatgtaacatgttagtgcgaaaagttttataagggatggtagaaaagcaggaaggttggggtccaaactgcaggcagtgacacagattttagaaggactaacaccttctctagtgtgacagagaataaaggaacccagattgcattaggactcagagtcaggcatcttactgtgttctatcttctctttttctgagtgatacaattcatttttacaagaaagtattgtgggggtaggtgcagtggactttgtgctctcaaagcagcagtgaagaaacaaggacaccaactctgccttctgctgcaggcaggtttgtgaggtatgagagaggaaacagctaccacttgagcagattgtgggagaagcagcgttttgaggtttcagctaaggaaaggggggcactcagaaaatatatggaaaatgtagaggagtttgatattcctgagagcacaatgcgaggtttgggtggatcatgatgactgagaaaaagtttgttgattttggcgagaagaagatcattttcaacctaagattaagcagtttcagaaatagtttagcagaatgatggaggttcccacaaaggattatgaagtgaaaagcagatacttcgttcaaggaatttggctgtaagtgaaaggaggaagagagaattcaagtctttttttttttttttggttttgttttttttttaataatccaactaattacctatgagatttcatttccattttgtttcttaacatgaactctagagtcaggttgactttcttccataatgctttctaaaatcctttcttctttgttgtcatgctttaactcctgcctaggatgccctaaatttttttttcttcctttgtaaacacaacttttctggtaagacccattaacatctacctctcaatattatctgttatatatattttttccccattagataattcatttttgttataaaactattggaaaaatatgtgaaatttagccgggtgcagtgctgcacagctgtaatcccagcactttgggactccaaggtgggttgaatgcttgagcccaggagttcaagacaagcctgggcaacatagcgagacctcgtctcaaaaaaaaactatatatatatgaaattataaattaaaaataaaataacccacattaaaccttccttcgtatatattatactatgtatattattaatactaacacttcaaaaatttacatgataaagtctttttgattccactaaatatttataacaaaatgttaaagactatctaatagtccatggtatttggttttccctattataaataagacactatcttttacataattgcttgtgtacatagttaatggcacccttaaggcagaaattttttaactagatgactaaatcagaagataagtatttttttaaggctctggatatatagagatgaattattttctagaaagtatctaatgaattatccttctacaagcagcatatgagcatttagcgtacccccctccattgtcagcatagaacattttctaaaaatttaatttccagggtagaaaaatggcttctctctgggttctaagctatgttcatttaattactaattaagttgaattttttaatagctactggttactgggtgttttcttctttgtgttgttatgccatacctttaacccattaaacatatttttaattgaatcacaaaagttttagcgtggttgatctaatcataaaagttctttacatgctaattatattcttgtattatatattgttattttcatcctattggtttcccagtgaaccatgtgcatctgtcataagctttaccaaattctctattctcagaagtcctgcagcactctatagtgtcaatctaccatcttaatgtttcagtctctattatcttgtgttgttcattgatagttcctttcatattaatatattaccatcagagcgatagtaagtgtcttaagaataagaacagggaatatgtttatcaccattactagatttctaattgacattatgttatatgattctaatttgtttattagtgtattattatatatattcaacaaaatatatagcaaattaactcattgtgtgttaatgaccataacattctggaaagatatgtgtatgtttaaagacctagagaatagattagttttctcaatatttttatatatgcagtaaaagttttgaaaaaaagtctttggggtaggttgaaattatttcaaaagttttaggattgtgtataaaacagcattaacatgctcttttgagcatgttacttgaaccatagttgagtgaaaggtggtgtgaaccatgtgataaatgattacttcacgtcaaacaacccaacttttctgagcatgctggctttgcaaggatttatagttccctgccttcatgccggagttacttcagctttccgtgatgcattccaactaatctggaggttaaggcatttcttgatcatggatagatctgcttgcttctcagccctggaattctttataaaattccagaatgcaggctagaaattgacttagggaatccaataaagttgcaagtcttggcggtcatccaagctaaatttatagactggaagaaatatgggctttccattgttctctttttcacctttctgggatttcttttgtgtctatgtgagtgtgtgagtgtaaatttatcattttactgacattggagtgtaaataaccatcaaggagatccagttaaagaattttcactttggatcttctctggtctttccaaactttgacccaaacctgcaccaagagtgaatttcttctccctctgtaggatgttgatgtcataaaataaggagttgttcttgaaaatgaatcatgctagtttaacagctgacatgcatgtttgccagctagctgcacctccccaaatcctgcccttcccccgactcggagccttcttttgggacatgatctgagaaaatgtgatcacatgtgttgtttctcttcattctatgactggcaatgggggaacaaaaacaatctcggaagcgtatgagacttcagttttgtgtgtgtgtgcctgaggcactgttgtgcctggagatccaagcaatccctctcctaccctctccattatatctgaccattgaaaacctgtcttgttttcacagaatgggtttgctgttgtgaggccccctggccatcacgctgaagaatccacagccatgtaagtaccagggactgttgcccatctccaagcaccacggttcctggcggtcacctgccccgtgcatgtttctgaagcctctaattgttagcagatggactgaaaaatcttgcgaggtactcccagaagcagatttatggcttcagagatcatatagcatttaaaaaaatgctctgaacattatttataatggttttcctggatgatttgctttcttatttctctgttcttctctattccgcagggggttctgcttttttaattcagttgcaattaccgccaaatacttgagagaccaactaaatataagcaagatattgattgtagatctggtatgtattcctggccagagctgcattttcagtgattctagataaaggggagtggatttgtatttctctgttaggttgtcttgcttttagcacttgcaaacaactgaagggtgtgttttcctttgaatgtggaaactcattaaactcaggattgcagttctgaaaccataaacattcacgtttcactttcatggtgttaactgcaatttaatgagaagaaggcgcagatcagggcaacttttatgatccttaaatgaattgatacttccacagttaaaataacccaacagaacctgaatttacttttccctacagaatatagactcaatagtcagatgtgctggaaagaatgctgttgctttggtaaccaattggccacttccccctggttagaaatcatgttgcttgttgtgcaacagtggtattattaaaacaagtcggcatgtcactcttactgaaaagatctccaatctcagatgccagtttgggatgattctctgcaggaaccctgagtgactgaaagttagaggcactagattagtcttgtattttaacgtgatgcattcttacacagtaaagttagaatttgtctaacaaatggtttgtttaaaagcagatgacacttggcatattgtccacagtatattcatgaataatgagctggagatctggagatctgccccatacaaaaaggaccaacccaggaaagggcgaaagagaagtgaatggtgatttatgagccccgttttcagtttgcctccagttctcaaggaggtgtaataggttgtctgacaaagcatagacaggaaatgaaccctggcatccaaaccgaacctggtacatctgcacttaattaatttttgcaggtgataaaagatttaaaggcaaaatatgctaaaggtttttttttgaagtgcaagccttaatagtctaaatcttgttcatatctgcactcataattaaatcttattggaagtcacggcctcgccctccagccttcgaatccagttaagcaggcacaccaaagggttgagagagcacaaacaaagccatgtgaagaaatgcttagttaagtgaaaacgaagataaaagaaatggaagaacgatacccatttgttgtgcttcgttgcaatgggtatttttcacacactatattgaagcattcctgcaagcactttggagagaagagtattgaaacctaactatccatgtattttccatacacgcctgagtctcaatgtcaggcatagctcaccgttaaagaaatgtgttgaaggcctagatatactacagcagcaagatgttacaattttacaaaaatcaagacatcagtacccattttctcatttatatgcaaaatgacagctaaagtaattaataattgctgttctgcataatttgtaagatattaaaactttaaaaatagtatgctcctctttctgtaagttctatgccagggagataagccagaaacttaagaaaagcagataaagagcaaagattgtagggaaagaatttttctaagctttctcaatttgtcaaaattatgtaagaaggtgattggtcaacagtttgtcctatccttagggatcttttagtgtttactttctaaagaatcttctctgctaccattttaaggttctaggaggatagtcaaaaactgttaggagtcccctttgaaaacacatttgtgatatctagactcaaaagtagtgaattgtacaagagacttgaaagctaaaatgcctcccttgtgataaatggatactttgtatttcagaggatgtatatgtaaagttttgtttttgtacagtaatacagtataggaataaaagactgctggaaaaatctgatacgatttataaaataagttacttggtagctccaaggagtttcctgtaagcttcctggcctttgattatgtatttgctccattatccaatcagaaaggatactgatttcccaacaggctgtagtagacgagaagtttttgtttcaaattatctaaatatatggagttctgtccaaagggttgcctctgagatcaccaccagcccacatattcttactttcaagtcttccaaattctgcagctgcagggctactttgaggaaattcctgtttcttccagctgctgagaaggaagttttaaggtgccacgtggccttgagacatccgttctccctggctgacaggtctattctgcaagttagcaatgaaaaagccaatagatggcttttccgtagccaaaaaaaaaacaacaaaaagttattcctgcaaatccaaagtcattaatgttagctggggggtgtgaactaactccacaaattacagcgccaatagatggcaaaggtactcctttgtccagcagtttcagcatttttatatgtttagtaaatgcagagctagagttctaatttgcctactactttgggtcacagccaaattcagcagcgttgagtattttaggcaagaatgattctagttgatctgtggagctcatttattccatgttcctttctgaggcagatcccaaacatattcagactagtgtggacagggagcaggtgtacttgcttttcaacttgcaagagactgaccattgtgtttaggggattaacttgtcctacaagtaagactgtatgactcaggtagcttttaggtaatgtgacttttattttgacaatagtactttttaagctgtctttgtaaaaggaaagttaattcaaatgtccttagattttgggaaattgcgttgttgatcaagtacatttagatctttattacaagtccctatactgagtaactaggagtgataacattagctgctagaatatatgatttattcaaggttactcaaagttattttaacataatagtgaaaatatacaggttctaaatccttgtacagcatcaatgtttgcagtatgctttttaaccagtaaaatatttaaacaatttttcagcatttccccacatatcttagatacaaggtctattttgggagttttaatgtttcattttatttcatttctatagtaatttctcacaatcaccaataattttcttatcttagtttattatatatgtgttgccatgaagaaacaagctttagatcatacctgaccaatcagtactttgtatgaatattttacagcaaggaaaacaaacaaaaaaatgatatatatatattttttttttcttgagacggagtttcgctcttgttgcccaggctggagtgcaatggcacgatctcggctcaccgcaacctccacctcccgggttcaagcgattctcctgcctcagcctcccgagtagctgggattacaggcatgcgccaccatacccagctaatttttgtatttttagtagagacggggtttctccatgtaggtcaggctggtctcgaattcccaacctcaggtgatctgcccacctcggcctcccaaagtgctgggattacaggcatgagtcaccatgcccagccttaaaaaaaatgatattcttaaggctatactgtgagttgttcccccaaacaaaagacataattgagtttaacctttatcactaaatatttggtgaatatgaatacagaatcaagaattgccccattagaatggatttatgtattttaataataatgtctgttgaaaatcttattatgctgtgaacaggattttatttcttactcagaaatttatgcactagtaagtacccaacagatttttcaagaacaaataattttatatctgagagaacatatcattttatatttgactgttttaagtaaacatttacagtgtccccagagaaacaaaagtaatcaaagcaatatttttctgctgttcaaattgtggatgcatttatgctcaaaccaaatgtgtcttagaactgattaaaattactattgtataggggaaatacaaatatccccttaatgttgtttttcaaaatattttatttgtccattttctagatatccagtaacaaacacaaaagacattgtggctttaattgtttcacccttgtttacatacaggaaaatagtttttttgtctcctccttcctttccttgggatattcagaaatccaggaattgatataatttgactaagttattttttttcctgatgatgtatgtctttagctgaaacaactttctgggatgatgtgtatgtgccccaacattatgatttcttaattttggatatgtgtaccattcaaaaagggaaaaggattattgtatgtctacaccgtggatggcaagatcaatgcaggttttcagaattcaccaaaagaaggctatgatagtgtctagtgaaggagtactgggctggagattggcatgaagacaggtcatataagtctcctatggagcaataatgactgacaacccacctcacaggtttgccaagaggatcaaacagattatgaatgtaagtttcagttaactgtgtaattgttaagagtttggcctttggaataggaagtagattcaagacccagtcttgcaacttatttcctgcatagtcttagtaactgaaactctctgagcctcagtttacctaataatccataccagatatttatatagtgcctgacttaaaaattgtagaaatcattgttgaaaatagcatgattctatatcttgctaatataaagtaagtatatagttacaagttttaaaacttttaaataacagaaccggaaactatgtatgtttaaagtatagcagtaatattctattgaatacaaatatataaattatccacttttggagtggctcttttttttttggtcagaagatattatgaagcatattaattgaggtgttttttttttacacttgaggtctttcagtgaagacatttaaaataatgctattagttctattgactttttcatttcttatatcaattctggcacgtatctgtatcataaaacagtgagaaaaaagaactgtcaagttttatatcaggctttttttttttttttgagtgggaaagaggactggtgtagggaaaggagaaaagagcaggaagaaggctgtaaagaaagctatgatatgatattaaaattaggcagattgcacaagattgcataaaaccccatgccatctttctgctttggcccaaatgatttaagagctaatgagctcatgctcctgcgtcttcgactcttgtgttaccgttttatcaaaatgaagtatgaagtttttttgcatctggcttctcttttgaagtgattctaactgcggagggattgctaactgaactgaacgcttcaagaaagccaatttattcagctggttgcaaagcctttgaccttaatggtgggacttggcaaatcaatgcatacacgtatgtttagcgttctgtcaagaattgcgaaaatgctctgtaagccatagatccttctgcaaaatactagtttgtagtttagtttaaacattagtcttttttcagaggccaatgaggctagttaattaagcctgaggggttatgaactgttggcagttaataagtcataaaattcctccataaaacaggatgcaagattccatcactgaagcaaagagtacaaagagccggtgtataaatatctaattgtaccaaaggactgggctttctcaatgactgctcatctggagtctccagggcatgctcgctgtggtttcctgatttttagaagccagtttaaaaaatgagtgcattaaagggtaatttgcctgaaagttcaggaagtaaagggggtggtgtggaagcaggctgaaagggagaaagaaaagaggaacgtagtgagaagacagaaaatgagaaagaaagtggtagaaagacagggaactagaaatcagaaaggttgtctccacacaaagttagacatgactgtatttgtcgtctgttttcatttccctgtaggatgttcaccatggaaacggtacccagcaggccttttatgctgaccccagcatcctgtacatttcactccatcgctatgatgaagggaactttttccctggcagtggagccccaaatgaggttcggtttatttctttagagccccacttttatttgtatctttcaggtaattgcattgcatgattacccctaattttcttgtcctttgctggtgttttaaattacacgagattactgaattgtcccatgggaccaagaaccagtgcagaacaagtgcataacccagagcactgtttgtcagggaaggttgggctgatttgatgtgttgtttgatgtttatttcaagagctcccatgtgcttgttttcctctcttcttgctttcttccatttgctctcttctctgcccaccgtggtgtgtctttctcttcccaggttggaacaggccttggagaagggtacaatataaatattgcctggacaggtggccttgatcctcccatgggagatgttgagtaccttgaagcattcaggttggtacttctttctctctgaaagtggcaaattggaaaataaatgtccattgaaataacaccaaatatggaagagaaatgtaaatgtctaattaaggtaaattatcgctcaaagccacataagaatatgtataagaagaaaagatctatcaagacctggttttgattatacaggtatattggccaatggcccattttcccccttccctcccaaataaggaggaaaaaatattttattattaaatagttctctctggaaaattctgcctattttaacatatgatgtggtttttacagtagacattagcatattcattgccctgagaagtccttcattacctatttgattttgttgaacaagcatttctcaaacttcattggactacagaatcccttttttacatagcaccatttagcattcctagttctggggagctcactcattttcatgacattggccaaggcaatctcatttgatggtagggtaaatgacttttgtatagttttcctttcacatgaaaacattaactaattaattggttgcttccattttctctggaacaaaatctacaaaatgtaacattaagtacagtgtattcacatagcattctgcttttgtctaagcaaataactaaatattaatataaataagaaaaagcaaatcaaaggcttctctttgagagaattttaaaaatgagcatttcttctctggaattaagaaaatattagtttgtagtttaaacgttagtctttcttcagaagccagtgagtctagttaattcaacctgaggagcctcccttgcaagatttttggaagaggttttagcctattggtaatgcataatttctcgaattttttatttagttgaaagcaaaacaaccacatgaaaaaaacttacatgtgttcatagttttgaaatttgccatttataagttcccatgaagaaaatcctgttgataccctatatttgaaacttgtggaaataatagggaaattttttaattaatgaagttttggtgggtttcttttgtcctgtgtgtcatgcatacttcgttgtcttatttgaagttcatttctcatgagaaagcaggtccaggaaaaatgatagaaaaatagctatttaaaaaatacatttaaaataaatatgtttggcttggcattcaagatacaaaggaaaattctacccacattctggaatgtgtactttgggaaaaaatatacacaaagatatccacaatgttgtagaaaaaaatggctggaataaaattttctaccgtcaacttgggttgattgtgaagatattttgctttaattaggagcaaaataaaaaattatgttaaaaaacagaagttttaatgttatgaattctctttttcaacatcacaaataccattacatttgcaaatttcacaaacattattaatatcttgtaggaactttaacaggataatagacttcaatattatatcacatatgaatttatttgtctgcctcccaagttaacctggtaacttgcatgatacacattaaattcatgttaaatacacattaaattctcaaccttactatctcatataatcatatccattatctttgatgcagaattcatagattttttaaattatcgtaattccatttggggtactatagctttatataaaaataaatcatgtatgcacagcaatgaaaggcaacttctattttgtgcctttgttttcccatcacaaagtgagcggtggatgagatttttttctaaagaacctctttgaacacaaccattccattacataatgtaaacgcagatattaagtgcacatattgttttgtgatttaaatggtaaatgaatgaagtactcctgaatggggttgacgattctcagaatggcgccttctctttgcctggaaggtggacactttatattagcaaacttttctaagcttcccagtgtatctccattacttgagtttcattagagaagtggcattatctagctaggatgcagaaatgtaaatttctggctttcaatgtccatatttatttaagaaccagatttaattcataagactcctgccattttgaactatggcctgtctgctattcatcatttatgaccagaagtacttgtgaatttgttacggctaggtcaaacaggtaagtcattcatttcaaaaaccatcattgaacacatattatatgctgggcactgtggtaagcacttggaattcagagctgttgttactttcagggatcataatatatgtcatacgtattattctagagaacagaagcgctcagagcagataaaatgattaacttgtcctcaatggtttcaggaaaggtttcatcaagtattgttcaacctgtgcttctaaagatgagtgggaactttcaaggggagaagaggagttggagtcgggggtattcatactgactgggcagagagagtgaactgtgaaatgcatggagccatgaaatgatctttctgtattggctcaaggacatgaggtgggattggtagaaagaaaatgaatcatattttgtaaactcttatgcaggcaaaggatagcccatctatatatgtatatactcctttgtcaatttgggcttagtcagatagactgccaaataatttttaatgtagtattattttctaagcttatccttaatacacttcttgtttcctagtattgaaccagaagatctttctggcatctgtgtgtgggtgcaggaaatggaggtgggggaaagagtaaatggtgccttttcttttctcttagtttttaattgtttctggactcttacaagtatcttttgaaggaaaatctctctccctgtgaagctacatttatagtgggatgtaagatcgctgcttattttactagccaaaatttgtcacatatattgccttcatggtttctattatgtgctttttctatagcaaaaaaatcatagacaaaccaaagatttcacatttactgtaagctttaaatagaatttaaaaaatataatagaataactaaattatttcaaatgactagttatttcttccaagcagttatcattcatctctgaaataattgaagggtatacttaagattcttcacgagaattcttaaaatattcagtatcaaatatcttttatgttcaactaaaatatatttccgaggttaccattgtataaaataattatgactatttttattggggtcttacatgccaggtcctagattagaaactttatagacattatggctaattcttaagtgctttatataagtcacggaactactaattggaagggcagtaatttgaacttagtttgtgactctacaatctatgctccttttctcacaccacattgctactctcttctgtttatgacttaaaatactcaggagtaataaagcacagtgactttttaccaaagtgtaagaccttcatgcccgcatagcctcccaacctaaggcacaaatgcctagtgaacaacatggcagagaagagctattcaataatatttggttgaatgagtcaatgaatgaatgaatgaatgaatcagagaagaaagagggaataatgttgtcaatgggagcattgtcaagctcaggtattaagcgaacctagcaaaagtctgagggaactaccttggcttcttaaaaactatgctctacaaagaactctgaacatctattcattttgttataagaatgtcagacttgtctttattgaacaaatcttttgctgaatgcctgctaaggaatctctgtttcaatcatttcaaaaggatgttccaatggttttatactctctacagtccattgatgaggattgggcacattattttttctaaagactaattcttttaagagtactgcaaatgttaaagtgattatttatgtcagaccatttaagtggtttgtttatagtgggcaagagacaattatgaatctcatgcttctgtttaaatctgagaaaaatatcttcaaatgtttaaaaaataagtagcaatttccaacgaataagattttatttagtagtccttgaaattatgcctgttttattaaataaataaacaaatgagtgaatggaggacaattcctttgtagccccttttaatttcaagaaaagaaatataagccccttcaatttagcaggtcttaatgaaataattaaagtgacccatctggcatatactgaggactagctaaagaaaggtcatagagctcttgatctgggttctttagatgcaaacaagttctaattttaaatatcatcttttcatgtcagtatgttgtagtatgtagctaccttaattaatatttgttgttgatgcatattttcaatagacagtgaatctgtacatatcagctcttcagggaagttcatctcaggggaaaactctgacccagaaggactctcttgcactgaggttgtcagtatgccaactgaaaaggggactttgagagagttgtctagtagaggtagtgcacatttagtcaaaattttgggggttattattgaaaactacctatttttattttattgacttatgtaggtagtatctgtatttaatcgaaatgctatgtgcttctaaatttaggcattactaaaatattttggacatatcattaactggaatttttagaagcttaatgtttttgctatatagtcaaagccattgaaccatttgagcacatacaagcagcccagtgtctatctctttctcctgtcttgagttcatatctgtttactttaatgacataagcaaaattaaagtccattaatgcaaaattgtgattggaaatctgtccagatatcctgtctattcttagttcacagtcaaagtggcaattctgttcctgatgctgagtctttaatataagaatcatggcttccggggattcctcccctgcttgtgacaaaaatgtagaaagggcatttaactcaagtgcagaatgaaataaaaccttttattgtcatatccacactgcaagtgctccttggacaagtcaataatggtcagcctagagatttcttagaatggttgggtttaccttggaactatagtagataatttggggcagggcacataaataagttaaatatatttttctctcattcttattttataaaatatatcatcattattctggctaattcttagaagattaacttctaaatattcttgttatatgtataaactgaaaaagaggtttctaaattctatttaagagataaaatgggaccacaagtaaatatttgcattcactcttttggtaatgacaattaagtaaatactgtttggattttttttgttcttgttcttatttttaatattttaatataatttcatgataagtgaatgtagaataataccattgtaaaaacaacaatataataataataacacagtaatatagagtattcgttgaggctttaatttttgctagttgttcatttttttaaaaagcttttcaagtccttgagttaggtgcttttgttttccacaggcagttaccacgcttcttgagcttcggtaggtttcctgatgtcacacagctggtatatggtgatcagggcttctgaggcagcaagtgtgattttggagacagtactttgttggtcccaaaccatacaggaactgtagtccctgtgtcaagagtatgggataacaaaacaatcatatagcgaaaaattctttgcaatgcattttagtctatttaactttggcttggacatctaaactggtaagtgccccaaaattgaaaatttagactttcactacccttgatatctccaagccacttctccttgtgtcttctcctcatctgacatagtaagagagcctatcaaattaaacccttggttctttttttccttttaataaccgatctaattacaacggggatataaatgttttcatctttgttaaaagaaatattcttcttatgtatgcatttagattttgtggaaaggatatgtaatagaacttgaaaataccaaattaaattttaatagaatatatagtgaaaaatgaacatttagatttaactttgaaataaagcatgatttcgttgtcatctaaaagtcatgcttaacaatgtcaaatgatttgggatcttaatttgtcaatgagagctgtggttgatgcttcccagtcttgcaatggattctcaattgttagtgacaagtaaatatattaagctcatgatatcatgtattttcccaaggatgttgaagacagtttgagaaagagggtggagtttcttgaaacaatttgccaatatgaaatactgtacatatcaaattggccctactaccatctttcccagaccatttatcatacctcacaaatccagcccacattttctctttctgaaagacttgactaataaagaagatgtgggcttcaatctgaacttgtcaatcaatcttagtaacaaagcagtaatgattttcatctattaatgatttatttcaataaaaagcaatacatatgaatttattgctagtgtgaaccacaattattcactgtccagattccattctctattttccgtatgttgagatgtttcaaaaagttttatcaaagcgggtcacaagaaaaaaaatccataggaataaatttgagaaagctgtcagctctatctgcttttcagcttcaaaaataaatatagtttaaggacattttttctctcatctgttcaacatattgtaccaattttcatcaaaaaattacaatttctaggtgtgtgtctctagatacccttagaatttctgctctttgaccctgagagtaaattgatcttatgcacacctgtcttcctagggaaacttgcaaacttgatttttgagccaagcatcaaagagatatgatattattagacagtatagagctcaggtaaaaagtccaggaagtatcttgaagtacttgaagttttgaaagggaagtgatatctgcagtgaagagctatttaaagtagatcaaatgctacaacttacttcttcttattgtttttaaaaggtcggatcagctataaaaattttaagacaatattttttctctgccttaaaatggttctaaagccaaaaattttctggaatctgtatagcaattaaacaattttccaaataatggggactaattaaaaggatatctatgtttaattcttttctctagaagttctttctaagaaaaaggtaatttgtatgcctagaagtgatttgtttttgttttgcagatgaaacactgaattatataacccttgcctgcacaaaatcctctcaatgtatgtgtaatactttgaaatatcaggaaatgaaatctttttatgaaatattattgtggagcattttaaggccagaaatagcagacattttggactgtcaaggagcttacgtcaattcattgacttaaataacctaatctagtaatagtggaattgtcgtgtagttaatgctgatatgagatggccagaatggaaggtaaacataattaataaattatagagtcacacttttcttcatagttctagtgaatattttagaatttgcttcatttactggtaagataaagctctcgctcaattaaaagttacttatcctttacttcattgaacagctgtttttcaaccaaatttcaatgtctttgggtcatagagtgaatttttttttttgaaactgagcaattaccctctttttctatgattttacatctaaagtttactactactagacttattgagatgacaaataatgtggaaaaaagagattgaatgtttgttttaatatactgtaaatataaatttgtagtcccttttttgagagctagataaatataatggcttactagtattaaaatttacatattgactttcccacgtggaggaatcatactcgtgaaaactttgctcaactgaaggtctgttcagatattacatctgagatgcagagctgaagttcacactgttttctgatgggcaggactttcagagagtagttcaagtctttgcatgacatcaaacatgtggatgatagactcaattttccatatttcatcccaatgatttggtgtcatatagatggaacttataaatcaacatctgttttcgtttaggcagaaatttaaacttttctggcactattctagaagggtaatggcttgttcttgtatccattaggaatctgcccatctttcttgtgggcactgcagtactgggtattggttatctaaacatctattccaaagagcagcactactgtcgtaaagccatagggagggtggtgagcttatgaacgacaaagcttctagtgggaaagacttaccaaaatggcatttgtcccattatcactcatatctcaacttcaaagtggagagaagaggacaaaatagattattcagtccccatttaagcacagcagaattgtaaatctgcatctcaatttgaagatatttttacatcccaaaacacttgtatgaaaggccatcaagaaaataacatgtacacattatctttcccattaaagaaacatattgttgcacttgaaaataaaatgttggctcgcctaggatgtatatttttagctggttcttaactcttttaaaattaaagtgatgctggagttaccgaaatggactgaatttcagaaacaaaagagcatttttactggaacagaagccaaaagcaaataaatgaagaagagctcattcaaacccaagagcaagaatagaagaggcacagatttataatttgaaagttttattacccaaagagatctgggtttcttatccttctgtacttttagtttcagaaagtctcccagagctgcctcattaggcctctgattttgctttatatacccatgttgcctcccctgtagaagtttctgacactgtagattcttttatgtttcagtacttctaaaatgaaaacagcactgtagaaatgattcagtgatggcttcctttccggtaaatatgacaccgtcgtagtaggtgaaacggacaggaacagagataataaaatctgacgtgtcatattttactgactcagtttcaatgaactgattacattctaaatcattagaagaactgaagtctgccaaaagtttgttaatatatactatttagtttggttttttgagggtgtgacaattaatacaaatcaaatgattgtatgtagaataaaaaaattaatatgaaggaaggctcactcacctgttaatttactagtctcaatttttttaattaacaaattaatattattttgtctctcttctaagatacacacagaaggggagagagagggtgagtctggcacaggtctctaaacatactttagaagagaaagaaatcctcccattgtcagagctgagcataaaatctgcaccaagtttgaagggcttatgtggcccaatttaaaattttgttgttttataataactttggagaattgtattgttccttataaaatacccacatgttctcctttggaatagctccagagtgtaactgaaccacgaggttgcctcctggtgctttatgtattgtttaattgtttgctttggtggatgtttttattaaaagcttattatttaggataagaccaaagtgtcattttaagaacaacagaagcagagctgtttggtctcatagttctttttcataggtgtgttagtgaatactagatacagctaatgaaccagctgaaaattgttcttgtaatacttcacaaagagcaacaacgacaacaagcaaaacccttgatttttattttccttcaataaaacatgaccagattggctagaagagctaggagtctccatggctgtgtccaggcctcgaaggaagagaggtatctgtgggtgcgcatctgctctgtctgtgttttgttccaggaggagtttgcttggagtcacgtgcactgtggtacacaaggccatagcaaacctcaggagctgggaggcagtgaagcccctgtgtcacaagggccgtagtgggcttcctggggtgtgtaccaagcctacgaaggctttagtggatctcagaactacaaagttcttcatgtcctccctctgcccacaatttgattgcaagataattatcttagctgagatcattctgaatataaattaggtctgggaaaagtttttaattcaatgattttaattctcaatgttcttctcctccctgaatattttcttttctgaagcagtatcaccatatcactcaccgactcctcagaagttggctctggaaagaattcataatgttccctagcagttccttgccacaaagagcaagcaagagtttgattagtccatgacttcccaagctagtctttgtgactgggacccaccctcagacaaaaaacttaaaggcaatataccttgagataatttctaggacttacatgacctcattaaattccgactctagatcttatgtagacatttgaggaaatatggttattgacaaaatgtaagcccattatagactatatcacttcaaaaggagaaaggccattagaacataattacatcagaaacagtatacacgtttggctggtttataaactgtcactttcagaagtacgaagacttataaaagtttccaaaggttccattataaccctatttccaacagtattctctgacaaactaaataaattactgcatgtattggacctttgaggcttggggcaaagaatggaaaaattatttacaaaagcttgaaaatatttaatcactagaggcaggggggcaacggtgttttaattagcaggtcctcgggccattggctgactagaggctttctcaaacaaccacacaaatgcactgaatagctgtttgccagccttagggtcaggcctgagatgaaacagataagataattggctctaatgaaatccagaaggccttggctttcttgtttgagcttggatttgaaaagtgcgtgtggaagtgaggcttaattcaaaccagaactgagctaggcccgtttctcagtgactttgatattgtttgaagttctaaaagtgttcgccacaccactagcctgctgggctgggcctccctggtacccttaattactaagctttattgctgactttactacacaggaaaggggccattatatgttccatcaacatcagctcttctcagattggaggaaagggcagggttaaaggccactgtaggaaggcaaaaacttcactttgaggtagtcagatcatttaccagtgttgaatttcaccgttacgcacatacattccttacaacacagaagccccaatttccattttttaaacaagtgattacttttcaaaacatttttgtttgtgcctttttttctttttcctttcttttttttagagagaacgtttatttttaaggactgaaatgattgcacatgatacactgaaaaaaaagagtacaacacctcccaattaatcatcacaccagaaggtctggttggattctgtaataaggaggattattattaatgcccctttgaagtggaaataagtgaggaaccctcctgtggtgtgagagttgtcctgacaccctgaggaataaagacgcctcaggagactctacaaaattaaatcccagcttctagagtctctcacaaagtggttacacaaaagggctcccaaaccagtttgaagccaagaagcaaaaacgaggaagtctccccctgaggggtcagctgtggtgttactgaggattccatcctccccattctggccgctgctctgcctttggtccaactggtaaaatggattatgcatacatatgaattagtaactattcaacacttacccctctcagatgaggagatctggttatgctatgaaagccaagggacacggagtccagtcctatttcctgccctatttatcacctctggttaggaaagtcatgagcgattctatcagacttaactcgttatgaaagaacaagttgagtatattttgcattatttaagtaaacttgacattaatatgatccaatttcatccatgatcctgctaaccatttatccaatactcttttctgggtattgttatgcacaggtggactgggtcctaggtctccactaggatgatgtgtgtctgggcctaaggaaccatattaggaacccagggagaccagtattaggaagacaaaactgagcttctgcttcctaacctttcctaagcggaattaaggaggccctatacaaatttttgccagtgatgaacatgatatcagctctgatcagaagaagaatctgatcatactcagctcgttttaagtatgtatgtttttcattaggcactgttattgtctaaatgtttgtgttcccccaaaacatgtatgttgaacccctaaccctcaatgtgatggtgtttggagctggggcctgtgggtggcaattagggttagatggaatcttgagggtaggtgcccttatgagcagtgacaccagagagcttgcttccttgctctctctccatgcacacacaccgaggcaaggctatgggtgcacgcagcgagatagggctggttgtaatccggtgagagcgctctcatcagggcccaaccatcctggcacactgacctcaaacttctagccaccagaactgtgagaaactaagtttatgttgtttaaactactcacctggtggtatttcttttttaatggcaacctgagcagaataagacagacactataaagatctttaatatgagaaaccaagcaacccactaatggacttaaattaccaaaaaaagtatcttccaaaccatattttgctaaacactggatacaagaaatgttaataagtgtttctcaacaataaagaatatcctatagggaaaaatctctaattgaagacatataatatgtaaattcatgttaacaactgcaggaattccagtagtaattttacattatttaatgcattcttcctcaaattatttgaacatgaaactcccagctccccacatctcttcacccaacatctgtaagtatcatgaaaactaacattctatagaacacagtttgaaaaattctgatagatataagtagcaaacttagtgggcattttaaacagtccatcgctaattcagtaaacatgataaaagtaagtaaaacacatctgcccctaagattctcacagtcactttagtaaaataagtacattatattacatgtcattataatattgtgttatcacataaactgagcataccacaatccatattctacggactgtcttctcctttttccactgattacatgtgagtggttcttagataacacaccctaaagacaaagaaagaaaggaagagaaacagaattaacaagagagggaaaagagtgtcagtttcctttgctatgactattaaatgactcagtgaattttcttagggtaaagttactgccattcaaaattatagtaaattggtaatattttacagtcatatattttttgtttcagctgagtatattttgtttcagcttaagtatgggcacatatctcccacacttttttagatcagatatgacacataaaaaagatggctttggttttttaaaaactcttacaattagcaactaatggcagtgtgaacatataattggttttataggtaaatcaatttgtcgacttacaaacttttaagacttcatttgttattcataactacattttgctgaggaaaaaaatacttgtttatgtcaaaaaggggagaatttccattaagttcatactctccatgatgagaaagcacaccccgaaataagacattaaatgttagaatgtattacttttcctggttagaaaagaacttggctttgggagtggaccctatgcgtatcatggtgtggcaatgccattttgtttccaaagataacatttgtagatgtacagatgtcctgaactttattaaaccacagctgtggttatcacatatttattcaaaagatattacagctatcaaagcagtatgtcagcaaagtccttagtagtttgcttaaattgccctttcattttactgtatctgtaagtattcaaccaatgtctttaaaagcctgagtaaaaaaaaaaaaaaaaaaagaaaacacaaataagcaaacacgaagcattatttacatggaagcattcagaaatcatgaatagcattatcacaaatgagttatgacattttataggttcacaaaaacgagagagagaaaaaatactttccttgaatagcacaaaagcatgcagctttctttagcacattgattcttattccaacgatctgaatgtggagtgtgcttggccaatgatgatgtggctgaaatatgcaatatttatgaggcacagacccttgtacttcttgttcgaggagaggcagaagtgtgacaatgtccttccaaaaatgaaagcgtaggggaggattcttccctggaataaacctacagaatgctttcttctgtggaccattagtagattttttcctgagccaaacataatgaagaagtattttttatctcaaagctcaaaacctctgcatctattgtcatattgtatttgtcctcaaatatccttatgaattggacatgatacttctgaaaatcacacaggaaattattcacatgtctagaatagaggcttccctcgccattaattcaaaatgggaaaccgagtgcattcctgtcttgcttcattaaggctgctgtcacaacatatcatggactggatggcccataaacaacagaaatgtattttgtacacttctggaggctgagaagcccaagattcaggcgtcagcagaatcaatgtctgttgagggctgctttctggttcatagatggcaccttctagctaaatcctcacatggtggaagggtgaggcaactctgtaggttttctttcacaagggcactaatcccgttcttgagggctctgctcccatggtctaatcaccttccaaaggccccacctcctaatatccgtctgggttaggattttgacatgtgaatttataggggacacatttaggccatagcaattgccaagacaaacatgagtggattttgaagagtagtgagaattaaccaattcttgtggttgcagtgcttccctttgcctagcagcagcaggtctctgctctcaccagatttccatgaggagcagctgagctgcagtatctattcgctctactttcttgggtgctgatacggtttggctctgagtccccacctgaatctcatctcgaattgtaatccccatgtgtcgagggagggacctggtgggaggtgattggatcatgggggcgatttccccacgctgttctcattatagtgcttgagctctcacgagatctaatggtttaaaagtgtttggcagctcctcctttgctctctgtgtctcctgctgccgtgtatgaagtgccttgcttctccttcgcgttccgccatgattgtaagtttcctgaggcctccccagcaatgtggaagtgtgagtcaattaaacctcttttctttataaattacccagtctcgggtagttctgtatagcagtgacaaaacggactgatacaggtgctctacgttcgtattacctcttagtaattatcgtcttttatttgccttcccatgaaactgcgtttttaattttcaaagagtggacttgaaaggttaagaacacatttgtacgatgtgcttttcctgaaatgttagttagtatagtgatttatattaaatcatccaatctactttttaaaattccattaacaccaaatgtctaattattcctgtcttgtaaactgcatttatgaaagcaaaccattttccgtttttctttcttttacggaaacatccaatcaaagttggtttcctgaatatttagattcattagactttcttcatttgtaaaactataggagcagctactcagcaatgccttcttcgctccttgcaggcaggtaggtgcctgtgtgggaaataccttaggaaccaaggattgttggaaacttgtctttagagacagtccttctaacaaggctgctgaggggtgcagaaatggtacacctctgttctggctgcttgatcagtgtctcaatttagcctttggtgctttgaggtatctttcatgtgcgtaaagctgccttacaagtagctgactttctcccatgtgcttaactgagctagttgctgtggagaaaaatgcagaagcatgtaacagtcggggctgggagtgagaatcactacaagacaattagagaatgagcaaagcctgatatattgaccatgcactaggagaacaaagataagggaaaggactcttaatccaagtcttgtgagtagcccagtgtcctcctggcatgtccaggaacttgaggacgattagagtcaggcgaggaggcggaggattatagacatactatcattcctattctgaggccaggcctgatttgtgggtgttaatcttgtacaattacagaaactctctttcaaagaaataatacaaaggcaaaaattcaaaaataggtacagggacttggaaaaggtccatgtgagtgagggactttgaaaattaagattcattagctttatggtaaatatgccttggtacatatagtcctaacaccttgtattgccattaattggagtgaaacaatggacactgcaccatggaatgagccttaagtaaaattaatggctatgctgggtagtgaagagaaacagacaaattctgcaaaggtgggggatttcttagagaaactgcactgacagggaatgatcttgacataaaaattcaactgggatacatttttcatctgagggcacatgctgaggagatcaaagtaaaggagctttttttttttccctctctttctttccagtgtatgttaaggtagatttttaaaaatatatataagaagaaaggatccatcgaggaaaaataatgaagtcaatccaaaccaaacaaatcatagtaggggtgcggggagcaaccagtatttacatggggagcgcacactcttcttttgggtttggtgtgaagggtcttcacctgtttgtgaaagtgttcagaatgtggactgaggctagtccctgagtcggcctggctccgactttccaccgaaggggtagagttgctttaatgtggttcacgtgtatggtgtttcatcttaagcagagtgatttatgttaatgaaatgaaacagaaaaaataccctttacatcctagtctccttaaaaatattaaataaatatgtccaggacttttgcatgattatatttattaaaacaaatggaagacttcaatccataccagaataaatttgtaggtgaccctggggagggttaaatccattaggaaaaaaaaatgagtttgggggtttcttaccaattctgaaaagaaagtttttaaagccattaagttcagcaatataatagatggttacaaaatgagcatcaattgtaagataatttgttctgtaatttagaatattgttttgtttggcttctgaaaatttaatccccaaatcatggttcacaaaatatattcagaacatctttataaattgaatactagacttcttactgtgttaatgagaattaagcatgtgccatctttaaagtacctatttgaaactgttataatttaagagttcagcttttaattgtttgtcataactgttctactaatacagaactagtcattttaatagaacttaagggcagcagaatcttttcaactcttagatttcattagcgtgcatttacctatacctttacaacatgattatataattaaatttcaaggaaattaaattagccaaatgaatacattttaaaaaattagttgattggcatttttctcagaagttacctatctgatgacaaacattagacataagaataattcacatgtctggttatcttaagtgttgattgaattgtaatttatccagctgactgtaatatttagtaaaagtggaattagccaaggaaaatgtagttcacttgcttggaacatagtgacatactcttaattcctctagtataaataaatagacatctatttttgaaatactttttaaaaacaaggttaagaaagtaatacaataaaacttctattttaaaaatctttctgttcattgctatgtgggaagacttcaccagaaatgtaccagaaattttccttaatgtgatgtacctgtgggtatttggcaagcatgtcacttggcagatagttgctaatatggagcacaagaaaatgaaatgtaagggtacttttaaaacacattcctgagaaatgcttagctctatctgccaggtgatatatcatttactgtcatatattggcagctgaaaaactgaattttatttttgctgtcttggctacagatattatgtaaattatattcttatggggttcaaggtagtgatcatgattgtaatgacgttgataatggtcatttaatcaatacagagtctgtcggtgtatcttactgcaaagaaaaataagtttatggtaattcaggtgtatttccaattaaacagaaaggagaatcagaagaagagtcaataggagggtagagaaaatatagaaatggctgtaagagaaagaaacaaagagaaatagaggacaaagacactactctagtctagtatgggatgctaaaagaaaaaaatactgaatagagaaaagtataaaaagtctaatagaagagtaaataatcaaattggggtaattttttaaatgggtgggagtaaggagccactacagcaagaaaaaaaacaaaaatagtaaatgccattattttcaataaatgctaaaatttatgaaaatgggattttatcacggtcattgacgttatagcattaatggtctatatattttgacagcgtacttaaacccccaaggtaggcaacatggtgagtgcctgcgtaaattggtcagggcttgggttgttattgttaaatgttttgatgatcacctaggtttaaaataatgctttcataatataatgggaaaatggatgcaattggctgctaagtgattggcgtcagatttcagaggtagtatgaattagctagaaggcgtcccttaatctcactgcactctactctccagaagccgtctctgaaaccagagcagtaataggacatgtctctatcacacaaccaatgaatgtcacaggctggttttaagacttccagctcaggacttgctttacactaaattacgtgcagcagacattttccaaatatacaccccctaaagatctatcgtgacctagcgtagtgttattacagagaagggagttggaaagattgactgattgattagtggccattctctgtaaacctgacataaatgcacatttcctctatttacagaaaatagttgcaattgttattttattattttttatcctggcccatggtcagtagctctatccacctcatttctatcattgctagagtcttttgctttaagtcttcatcatgagcatgcctttcctgcttgtcctttgagaacactgttcacagttcatggcactgactgtgtttaggcatggtggccgtgctgaacttgagcactccttttcaactgcctgtggtttcaccacttcttaatatgttaaatttatttaggctgtggttgttagccccttatttttctgcttgccgttctgtcagttaatgtttcccttgcataggtcagaaggtggagaggggaagaaaagagggagaagggattcttagccaaatccaggtcaagctgtctaaccaaacggtagctgattctattaccaacttggtctctgtttcccagcctttatggtaccaagagacttttgcagtaatggaaacattccttcttttacttctgtgcaccgtcatcttccttgacttcatgcagagaaacacaaggagcaaaataattgtaagcattacagccttttactctaatgaccttgactctgcactgggatagatgtctaattacaaagaattcagcacagaccacattagcgaggctggtgtttgctttgcacacagacccaacatctgttggatctttggagcagagatttagtcatgggagatgaatcctgctgttctcttaaaatgcatgctttgaaaagaatgctcttataatattttggtcctgagagatacggcatcataggttcacgctaaggctcacagcccctaagaaattatgagtaactgattagatttttataactgcagatcaagtccctaaaataagaatctattcttatcttagaaactatgagtattatttagaaaccatgagtaactgattagattttttaactgcaaatcaaacccctaaagtaagaatctatccctaaaaatcaaaatctattttgctattttggtcactataatgaacagagggagttgaacacatggttatctctccaccactcatggctgctgcatagaaattgcccctaaaggatgttaatattattgattttataaactatgtaggtagaacctctatttttcttacactgaacttggagtgggcaaaaagaagcctacaaatgcattataaacattgcaaatgtacattatgaatgtatattacaaatacattacaaatgtgcaaatgcattagtagcttcccttaatttcagtttatgagtttgtgatataaatggcagggaagaaaaacatttgtgtgcatttatctttggaaatagcacaacttatttaatcaattgctttctattaacatttttttggtgaatgtgaacaatacaatcaaatgtaacatcgatttgggtctctgtgattttccctgtcacctcaattcattcccgccttttctccacattactgtctttccctgaagcataggtagtattcatttgccacctgaatgatcaccgctgggtcactgttgtgaaaccataaagtgccttgaaggaaatcacagtgcagttattcagtctgttcatatattcttctcctacctctcagctttatctttttctttctccgatttcttcagtccagctttcaactcttcactcccatatatgtcatgtttcaacttcatttaaatttttatctttttctctatgtgtcatagttttggtaattttatgactaaaacatgcttttccttttgtctggaagtatttattttctttcactgaataattgcttctctttttttatttttttttaactgtgttgcagcacataaaaagtttatgaaatcaattcagagggtcaagattggcattttaatagaatgtaatagaagataaaagagtgtcacatattgtttcacaaaatatgttttagttgtgtgtgtgtgtgtgtgtgtgtgtgtgtatgtatgtatgtactagttcctggagtgaaatgtacttttttgtttgttgtggtttgagaattttgaaagccactgtttaaacagccaattaaaatatcattttatctataaagttttgtctctgttctccagaataattaataagttcattttctatgtccacatttatagctgtagtttctagagtaattattgttttgaactgggagaaaaaaatcaatatctgtattaatgaacgcatccctttgaactggaagaaatttgtttacagagttgcttcatccatgccatctgaacttgttaagtataggaatcataggaatctgtcctgacattatgaaatctagcacttggcaccttggcattgagattcactgtagatgttcaatgaatgttccaggaataaattaataaatgaaaaaatctatgaaaagacaaacttgacaaagttgggttcagctattttgttttcaaatgggaatgtgacattcccattttcaatgggaatttgaaaatatttatctaatatctgctacttgaaaagatttttaaaaacaagctaattttttaaatatgagggtacagtactgatgtactaataactgtggagtattatttggtctaaaacaaatacacatgcacaaaagaaaattagttttcaaatgtttatccattgaaatcttggattctgccggctgtttagtggttcatttagcatgtcacagtatcatgacagcagtgtcgaaataccaccataacattcccttttcaaaaaatgaaaataatcagtgagaaagctagctatctgtgcatatggatccacatggttgcatatttggaaaaatggataatcaatgtattactcaattcttaggctgctgtgaagaaataccctagactgggtagtttataaaggaaagaggtttaattgactcacgtggctgcatgttctgcatggctaggcaagcctcaggaaacttacaatcatggtgggaggcacctcttcacgaggcagcaggagagagaatgagtgcccagcaaagggggaagccccttataaaaccgtcagctctcatgagaactcaatatcacaggaacaggataggggaaatcacccccatgattcaattatctccacctagtccctcccatgacatgtggggattatgggaactacaattcaatatgagatttgggtggggacaccaaagtaaccaaatcagcttatgttaacatttcctatctagaatgtttgaatgtactttactcagaaattgctttcatgctaatccaagtgacaacccatagtctaactagtcagagtatatttttatcttaaataataaaactactctatcatgtcaccatggaaatttcgtactttgtggagtgaacattgcagttggaattgtacctggaaataagttgctgctgaataaatattgacagcagtgtctcatttttaccatgtcctgatctcctgtgaagtttgagtggcatacctacttcccttctaactcacagaaacactgaagtgattgcttcaatacacatgatatgccttcattgcctcattgaatcagagcacttagaaacactattttttcatccaaaaatgcagttaaaaggcagtgaaattgtcaagcttccgagaacgtgatctttggattcagacagatatgagtttgaatcccaagtcagtcagttatttgctgaaacaacttgactgattatcttaccttcattgagtcttagtcttactgtctataattgggatcaaagtacataatttcaagtatattgtgatcattgcaacattagaaggaatgtataaacttcttaacttcatgcctggcacctagtacattgtcaaaatggttgatgattttgttgttgttgctagaagaaaagagtttccttgcctccaacataaactatttttttagttttggaattaatcctactctcctgttattttagctatgaatacatgtaacactcctagatcttgggctgatctcctgattgagaagacagcctgactctgcacttcagaactctattcaggccccaagttctttctttcttctcagtctctttctggctatgcctcagggaacaagtaaaatgtgttactaaatgagcttgccttttgtcttgttcatctcacattgctacgcaattaaaaaaaaaaaaaacttgatgatgctgccttcctcagaaaggccacatcaaaaggtagagttaaccaaaaataatacacactttttccaaagacacaaacagttccttgaaaaggatgtcatgctgtaatttgttttgtgaattctataaaccacagaacatttacttacagtaatgtttgacctttctttttccttatttttatgcctacaaagcttctttttctctcctcttgagaagaaatataaaggctaacgctctcatatatatatatatatatatatatatatatatatatatatatatatatgtgagagaatgagagagagagaaatatatatgattttattggaatactgaatttaatttttagccaaagtcctttggctttatgcaataatattttatggaatgcaatcacttgtgcaaagactaaagagaggctcatttgaaactttgcaaaaagaatatgctgctcatagggtaatgggaaatgcaatatgtgtactaagctacacactgcaccccaccgaaaggagagaaatccctatgactgatttgatggtagtataatctctttagggattttttggataaagaaagtaataacaaaaaataggcacataattaagtttccaaagtgcacgtgtcaccagcatcttattgtccctctggaggggaaatttactaatgacttgggtagacatttttcctgctatgtgcccaactgagaaaaaaaaatcagcctttccaaattttctaaataattctctgctatgtaagttttaagaacattttactgtcatttgtgttctattttctattcattatggcaatgttttacaaccaccaggttgctatagaaatgaaaataaacaaagatttggaaagatacatgttgcaggggcttgttctgcctctcttgcctaaaccatgaggattatgttattctttaaatatactttcttccttggttatccagttggtcttaatataaggaaacaaagttaaatactttgttctgacttgtgtcaaatttttctcaatgtcttaaactcttttcctgtcctttaagaataaattgggctaaaagaggataaaattagaaggaaataaaggaaagaaaaaaaggaagacggaagaaaggaaggaaggaaagaggaaggagtaataaggtaggcataagataaaactaaaagttgctatggagctgacctccttgtcagcacccactggaactataaggaagggtgtattttattgagcaatcacaggcaattttgaaggggttcaagaagaatcagtagttctagtgcattatgctggcaaagacccttgcccgctctccacacccttgtagctcagcctcagttctctaggatgtggtcttttgttaattggatagtagcagagcaaagtcgggactactgatcctttccagctctagtccttacaaatatggaaagactgatttagtaatgcttatgaaaccaaatacataacagcccctttatgttactggactcacatttgaaatcataataaaatatttcttgagaaccactgttgcaaacttaaagacacatttttggcatattaaaattcacggtatttctatgcttttatacaataatgactgggaagggacatatataattacattctacatttctcagcaaaagagtgtttacttcagtacaattttaatattaactcttaatgacttctaccaactccaaactaagcatgtttcaacattttgttgtttctttctagactagatttcagtacagagtttaacgaaagcaaaatctgttaattctgttgtcattgttttatatatggtaattagataagaatcagtttatctgttttgataaactagcaatcttaccattttgcccagctccctatgcttgcgtataggattttgcctagggaggtggcatcattctctattcagaggcgttccaaatataataatataaatacactaatactattctcacagacaatgtcccaaagtcaggaagagatactgttgagaaaaatttctctctcaactcttagctcagagacacattgggcaatatctcagaattagtcagaaatgttactggctacgtgacacatcttaggcaaggaaagtccctcattgccttcaaatatcattattttttaaacacatagcatttaaaattagcattggcttcttaagcactaaagcaatataaacttactaaatgtcatatttgaaactctaattaaaagaatacactttctggaccaggtatatatgtgagtgtacacacacacgcatattcctaattatgatatattgcgttacattatgatgtatatgtgctatttgtttgtagcttccttattctcatcaatgattcatttaaaagcacagagtactataattaggattactattttgatgtagtgaaatgatatggactcacaatgtcacatttagagctccaatctctttagaagtgataatttagcccccaaaatatagcttatacaaattttgttcttgcagtgaaatagtttgctctccactctagggtctagcgtcatcaaaggaaagacacactttagaatcgttctgaaaggccaggggcaaatcagtggatatgtaggcaaagattttgatcagcaaggatgctgagcttcaggcaacaacttttcttatcaaatgcaagagaaagagaatgtgaagggggaaaaaagtgtccctttggtgtattagatctggaacatagaaaaatcatagaataatagagccgcatatgactttagagttaatctaaatgaatccccccagtctcatataatagttgaaactaagacaatttactaaggttacccaagtggaggcagtgccaagaacagaaattgaatatcttgagttggaatcaagtgatttttctaaccccctacaattgtacactgaagccagataattcaattttgagatggcacactgtagaaatcattgcagaatttaaccccctttttgaagacttttggagaaacctcacctttccccctctccatctggttcatacagtgttccaatgctcatcagaggaagatggttagagaatgttttcctttatactgacagagttcccatttggataattaatttgtaaaaatacagaaaaaaacctagctagcttagaagcatatctaaatcaatgaataaaaatagggcaagataagaggaaattcattttgagaagaattatgaagacagaaagagaaaagctatgtagattcaggagaatgcaataaacaaaacatggaaaaaatagaagccgtatcatatatatgtcacattttctgaaggtgtgaaaatttttgagcccaattttttccttttctcctcattacagtagtataatttctagattaaaaatgaattaaatgagcatttgcatattcttgtaattatcatccccattctgcttttgtgtctggagagatttggaaccagctggacaagagaggaaaggacgattttctgatgtttgcatttaaagcaaaggctcataaacagtgaagccacagtagaaatgggaatggcctttcactaaaagagggattttacatacatttgtgaaacgtgcagaggctgaggaagagtgaggcaccaagaaaatctgacctccaaacacgaaaaaccagagagggcatcactgggtataacattcaacaactatttattgagtatccaccatgtgctagactttagcttgtccaacccatggcccatgggccacatggggcccaggacggctttgaacgtggcccaggatggctttgaacgtggcccaacacaaattcgtaaactttcttaaaacataatgtttttgtttttggattttattttttagttcatcagctattgttagtgtcagtgtattttatgtgtggcccaaggcaattcttcgtcttctaatgtggcccagggaagccaaaagattgggcacccctgtttggacactcttttaggtccccaaaatacatctgtgaacaaagagacaaacatttcttccctagagaacttgaatttagtgggaagaagcaatgaaaaaataaacattggacataatatataagtaaatcatgtatgactttggaaggtaagtgttatggtgaaaaaaaaccagaagagaagagttaggaatgacagaggtggggtaggcgtgggaagggttgtcaggagaaggtcttactgaaaagataatagacgactaaaggtttgaatgaggcaagggagctaggcctctggggaaaatcattcaggcgaagggaacagccagtgtgaaatctccatggccactgtgagtactgctacaatgagcatgggagtacaaatatctctttgagattctgatttcgattcttttggataaacatccagaagtgggattgctggatcatatggcatttgtattatatgttttttaaggaagcttgcactgttttacatagtaactgcaccattttacattctcaccaacagtgtacaagtgttccaatttcttcatattaaacaacttaagtgtccctggatggatgaatggataaagaaaatgtggtatatagatacaatagaatattattcggccttgcaaatgaagggatcctgccatatgtaacaacatggatgaacccagagacattatgctgagtgaaataaggcagaatcaggacaaatactgcatgatttcacttacatgaggtatctaaaatagtcaaactcatagaagcagacagtgcaatggttgccagggactgggaccaggggaaaatggggagttgctcaaaggatataaagtttcagttatgtaggatgatgaagttctagagatctgaccaggggaaaatggggagttgctcaaaggatataaagtttcagttatgtaggatgatgaagttctagagatctgctgtttaacattgtacctacaggtaacattgtattatacccttaacagttgtttaagggggtggatgtcatgttgaggattcttaccacaattaaaaaaaaaaaaggaaagaaaaaaaactaagaggattgggagtaaacaaatattttatcacccttgaacctcccaaaatgctctacttacagagacagaaattggaatggtggttgccaggggcttggaggaaggggaaatgggaagttattgagttactgtttcacggttacagagtttccctggaaagatgaaaaagttctggagttggaacggtggtgatggttgcacaacagtgagaatatatttaatgctgccaaagttaaatggttaaatacttaaaatggttaaagtagtacattttatttaatgtacattttaccacaataaaacttttagttgttaaaaaaaatccctttgaccgtagtgtgtcaggcatatttgtgaatagagtcctggccaagcttcactgaccagagactcatgggtcattaaaacaaacaaaacaacaacaacaacaaaatttgcttccaccagaagagaaatgatgaggatctgattaaacatgttaagctggccggctgccattttgagaacagagtacaggggtaaagaggtagtatgggcccctctgaggaggccatggctgtgatccaggtgagcagtaaagttggcacaggccagggtgagaacagtggaggtgtaggaacgtggtacatttctggatatattttgaaagtttgacaataggattccttggaagattggctttgggtttgagaaagagacagggagctgccaaagatgaaaaattgaggcaataaaaaagggagtggtaaaagagagaagggggcaatgtgtgtgtgttggtggtgtgaagagttggagggtgaatgctaaggaagaagagcaggacttattcaggtctgggctggtggagctagaggagaacaccaattatacctggtgtgcttagcgctcctagtgctgacgcttttccacaaatgcccatggtaaaccttcatttagtgccccccacaaggaccctacagggcctgtgttgtgtgaggcactgggggctgttctgcagcactagcagccacaacagctgcctggaatctgtatagacagttctttgatgtgctgccttcaccactttgggagcctcttttccttgtacttcatgcacaaacataggtgaatgcatgaaaaaatgtgcagtctataatgtgcatttttgtttttgccagaaaaacctaaaagaaataaaagtttttgtaccatttgaaaaggtataattttataatatgatgctttcatgcaatgacatacaattagactatagagaaaaaaggtaggcttggattttcacctataatttacatttgcatgattataatatgctattataaattatacaggggatcagaatctgctgtctcagaggtgacatataagatcatataactgcctactcaaaacttttgagtttccactcttgttcagaatgaaatccagtgtcctcacagtggcctacgagatgctacatgaactggctttatgccacctttctcatcccatttccaaccatctttcctttcattcactttgtgtgagccacagtgacattcttttgatgccctgaatatgtggaagacccttccactgcagggctatgtccacctcagaacggccttctctaggtacccctgtctcaacgtgcaccacccccgtgactttctgtacaatttgtttttcaccttagtccttattacatgcttacttgtttatttatatagtgtcttgccatgaaggcaagagatcagggactttgctgtgaaccctggcctataactgatgtcctaactcactttacacatcctctctggtggactttcacattgtttcttccttgttggttgcccgctctcctctgtccctcagtacactgtgtgtgcctgggtttgttttccacctgcctttccttctaacctatgacctttttgaaggcagagttacaacatatttgcatttttgaatcccagcaccatcccagtgcttcccatatggcagggactcaataaattacttctaaatgaatataaaaatattgttgagtaactttataagttaagatgttgtgaaatttgctttataattttgagttgcaggctgtggaaccaagccaaagttctggtcctatgggagttcccttcttgcaactgagcacgtcaaatgagtgggtagcgtcttatgccgttcactcagcacatgctggggtgagtcatgggaaattactagtgtggttcaacttaaggacaacacttgactcaatgtcagtgcaaccaattgtttggccattgactagagatgaaatagttccagaaatctgattctgaggaagttcagaatcagaatcaattgttccaaatctcatggaaagaaatttaaagtggaattcttttctgcttactgtgtttagcatctagtcacatgatttgtatctctttatgttagtggtagtactctttctgtctccttttatttttataagtttggtttattctcactagcatgggtttcaccaggggtggagacatgcagggaagaaggaagagggttgttcttcaagaagagcatgacagaataaccattggtaggtgaggacaaaaaagcatatatgccattgttattgcttcaatcatgtgttttctagcaaagcaacgtaggtgcaaatcaccagtgaatcctccttattctcctacgatggcatatccagtacttggtcccatgcctcattctttctttgatgcactttcttgctttgcaaaagtacattgtcaagtaagttattcggaaagggagcattgaacataaatttctgagccctaaaatgttttaaagtatttaagtcacatacttaaatactagtatgtgatagctgcaagcagcattaaagtttaaaaataattttccctcagaatgtaaaaacattcagtgttactgattaggactttgctgtcaatatcattttctgattctttgaggacacgttttttctttttaaggctctcttaggatctgacaagtgtgtattttttaaaaaaatacgtagagcttcacactggttggactaatcaaattcatatacttgagtatttttagttccgaaaaattatcttctgtcgtaagttgatcatttcctctcctctcttttcttgggtctctcagggactcctattatttaaatataggacttctgcaatgaccctctgtgtcttatattttcccatctattttatactttacctatttgcttcctcttctgggcgatttcttcaattttatttcttcagatcgtctactaattttttaagttatgcaattttagtttttatctttaagtacttcccttgttctttgattgttctttttcataacagcatgtctttgtttcaaggctaaaatattttccagcatttctttgaaattattatgtttgttgtctgaactttatctgtttcgttaagagtcttctatgtatatgtttgttttaatctttttttttcttgcatacaacatggtcttcttatatgccaggtaatccctgattttccactcatatttaagaaagtagctagtaccagctttccctgtggttgtataaatgggtcaattgagtgtgtgtggactgtcaaaccccactttagtgttagcattctagaagatagcagctcttggtctctggatccccataaatgacaaaataaggaggactgtgtgttagagtcccagtatctacattagaagtcttagctttgttcacacacatacatacttttctttaagaaagaggcaatctgagtgtgttgcttggttgctggcatcaaggaaaggtaattaaggcgttgggatgtagtctgatgttcttaaccgactgacacttttttaatttcttgttttaagtcctgcctgttttctgtcaccatacccatttcctcagtggagtatatggtgttaggacatacattagtttttttctacagttcctggctcataactcccatagttcttgctacagttttttttcttagtaggttggtgcaaaagtaattgtgttttttgccattaaaagtaatgtcattaaaagtaatataatgttgggtgtgctaggcttcagaggcgggcctctgatcttctgctttcctttcacctgtcccaaggcaggactctactcttcccacccttcttattgtaggtcttaagaccctctctggaatgaaggaatgctgagtgtcctgaagctttcataaaaactcaagaggactggtttggagagcttccagatagttagaaatgtagaggttcctggagggtggcattcccagggagggcatggagactccatacgccttcccccataccttgtcttatgcatctcttcatttgtagcctttgaatgtcctttataataaagttaatgtcagtaagtgcttctctgagttctgtgaagcagctctagcaaattaatccaacccaaagaggggggcatgggaaccccaaattgaagggaaattcctggactcacaattggggtgtgtgtgtgtgtgtgtgtgtgtgtgtgtgtgtgtgtgttgcggtagggggaagggccttgggagagttgtcttggtccggatctgtgtcccaccaaatctcatgtcaaaatgtaatccttaatgctggaggtggggcttggtgggaggttgattggatcatgggggtggtttcttatggtttagcaccactcacctagtgctgttctcatgatagagttctcatgaaatctggttgtttaaaagtagcacctccttcttctctctcttcctcctactctgccatgtttgtaagtttcctgaggcctccccagaagcctagcagatgccagcatcatgcttcctgtacagcctgcataactgtgagccaattaaagctcttttctttataaattacccagtctcaggtatttcttcatagcagtgcaagaacagactaataaagagactgagtcctcaacttgtgggatctacactatctccaggtagatagcgctgaaactgaattggaggacacccagcagacatccactgcttggcgtgtggagaaaagcacccacctttgatcacagacatcttctgtattgaagattattgtggtggtgtgagagcagagaaaaaaacaccggtttagagagttttcctgacacaggctcaattggatggagtgtctctcatctcttctgtggtcccatgaacgcatatgcaaagcagtagctttcttttttgggttttttttgttttttttttttagtgtgcttccagtcaatttccttattccggaaatttgttagaaacttgtttgatagcaatggtccttaccctctttaattgctataattttatttattttgatattctgatacttgttagcattttattttgaaataatattgaaattacagaaaaagctgtcaaaataggacagagttcctgtacgccaacacgcagtgtaccctaatattaaaaacttacctaatcatagtatagttatcaaaattaacaaagtaatatgtgtacaatgctcttatctaaactacagattttatatggcactgcaaattttccactgatgtcctgtttctgtcccagaatccaatccagcatactgcattgcacttagacatcatgcctcctcaatctcctccaatctgtagcaagtccttaatcttcccttgttttttatggccattacttttgaagaatactggtcacttattttgtcaaatattcctcaatttaaatttgtttaatatttcctcattatgagatttgaagttatatgtttttagtaaaaacgccataggactgctttgcctttaatgcatcatatcagggagtattgatgctgatatgtccaatcataggagatgttaactttattcaggtagtgtctgaagttttcttcatttcaaagtttctgttattttcctttttagtaccttggagaagatactttggaattatgcaaatataatgattgacagcaaacttttgtccactaatcttatttattatcattattattgttattactattttttgagacagggtcttgctccgtcacctaggctggagtgcagtggcatgatcataactcattgcagcctcaaactcctaggctcaaacaatcctcctgtctcaatctcccgagtcattggaactacaggcacacaccaccatgtgtggctaatcttttttggagagatggggtctctctgtgttacccagggtggaacccctaggctcaagcaattctcctgccttggcttctcaaagtgctgggattgtagccatgagctgcaatgcctggctccactaattttggtatccatccttgaatcttgcctgcatcagttatttctgccttgttccaatggtaattatatattttcctcaattcttctacatttattagatgatatttttctgtaagaaagagctgttttctctcctttctattcaattattatgtattcactatggacttggtgtttgattgtttggattataatccaatactatcattatttattttgctcatcaaattgtttcagctttggccattgaaagtgctttcatattggttcacatgtcctgttgacatgtccatgtctcttttaaagcatttttttgacttctgtcaccacaagatattccagagtcatgtagtattttccctgatgcagtgctggaatcaaccacttctccaaggatctctgggtccttttattggaaattgatatgagaaagcaagatctgggtattaactctgctccttgtcactggggtgccattgcttttaggaaatatatactaacccatggatacagtcatctaaatgattcatctattatatattaagaaccatgagttcgtatgtatcttcctatactttcttttcagtgggatattggaaaagatgagaggcaaacatgtattctttgtttgctaactttaatcagaaatcccaatttttcagataaaattttaaatcagtgctttcacagatttgttttaataaaaattacattgtttttcctacttcgtaccctcaaatgcattattcaatctttcagacacaatagatctttttgaatacaaattaatctagactggcataaatagaacagtgaacacttccatggacattcgtaaattcattgccaaaataaagagatctgtggagtctcagtttcattcatttatcagagaggagaacaagagtttaatgctgacaataggaaaataaataatattcagttcaaaattgagcacatctttagaccaagacggtgtttgcaacatagtagacactgaatatatacttgttgaaatgaatgaatgaaccttaccaatgtcaccctccataaccatctgttgctatgtagttcttcaatgtaatggaaaacacacagcatgcattgcagcatgatgcctctgttctcatcatacttcactaattgattcagcaaacagcttccacccagacataattctaggcaagtatatttttaactgaaaggattctatcaggtgatgtatcctttttctaaatttcccatctttttcttactttttggaatgagttcagatatataggattaggcctataaggtgaaggaatttgaaaacccacaggaaattagaaaagacattgtgtttgtgaattcagaagtgacctacgtagcaaatgtgcaatttgcttcagatagaaaccagtagattccgtatattcagagatatgtggcatagagagctatagttcccctgtaagtgggtaagatgtctttattaacaaaatatttgcattcatcatatttaagaaaagggcactataaaggtgaatggggctttttgaccactgattcacggtagcaagattggaaaaataagctgactgttggtattttctgctttttcagttagtttctccaagaagagagagaaaaattcacttgctttttgtggcttctctgtaggcacttatactctgtagatcatctctgtgttttcagtgttctaaaattatgtgggcaatcttgtctcctctcctgtcttcttgtacttcaaaagtatgcacctatatttaatatccatgggtagagagaagcctttatggagaagatagtatgtgaattgtgccttgaaggatggggaaatactggggggaaaatgagggaaggatgaccttctgatagagggaaaagagatggaaaattgattactacgatgcttatgattgcatagacaatctggttcaatcatctacttactgaattttgtagaagcatccattctctaaaggagtacataggattaataaaattaaattgagtatcttgataaagcactcctaattctttggaaaaacttgtttcaatctctaatatcccaacatacaccacaatactatttcactcaggaaaaatagtgaatttattatgtgtgacacttaatgacaaccataatgtaaggtttgtaattactgggatggggaagaatccagtatatctcctgataatgtagctgtatttgaaatttttaattgtattgaagaaaaaacataatacaattgtgtatagtaaataaaattaggttttcacttagttttatgatcagccaattcagatttatgtggtttaccagttgttggaaggactactgtggaagtcacttacatgtgtatttatgaacttgaaggatagaatttttatgacagtggattcatttaggaaaaatatttcaatcatttacatttctaggtaagtttcaactaaatatttttattgcataactgcaacaacttcttgtttatgatatgcaataacattttttaaatataaaattcatacgtaatcattgtagaaaatctggaaaacttaccaacataaaaattaaagtaattatgtcattattgaaggataactattttaatatttgttttagttatatctcacaaccacacaagagtgattgtactactttttaaattcattatagtgtgcagtttccccatctcagtaaatagtttttgaaatttgaatttttatgatggcatactggtcttcaagcctatgttaaaaattttataaagcccagttgcattcattagtcattctttctcaaagctagcaatgatgagaaaggggtttcggagccctgaagttgagaagggaagtgttgaagtgtctgactggggccagcaggggttgctgtcatggatgaggctgccacattcctggtgtgtctgactttggactcacttaacattgtagtctggattctattaagggaactttgtgtttctcctttgcaagagtcaccccctaccatgataaatatttaaaaatgttttttttttttttaagttgggaaagcaaacttttcccaaaagaaatttatagttcaaatttacaccaagttctcactaactggagcaagccgggttttcactaaagctttgactttcctctgtaaaacattagtcactcccttggaagaagcagttttttataggcagtgggataaaacagccacagacgtatgtgtaatatgatgggctttagaatgtacctgcaaagcagttttttttttttttccatttggaggaaaaaagatgaaccaaaaaagactgaattgggatgctaaaataacagcgatttattattaaggaaatgatacgcttttgtcccattcaaataatgtttttattccccttttctttattcttgggaggttcctattgttgtgccaggtcgttttcactgaacgatttttaaaggtattcaccagtcccacgtgtgaccggttgcatttttactgtgcaggaccatcgtgaagcctgtggccaaagagtttgatccagacatggtcttagtatctgctggatttgatgcattggaaggccacacccctcctctaggagggtacaaagtgacggcaaaatgtaagtacctctttcaggactttacgaaaggctctgatatcataccatcttttaggtctttatgatagacaccaccttttacatgtgtccagtaaacttgggtgagacatttgaaaatgattcaggtggtgtttattgctctgtcggattcatgtttctgtagaaatttgcctttaagaaaaacaaagttaaagtgctttgtttggtggacatgacagcacatttcagaaatcgtatgcttttcaggagacctgttttacatttaaaggcagaaatgatagggcttctgtttaaaatatgctgcatgacttgagaggtcatgagtctagaaaagctactgtgcttttccagggagaatggaagttccattgtacatgggataaaaataactatttcttaataatattatgcacttccaagtttgaaaacaaaagtgtaattccccttgctcagagcctctgtatgtgtctatgggcaaccctcataatctctactcgtcttctgttgtgttgcaaagttggactttttggctgtgttccttagcaactggacaccacatgaagaaataaattttatgttacagtgcatttgaataatacaacctaatggaatctggctagaaagaggatttctttaaaaataattcccttgctctctgagtgggaaaaaaggtatatatatatagctcacatataaatgtacattggcaccaggggtatctatttaaaaatagaagaaaaaagtaaaattacacaaagaatagggcccacagtggtgtattttagggagcattgcaaagcagacaacaacaaaaaacccaaatacttttaagtgggagagatgagtttggagcaaatgtgctgtattaatttaaaaagaatcaaagaaatagcgtcatgccaacctttgtttttagctggcttctcatgtgaaagagttttctgcactctaattgttctagtaacattgttaggtagtaactatttttaacatgtattatttacccaggattctttgtgccttgttgtctattaaaaacatattaaaacaggaaactctacaaagacaaacaaagcaaaataattcatgattttggtaaaattgaatagagaggtgtttgctgagattaaatgtctgtatggcctttttaaaaaattgttattattatccatggaactcaactcaatggaagtcagtctttccatcgcagataaacctcacttgtgggtcagaactggtaaacagttgtctaaataaacaaagacaaagagagtttgtacatcaagttgagataaacccaaaaaaatacaaaatacctagcgaagaaagaaggaactctggaaaagttgttccttgccattaaatccaagaatctcactcagaagagaggagtgtctatgtttagtctttctccttgccacagggaaaggttgtaacaagactcttcgtcagaactagttaaagggattgatcattttgttcccttgtgtcttcatttttggccaagtcaagttcaaatctcaaatgttaccttgaaaatagtcgcatggtttcttttggccattaggtataggagacgtgggttctaccacttctaggtttagtagagtataatagcatcttcaatatattctttacccatttacatatatctattcattggagaggaagctcttcattgtgttccatctcagaatcagtttgtctagaatgcctccaactcccctcccctcgttcccagtccctccataccccttgtgtatctttcctactcaagaaccatatgttctctgctaggtgcctatttcctaggaaaatcaagcagacatattttaagtgatatcatactttaccttttgcgtatttgcagtttaataaggaaaaatatatacaatgagaagagaagtccttagagtctaaacagattgtagttgaaactcttcacatatcttatagatgaggaaactaatttattttaaaatctgaaataactggggttaaaatcaaagttcttatcctgaatcagtagttaggtgaaattgcatgaggcattttctgtattttttccattaaaaagaaaatgtttcataaaatggatgagaatagattttttttttttttttaagacagagtttcactcttgttgtccaggctggagcacagtgggatgatctcggctcactacaacctctgcctcccgggtttaagcagttcccctccctcagcctccctagtagctgggattacaggcatgtgccaccatgcctggctcattttgtatttttagtagagacagggtttcatcatgttggtcaggctggtctcgaactcctgacctcaggtgatgcacctgccttggcctcccaaagtgctgggattacaagcatgagccaccacacccagttgagaatagagaatttcgatgcacactacagagaacatattagtgcccatgacccttaatcccccaaacttagtctatgacagacattgactagttttgtgatacttaagtgaaacacaacaaagcctcacatctgggcaactgtatatattatttcatggaagcctgagtttctcagctatactttctagagatgctgccccaacaagtgggtagaagctgggattactagatagctcaatagttgttccctaaaacactccccacttggtatctttgtttgctttctaaccacctggcagatgcattcatattgctttggtcgaaaagttctgtacaggcaattaacactggactttcactgtcttgttcaggaagtcatcctttattgtgggagtagggtgatcccaaaacgaagttagaaatgggctagattctaaagtaaaaagtaggaacaagatacacaaccaagttcttctccccgtgttttccaattctagcaaaactcattcctgctccaagtagaatatttgataattacagagagtggttttgaggatgctatccatgtcagagatgctaaaattatattttcttagcacattgagtcaatcttttaaaatagttttgtttgctatctctgaaaggaaaagagaaatgaagtcaaaataactagggtttttgtttgtttttaaacattgttacctgattgaaaaataataataaaaggttggtgtaatcaccaatatctcagcccaaatatagaggtgatttaaaattaaaggtaattcttttcactagtgatgtttttctttcttcctcttttctcctctcctttctttatatattaagtgttttctgttatgaaactacaaaacttttggcattggtttctgctgaagttttaatcaacaatctgaattacttacttagtatcagtgctgctctttaaggaccaaggctaaatcccaacccgaaatgactaaatagctttttaacctgccctaaacccagcatcaaactgtaccttgaagttatcagtttatctttctaaatatgctgattcagatatagttgtcttcaggttacagcttaatcaggttgccatgacaactaagtgctgtattcaaacaataaaattaattcatcatatactaccaccccctggctttatagtgttgttaacatttttttttaaaaaaaagcttctttggtttaaattcgttttgccacaacatatattttttcttccctttcaacacatacatgcgttcactgcttttgttggtgtcaggcagtgaattcatatattcaaattgcttttgtcatgtgaacaagaatatgtttttcctttggaattatgcaaaatcattgtgagatgatagccatatctgataaaaagtatgttccttttataaacatgtgaaatacattcctttaataaacattttatagtccttgagacagaaaccatttctctcagcaaatatacaagggttattttgacaagtaaatcaataaatgtgattcatcacataaacagagctaaagacaaaaaacacatgagtatctcaatagacatagaaaaggctttcgataaaattcaacgccccttcttgataacaactctaaataaactaggtattgaaggaacatatctcaaaataataagacccatctatgccaaacccacagccaacattatactgaatgggcaaaggttggaagcattccccttgaaaactggcataagacaaagatgccttctctctaccactcctattcaacacactttagaaatcctagccagagcaatcaggcaagagaaggaaataaagggcatccaaataggaagagaggaagtcaaactccctgtttgcagacaacatgattctatagttagaaaaccccacagtcttggcccaaaagctcctttggctgacaaacaacttcatcaaagtttcaagatgcaaaattaatgcacaaaagtcagtagcattcctacacaccaacaacagttaagcctagagccaaatgagaaaggcaatcccattcacaactgtcacagaaagaataaaacacctaggaatacaactaatcagggaggtgaaacatctctacaatgagaattacaaaactctgctcaaagaaatcagaggaaacataaacaaatggaaaatcatcccgtggtcatagacaggaagaatcaatataattaaaatggccgcactgcccaaagcaatttacagattcaatgctatttctatcaaactaccaatgacattcttcacagaactagaagaaaactattttaaaatccatatgaaaccaaaaaaagagcccaaatagctaaggcaatcctaagcgaaaagagcatagctggaggcatcatgttacccaacttcaaactatacttccaggctacagtagccaaaacagcatggtactggtacaaaaacaggcacatagactaatggaacagaatagagaacccagaaataaggccacacacctatgactaactgatctttgacaaaactgccagaaacaagcaatggggagaagactccctattcaataaatggtactgagataactcgctagccacatgcagaagactgaagctggaccccttccttacaccatacacaaaaatcaactcgagatggattaaagacttaaatataaaacccaaaactataaaaaccctagaagacatcctaggcaataccgtcctggacataggtattggtaaagattttatgacaaagacacaaaagcaatcccaacaaaagcaaaaattgacaagtgagatcttattaagctaaatagcctctgcacagcaaaagaaactatgaacagggttaacagacagcctacagcatgggagtaaatttttgcaaactatgcatctgacaaaggtctaatattcagcatctataaggaacttaaacaaatttacaagagaaaaacaaccccattaaaacgtggggaaaggacatgaacagacatttttcaaaagaagacatatatgcagccaacaagcatatgaaaaaaggctcaatatcactgatcattagagaaatgcgatcaaagccacaatgagataccatctcacacaggtcagaatggctattaagaaaaagtcaaaaaataacaggtgctggcaaggttgcggagaaaaaggaacacttagacactgttggtgggaatgtaaattagttcagccattgtggaaagcagtgtggcaattcctcaaagagctaaaagtacaaccaccatttgatccagcaatcccattactgggcatatacccagaggaatataaatcatttgaccataaagacacatgctcgcaaatgttcactgcagcactattcacaatagcagtgacctggaatcaacttaagtgcccatcaatgattgactgaacaaagaaaatgtggtacatatacaccatactatgcagccataaaaaagaacaagctcatgtcttttgtggaatcatggatggagctggaggctattatcctcagcaaactaatgccagaatgtaaaaccaaatactgtgtgttctcactttcaattgggagctaaatgatgaacttctgaacacagagaaggaaataacagatactggggtctacttgagagaggagggtggaaggaggaagaagaacttaaaagataactattgggcttaattcctaagtgatgaaataatctgtacaataaaaacctgtgacatgaatttacctatgtaacaaaccttcacatgtacccccaaatgtaaaagttaaaaaaaaaattaagtgatttaaaaaagaatagttaatagttgccgggggggggggaaccaaataacaaagcttagcatcttgaattaccatcttttttttaaacagaaaattgtatttcttttcagtatcttctgattctctttcccccaccgagtgcctgtttagcaatgagaaagcataatttgggggaagatacctgtataaatgaatttagacttaacagtgagttattcttagggaagtacaaagattccttgtttagtcagtcaatgatccaaaagtaagactctaaaaacttgagtactaatccgataaacaaatgccaagaaacaaactgataaatacacaaggccatgttgtctacgtcttctgctaacaatgcgtgtacatgctttatcccaagtgcctcatgaagttttatctaactacaagttctgaataagcacttcagttttaactccagttattacagaggataagataaattagtttcctcatctatgagacatataaacttttttagatagccttgattacaatctgtttggattctaaggtcctctcttctcaatggatatttattctttatcaaggtgcagatactcaataaaaggtcatatatgggtatgtagctcaaataccctccacttttccatttcttgtgtccacagagttgaatatagattgagccagaactaggtgtgttttggtgaagttgactgctttttttcttgttcttttttactaatgactttttactaatgactctatacctatcttaaaatgtccatggctctcctaagtgtctaattttttccacattatcaaaatctataaagaacctaatcatatttacttaaatgcttcactaattacctgactatggtctttaaatgtaagtgtatttcacctaatgttatggttgtaatatttctgtaactattcagaacgtagtagctctgtttagcagttgtatcttttattacttatctgtaatcagggactcaatgccttgtcttctcataatggcatttcaggccacagcaaacatgtatggagaaaaggagtgtctagaagtcacctacccaccaggtaccacttcatgaagggtcaaccttaaacttgaagggcttcagttcttttagattagggtgaacacaggggaatactatgcagcattaattcttcgaagtattgtcttatccagctaccatcagattaacctctttcatctgcttctgtgccgtgtttcaaaaactggccaagtgcctggaacatagtctaaatagcatttttaaaaacgagtaaggctaaaaagaatccatgatttttttaaagtaagtcagatgatttcttccactatattcgatgtttcttgaaataggagttcataattttttttcttttttgccattgctatcttccccatcactgccatttcttagttttgaatcacatattcctgtgttctataatattttaattaacaaaaccttgtttttctgaaaactgcttctgacaatggacacttgtttaatatttccctttaataggaattgtattcagggaagtcatggtctccttgtaacagtgggccttgggcaaaagtgcggagacccagctgttaacacctgcttgaatctaattggtgagaaactcatttaatctctgctcagaaaaccaggacatgggagatgatagggtcctttaattattaaactggaaataaacagtaagaattaaaggagagtaaacaatagctaattttggtattggaaaatatttgttcggatctcaaatatgtttctcactaattttgtaatcaagttagtttcctaatcagccaaaaaaaaaaaaagtgggtggggaagggagataataattttacctacaacctatgtaataaatgattaggttgtgaattaatagttttgaattttattgttcatatcatttcaacaattctaaatattcagtgaaagtctgggtgtttagatgatatatttgagcacaaaatatacaacacaaattctgtagcttttttgaaggtgtttcagactcctgtttgaagaaaatggaaggaggatgggcagacatctttggaagcaatgcaggattttaggtaaatagtaagtgtattgtccatttaattaaaagccagtttagcaaaataagtgcctgcatttcacatttctatatctgtttgtattcctactttataataaatccagagacaattgaaaaagtggtaatgtttttaaaagaaaataaagcattattattttgtgatgaggatacctcagtcattgcttgcctaaaaactgtgcattttgttatgatacattgaggtatgttctgctcttaacattatgaatatgccaatgcagaataaatagtccagtgatgcttttttagcaattgactacaattttagttaactgacagttaactatctgaaacacacttgagagtcagaaaaaaacgtctcaacaaaatactaccaaatcaaattcaaaaacacattaaaaggttcattcaccatgatcaagtgggatttatctatgggatgcaaagatgattcaacataggcaaatccacaaatgtgttatacctgattaacagtatgaaggacaaaaactatatgatcacttcaatagatgcagaaaaggcatttgacaaattcaatgtccttttataataaaaactcccaacaaattaggtatggaaggaatgtacctcaacaaaataaaagccatatatgataaggctataaatacatcatactcaatggtgaaaaaataaaagtttttttcctaaggtcaggaacaagataaggatgctcactctcgccacttctattcagcatactaacagaagttctatccagagaaattagacaagaaaaagaaatgaagggcatccaaattggaaagggagaagttaaactgtctctgtttccaaatgacatgattttatatattgaaaatccaaaaggttccagcaaaaaaaacctgataaaaccaataattaaatacagtaaacttgcagaatataatattaacatacaaaaatcaatagcatttctgtatactaacaatgacctatctgaaaaatgatgaagaaaataatcccatgtacaatagctacaaaaaggaaaaaatgcaaaaaccttaggaatacatttaaccaaggaggtgaaagatctccaaactgaaaactataaaatgttgatgaaaaatattgaagaagatgtaagtaaatggagagatatcccctgttcctaaattggaagaatgaacattgttaaagtttacatagtgcccaaagctatcttcagattcaattcaatctctgtcaaattcccaatgacatttttcacagaaatagcagaatcaacccaaaaatttgtgtggaaccacaaaagaccctgaatagcctaagcaatcttgatcaaaaaacacaaagctggaggtaccatactttccaatgttaacagctactgtgaaactgtagcaatcataaaagcatgacagtggcataaaaacagacacatagaccaatggaacagaatagaggacccagaaataaatccatacaccatggtcaattgatctttgacaacgatggcgagaacactccatgaggaaaagacagtctttgataattggtgctgggaaaactagatatccaaatgcagaggaatgaaattagaccctcgtcttataccatgtaaaaaaaatcaactcaaaatggagcaaagatttatgtgtaagacctgaaattgtaacattaatagaagaaaacatagaaaagatttatggctatagttactattataaacaatgttgaagtgaacatccttttacaagtctccctctgcatgtgtgttaaagttaccttaggctgatgtttttagtcagttggggcttctgtttcttctttagtatgtagcacttgaaaacatgaagggaggcaggaaaataaggaaagaatgccttcgaccttccttacctattcctcaaacttcagtccacatccctgtttctcaatacacatgcacacacccacacaacaaatctctcctcctctctttactgtttaatactctgtatatcacacctcttcggttccagttaaaactggcagaaagggtggttctgtatactgatattcttcaagtttaatccaaactttaggggaaaagcaggtcaaaagtcatgcagtagatatgtaaaataccattttgaggtgttttcaagcaatacgttgggaattacaatttaaatagaaaagatgactttctgctcgaaacattctgcttaagttatcaaggactgcggagggcaatgtggtcgtaagggtgaaagcacagcctggtcgtccagcagaaaacatcataattctggcctgggccatcagaattatcccaggaatgccacccaacctcttgaagattatattcttgactgaaaagggaacattaatttcatcctggctgtgttgttgttattgatgatagaattataatacctgccagtgatgttgaacgttttccatgcactaggcactatgcctcaatgcttctctgcactatcttattttgtttttatgattaaatgagataatatatacatagtacctttgtgtattttttgtattaatatcattttttaagatgttctcatccctctgaaaccattacaaaattttacaaccgtttatatttctaattttaaaagtaacagaaaaattaagtaactatgcttaagtcacagagatgaagactaacaaaaccacaaccagatctcatgtctctagacttccgccttcatttattttcactaggtttaatgggttattaaaaatatctcaaataaatatgtacgcactttttaattactatagaagcttctctgaattgtgaaaatatttttcgaaaagaaaatttttccaacaatgacttttttgtgtaaataaaattttccaggtcagaaaagtaagctttataatataatagcagtttacagaccatgtttcctatttctcatggagcatttttcacaagaacgaatcaaggacttactctttgactcaaaattcctgcaaaccagtatgtctctttgttatattctcaagcaagtacatggcttcctgcaaggacagaggaagggaatatgcaagacatttatgattgcatgtaatagagttcactcatatatatttaacagctaacaaaaaaagcaacatggctgattaagaaggcaaacctgtcaggatataaaaacacaaatttgagaatgattttatttttaaattacaatcaaaagatttattcaagtgaatgagtgctccatgttcgctcttactctgcattcacttccttgctcaattgcctatttcctcataccacatgataactcagataccaaattgtagaagaatattttccacctgcactgtttagttactgatgtcatgaaacaatccttaggctaggatgactgctgcttaactttgaagaacacagttactataactgtaccataacaggccatttcaacattgcttatgaaaagaaaatatgtaagcagagtttgccccagaggaagatgccaactgcagctaatgtgtactgtattccattaatactaagatatactttttcatattttgacatatctgaaattggaatgtctctcacacttgatggtgtttcatcatgagattgaggctgtttttttaattttcatagtggtatataaaataatggttacatttattttgtgccacaattgatggcatcttagattcaatggaaaataatattttactctttgagatgtttgtaaaatcccagccaatggccttcctaatctaatagcttagatttctattttatattttctttacagacttccagtgactgaatagaatcccaaagaagcaaaaattaaaataacaaaatgaacaaaaaatattgccagggacaaattttaaataatagttgattctcttactgtgagtttgctttgagctcagacaaaaaatggttcttccttggcctgacatctccataaccgtagattttgaccctttattatgatgattgctataagtaaaataattggcttatgattcatcttacaaatcaaatcaatacggaaaagaatcagttggtcaaatcctttgttaagtaatgtcatggcctggtgccagcagtgttaagtgtatggaatagtatgtgaccaagaatcagctattaatacgtgtgtggctgatgaagtaatcaaggaaatcttggggaatggacgtgcagcttccctctataggaagttctcctcacactactgtcatgggctggagagtcactatggactactacagaggtttccaaattaacaagcatcagtatcacctggaggccctgttaggcatgctgggttccgcttccagaatttctgacttagtaggtctggagagggtactgcaattggcatttccaacaagctctcaggtgatgctgatactcctgatctagggaccaggctttgagaaccactgggctagtgattgaaaaaaaggaaacaggatttggaatcggttgatctgcagtttgggtctaattggctaccaactaacttctttttttgtgtcttgatgttctttttattcctaacagaaatagtacaaatcacgtgtgctttggctaaatatagggccattatgagaatcaaatgaggtaatggacctaaataaaatgctttgcaaaatgtgacactctacatataataacgtataaatgatatcatccccacgaaatctactattgttttcacacatataagctggggtcagaattcatatgtcaaaatacatttggaatcttatgtgaaaattaatactaagctatttagttatttttaaatgtttaacataattattttatatttctaaaaacatttgaaatatttagttatttttgttggtttttataggaagtggctaggattccacatatattttcttcctctacctaatccctttccaactgaacctctagacttgtcccatgcaacgccaagatttgtggccacagagaagtcatcaggagttgcagtggttctcatgccaacagctcttagaattcctcagaatgatagaaatttagccacctttacccaatatttctcccacgtagtttcagaccaagagtaacttttatgaactccctcatttatcttatcccaagtcacctaactgttacttggtaaagcgccataaattcttcctgatctgtcagtattaatagaaagagctctatagaaatgagctttcactgggccgggtgcggtggctcccgcctgtaatcccagcactttgggaggccgaggcaggcggatcacgaggtgaggagatcgagaccatcctggctaacacggtgaaaccccgtctctactaaaaataaaaaaataaaattagccaggcgtggtggcgggcgcctgtagtcccagctactcgggaggctgaggcaggaaaatggcgtgaacccgggaggcggagcttgcagtgagccgagagcgtgtcactgcactccagcctgggcgacagagcgagactccgtctcaaaaaataaaataaaataagaaatgagctttcactggctctcaggatttgatacgttttcaataaacaataggaaaagtgacataatagagatgtattaattttcctccaagttgtttttaaaatgcaaaacttgtcttacaagtgtctatatcctatcgacctcccaccttaacactatccccagatcttagtatcagcttcttccatgagaaattgtgtggatctagccagattaaaactattatttctctcctcctatcatctctttacatggttaatgtaactttttagtctaaatgagccacctgtgtaaaatacatatttattttaatgatagaagtgaaaaagaaatgcctagggttataaatatgaattttgtaaatactggctttgattgctgcatgcttgtgtaatgttcaaccctttttcaggaacgactttgtctagtcatatataacaatagagtctatagataaggtctttattccatgctgttttcctcttttctctgccttggtgaaatttgtctataagctacagaaattacctatttcagaaattattttaccaaacaattgactatctgtggcgtatcattcctctgctttatattcttttcctgcaactacaataatgtacacctcttaccacacgtgatgtctatgtactctctaccctactctatgctcctctgccaacccttttttcactattctgcagcctggaaaatctttctgtctctctaacagaccaggctcacatcagggtctttgcatgaaaagatcctattcaaaggatctcttctttagtgataacctggttatcttctcagctcagatatcaccttctcaggtcaattttcctgaccagtgtacccatcctccatcatgctctatcacttctttgacgttactgtgtgttgttaactactatgtgtccccaggggctaaaatatcacctcagctattgtctaggctccagaaatatttattgactttcatgtatggagtgatttaaaaaaaaatgatctatttaaaaatatatttaaagtcaatctctttattttttcttttacttgaaaagtttgctgcatgggtgtttattcaagatattttcataataagcatccatgttgtattgtgcttgttgctataaaaaaaagaaaaggaaacaatgatcagcctgccagaccagtacttggcagtggttcaaaaagcaggctccacagtatatacacctttataggaccaacacatgggtctgccacttttcttctttgttttgtcgttgagatagtgtcttgctctgtcacccaggctgaagtgcagtggtgcaattatggttcattgcagcctttagctcctgggctcaagtgatcctcccacctcagccttctacatagctagcactaccggcctgtgataccatgcccaactcattttcctgtaaaaaattttttgtagaggtaggatcttgttatgttgcccaggctggtcttgaactcctgtgctcaagtgagcctcttagccttccaaagtgttgggattacaggcgtgagccaccgccactggccactgccacttttctaattgcgtgaccttgggcaacttactttcccttttagtgggccttaatttcctcatatgcaaataggactatatctcatagatttatgaagagtaaatacagaaactcatttaaacatctcagcctaaagcctgacatttagcaagcactcaacaaatgttagccaatattagatagtcttatcatgtccatgtgcctcaaaagagctctggattataacatctttaatgcctgcatagcaactcttaatgcatgacagttgaacagttctagatctgtgttttgataacagcatataactatctgacttttaaatgcttcaaaccacctaacagatgaaaactgctgtaatgagcaaccaccaaaagtctacaatacacgagtcatagagttttggagatttgttttggagagttttggagatctgcccataggatgactctcccagacatctatgtaacaaggagtcagttttgatagccaagcacacgtaaatagtacaggtttaataatatttgggacatttagcaaacttcttcatttagtaagcatttccataaacatttcaaagattttcatatgtgggaaagaagagtttatgctgctcaagataaatacaaagaatgaaacagagggaacgtttctgttgatgattggaattataccacatccattgtggtcgattaccttttgaaaagcagattttttaaactaaaaaggaaattcactacagtgtaacatagaagtattaatatttactttggggctgtaacatagaaacttatctttgatggcaccgtaatataaactttaagcgaaagtagaaaatagatgaaaggataggtggagctagtgatgaaaagacaaaggtaagcccagagagaccaggcaattagaccaaggtagtgtactcaggatttaatttatttagctgacctgtactgacctccagcagtctaggatattttggcgagtctgtctgatctgggtttcatagcacgtatttgtgcgctatataaaatccagctgtctcatttagaattgcttatctcagattcagaatgagctgccagctctgttcatttgtttgcacttttctggatctactataaacagttttctcagatgttgttactctttagtcaaagatttctccccacagcactttccttatgcacaatatttccttcctgccttagggtaatcatgtaaataaagtgagtccctaaaaccactttgtcgcccaagtagccagcagagggaatcatttatgaaatgtagttaatttcagtaactgacaagcacatgaagtgcctaaagaaaacaggagtgtcaggctacttgggatggttccaggaaggtcctctactttaagagctgcattttactaaggatcctgatggttattagaacttttcctgttgttttactcagtagtctccaggggactatttggcacttgggtgcaaaatgagatcagcaattaggaagaaccactgcaggcacttgaacagtaaatcattgagtaccaggcttaagagctagtaagtaccaggccaaagtaatagcctaaggatggtggcaagtctggcttcttagtctttccagggtgcttggggccctagctccttgtgtgactgacttgaggtggtgttcagatatttagcaatgggaaagttgtaatcaactttcaatcccaatagatcaccaaaggtttggaagtttcatcaacttggaacctgaaaagtctacactattcacatctatttaagggcagccctagacccaccttccacataggacacataggacagagatactagtgtcaaacagcctggcaggtctttgtatgaatggattcattccctctgggggtgatctatttgattagatccagcttatctatttgatgacacccatgtaggtaaaaaataaaaataaaaaataaatcttggagagtaaaataagtaattttttacttgcaaccaaaggcacaattaccacttatttccaagctctgattacttcatttactcccatgtaacaatcaagaaaagaatgaaaaagaatgaggggaaatagtgagctttcaaggagtttattggaagaaacacaaactaggaaataggagacctgcgttctacagacacgaagtatctatttgaagaattgatgtcttcagtcgtcatctggaaaatgaagtatttggaccaactcatacaatggtttaaaattctctatctagaatatcaagagctacgaacatttaaaacgtgtttataatcaatagtaagcacattgcatttactacttaatctttataacaatgctataagataaacaatatcaacatgatcctcattttatagatgaagaaactaaagcataaaaaagataagaaagggtcaaatttatgaaagagctagagatggaattcacaggtggtctggcatcagagctagtggaatatactttctgtctacatttatatcagaaattgaccttcaaaacaaagagaggcagtctctctccctctctgtccttaccgctattctttcttctctcctggaaggtcatattgtttatggagagcataactcttccactgtaaggtcttgagccctgccctgcaaagacggaaagaggtaaatttggttcctcgtgtatctattctcttatgatgctttattaaaggataatttttaagaagcaatacaaagtgggaaaaggagaattattgcccagaaataaattctgaaggctcaggaaggtatatttgtttttgtcccagacataaaatgcaattaaatctaccccatgtaagactgatgaaacttctttcttgatagagagatgtgatttatattctagcattaattaatactgagtttaaggaacttaagtttatgtcagatcatttttttttcctcccaggttgttacttgttgcttctcatatttggccttccttctgcagctgtgttgagagcttatacagtgtttcaagtaggtaataggccgaaaaaaaaaaaaaaaaaaaaagaaaagaaaagaaccctaagtgcttttgtcattacagcagtgagaagaacagacatgcaaacaccttcatatctagagctctctcactgtacccctaacgttcttttcatattgatggtgacagtagtgtcaaaaagcagagagaaagctgtaaaccgtaagctacagggagatctgcaaaaccaagttactcagggtcacaacctgtagttgtgtagtttgtgctttacacaaggggcagcagcgtgaaggaacataacataaccttcgctctccttatcaaccaaataccatggcctggggcaatattcaaccagagaaataaaaccagaaagaaaagaaagtgactaattcaattcacaggtatacatcaggcatctagtgctggagctacatcagtctgaagaagtcaaaactccctgtttgcatgtggcttatatttaaactgtgctgtctaaaatggtactccctggccatatggttatttaaatttaacttaatgaaactatgtatttcaactgcccaatagccattcacagctagcagcttccacaatggacattgcagatatagaacatttgcatcgtcactgaaagttcttttggggagcattgtctagtggttaaagcctaagcaaaataagtaagcaaacatagagtacattaggagttcatgaataaaatgaacgcagggaaagggtcagattttgctgggacaagggaggtttgtgatttttaaaagggtgatcagaaatggcctcacttataaatgatgtttgcctgaagagctgaaggtgataaaggagcaagctgtgaaactatcatagggaggaacattgtaggcatggggaacagaaagggcaatagccctgaggcaggaccaagcccacagtgccaaaggaagaagaaggcaagtatgagatgttcaagagaaaagggtgatagaagtggggaaaagtagtcatagtttgatttattttaaaggtgagtgaactggatttgctggcaggctggattgggtatgagagaagatcagaaggtgggaatggagtaaaggatgacttcagggttttgggtctgggcaccagagaggaatgagtggctctgaactgaaatggggaaagatgtggaaaaaggtttaagctgagagttaaatttagttgttatcagcatatagacgctatttaaagccgtaagcccagatgagatcacctagggaacaagtgtaggtagaaaagagatgcaaagactgttgcttgggacactctaacattatgacattggagccatgagggggagccatatgaagcctgattgattttcactggcagagtgtgctgtcctgtagcccaatggaggcaagccgttcaaagaggagcacaagccattagctctatcaaatgtccttaaagggtcaagtaagataaaaactgaccactagattcagtaacatgcaggccacttctgacctagacaagataaggagtttgatgagttaaaagcctgattagaggagaaattggaggagagaaattgtagactgcacatatagactgctgctcttgaggaattttattctaacggggaagagatcaatggagcagtaggtagagggaggaaagggtctgatgagtacttgaaaaaataatcttaataaaatgacagcatatttatgtgatgctggtcatcttctagtagagagggaaaattgatgctgctgtaaaaagaagagagaattgctatacaaatgttcttgaatttgtgaaagaattgagttctaggacacaggtagaaggcttgggcttagatacaggagaatttatccacaggagcagttgaaaaagcagagtatgtgggtccagatgctggcaggtgatgggtgtaatggtgggagatatatgaagtgtgcttctgacttttttctcagtgaaacaggaacaaaggtaatcactgagaattcgaatgggcaagaacattttggaggcttgaaaacatgagagaaggtatggcataattatctacaggagtgaaaaaggggatctactagcggaaaatagcttagaacaacttatgagcccatgtaaatttcacatataactttaaagtgagaccagtcagaataactatgtcaaataacaataccatttcaccagccatattcgatagggctcaggccccgctaggcagagagctggatgtaaccaggattgagttagagtaaaagagacaagtgattatctgatgtactaaggattttaaactggtttaaaaggaaagtgagacaatgtagattataagagaaatgaaaaattggtaggatcaatggattgtagatcctagaaatactgcagtgtggcagtaaagagagtaaattgaaaagctagaaggtgataataagagaggaggatgcttggaattgatagtatgaaagagttctgatttttgttaatcaaaaggacgagagcatgattacaaaagtgagtcactaaatcctattctaaagatcagctcatgaagtgagtcactttaaattcttattaggtgagtgtactcctcctttgaatatgagtgttatctttttatgaaagaagaaagttttgacttgatactttcagttaatgctgagatttaaaaataaaaaacagcagggcagcatgtttcccttagcatcgaacagctctctttggctgtctattctcttgtaaggttagacagttggagttcgcatttgatctgaggctttaagcttcttgttatactcaatttccaagagtttcctgtttagagacttgaaatgcagcttagtaacaataagtcattatttaatcatgattaaccactttttaaatggacatatttccaaaagggagaggtagcagtttcttaggtgtggattttgtattccttgactatacaagcataaagaaaacatttgtttatttggataatcaagaaaatctcaaaaaggagcagctgcagttttcattaatgccgaagggaaacatcaagaagatacttttcctaatgtacattaaattccaagtgttatttatgaaggaagaaactattttatgaaatatgatctgttgacgtttaaatgtaaattttattttccattagagtcttatttatgtttcaaaaatggacaaatatttatatttatgcttaagataaaaatatagaaatatttctgcttactaatttgaagatttattagcatttgatcataaaaacatagaaaagagactaatcactttaagagccaagaaaaatatgtatattttttccaactttacagtaacttttaagaaacactcaatttggtcaggcaggattcattcaccattacctttaaaagcacaaggtagaaacttatcttcattaagtgccactgaatgtctggcaccacataactaaccagagaattcagtagcttagggtctatggaatgcctcaagttcaaaggaagagagacatcctgtttggtgttgtatttcacttatgctgttaaaactgcccagaccccattaagtgttttctttttcattcttgggcatgatcttctttgtccctcatgaataacacaaagcttaataaaactccatgccagactaaataattttaacaatgtgttataagattttatttttaggtataaaggtctttctttttgtgcaaaagccattttgttaaagatagtgacatcgggtcacacgccactcctgtggacctggcttgttagagaactagcaagaacattgtctcagacccaattccttcacactgcaaattccactgttgaaacttttactacaatgggtatctatggagaaatagtgaaggtaaataaactctaaattttccactgaggaaaattcattctcaattcctgagaccataaacatgaacacagaaaaataaggtgttttgaactacttctgcatacaatgacattgtaaaggatttagcaatatgtattcattaagtctagagtatgcatatgctcattttttctagtttaaaaccacaacctatatcttccttgaatttcctgaatataataaattttaaaaatagaaaaaaaatttaattaaatttggggaaaataatggctgaaaaaatctggtctgactgaatttttcagaaatagctttactgacatttttctacataattatttgtaacagagtgtggttaagaaatgtgtacatctgatttaaagatgacttttgaagaaaaggtaataaagcctttcaaatgatcgcttattgaataattctcgaaaatctaaacaaagacttggaagaatttatgatttgtcaaaactctaggactttataactttttcctttgttttcttagaatatagctataagataataaataaaaataatgtgactcctaaaatgcagtgttacaatttactaaaaattgtttaaagaatgctatgcggaggtttctgatccttcctgtttgctctgctacctttttctgcagaatatctaataatcatatttgtaggtcatatcaattcaaccatgttttactggagaagatcttgctaaactgcttgatttggcaacctaaaagggtgaataatgggctataattctctacataatattttaagaattggagtctacttaaagattttatttgctactcattatatgtgtagaatgagtataatgaagttttaaaagtggttataaaacaaatgttatgttttctctatctaattgctcttttaaaatatggttacttaaaaaaaaaaaaaaaaatccctccatttcagctaagggtctttgccaccagggaaccatgcatggatccaatgcttttaaatatcgtgtccatgtgtgatctttctagacacagttttttactgtcacttttaaaatgttccctataagtcaatctcttcaggaacaaatacatttttgtatatgcatgaatagtaaaatatatttcacacatttctttaatcatctcctctggaccataaagtcatacatggcaactgaccttgtaaagcaccattttagacatttcttggtggaattatttcttaatgattgaatcattcattgatttatttgttttgttttaaaacatttattgagtttttaacattggggaagcattcatagtctattaagacagacacatacacaattatgacaatatatttgtaaaataatattctatgggaacatagatgaagaagtacatcagattacctggttgagtaaagacctcactgacaaggtaacttgtatatggcataaaaagatgagtggtacacagccaaatggaacaaatagctaaaaattttttacataaatattttaaaaattctaaaagcatgttatattttcagaaaaataatgagtggcctcatgttaatagtgtttgaggtatgtgaaggagagtaattaagagaacatattatttctgaaggcgtttcctttgaccacaaaatactgtgagttttataaagaaatattgagagaggcagtatctcattttatctaagttacaaactcagagaaagggtatgtactcagagaaagggtgtttactgtatatatatctacttacttatctatccattgatcatcagtctgcttatgttggaattcacatttacaacatttgaatggaaaaaaaggataagactttttttttataagtgagtctgatttagttgattggtgtgacaaggaagactggtattgtctatctgattgcatagtggacattttccataaattgaatcagctaaatccagaggtccaatattttgaggaaatgtttttaaatcacttacacaatatgcttaaaagtatatcctttaagaaatactaactcataaaaatattagacatccccttaaaagacgaaagaaggtatatagtttttcaaattctgttacgcttatgctaccaaaaagtatgaagattgctgagttaggaagttattgcatagggaaagtttccaaagtatggcttaggttttggaatctccactaagcaaactgttattaatgaaaaaacatgttttaatgttaggatatatttgctatggtttggctgattgaaaacataacttttggatgacagctagactgtcgtccctattaataaaaatgctgtttgggtgtcttgtcaatagaggacacttttcttgtagtgcttagatttgaagtgagctcctatgtggtaactagtaattagtaggactgagtttactcacctgatgtactggtataattttttttttccctgaaagttacttgctctccctatagccaaacatgaacttgatgtcttcttttttattatcttttctgagattgatgaagaatctgacaacctaggctagatcatgttaaagatgttgacatgatggaagactgtcgattgccaatagtaagtttcaactatgtaacaattaaatagatcgtacttcaaaaattttatagattcagaatctacagattttaatcatttggtttagtccagttaaaattaatagtatattaattatttctttggaagacatggtggttagcttaccttataaataatgtgaatacagtgagttaatgatacagtctttaaaaatctataagccttgaactattcaatgtaatttgttatttaacaaattatcagtgtaatttgttatataactagggttatatagccctagtagtatggataaagatggatatccacactaatcacatctaacttttaacaagcttcatactatctgtgacctgtaatataaaaaaattatcttcagtgtggaaatactatcagaaaaattcaaatttctattctcacaaattgataatgtgcattttctgaaataaagtgttgtttgaaagacttgataatacacacacagaaagatgatagatttctctgtacatggatttcaaacaaggagtttctctaatttaaaaaaaaatgaactggtcacacgatatattcaaaacaaaacaaagacttctatcagcataacattccagaggtttttttccctgtccaaaagatgtatgaatacatacaagaattttgctttaattgtgatactcttaatttcaagtctacaaaaacaactcaaatctatacatgcgcacacaggtgcacacacactaatgcacctatgcatactatcattatttagaaatcaaagataaataaatttaaaatatgtctcattaggactgggaaaactctagggtgcttcttcatgctttctaagcatgaaatgtacttgatcctgggatgctgtgaaaacgatgatttagcccactgaagaacagatggcccttaatcaccccatgtggctaaacacacaaatgccaacctcagagacgccttacctttgccctgtctgtcccctctaggctagtcctgctatattaagggttattgcctttctggccctccctgcaatcagcttttgaagtccatggccaagaaggcagtgtgagaataccattatgagagaggtgtttgcttaaagtcatagtccggacaagatcccatggaccccttgatagtctagcagggagccacaaactttagccaatatcttctaattccctgaggattcagaactgcccaccataaaaacataatgggctgtttatctgagcagccagaagataacatcttaaagttacaatctgggttacagactggtgacataaagcaataagaagtacgaataccacccctaccctgggaaaaacaacatgtgaacagtctagtgtatagataccactggatgcccttttctcatgctaataagagccacaactttcccaacatttttctgttaaatagattaaatatacttgggaagaaatggatggaccccgccccttactccatttgcatgctttatactgtttttgaagtttgggactatgttaggaaatattcccactggcacaatcaagtgaatttttgtggcacattttgacttcttttcaaagattgcttaagtcctgtgacattaatcatgatcttctaataatatactacagagattcccaaaaagatactttattcccaaggctccaatactgcaacagatcagactctctttctctctctgtatatatactatatatacatatatatatatatacacacacacacacacacacacacacatatatacatatacatatatatatatataaaattgtatgaataatatattttgttcctgtgattctttgactctctgctgggacagaattaaaatatctcagagttaaaaaaaatcctcttttttccaaacgcctgttatttgtctgcattgctgacattagggaaaagaaaagctaggtttgatatttcaactgcatcaattgaacacgtaatatagtggagactttacaactgtttgtttctggtaagcctgtttgttattattaccagtcaactgggagaatccaatgcctgtaggggatcccacccccaacaaatgaatctctatgattatggagagtgaccaaattaaccacataattgctagacttaacctcattgtatagtatgggtattttaccacatataaatatggccatgaaccaactatatctcaacccacttggttcgttttaaacatttcctgaacatccaataggattgttttcataacttatcttatttaatcataaaagttgtttccatatatcagtccagtatttttaatcttttaaatgttcacatctgcatatatacatttctaatctactgcatttaacaagcagctttcttttttatttgtcccaagagtatgtcatattattattttatgccagattcaatttagtcacaagttttgtctggccttacctactgtattttcttctaccctttcaggaaccctgtaaagtggcagaggaaaagttacacatgaaattgccctaaagtgtttggaaacagcttcagtcacaactgcattgtgctatgcaataaagctaccctcacaggcaactgttgctggaggctgaagcctctggaatgagtctcagggagaatgtactgcatcccaaactgtcttccttaaggatgacaacagtgaaatgtctgccctgcttgggaacatgcactaatgctgctttctcttacaacttgaaaacgttttattggctttaagaatttgtttaatcaaatcctagtgaaggttcttctcactcctggggctgtttagtaaaatatggattagggcaaagccctctaatgtgtccttaggagagtcatcatggtgagatctgtggaggggtaggggaatgaacaggctccagaagattgcttttagccaaaaaagaaggagaaaaatgaggctttggcaggaataactctctgtgtttgaaaccaaactatgaaagaaaagtatgtgagtaaaaaagatttccccaaagattcgtttggaatagaattttcaatataatgaagataaagcagttttgagaaccccctctaacaatattttatttctaatagaattgcctgtgagcaactgaaacaattgacaagggcagggggaaatgattgaatgaactgcatcactgaaataaataaaaatatgcttacctcaggatatcttgttggatttcctaaaatataattatttagctacgtatttgaattagcacataaacaaataaggaacacttttgattttaatatctgaggaatggaaaagtttggaaaaagaaatttcacactatttataagtgaaatatgtctctagtttacatgtacaaattttctgattccaggaatctctgcagtctcgttcctttgagtgttttctaatgagtataatcatctatagtaatagtatttatttacatatggcattgtgctaaggggtaagcaaaaccaattgtgcagagctagtcagtctgatataataaagcatgatacacagttatgtaggggaatatgaacaaatatattcagcaattttcttgcatgagcaatttgaaaacaattttacatgttcaggccagagaatacatgtttgatcagagtaggagaaaggaggtgctttgagaaatgatggaatttcagcctgatggttaactatagcaagggctgtggaactaaataaacctgcatttgggtcctgacttggcccttctaagcaataacatgactttaggcaagttgttaatttttttaaatcccagttttctcatttgtaaaacatagatgacaactgcattttattcatagtttacgtaaaatacttgtgtggcgcctaagcaatggtgttagaccaaaatcagggaatcggtaataatcctttcaagttttaatccattttcatcttttttgacttctttattacatatccttcctcttgtcaatctttcaaatagacatccagtggaatttcctctcttccacattctgaggccatccctagagtttctgtttttagcttccttaactcttttttaccatcgtttcactggcagccagcatgtgaccctgaaaaggtgaattttcatacccttgcagaaaatgttgacagctttcttatctttgtgtcagctatttacgcccatttactcctcactatctttctgacaaacattctcatttattctacctacatcctaaagtaagccctgataaaatgaagcttcaattccactcctaagatctcttctctctttcattgttagtcaccgttagtcgagaatgtaccatttggctcactctggcttaggatctttgtagtcaagcatgctgttctctctctctattttatcaatctggagtcactttaatgttccaaatggaattggagccagatacctcatattctgttcacctccacatgacccttacacaactggcaacaaatctaggatgagaataatgctggctacgattgggaacagagattctgatggaagtctgtagtttcgatagtcataattacaatacacacaattcctgtccttccccaaacacccaacaattggaacaagtacgagctttagcattccttggattaaaaatatgtattttcccgatttcttttaagtagataaagtttactttctactttagtggcaagtatgaatttactgaaatagtaaggttttctgctttacatattcatacaataaaagtagaagataattatgagagatacattcttcttcccagtccaaccatgttataaaaggaggatttaaaaaaatgctgctaccaggtgaaagaattcacagattatctatgatgatcagggtgctgcgttgccactgtaatgataaagtgtgtgtgacataagatgtgctctcaaatctcataaaagttaaaatctatatggaaatatgtcacagggatgaatttgttataaaacatttagatccataaaatattgcattggcttatttatcatctgagtttcctacttgctagatcctcagcataagttaatggggaaccctctaccctccccatttcttttttttttttttttttttttttttagatggagtctcgctgtctcccaggctgaagtgcagtgacgcgatccgctcactgcaagctccgcctcccgggttcacgccattctcctgcctcagccttccgagtagctgggactacaggcaaccgccaccacgcccggctaattttttgtatttttagtagagacgaggtttcaccatgttagccaggatggtctcgatctcctgacctcgtgatccgcccgcctcggcctcccaaagtgctgggattacaggcatgagccgccgtgcccggccacttcttttcttttttttaactagtttgttttgttttgttttttctcaaagtcttggtctattgcccaggctggagttcagtggcgggatgtccactcactacaacatccgcctccagggttcaagggattctactgctttagcctcctgagtagctgggcctacggtcatgagccaccatgccaggctaatttttggttttttagcaacctgaccatgttggccaggttggtctcaaactcttcgcctcaagtgatccacccgccttggcctcccaaagtgctgggattacaggcgtgagccactgcgcccggcccagcctccccatttcttgttaaccactcatgacactgtcagaatccctcttgttgctcacttctttttttgctgttgtaagctgtggccttgccatatatctcttaccagcctgcaggcacttgaaggtttaataaggcattttatacagagtagatgttcattaagacaatgttgtccctcagaagctagataagctaaattcaaagcttcttcacgtagatttttgaaagtccatttttctacttaagattgtacaagtgaggtggtgaggatagtgtgatacttatagtttcttgaatgttgtagctctgtgtgcctgcttcctcttaataactttatgttaaagattattgccacagctcaacagtgccatttttacattgcataatatcaatgctaatgtaaaattaaacccttttaaaatgttttcatgaagaaacaaacctgcaagtttttgtgtatgaaagcatttattgtatgcagggaaatggaagggatttccattgcagatgagacagaaatgtaacattccaatttctagaagtatttcagccatctgtgcattttaaactacaacctcttaacatattacttagcactcgcactccttcttccttctccctcatcaagttttatagttatttctaatgctgaatagtttctttctttctttctttcctttcttttccttctttcctttcttttccttcttttctttcttttctttctcatctttcttttctttctcctctttctttccttcattccttccttccttccttctctccttccttccttctctctctctctttattttttctttctttttgctttctttctctctctcttttctatcctttcttttctctccttttgctttgtctcattgacccataacctctgcttctaattcttcactttcaaatgtctttttccttttttttttaacgttattttttttcttgagatggagtctcactctatctcccaggcaggctggagtgtagtggcacaatctcaactcactgtaacctagacgcctcccaggctcaagtgattctcctgccttagcctcccaagtagctgggattacaggcacttgccaccatgcctggctaatttttgtatttttagtagagacagggtttcaccatgttgggcaagctggtcttaaactccttacctcaggtgatccacctgcctcggcctcccaaagtgctgggattacagacgtgagccatgttgccaaatgtctttttctaaatacagatataaatgtctttttctaagtacagatagttcctctgccaagaaacattttgagttgttaagataatatagttttctgccctgctacaaatgcatgaaatagagtttgtagaggatctatggtggggaaaatgatggtaaagagattacaggatgcaacagtggcaaaggaagcccagtttatttgctccttcacagctccagaaaatatacagcagtgactctgaagaccttgtttgacggcctcctacaaatagattcaactaacctgagcagtcttgtttaaaatgcagattccttgtcttaacagctagagattacaatccacctgttctttattcaatacacacacaatcaatttcgaggaccactgacaaaaggaatgtgataacagctgatatggccatgagtacactgcacttttcataaggtttttaagccctggaaagccctgatttaaacctgtgattctccagaaactcctgtgctggaggtacaacagtttggaagtatacttggggaaagagaaaacacaagatggaaggaagatctctcttttcacatcgggagcaccctcacaagaaaagaagaaaccagctgcaagtgcatccaaaagcatagaaaccacaaggaggcactatggaaaccacctgcaattaaacccaaatgatctcgagggtaggagtcaatcctgcaggatgttgtcccatgcagagcatggaaaggtgtattttttctttataattctgtttgaatggaaaacaatttagctcaatgtagaagagaagggagagtctcacataaatcaatggaattctgtgatttgaaaaatatttcccaagtgaaatagaacaatgcccagaacaactgttaaacacatttgtcactagatgagctagaatgggaattctaaattacttaattcacgagtgatgaagttttgtttacaatgactttttaaagaggggcacattataagatgctatgatgcatgtcaagattatatcacctagctttattcctagttgagccttattgctagtgtaagaattccctgcagattttgtgatgtcatattatttgacaagcaaaatttgccaaaaggtcaaaggaaggaccacaggctttctgggaagggccacagggctttggagctatagctagataattccttgggcaaaggtggacctataatcctctgtatcataccaccaataatgcacaatcagataattctggaaagaaaacaaaactcaccaaagggcaaacttgagagagcatgagccattcttacagtttactttacttttgttagggtagtgacatcttgagagtaattcttagaatgtctggtcatttgtagcattatccatatgcagaagtttgaaacggagccactcccctagaattggatctgattaaatttatacctctggtatcatcataatgtattttattctgtacacatactatgtatatatcatgtatttagccatttttacagtgatttttccaggatagaatgttttattctaaaggaaaaggcatcatttattatactgcctcttacaatatagtagaaaaacactttatatggaccatttttaaatgtcacatggaatagttagttaatttgagacatgaaatgtctcaaattatgcatattctttaaaaacattaatattctagaaataagcataatatagaagctcccagccacatcaattatagtgcctttatgtattcagagcttaatttttttattctttgtactctttaaaaaaaattttaattgacacataattgtacatggttatatggtacagagtaatattttgatacatctctacagtgtgtaatgattaaatcaatgtgtgattattaaattaacatatccatcacctcaagcgcttatcatttctttgtgatgggaacattcaaaatcccttcttctagctattggaaaacagaataaattgttgttaactgtagtcactctacagtgttgtaaaacgctagaaggtattcctcctatctacctgtaattttgtatctattaaccaaccttttcctatttctccctctctccactcacttcccaacttctggtaaacactattctactctctacttccatgacatcaactcttttggcttccacatgtaagtgagattgtgcggtatttattttttttgtgcctgcattattttacttaacataatgttctcttggctcatctagagccacaaatgacaaaaaaaaatttcattctttcattctgttttaatggttgtataagattccattgtctatttataccacattttctctatccattcatccattaatggacacataggttgattccatatcttggctattgtgaatagtactgcaataaatacaaaagtgcagatattccctcaacacattgatttccttcctttggatatacacacagttgtgagatggctggagcatacagtcattctatttttggctttttgaggaccctccatactggctgtactaatttatattcccatgaacagtgtataagagttcatttttctctacatcctcaccagcactagttattgtttgtctttttcataatagccattctaaccggggtgaagcaagatctcattgtggatttgacttgcattttcctgatgattagggaggttgagaatattttcatatgcctgttagccattcgtatgtcttcttttaagaaatgattattctgatcaattgtccatttttaaatcagattatttggttttattttgctgatgagttgtttgggttccttgtatatatattctggaaattaattaattaatagtttacaaacattgtcttccattctacaagttgtcttttcactttgttgattgttttctttgctctgcagctttctagtatgatattatttcattgttttatttttgcttttgttgcctggtgtttgaagccttatccataaagttcttgcccagctgaatgtcccaaagcatttcccctatgttttcttttagtagtttcgtagttgtgggtgttccatttaagtaattaatccattttaagttgaattttgtatatggtgagagatgggagtctagtttcattgttcttcatatggatattcagttttcccagcactatttatctattttttaaattttagattcattacatactatgtgcaggttcattgcatggatatattgcatgatgcggagactgtcccttccccaacgtatgttcttgctacttttgtcagaaatcagttgactctatatatgtgggcttattctgggtcctctcttctattccactgatctatgtgtctgtttttatgccactgccaagatatgttggttattataggcttgtagtatattttgaggtcaggtagtttgatgcttttagctttcgttttttttgtggggttttttgctcaggactctttggctatttggggtcttttgtggtttcatacaaattttaggattttttttatttgtgcagagaatgatatttctacctagatgatctgtccaatgctgagagagtggggtgttgaagtccccaactattgttgtattgggatcaatctctctctttacatctttacattaacttgatagggattgcatttaatctgtagattgctttgggtaacaaggctattttaacaatattaattcatccaattcataaacatgggatgttttttactttctgtgtcttcttcaatttatttcatcagtgttttacagttttcatcatagaaatctttgacctccttggttaaatattttctcatatatttttgaagctattgcccattggattgctttcttgatttctttttcaggtagctcactattggtatacagaaagattactgattttttgtaggttgattttgtatcttgtaactttactgaatttgtcaattcaaggaattctttgatggattctttaggtctttatatgtgattatattatctgcaagcagggagtttgactttctcctttcccatgtgaatgccttttatgtttttctcttgcctaattgctctgactcggacttctagtactaggttgaataagaatggtgaaagttagcatccttgtatcattccagttcttacagaaaaagctttcagcattcagtatagtattcatcacagttggctgcgggttcaaatgctctttctgtgtctattgtgatgatcgtatggctttcatcttttattctgttgacgtgatgtaccttgattattgttttgtctaagttgaaccatccttgcatccatgatcacttgatcatggtgtataatctttttaatatgcttttgtattcattttgctagtactttgttgaggatttttttgcatctatattcattgggggtatgagcctatagttttcttattttgttttgtccttatttggttttattatcagggtaatattggcctcatagaatgagtttggaagaattttctcccctttaatatcttggaatagtttgagaagacttggtgttatttattcttccagtatttgttagaattcagctttgaagacctccagttcttggtttctctttgttgggagactttttattactgattctatcttgttatttgttattggtctgttcaggcttttttttttttttctggtttaatcatggtaggttgtatgtatccagaaatgtatctatttcctctaggttttctaatttgttggtttatacttgtgtccgttttatagttgttgcatagttgtacagttggtgtcagttgtaatgtcttgttgttgtatagttgtatagttggtgtcagttgtaatgtcttgtcatgtagttgtatagtcggtgtcagttgtaatgtcttcttcatttctgattttgtttatttggatctcgtctccttttcttagtctagctaattgtcaattttgtttatcttttatttttaaaaacttttcattttgttcatcttttgtattttttggtctctattttgttcatttcttctctgaaacattatttctttacctttactaatttggggtttggtttttcttgctattctagtttttttttagatgcattgttaggttgtttatttgaaatctattgtttattgctataaactgccctcttagtactgtttttgctgtatcccatgggttttggtgagttgtttttctattttcatttgttccaagaattttttaaatttcctttttaaattcttcattgacccattggttattcaggagcatgttgtttaatatccatgtatttgtacagtttccaaaattcctcttgttattgatttctaattttattccattgtggtcagaaaagatatctgatatgatttcaatttttaaaaatcttttgaggcttgttttgtagcctactatatgatctattccagagaatgttccatgtactaatgagaagaatgtgtattctgcagttgtcagataaaatattctttaaacgtctgctaggtctagtgtagattaaatccaaagtttctgtgtggattttctatctagataatccgttcaatgctaagagtggggtattgaagtccctaactattttcatattgggatatctctctctctttacatagaataatatttgctttacgtatctgggtgctccagtgttgggtatttacaattgttaaatactcttgctcaattcatcttattatcaatatgtaatgaccagcactatagatgagcgagctttagggagttatttcctctcttatgttcacttttctcagctgtgaaaatgaacataaaaacctttacccctaagtttttatcagaataaaatgagataatattttaaaactgtagaaaactataaaagtatccaataagtgggtataagtattaatattaaatttgttttctttatcaataaataagaaacatttgaaaatatgttatgcattgaattaccactttctctgaaaattagcctaatttagttgctctcaaatggaggtgattttgctttcctggggattatttggcagtatctagagacattgtggttgccacaacttgaaggtcccactagcatccagtgggtagtgcccaaggatattgctgaacattctacagtgcactggacggttctctatatcaaagcatcgtctgctctgaaatctcaatagtatggacattaagaaatattggtcagattttaattttaaaaaacaaaaatgagacaactgtaaattgcataaatcgcaaggattctaacaaaaaattagagtaatcccctattactcagaagtttgggtaagacagatttgtgttaaacttacagaaggtttgagaggtaggtattataatttcaccaagaatatgctcatgcaccttgaaatgtatgttctgctagagcttaaataatgtgtttagtaattcactgcactgtaaataatactgatcttaactattagaaaactaaagagttttcagtgaaaacgttgctatttagttgtagcacatacaaatggatattttctctgcttaaaaactttctatttctcttttgtgtcagagaggactctagcatttttgagtactagaacaaaggctgtataagtatatataaataatgcaaacttttcaacacgtggctaatttccacggttgaactttctccagttcttatccaaatatcttccacatcccttctggataaaaatatcttaattcgccatgtctaaaatctgtttgtattcaagacagtcactcaagtcagaataatagaatttaaactacttgatgcacaaatgtttttcatttatagatgtaggctgttgtcaaaatagaatgggaggatgtttggcaatctatctgatgattatttaatacttaaggaatcaggctacttgacatacgtggtacctcccttctagacatttacagtccaaaattctaaggtaatgacatagcaatacacaatttgttccacccacctttaaacaaataatatgcgtaattttctttctgtttcctttggactccatgtgcctgaccctgtgccagaaaataagaggacgcttatagcagccttcctaattaatattgacatcacagcatatgtaagttttcattaaagctttgagaggtggttcagtagatgtgaaaatgcagtttcattctaggcagaagagaagttaaaaccctagaagataagaatttaaaaagataatatattgactagcagtgaatggattaaaaaacagttggaagttaaggatgaagcatccacgattcaatataagtactcattgtaaattgtaaattagctctttcaataattctggtacagaagacaattagtaatttgcaggtaaatatttaaaaagtagctcttaaaaaacaaaaacaaaaaaacaaaaccaaggaaaatatccacactactatggtctgaatgtttgtgtcctctcaaaattgatatgttaaaaccttatcaccaatgttataatgttaggaggtagggcttttgagagctaattaggtcatgagggtggcagagccctaaataaatgggattagtgccctcaattaagaggccatcgagagctgtcttgcctctcacaccatgtgaggacgtggtgacaaggtgctgtctatgcaccagaaagtgggccttcacccagtactgaatctcctatcaatctgattttcttctgcttgatcttgaacttcccaccctccagaaatatgagaaatacgtctttgttgtttgtaagctacccagtttatggtattttgttacagcagcccagacagacgaaggcattccacccggctattcattcgtttcaggttttcaatgtggaagtaactagcacagctgagacaagacatgcaacagcaatccatagtccagtatttcaactctatctgtacaatagacataagtaacccccatagcacaaataatagcaaatatagtaaaataattcagaaataatgaatttggggtacataatgcctttgtttctaatataatttttaagttgtaagtttatataatttaacatttataatggtgtttaaaccaggctcacaaatttctgaagatttagctgtcagttcttgcaagtcagtatgagctggctttagcacaccattgatgggatagtcatttcaatttcccacttaactttgatgtattgagttggaacttgatgtaaaagatgactagtagtcactgtaagtgtattaaaggtcattacgctgggagagaaacatattttttgaaattttgaccgttaaagatatagcagaaaaaacctctggaatagaagttacactatagaattggtatagcagtatttggaaagagtataaatattggaatactttacataatacaaccaagaagagattataggaaaaaagcagaatgagaaacatgattttggggactaagaaacttgtagcttgtttgtgggcttaagatttaaaagggatggttggattacaaaatcttgtgtatcttgttcaaataaagatatatgaccactgactgacaacaataaatcaatttgtacgcatttgtgcatgtgtctgtatgtgtaggggatgtgtgttttcaaatgtggcatctgtcaggccatatttgaaatgcacagtttttattaaggatcctaaaatcttctgtaaggatattttataagtagagcatgaaaaccaagtagacattttctttagattgcctgaaaatttaaggtacatttttgtctttatgccaagagaactggttactttaagagctaaaccctatattgctatggcttttatcaaaaagattccatttactatattgctctggattttcctgttcctttcttgttttcagaaaaccgcaacaaactattttttttttaagttgaataaaataaaagtagaatgcctcactttggagaggaaaagaatagctaaggtcgagcttaaaggaaaaaattacaaaaaattatgtgccacaatgaagctttgaaaatgaagcattgaacaaatgaaagaatgacagtttgcaaatcaggagtccagaagttttgttttatgattatgttgcagcttaatttctttatatctttctgccattgttaaaaaaaaaaaaagcagtcggaacttcaaagcgaccccgcatgtgttctgaatcagggcttcagagctgatgtctgacagcccagaaattaaaacgaaataaatatgccattttaactccaattttttccctaacaacaacaacaacaacaacaaaatcactttttctctatttatggtttttttgttaactttaaaattgtgttcctttggatattttctcatttaccaattatgggactgggcccttagagtgcagagttcccgtagacttcagagggaatttcaggaaacgagagtagatgttaaggcttcgcatcagcctttgtgactttttctgtactttaaaacagaccctcctctcaccccccgctggaaaaaaaaaaaaaaaacagaaaaagacaaagaaccttagtcgttaggccatacccaaacacctgcatttggctgttcttgcattttcttgggatgacggaagcagacatctccaaagaacaaagaaaggctcagggatggtttgtgtttgaaagtgtactagcgtgaatatgaaatgtcagtcactagccagaaatttggcagccatttcttggagcattgaagagagtaattagagtttgacccacagagctctgtgatgtggtggtagagatgaatctttgactaatgtagaatcataaatgcaaggggactttgatatcatctgcaataatttcttagttttacaaatgagaaagtgaggacactgtgtctcagggtggcaaagtgttttgctcaaaataatacagttagtaaagtggtgtaaaattttgatgaattctgttatgtggctaatgagatagagatagaagctattgggcttcagagagaaactattgaaacttcaggtagaagctactgggcttcagagagaaacaggcacataaagtggtgtaaaatgttgatgaattctattatgtggctaatgagatagatatagaagctattgagcttcagagagaaacgggcacacaaatgctttggatttaagtgcagcattctacccgcctatcagagccattactcccaaacacctctgccttccttatttaatcaatattcacaaacaaccaaaaagtgtacatacatagaaaacaggagtaaaggacttgctggccatgtcttcgcaaagaaaagcagagaaaagtaaagccactctgggaatatcctaagtttaatgggcttgggttctttcttttctctcccacaatgccatctcaacagtctgcacatctggcctgcagagcatcccagaatgtttatttccggaacctaagaggctttcctgagtattgctggggaagagtccacattttattgatgttagaatacattctgagagtatattgtgcccaatcagagatgatacacttcagtttcaatatgctcttagaagttctgtgaatatttgtggtagacagaaaatagtaaacatgagctgaaatgctttcaaagctcgcaaatatgaaatcatcttatgttacttaggaaagagcaaggagaaggtccaagcactgatctctccgctcagacactgtcatggtttttgcagtcagtcatgagggagaactcaggatcaagcatgggcactgcacaattgaagcatccctctggacctctggatatgaatttgaaaaaaaactgggatttttttttcagtaaatactactgtgtttatttattggttgatgtgccaagaattaggatgttgaactactctttcaaaatctcacaaataaattgaaaatagaaaagacacgtatatatgaaaaaagacagtatctgattgagcaaattctgcaagcaaaatgtctagtgatcagagccacttgtctgaacgttgtggtgggggcagcagagttcctcttgagtggtaagttagacatagatgagaggaggaggaaaagcagatggaaagaaggacacgagtgaagagatcacatttgttctccagcaaccatttgctgcttttactgtgtcctttcattggacaaagtaaataagtacatttttttcatgtattcaccttaactttgggtgttactatccccgatttattgaagaagaaagggagactcagggaaattaaaaatatgtctgagatgacactgatgaccgtgagagagatgaaattcaggcccccaaatctatgctcttatctaatacatgcaatggaaagcctattcagtgcagtcattttgacaataacggcatattggggccctgattaccaaactgagcagtttaagctcatttgtcattgggtagtttgagatagtgtgtcattagcgttgacagacattaaggtttcacaatcttgattacctattggccaaagtagtgacatcaggaggagaaaccgaggatgacggataatggataatatttaaacacattcaattaaaatcaagtcgatgtgcaaagaaatgcatttctggccatttctgattggagataagggctagaaaaggcgaacaggaagaaaaggagatttcagtctttggttcagtgataatgggtataactgtgacaatgaaaacattcactgatgaaccatgtttgcagagggagaatggagtgctgaggccagtctctgaggagtacccatgtttctcaggtggaaggaggtagaggagctggcagcttgacatgggggggatggaggggaaagggggaaatccaagaatgtgatggcactaggccaggtgagaagagtgtttcataaagcaagagagataaaactgttaataacagagtattattctagaaatattttatatagcacacttaatatatgatttttatagcttttattactcaggttaagaatagacataagaattttagacttttttcaggtgatcattaaaagttgctcctaagttaagccaccaaaataaccacagtcttactaccttttcacacttattgtctgtctctcctccactaaaagattaatatactcttgggtaatgcattcataacacagtttgaccgcatagctctacaaattgtgccacctccattgttttcaccagaaacaaaacatgaaattattctattgaatcaactagctgaaatgatgaagtatccaaagaacctgcttttccttgtagttaaatgattacggtggaattaatgagagttctcctgtttaaaaacttagttttaatcctaggggcctgaacaattgttttgtgttgagaatcacggcctctcatatttagttctctggttggttcaatagagcccaagttgcttttgtttagtaatattacatgtttcagatcccctgtgcaaatcaagtctttgcccttttaagtcgttggtaataaagaggtaattacaacatagaaaactttttgcaataaatacttgagttaatcagtaataagccacaattaatgtaaaggcctaattataaagaatagccaatgcacttcaaggaaaatttataattgtcagaaacacaaagtcagaagggcgcttatgtatcattttgcaaattatcatttccaaggagttgccccttatcgtgatacctaaactatttatttactatttttggaaggttttcttcatgttggcatgtaactgtttatacttcatcataaagctaaccaatatgatggtaaccagtttggtgttaaatgtgagtaaatagtttcctttaggactatattttgtgagagccaggacacaagtccacttaagcaatcttcctagagaagaaaaaatgttgtatcattctagaattaacaagcagttacataagtcttacaatgttaggcacttttctatgagttttgcaagtattagtatttaaatgttgggatgtgtctcccaaatctacagccacctgataaaaacaacccattgatgtaaattcattgtttcaaagaagatttcacagggattaaagggaagaagaaaagagcacttgaaagggaggtgggaggcaggggagaagcaaaagaccaggatgaaattccacctcctatacaatttcatggaagtcctagacctggaataacaatgtatactattatttatcttgttgataagcaaatcaaaatctgactgtcttttatttttgttttggtatgcttaagttgttgactactaaaaagtaataaaagttgtcaaaggctctcttctgttccatgggtctatatctctgttttggtaccagtaccatgctgttttagttactgtagccttgtagtatagtttgaagtcaggtagcatgatgcctccagctttgttcttttggcttaggattgacttggcaatgcgggctcttttttggttccatatgaactttaacgtggttttttccaattctgtgaagaaagtcattggtagcttgatggggatggcattgaatctataaattaccttgggcagtatggccattttcacaagattgattcttcctgcccattagcatggaatgttcttccatttgtttgtatcctcttttatttccttgaaaagtggtttgtagttctccttgaagaggtccttcacatcccttgtaagttggattcctaggtgttttattctctttgaagcaattgtgaatgggagttcactcatgatttggctctctgtctgttgttggtgtataagaatgcttgtgatttttacacattgattttgtatcctgagactttgctgaagttgcttatcagcttaaggagattttgggctgagacaatggggttttctagatatacaatcatgtcatctgcaaacagggacaatttgacttcctcttttcctaattgaatgccctttatttccttctcctgcctgattgccctgaccagaacttccaacactatgttgagtaggagtggtgagagagggcatccctgtcttgtgccagttttcaaagggaatgcttccagtttttgtccattcagtaagatattggctgtgggtttgtcatagatagctcttattattttgagatatgtcccatcaatacctaatttattgagcgtttttagcatgaagcgttgttgaattttgtcaaaggccttttctgcatctattgagataatcatgtggtttttgtctttggttctgtttatatgctggattacatttattgattttcgtatgttgaaccagccttgtataccagggatgaagcccacttgatcatggtggataagctttttgatgtgttgctggattcggtttgccagtattttattgaggattcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttacatgttagacctaaaaccataaaaaccgtagaagaaaacctaggcaataccattcaggacataggcatgggcaaggacttcatgtctaaaacaccaaagcaatggcaacaaaagccaaaattgacaaatgggatctaattagactaaagagcttctgcacagcaaacgaaaccaccatcagagtgaacaggcaacctacagaatgggagaaaatttttgcaacctgcttatctgacaaagggctaatatccagaatctacactgaactcaacaaatttacaagaaaaaaacaaccccatcaaaaagtgggtgaaggatatgaacagacacttctcaaaagaagacatttatgcagccaaaacacacatgaaaaaatgctcatcatcactggccatcagagaaatgcaaatcaaaaccgcaatgagataccatctcacaccagttagaatggcaatcattaaaaagtcaggaaacaacaggtgctggagaggatgtggagaaataggaacacttttacactgttggtgggactgttaactagttcaatcattgtggaagtcagtgtggcaattccttagggatctagaactagaaataccatttgacccagccatcccattactgggtatatacccaaaggactataaatcatgctgctataaagacacatgtacacgtatgtttattgcggcactattcacaatagcaaagacttggaaccaacccaaatgtccaacaatgatagactggattaagaaaatgtggcacatatgcactatggaatactatgcagccataacaaaggatgagttcatgtcctttgtagggacatggatgaagctggaaaccatcattctcagcaaactctcacaaggacaaaaaaccaaacaccgcatattctcactcataggttggaactgcataatgagaacacatggacacaggaaggggaacatcacacactggggcctgttgtggggtggggggaggggggaaggatagcattaggagatatacctaatgctaaatgacgagttaatgggtgcagcacaccaacatggcacatgtatatatatgtaacaaacctgcacgttgtgcacatgtaccctacaacttaaactataataataataattaaaaaacattaattattataaattgcttttataacaagacactgtgctaaattatcctatttttaaattctatatgttttctatataattaaacctattatttataatgtaatgatagtctaatttctttttcccaaaaaaataaaaaatgttgtgagaggatcaactcaaataacacagctagaaggaagccttcaagattttgtagtcagatgaccttcaaacctcaatgcaggtagaaggacctcagtggaaaaactcaaacctcagtagaggaacttactttaaatgcagagatttggattcaaacttggtctgggatgaggctcacaaatctgcattttaacaaacacccaggagattctgattaaccaaaggttaaactccactttaagaaatatgagttagtctgacacttatatttgacccttagagaaacaaagcaaagtccagagatgggaattggcaggtccaattatgcagtaggctatagaacctgagttagatttagttactaatatcatttgaaattattgattaattttatccaaattcagaatcagtggtgccaccctggctctgttgctgatgcttcccaaggtagactagataattttcctaagcagttaacatttttatggtaataaaaatcgacaaatgtctagagagggtttaagcagctggcagagaacgcctgggtgtctcctaagagaagtaatgtctcttcaatgaatttgaagttggaaattattaggatgagttacacaactcttttgacacatggtgataatgataaaagctttattcctttaatagtcactatgaatttcttttgtcacctattattaattaggtaattttgaacacccagttgctattattttctgaagctataatacttgtgattgggataagtgaaatgctgatggtcccactttaataaagtgctactttttttatcttatacatctatccgttaatatccagattctgaaattttaactatttttgaaaaatctaaactcacactctaaggttagagcaatagactcaacagctgcgtatccctagtgtattccagcttgactcccagtctaatgcatctgcgagcttctttggtttgaaaagtagttgcctaatctcattatagacccttgttgaaagatgtccatgacctctcagtttgaacgattctagaatggctagcatagtgcttttttatttattctggtacatacccagctattccccaaagtcctggcaactcctctttatctttgatctccccaccctgaatctgtcctctgcttacctcactctctcatcattcaattccacaatcttgtcatcttctttcagataccttaagtgtcttgaagtgtttgacctaaaatgtcaccgccttacccgaaatactctatctttaccattatgaaggttttatagcattttatataagttggatattgggcttcactcacaagtagaccatggcttaagatgaaagacctctggcataataaaggaaagactcccttttcatgtcccacacctccaacttggaaaggtaggaaaatcatgcaagataaaaacaatgatccaatacgctatggaatatgtaatgttattccccaaagaatgatagttatatggaaatctttcatggaaattggaggcagtctttattttcttttaatgatttttttaatggcaggtgggaatagacttaaaacagaacaaaaccactgtgataagtatttgaaaagaagcctttattttatccatattgacaggttgaatcatggcatttgtaaaaatggtgtaggatcttggccatgtttgtactgcggattttctgccctgatgttggagaattgcctgttttaaaaaaaaggaaggaaaaaaaaaaaactatcctaactatcctattgggcttattagatgcttatgaattttgctaaatgttatcctttcttttgcaaatattctttaagtatttctattaaatggtgatttattttaaaaatcatcaataacaaatgtataatagaagcttatatactatggaattcttaatctttaacaaacacatttagaggcatttcatatttagttaacatacaattgctgtctaatttaatctaaattaaatggttgcttgtaacttacaattcggagggttcctgaacctcgacttatggcaggaaaaataagaagtcatcagttttgcccagagggtagatacttatcttttaaaatcaggtattttggtcttgaaattaaaaaccctggtcatttgggaaatgcaattccaaggaatgtttttggcaatgagacatgtccccattttccttagaaggcagcggttttgtttttctaccatttaacaaatctgtgtaatttagctgatacttatctagcactttaaagatgaatgatcatctgtttgtgaagaatatacacattgagattcaatagtaatattttcgttgttgtttgtttgtttttttaaagaccagataacttattgtgtgtcaggtactatgctagttgaaaatatcagtttataaaaagcaactaggcattcagaaaccgtgaggatgattatggcaaatcagtgcataagctttttggcaatggtcaattataagtgttgccatggccatcataacctgagttgaattttgggagtactgccatgaattaatgctgtgctcaaagttaaaatgcaagcttagatgcaagggttagtttgaaaaggaattagttttttgaaggggtgatatatttccttttcaaactgaaaaaatagcaaaaaaatcgaagtggatcagttttaactactgtaagttgtagcttgagtaagaagaatgggttacagtcattaacgtttgaggattatttttcaggcacaactggcactgtgattgtagtactaatgcattaaatttgcacttcaatattacttggatttagccacagaagagtggcttggatgacaggcactaaagtcaactgacccaacctcttatcccaactttgtcattgattgacctttgttgcttgggcaagttaatgttcttataacttgggaagttgtgtggtgaataaatgagataatgcatttcagcacttagcatggtgcctggttatattaggtctcactaacattagtttatacaccatataagggtaatgaacacctttgcttggctcataactatgccttcattgccagcacagttccttggtcacatagtagcttcttagtaggtatctcttaattgaatggatctaccacaattattttttgagtcctcttgaatacatggtgttttagttttaccctgtgtaaaactaaatcaatgaaattttgtataagttaaatttttttagttaaatacatctttttttttccatacacctatgtaagcaagagtttgtggccagaaagacttgagcctttttcatttggtgtgttatatttatttggacttgaacttcttccccacacatctctcactcctcaccctcacccccatctttgaacatgattttctacttatattggccacaatgtcttttttaaaaacattgttcaaaaaggatactagatattctatagcagatatatcataagagcataacatttttcatgttttacttgctcttctttacttttcctcaaaaaattgctctctggtatcactatgggccttagtttcctcatccacttcttaaaacgatagaattggagtatgtaaacttgcaattatatctagatctgtaattgttaaatgaaaagctttcattaaaagtataaatactggccaagcatggtggctcacacctgtaatcccagaactctgggaggccgaggcaggaggattgcttcaggccaggagttctagaccagcctgggcaacatagtaagaccctgtccttataaaaaaaattgaaaaattagtagggtgtggtagtgggatgtaatccaagctagtcagtagactgaggtgggaggattgtttgggccctgtaattttaggttaagtgagctatgatgatgccactacactccagcctggatgacagagtgagacttcatctccaaaaaaatgtataaatactgagcatctgccatatgccagactctgtttgataaactgtgtatccattttgcagttggcctttaatgattaaatattcatttcaaacctgtgatgtagaataagtagtatttaattttatttataggtaatataactgaggttcaaatagagtttataataactcatatctaatagaagtatcagaattatgtataaaactgtggcacagagtaggtattttgtaaataatagttgatttgtagttggatcgtagatggatggagggatgggtgaatggatggatggatggattgatggataactaaagttccagtcaatcattcttgccatttattttctcaggaatttctgaggatcaattttgtcttacaaaaaataatggcattgaagtattctgttgtttcagactttttttaggatacaatttattcatttgctttcaaaaggtgctgagaatataaacttacctcctggagcatcactgactagaagagtaaaaggatttttactgtgattgaaaatgctttctttaaaacatatgcagtatttatagggctgcttggaataagccaattgaaagatttaatggtaataatctccatatttcttataaaattgatttccggattcagtgaacttggaaagagtcctgggacatcaaataagtaaaatcttaacatgaaatgaatcttcagaatatgttcataaatttacattttaaacataaccagataatatatatctttacccgttattaaggtgatactttaatgaaaatttttcatttgcatgaaataaacctttttggctacagatgaaaggactttatggtagcgacaatggttctgtgagttaaatgatcccaacatcatcaggaatgaatcacaagtgcctaccatatgaattacagcaccatgagtcttaaaaaggtatttctgtggaaagcattcctcccatctgcaacaatcagattctgctttgaagtcctgctggagagcctcacaatacatgagactgccacatgctacccgaatttctctctctacttgagcctgactgcattttcctaaagaataacatggtaacttaatgaccagggggtttagagagggaggaaaatggctacagtttttataattagacttccctggatgtgcattcttcagtaatactttttggatataactacagaaggtagtccaatggatgagaaaaatttaatttcaaatgaaaatagggcaacaatgtgtgactcctttggtccctactatattaaatgtgtggtgaagtcttcataaacatttcaggcccaaatgtaattgacatgttaataaatgagtaaattggtagtgagactttttagccatagaagagttacaaattaatacaaatcatcatgagataggtgtcagtgagtatttcaaaagctttcactcctgcttatcttgatgccagtgcctctgctgctgaatggcagagtgaggatggaggttgccagaatcatttttgttgtttctttttttaactagaggctttcctcaatagaaagaaaataatagttggggggagacttgtcatgaatgggagactggcatcagcaacgtcaacaaatgtttaagtagaagtaaaatgacttatccaatagatcacaatgtgtcaccatttctttattaaccaaacgaatcatgatcgaggtatctttctctgagaattggctgctgattctagagtctgttctattttactacagggaggcaggatagcaatagtaactaaattgtaggttggagagaattccctgttcaacctactacagcattaactcagttttggcctccatagagacttccaattccatttgcaattttgtaatagaaacagattttgtgggagaatctctcatttctctgagcttctatcaaaacattaggttattcaaaataggcattgctaaatatacatgggttctaaaagaaaaaagtttatacagttctgactgtactttgttctccttttggctttatgtgctttaggttctagcccatgctctggtgaaacagataagttagcaataaaaagagcaaggcttcttccaaccctaataatacataataacactagaataagataaacactaacatacattggtcactttgattatacactaggctattatttgctatcttgtatattaaactaaaaacctaaagcacacttaaatatctaaaaacagaattgcttggtgcatgggtacattttaaatgatattgtagagaacatgaaaaatgtatccactatttgatatttgtaaatgtatttttaaaaaaccagaatgattttgttttatttagaaaatacaacaagaagcatgaaatacacaaaggtagaattggctatttctggtcgatggaactatgtatttattattatttataattatttgatgatgatcatttattttatttatttatcaaataaaagataacactttatatgatatatcacaacatagagcctgtttattattatactatttatttattattttctatcatcttccaaatttcttacaacgagaatgcaataattttggttttttaatatagttttttttaatgaaaattaaaataaagctagttaaggttgtttcctttcactaccactattctctgggaactatttggaaatgttagagagaagcatttgagacatgtcaccttgaaggatgaatccttttgtgtcatctgacttggttattaaatacgtatataaggcttaatctttgagccttcttagagcaacttttcatttcaaacaacttctaaactagagaaaatactgacacaatatgatttcttagcagaaaccaacccctataaagtatcaggaaatcaaattgaaattgataatttgaaaccattaccatattgatagcttatttaattctatttttataatcaaaaatattaaatttgtttctactaaattaatggaaccaaacagaggatttcattctgaaaaggcccttctaattctctttctcagtggtttcaaggtcatggtaattaccagttcagctccacttggtcatcaaaagaaatgatttgttacaatgtagaatccttctcatgcttataatttaatgctgatagacaatttttaaaacaaccaggctacatgtaggattctttagtagtagatgtggtgtttgattaatgcctcattctaaaatatttcctaaaataaaagcttaagttaccaaatctcttttaaaaagtatctgacacggctgggcatggtagcttacgcctgtaattccagcactttgggaggcaaaggctggtggatcacgaggtcaagagatcgagactatcctggccaaccaacatggtgaaaccgcgtctctactaaaaatacaaaaattagctgggtgtggtggtgcacgcctgtagtccagctactcgggaggctgaggcaggagaattgcttgaacccgggaggtggaggttgcagtgagctgagatcacgccactgcactctagcccaggtgacacagcaagacgccgcctcaaaaaaaaaaatatctgaaacaatatgatttcttagcagaaaccaacacctataaagtatacagattcttttgtagtcaatacaggtaatagggatgtctgtcaaggctgatttttagtcagtgcatcccaatatgaacctgtacatgtggctgctccgaggcatccaagctcctccctcagctctgcactcaattaggaaactgatgccctatgtggttgttgagaaccccgttccatctctatgtccagtgattgcttgagcctacaaggtaccatggtataggaacacgttttccacttaatcacttagcccatcagccctcacactcaaaacactcaaccccgcttgaggaaggtctgtgctaaaatttttcaactctgaaggtgttattaagtttactgtcaaatgtaggatgagcttttgtgtctttaatgaagctagaagtaaatatgattacatgaaacttgcaatcatgcctactaaaattgttatatatgctctaatctaacacacacatacacacaaacacacacacacacacgtacacatgccactgaaacctttaatatgtcctgaaaaataataccttcacctgggtagccacactcggctggcatttttaatgtttctaatatgtacagtaacagtggacacagcagaattcaggataataaaattaaaaaaaaatactgaattgcttattttgatttgaagaaagggcatgggccttgtagaactttccttacatcacttgaatgttttgtgcatgcataacttagagttcagctgcctcagtctctgactgcagagatcacatgggtaacatgtgaatggaaataaaccctgtaggtaaaagaaagaggaatttggatagagatcaaagattaacttcattccactctttccttccactttttactatcccatctaaatttggcattttatgggactttttttcattgccagaggaaagagtgaacttaaaccagatttggatcgctctgtctctttctttctttaatccagtgatttggtttgttcagtagtgactttagataattgaattctcagttactagaaattattagtaagatttctggcttgatttattatatcttttaaaattataactgtagccctggtttaggttacagaaaaagcggtctagaatatttaataatatgattaacagaaatgtgtccttacctattaggttttttacataaattttctagaatggtactaattactatgtgctattaatcttggctcagggaaagaacatttctaagcattagggatcaaaattttgcgttacttcttttctgaatgtttatcattctttttattgtcatcccggtaataaggtagtttagtgtggacagcctcattcctaagtggcctgggtaaaagattcttatcggcatcataatgaggtccataggaattgagaaaaactaaaatgcttgataacagtttttaactaatttttaaatcctttttaaatgtatttttgtcaagaattttaaaacgtgataattgtaaagtgactaatttgacttccatccaaatagtagttaagtggttaaaatcaacattaaagtgcttcaagatattgaggagattcactcatcctgttcatggtgaacatcaagtgctagaccagaagggaaaatctaggcagttgtttaccaagtggattattttaatgcattaccgggattaatgtattattttattgttcaaaatagaagcaacctaatttagtttcaggctctcattatctgatgattttataggctttcattaaattctagtgaatacatcctgagaatttattttcttttcaaactaaagactatgacaattaaaagatcattggttgccaggagttgaggggcagagagggaggatgaataggtaaatcacaggaaattttcagggcagtcattgattctgtctgatagtataatggtggatgcgtgacattatgcatttgtcaaaacccacagaatgtacaacacaaagtgtgaacctcaactatactttagttaataataatgcatcggtactggcttatcaatcataacaaatgtaccaaaatgatgcaaaatgttaatatggaaagaaagagactggatatggaacttgctgtacttcctgctcagtttttctgtaaatacaaaactgctctaaaaaataaaatctatgaattatgaaaaattcaattgatttaaaaattaaaattttttgctgtaagttcacaaagcatataaaaaatgaaatgttctactgaaacacgtgttttcatttatttttatttaccgtaccttttggcaattgcccctgaaattggacaggtcggatgccatgataattttttctaaatgttgaatgagaaacattcaaatttggcaatatgagacattacatattcttaaacacttttatgtgaaagtatctcaaaatgctgaattaaatattaaaatcatccttttaaatttgtggttgacttccaaaagatagaaaaaggagagtaaatcctgaagttgttgactaccctgggggcatctataccaaaatctccaatcggtcggagttggaacattaataatctactgcatattgcaaaagagggtcagaggcttgggcctaagaaggggagggaatttaactggagaccagaataaagaaagaatgacaaatggccaacactttggaagagaataaataggagaaaagaaaatactcctaaataaaacatcatatctatcttagcttttgccaccaataaagggaatttccgaaagaaagtttcagagaaagagagagaaagaacgtaagagagaaagagaaaaagaagaaagaaagatagaaagaaagaaggaaggaaggaaggaaggaaaaaaagaaagaaagaaagaaagaaagaaagaaaggatgtcctgactttcttctccatgagaatttgtaataaagttttaaggtccatatttataatatacatgtgcaaacaaaaacagcaaactccacaaccagtcttgccatataagaatttaaaataggtcctagaaggtagtgtcccagatatccagcaaaagcaaacaatatcacacttgagccagacttgaatgacagataccatattcaaccccagtgtcttagttcaggctgctgtatcaaaatacgatagactgatagcttataaacaacagaaatttatttctcacagttctggttactgtaagtctgagatcagcttgccagcatggtcaggttctggtcagggccttctggaataaagactgccaagtaaagacttggacccttagaaggcaacaagagaactagaggactctgggtcctttttgttaagggtacaaatctaatttacgaggactctacctaatctggattaaagagtgccaacttctccttggatccttagaaggcaacaagagagctagaggactctctctggggtcccttttgtaagggtactgatctcattcatgaagactctacataattatcaaaggctgcctctcaaaaacatcacattggaggttagaatttccatatataaattttggggtgtagtcacattcagtccattgcaccaagcttcaaatatttttcacatataaagttacaatgaatacaagctcaaagtactccacaaattaaataaattaataaaagtttttaaaaaggggataattaaggcagcatgaacatgaatcagcagaaacaacagagagcaaactaaaccaaaagatttcaaatgtcagttacagaatataaaataattatgctgaaagaaataaaagaagaaataaaaacataaacaaggagttaagaaagtatcataatgaccaataagtcacgaaatagaacaaaattggaattctagagttaaataatacaatcacagaaatgaaaatatcactaaagatgtgatgtagcagattagagatgtctgaagagggaaagtctggaagacagctctgattcaaaaatatacgtaatgcaggacagagagagatggaaaatatgaaagagaacttagatcaaggaaatatttacagacaatgtccacctacatctatgtggaacttcaaaataatgtaatagagtaaacaaacattttatttcagcaaatttaaacaatgaaataaaagaaggaaacgcctgtaaaaatataacttaggacgatatagaaagcaggtgtagtgatataatccctttaaaaattcaatcaatactaaaaatattcttcaaagtgaacacaagaccctaatggtttcatacgagatttgtccccaacattctggcatcagataataaaaacagagggtcccaaccacatcaaaattcattatggccaatacaggaatggaaaagtacagattaaccccattcatgaacatactcaaaaaaatcttaaagcattagcaaaacaaatccaggtgtgtactaaaaagataatacattatgaccaagcttattttacttcctaaatgcaatgatggcttcatatttgaaatattaattaatgtaactaacagcactgtgaaattatggggaaaagtctatctgtgtaaagaaataattagattaaattacatttgtaatgaaatctctaagttaaattagaaatagaaaactcccctcttacactgaatgaaaacacaataagatgccatttttttgccacccacttggcaaaccataccaaatgttggcaaggatgtgacttaactggaattcttacatatactgtttctgagggtggggcttggtaatagccctttggaaataatctggcattatttagcagatttttaagactcaacaattctgtttcacatgtgcatatgtgcaccagaagacccgtgtaagaatgttcatggcgacgttatttgtaacgacaaaaaaactggaatttggtgataacaagaaaaccaactctctgccaatagaagaatgggtaacctctgttgacatataatggcctactagacagcaaaaaaactatagctacagggatcaacaaagatgagctaacaaaatacatgaaaatagcaagttgcaaaagtgtaaaaccatttttataaagttgaaaaacaaggaaatttagaaaaggaaagcaatggaattataaactcaggatcctgatctcccacaaggaggaggatagctactgtcagagaaaggcacatgggggttgaaaaagtgttgctaacttaattttccttaagttggaaggtaaaaaagcagatatttgtcatattattgtattttataactcgtatagatgttattcatattttgcatttatcaaatgtttcataataaaataatgcttataaaatctaatgtaatagattttacattacattagataatgtaaatattatattagataatgtaaatttgtaatatatagcaatttggggcatagaaaactttctataataaaggccattgatagcgacaggaagcatatggtaagcaaatggaagagtttaccttgttaacacctgctgaagagtattcagtttttttatccagatacatacagaccatgttatgaaaagcagccctgtgcactggtgaagagctagattggtgccagtcttggttgtgatacttcttagctgtgggatcttgggctttgggtcccttatctgtaaaatagagataataataggacctaatccataaagttattttaagtattggatgagttagcacacagaaaatgcttagtaatgacttactcaaaatacatgctcaatgttagattctagtgatcactttctcttgatttaatactttgaaatgttctgtttgtattatggtaggttttggtcatttgacgaagcaattgatgacattggctgatggacgtgtggtgttggctctagaaggaggacatgatctcacagccatctgtgatgcatcagaagcctgtgtaaatgcccttctaggaaatgaggtaaaaaagtaaaagtacaaaggggcaggggtaaagaatcagggatgtatgcatgcatatttttaaactaaaaaaaaattctgcatactcagaaagcttaacattgctcttaccattaagaaagaaggtaagccttagataagtttacatgttctcgtatactacaatgttatcccaggtacagaatccacatagcactcactcccttcaatcaggttagccatggagctcaaaaataagaacattttgtctactgacccaaccaatgagtacggaaacattgaataagaaataaaactttaaaaaatgtctggaggtttcttgtagggttatgttatttctgggaaaaaaaaactgttttaaaaattggtaaactatttttgtcaccatttaagaattctttatgctaagaggtaggtatttccatcttacagatggtgagaatgagtctcaaaaatgttgagaaatccatccaaagtcatgcagtcagaatgcattataagatccaagacatgaacatgaatctaaatggccaaagaccattatattttctttcacatcacatggctacattgcaacatactttctgactactctgcagaattcagatccaattgctatgaggttcacttccagctcatggcaacattttcaaccaattagttgcaattcagcaaatatttcaaagtttctatgtattcattaatattatccattaatctattttctatagtgattatacagtagtgttaagactatcatatgcattttgcctttcttttatgaatttgcaatatgattttgcttattagataaacatatacaaaatctttttaaaaatctatcattcatatcatttttttaactgtaatgcatgcctttgcctgtagtattttataaaacaaaatgtaccttttcttctgcacatagaacacatagttactattgtcatcattattttacaaacctgtaatgtttccatatgattatttttcatatatattgaagtaaaaatgtatgttgttaatttgaagaaaaaatatgagagagaaaacttaagcattgctcaagtactttgctcttgttaatttttttttttttttttttttttttctgagatagagtctcgctctgtcgcccaggctggagtgcagtggcgcgatctcggctcactgcaacctccgccacccgggttgaagtgattcccctgcctcagccacccaagtagctgggattacaggtgtgcaccatcacgcccagctaatttttgtatttttagtagagacggggtttcaccatgttggctaggctggtctcgaactcctgacctcgtgatctgcccgcctcggcctcccaaagtgctggaattacaggcctgaaccaccgtgcctggctgtcttgttaattttagacagcacagtaactcaaaggatgtaattatctaatgattagtgtcaacaaagtgctgctgtttcagatcacgcacaattcaacgtgtgtaaaattttctaaaatgttagtgtctttctgtgatccctgtacaccaataatgtcaaacaggatgttgagtgtttttttgtggcagtaagggagtgcaagaaataaatgctatttttattttataagttgatgttggggtgcttctttgtcccctagataacattttttgcatagtcacctgtattctgaaatcacttatttgattttaattatagaaatatgttacagaagcataataatattaatatttgcattataaaggcttacaccagatgtgcagacaatcagaataggttgtggatctgtagctccatggataattgacctagccagaaagaaatgttacctgattgcaaaagccaactacttttcttcctatgtggaaggaaatcagggattttactggctttctttgaacacatgcattcaaatgtctctatactcataatcttttgctcttaacccaacatttccaatgaggatggagtgatctcccctatgatctctttctttaagaaatgattatgtttcagaacagattcaactgtgtggagttacatgtttttcttaatttatctgtgtttactgtaaagcaaagtgtgttttgtaccttgctgccattctatgaccttttgactgggagaactctggccattttagtacacgtgcttttcgtggagatgaaatacactgcttttgtagagcaattagtgactttaaaattgatggcatgagccgagatcccgccactgcactccagcctgggcgacagagcgagactccgtctcaaaaaaaaaaaaaaaaaaaaaaaattgatggcaatatgagagattacatattcttaaatattcctatatgaaagtatctcgctggccgggcgcggtgtctcacgcctgtaatcgcagcactttgggaggccgaggcgggtggatcacgaggtcatgagatcaagaccatcctggctaacactgtgaaaccctgtctctactaaaaatacaaaaaattagcggggcgtgttggcaggcgcctgtagtcccagctactccggagcctgagtcaggagaatggcatgaacccgagaggtggagcttgcagtgagccgagatggcaccactgcattccagcctgggcgacagaggcgagactccgtctcaaaaaaaataataataaaaaaaaatctcaaaatgctgaattaaatattaaaaccacccttttaaatttatgaatgacttccaaaaagatagaaaaaggagagtgaatactgcaactgttggctaccttggaggcatctgtttgaaaatcaccaactggtcagagtttgaacattaataatctactgcatattgcaaaagatagtcaaagccttgggcctaagaaggaaagggaatttaattggagaccagaacgcagaaagaatgacaatgatgtcacctgatttaaagtgtgagacctgtgccttttctctatatgtttagaaagaccaggcttgagaaagagaaaggaataaaggtattgctggacaatattaaacctgaccatgtgagtgtttagattgctaaaatttccagtaagtgctaactgaaatgattatttttggctatattgactattgaacttactaattaatatgtatgtcttatggtaaatttgagttagttattatgatgccctaaataccagcttgtcccttttggttggtggtcttcagttgcataagcacaacctaaaattttttcaatataaactaaaggaagggaggtttaaataatgtatgcttttctatattttttgcattaaactttcttgggaacataaataagaatatagaattcctagcagatactttaagggtaacaatgaatatgggattattgaatttttgaaaggtaaattttgttgtgtcaggtctatcagtatatggaagaacaaagttaagaaaaagaaagattattaaaagtgaaaaattaaagaaaaatacaaatgtgttgtacattataattcatttggaaaaaggaaatgaaaatataatacataaaacacattaaagaatggagagttcttctcactttcattgacaatataatttataatccaaggcctggttttctgtatttttttccaggtcaaagatcattatgactacactgaagttttaaattttattcttttagaaaagtaatatataaggcgtattacatgtacttcaccattttttaaaaagtgcatatatgtagttttcacagtagttttatatggtaagctgtaggtaaaaaaatacaaaaggatgtctttcagattgcgatttcaaatcccagtttccctccaaaccctttattcagtgattaatagagcaattagaactcattatctgggatttcacttttacaaataacaaaatgtagtaaagcttgaacttaaaacattggcagaacccgctttagtttctcaacactgaacttgcaattgaactcccattagaaaggtcaagaggggcctttctgagggcctctgctctttgtcagatgtatttattcatgtgcagaggattagaattcataaacattttgccagttttttgaatgctatttctttcccttgttgtttttggccaggccatgtcaatacagcaaaattttgcttcttagggcttatgatcagcagaataatatgtattacataacccaaagtaattataaaatcagcaggaaccgttagctgtgcatctgtgtagacacatagaggggtaccaaaaaacttgatttttaaaaattttagttatctgagtgttgcacccaaaacatgcattttcttctttttaaatatctttatcatgaaaatgatctacttagcaaaacatctcttaactattcttttcagaaatatgtacaaggtcagtcaaaatagtatactattggattaaaactaatttgagcatggtacaggaaattcctggaggcaactgatattgaagacataccagaagtccatttttttctttttcttggcaaagtttagaacttagatttatcagtccaatcagtgcatgatgaatatttttgatctttttcaatgaagcacttagaaacaccagcttggggtttgcaagaaattgaagtgaatatttaaatgagaagaatcattaagttgcttggaaaggcattagggatacttgtgtcaataaccacatagtttttagaattcataatagaaacatctgtgaggttcccagaaaatctgattttggtaatctgtatttgagctgattggcaaacagtgtcacagttgctttaaggccaaatttgcctactgttatgcaaagccaattagtggcaccccgggttacttcctctgaaagaaattttcccaagaggtgagaaaagctttaagcagttgccattcctatggaatctaaaacaaaaacattgaaaaacttcaagcaagtcaaagaaaggagaggacatgtagtagtagaagccttgggtagtgagttgagaacatggccattagaagatcacctgtcaataccgaataaatgatgatttctaagcttgttagaggaaaaaagcaaaacaaattgtcataggtctggaagctgttgagattatggtaaatcctctagtactgcaagttcagcatttacacttggagcatatagcatgttttgatttccctcactctttttaaaatttggattctgatttctttttttgtctcttcttttttttttcttttctttccctccctgcctccctcccgttattcttcacttcctcactcccttcaaccctctctccctttctccctccctctctccagtttctttttaataactgctatctcctgttgagtatgctcagctgcttctatttgacttgaatttcacaaacagtggctaaacttagtgattgtgttggttgataatcttttaaagatgacgttttgctctaaagctgctgaaacagtctcttgaattgactctagtaagtgttgacaaccacccctgaggtgaactcttgagatgttgttgtccaagttgctcatcaggggtttgttttcattggattccgaatagggaagttgttttgccatctttttcatcctttagattatgtatggctgaagcttagtccattggggaattggtgtgaatctgggaaagcttacaagctcctaaatagttgccattcatgagtaaaggaaggaggaactgaatacagggacaatgtatgatatgtcagaatagtgtttttctatggttttcttttaaactttgaaggctctccatactctgaaagagaatgtgtgggtaatctaaagagaataaaactgtttggggaaaatattatttgaagatacttttcagtgtagatgtggcctgtgatgttgcatttcttatattcaacaaggcagagccaaattggttgtggatttatttttgtttatatcttttatcaaatgccaaatgaagtggacgttgtttggataattcaaaactccattatataaattttctatatagtctttaggtttttcagagggtgttaaggagaatatgggccagggacctggatatttcacaggttgtggtaaccaataaaagaaagaaagcagttctttgccatggtgaaacaaacatgaaatgacattcatttatctgaccattcattagtcttttattgggcatgtattttgtgcccaaaagtttcaatataagtaaaagtaaaacaaagtgctttgggaatataacataaaaccattgtttttaactacagagatcgaggaatattttaacatttaattggtcttgaataaaaaaatcagactaatatgagctaatgtctaaggaaaagattatcatgtaatgggaaagcatagataaagacattaagacttcttggaattgtggatggctctgtttggatttgttcgttttgtttttggtagaggagaggtatgttgagtagaataaaagtatatactggggctgaatctgggtaatggaatatcataaggaattagaatttctgtgaaaaaatatggaagctttgaataaatgaatcccaagctttggtgtaaaacaacaacagcaacaaaacagcattttgtttgtttgtttgttttggagatggcagaagcttgtagaagaaaacaaagcttactatgaaaataactattagcaattttcccagataatcaataaacaaaattatactctaaccacaatatgctggaactgactgtaaatgacttgtgaaagccaattgtgtgtatctctgcttaaatctaagtttaataacatcacgttagtagcttgaaataggccatggtgggaatatttacaccacagaaatcagcaaatactacaaattaggactactacttggacagttagcagttcaacatttaccggcacaccactgctacataatgtgaaacaggtcttgttagcagaaaagtcaacacttggaaaagagtatcatacaaaatctctttaataaaataaaaaaaattaaagaaaatattgaaaaatataaaattagcagattaaaggaagaagagattaaaaaagcaaataaagagaatactaaggcacacaaagtgaaacaggacttaacaaatttgactgtcaaatttaaacttacttgcagaaacaggggcaagtaaacaagatttttggcatttaatgtgagccaagccttcttcataacaattgatatccagactacagacattatgttggaaaactacacatacagccctgaacgaacttcccttcaatgttgttagaactttagtttgacatgcacttttcaacatatgtagtattttcctaactctactgtgtggttctaactgttttctcattatgttgtatatctacaaacttaccttaatgattaaacaagaatatcaataatctgaatcatccaacaaattgtatttattatcctctttccaattgaccgctatgccttcttccatttatttttaggtttatttttaattacttagttggtgactgccatagatgtttaaatatatcatgtgcaaactgtccatggttaagcatcatggaaattatgggatactatttgggtttgatatggaacagaggcatcttctcatagtcttcctcctttcattcattggctgatgtattgtttaacctacatttctctaagccatagtagttttggacaaaactcagttaatagaacaataactacagtaataatctcggagtctgactcactggtccctcttaccttattcaaggaattcctgcaatatctcatgtgagctgatgaccatgactgttccctttacctcttggtcttcctgttactctcataagacttatgtcactgctattgaccagagatatttctttattgctgtgttgatatcaccctatgtcatccacatgtaggtaggatgcaggcagacgcaatctgaataatttcaatagtttgtcagtgtagtaacttgattgtcaatacaatcaccctgattctgatatttcccccaatctatttggtcaagaattttaatgacttcaaacaaataaaataggttatttcaagaatgactcatgaatcacaatttggataaaattataaccagatttacttacacaatcaaattaaacatacacaactaattgcagacttctctaagacaattattcaaatgagagttgagtttccaccaccaatccctcctcactagggaattgataatagttcattagcatggagagtcaggtcttcattacaatctgcttcccttgtcctcttggtcttgattatcatattcttccaacgttccacaatatctttgactctgacaactgaaccctttctgcattttgtctgagtcgctttgcatgttgcagggggactttcagctttctttgtaagtaaatttgtggccttgtacctaagaatataacatgttgctcttatgcaaaatatataatctcactttgtttcctggaaggacagtaatacagtggaaagaacatgaactcaagatctagactttgtttccctattctcttacatcacagtgcttttaattttttttggatttttaatttttgctacactgtttttaattgtaaaatataacaattatacagaaaactgcaaaacacaaatgtacaactcaatgaaatatcacagagatcacatatgtaatgatcaaccaagagatagagtaatgtcagctctatctctatgaaaagcccccacattccttttctaactagtatcccctttctcttttctgaaagtaaccaattttctgatgtctaagactatattttaatttgtagctttatatccatgaaatcatacaatatataattcttactcattttgcttaagagatttatccatgttattgcagctagctatatttgattcatttccattcacatatagtattccattctataaaaataacttttagggaaatgtcacagtttatttacatattctgcttttgacagataaagggaatttttccagtttgggggctattgtatctaatgttgtgatggacattttatatgtgtttcttggtgcacttgtaccgacatttttgttgaatatatttctacaagtggtattgctgaatcctgaaatatgcatgtgtttaaatgtgttttccatagtggcagttacaatttgtactcctaccagtggcatacaagtgtttacacagttctgtatccttctaatactccatattgtcagtcttttaaaatcttagccattctgttggaggtgtagtagtatatcaccatggttttgatttgcccagacgctaatgcggtaaagcagttcttcatctatttattgatcatttgtacatactgtttttgaagtatctattcaaaactttggtccaccttcatattgtctttttccttactgatttagcaattctttataggttctagtgttagtttcatgtgttgaaatatcttgtcttttcaccgtcttaaaggtgacctttgataattgaaagtaactttttaatgtggtataatttatcaatcttttcctgtaggattggttctttttgtaatctgtttaagtattctttctggattcccaaagtcaagaaaagattatttttattctttccttcctcttttctgaaaggtttattttttgacttcaacatttagatgcatagttcatctggcattgaatatgtatatggcataatatagaggtcaggtttgtttgtttcaatgtgaatatacagttgatcaagtaccacttatagaaaagaccatccattcagccaggcacagtggctcatgcctgtaatcccagcactttgggaggccaaggtgggcgaatcacgaggtcagaagtttgagaccatcctaaccaacatggtgaaaccccatctctactaaaaatacaaaaattagctgggcgtggtggtgcgcacctgtattcccagctactcaggaggctgaggctggagaatcggttgaacccaggaggcagaggttgcattgagccgagatagcaccactgcactccagcctgggtgatagtacaagactccgtctcaaaaaaaaaaaaaaaaaaaaaaaaaaaaaaaaaaaaaagaccatccattcattatggctcagtagtgttaactttatccatgtatacatggagagtctattctatttcacaggtttctctctttttatgtgatattatcagactgtcttaactactgtagttttataaaacgtcttgatatctgctagaacaaatctttctgtttgtttttcttcttcaagacagtcttggctacatttggccccactgcatttttatataaaattttagaatcagcttgggtggttgtacaaatcacatataagtggatataaatggatttagttcaccaattaagacaaaggtgataacattgtaataacagatgctctttgaagggaagctttctgtaatataattataaggaaactttgaatgaaggaaatgaaaaaaaatttatccacaagaactaactgaaggaaaattcatgtgaccatattaatatcagataaaaatggactttaaggcaagaaaaaagagaaaatagagatcaaaagaggtgtttcatactgataaaatattctatgaaccaagaagataaaacaattcaaactttttgtgtctaagacagcatgaaaacatattaagtatacatggaaagaaccaaatgaaaaaattggcaaaaccacaatcatcataacaaattttagtacacgtctctcagtaactgataaaccatgaagaaaataaaagtgaagggtgatgtggaagatttaaacacttgataaacttgctataatttaaatatataatggagtatatatcccctaacatgacagaatatcattcttttcaaggacattcttaacatttttaaaaatagaccgtatatggagcataaagcaagtttcaataaatttgaactaattgaattcatacatagtataatttcttaccacagtgaggtaattagaaaatcgtatatattttgagatttcaaatatactctaattcatgtgtccaaagaaatcacagtgaaatactagaaagtattctgaaataaagcattatgaaaatataacatgtgaaaacttgtgtgatatataaagctgaacttagagaaacatatgcttttaaatgtatatattagaaaagaagaaaacttaaaattaatgtttaaaagcatatatctcattagagaatcaaagcagcaaattaaatgcaaagaaaccaaagaagatataaataaaatgataaaatagaaaacaagcatatatgtaagatttttaaagtcagaggttgattctttgaaataagtagtaaaattgatcgaactctagtaagactgaccaacaaagaaaaagcatgcatgcccagcactgggaaagaaaaggagacttcactacagattttaatgttattaaaaggatgacaagaaaatattaaaataaactttacgtaaacatttcaaaaacttatgaaatggaatatattaaatggaaaaattataataaaaatgcaaccttgcaagactgaataaaaatacagcaaatgtgagtggttctttaattacttacaaaactgggtttttaaaactaaatttaccaggagaaaacacaaaacccatatagcttcaccaggaaattctaccaggaatttaaggaaaaaataacaccaatcacaaattgttttagaataaaggaatggatggtaggaagaatccatcacaaataattttttgaggcctatgtgataccaataccaaaaacttaacagaatatcacaagaaaggaatattataagagaatatttctcatagtcatagtagttaaaaccctaaataaaatattagcagttcatcaagatcttaaatgttcataaaaattgggtttactctagaaatataacatatcaactttccaaactaattcattataattcatcacattaagacaatgaggaagaaatatatttcaataaatgttttaaaagcagctgataaactacccaatcataatgaacaatttttacaaatagaaataaaaaatgtttattaacttgataaaggatagctacaaaataaattccacagtatacatcaggtttaaaggggaaatatagaaattattcttttaaatcgaaaacaagacgaagatactcttactgcttcatttcagcattgttcagggaatcctagacagtgcgatattgtaaaaaaaagaaaaagatatcagtattggagaaaaataaataaatctttcactatttacagatgatttgtaattgagtatgaagaaaatctattaaaagatgttcatttaaattatgaattaatatgtaaatttaacaaagtgggtagttaattaaaaatcagtgaaaatttaaaactcacttaaaaggtttagtaaaaattaattatatatctatataactgtcataactgtagaaaataaaagtttaagaatacactggttttatgtaaccagttatcgttaagggaaactgggtgaagagtacatgggaattttgtacaatgtttgaaactttctataaatataaaattacttcaaaaaacattttaataatgagtttatttcacacacacatttttgtatccccaccatttccgtgtctgaccactactatactatatcctatcataacattccatacatacttaaaaccaagcaaagggtggagttccatcttagaaaactgaacagacattttggacaacacattcttggcaatggaacctggacaacatttatcagatatggtatgtaaatttctcactctgcattacaaaaagacaggtggatatcaaatgatagagaaatgaaataagacagaaattttctaacaagctgtttaaactattaaggagacttcttgctccactgccagagatcttgaatagcctcttggtcagtcattaggaagcagttcttcacataattgatgaaattggtttccaatttgggaagagaaccacctttttgtgtacttgcttgcatttttgctttaatgttttctacagaactaggtccttttagcgttttgggagggttttttttctgttttttgaaggattcttgaccttttgggtcttgatgttgatggttttgagtctttttcagtctggtttgatttttgtgcaattttggctggagtatcttatatagatttcttcactgagctttttcttcatcttcctcacccttgtcatcgtcatcttcattgtcatcatcattatcttcattagcagcaagtttttactttttttctgtggaacctcactaccacctctagaggcagctcgctttccagatatacttaagagctttgcatcctcctcctcttcatcttctcactgtgcatcttcctccacagctgttaagtgctgcccattaatatgcactggccctgaactatgcttcaaccataagaccataggtggtggtatttcaaagcccacaaaggaaactgttggctgtacagacattttcaaagttgccagtgttacttttatttggactgcgtttatatttcattgcttctgcttcaacgatgtgcaattcatcataggtaccagctcctgaactggccattcttaaagaaaactggtgctcattttcatcatcatccacattaaagtgataatatttgtcagctttagttcacaattaaaaagttaattttgaggccttagagggctcatgtccacgtccatcaaatcttctatgggtttgtggcacccactgtggtgggagagaaggcgaatggagataaatgactcctactccagagaacaaacacacaggacagaatcacaccaggattgaaaattttttaattaaattataaatatacgtattttatatatatagtgtaaatatatacacatacataatttacaaaagcattaaacaaaccaaatacctagaataaatctatctgaaaatatgaccctattcataaaattgtagaatatttttagagaagttaacaaacatctaaataaattatagaatacattatgttatggattagaggtctaggtattgagatgatcccagttctcctcaaattggattaaagattaatttcaatgcctttcaaaatttcattccattttattgtcattctattgctttttcttccgctcaattggaagcaaccttttctcctctaattattggcatggccattctgcctctacttgccctgggtctttgtttcttttgcatttccctgcatttctgatctatagaaatatctgcctgcatgtcaggaaaccttgccaatgcataggagaaaataattgtgtggaaattatgcaagagcagttcaccttagaaaacaaaatgagttatcactgctgttctaattcttcatcttaaaaccatatcctgattacagcaggaaaccaagaggaagaacccattttattttgtcttgttagctatggtgagcagaataaaggccacctcttcatgttattttttcgattaagtatttctccatttattcaacatttttaaaatgtctttcatatacagtctccatcttcgtctttaaatggctcacaacaaaatagagagtgggataaaaatgactttctactacataatgtatttagtaaataagaatatttgtgggggaaagggccataggaggggaagaaatttgctctagtggagaatttgaggagcacgcaatatttgcggtggtccttgaatgcttggtaaggttttaccaattcaaagaagaatgaaaaaaatagaattcagaggaaacagaatagataaaagtacagaaatattaaaatacttggcatatttgggaaacgtcaacacataacaaaaacgctaacaagtctatttaatagatcctttgcttgattgatgtatacatccatcctcacacacctgttacatttgcaaaggctctgtttagcttcttttatgttctgttctaagtcatgcaaataaaaaaaatcagtgagctgtttttcatagctcatcagtacagcgtaaattttaaaaatcttactcaacagcttctccaagaatatccctcgcctctttctatagatgaatcttaggcaactaaaatgatttttgacgatttaaatgatctgattctaaagaacctggaaattacttataagatgataatggccacaattttatggtgttttaaaatagctgcagtacttagaatgtatatggtatatgcaacttaacaaacatctgaatcatgccaatacattatcacaactttctgaaaatgatgtagaaaaataaatttccctgtcactgagcctgaaaatctgtgtaaagaattgctatgagtaatgcttgtgattaagctttagatacaattaagctggatgagagctttaagtgtcaagaggttgtgttaaaattatctagtgtatcttataactccatgataattaccattatttaacagaattgcttgacagaaatggcatgacgggtgtgtactatttcctacatttgcatctgcttcatctttctgtaacttttgcatgcaaaagttgtcttgtttgtataaattactccttatttatcttttaataatttccagtaatgctgattaatctccatcaccaatgtttttgctgtatctaatcacctaaattaaatacatagcaaaactttaccacatattcttattttctgctccaaatttataaaaaatgaatatttaatattattttattagttattaaattatgaataatgacaacactcataaatatttattaagtggatgcttcaatcagatgttgttagtgcctataattgtgagtgattaaataaatgtctagaaaagacaatccagttctgtggtcccgccatacaagattttaattttataaaaacagactctaaatgccacttgccttcttgccaacggagagaatattatccattgcatacctgccagagaaaaaataaagaacctacattgagaaatttctgaattcagctctgtctgtatgtatacactcaaaatgaaacaaattggggcaatttactgaaggttaaatcctctaaatgacattcaactaaaacatgcagggaaatggtttgggaggtttaaatgatcaatttaattgccttaattctctgaattgctttttaaaatagacacaacccttttgcatctaactgaagattctaaattgggggtttaggggtgtttgtattttactctcaatactctgaatcacgtatgctttctgtataacctgagtctttaaaatagcccagacctcagtgtgcaagagaccagaagttagatgttttacatatatgatctgcctatagctttctttccaggagccagcacctttcagtttgtcaggatttttaccccaaagtcacagggaagctttttgaagagctaaataagctgtcatcgctttgtgcttttgttcttaaatattggaacatagagtgtcatttcaagatattttattagtaaaatctacctgatttctattaaaaattattttctctaagctccaagaaaggagtgaaaaattatttataagcaaagtagccctctgaaccttgtctaatgcataagagttttccaagtaagcttcagtttatgattcagtagttcctctgagttaagagagtgttactagactaacatattcttgaagatacaatttgaaataccacattttaaaaaatgattttaacaagttttaagagtttatttcagaaccttgtactgccacagagcggtggtggtgatgtttttttttttttttcctctcaccaaactgtattgcaaataaaccttttgatgtttaaaagtttttctttggcagctaagaaaaacactctggaaagttatagttagtgaatttacccgtgtataaatatccctgagctagtctgttatcctgtggcatctggaataaaggtgctattgttgtagatttcatgattgaagaatagaataatcaattcagagggaccctgaggggaagattcactcacatatgtggtggaaactggtaatccctgtgtttttttaggttttcctacagatgaagagacatagatgagttcatgctttgatgcgtctagtgacatcgcttcccattcgtgccatattatagtttgatcaccagttcttatttgagatgattaaccttaatgtttctaggaaaactacttttttgttaatccttttgttactattactttatttgctttttgggtcacaatagctggacaactattttatttgcaagggccctagccatgcgctttctgctgcaacatgccaaactaatcaccacagcattctgagggatgtgttatcagacttaggcctaacagataggctctgtaaattatttaaagcttctcttcatttcttgcaaagcaatgcttgctgagcttctccatgaaaaattagtgtaattccagaagattatgatagatttgcaaggtaggagtttggcctgtgcttacacacagacatctgcatagttatgaataaagtagaagttaaatgaaactgtacagttattttacatttggttatttgaaccctttctctactactttattcaatggcctttgaataaaagcagctgtgtctcatggctttctatcgtgaagtgttcaaatgtataaggtggttggatgtaaaaacactgtgaaagtatggataatagagtgcccactttctgtctattgcaacttccctgaggttttgtttgcagggcccagctgcatatacagacatgatggaatttggtttgtcaggaacctacaaaaattacacaaataactcagatttttaatgaataatgcacagacatgcacctgcttcagggacttcatagattagtcttgtgaccaatggaaaagccccttggaattcaattacatggatacaaaacagaaaataaaactggctacacttctagaactaatatcagcaaaatgttaactagttctcggagcaagcttttcctgaggattaggttgtttcagtttgctttgcttctgtgagacttactataaagtcataatattctgctcatactattatctactattcttgcagctggagccacttgcagaagatattctccaccaaagcccgaatatgaatgctgttatttctttacagaagatcattgaaattcaaagtatgtctttaaagttctcttaaaaattctaagcaggtaaaactaactaaaattatattgaaaattatagtacaaagaaacatttatttagagttatcataatttgcacatgcgttcttaagtatatatcttaatgtgttgctcttaatgcagcaatcttatcttacactgatgacaaaacgtagagactctagatttagaatcttgtttttctcatgtatttcaggtatttggagtttttaccattatgatcactaagcatttacccagaaccatgaaataaatgcagaaattgtgattttgtaatccaatcttaatgaagggtagttatctcctaatgatgttggaattcagcaatcatttactgattcatatgtgtcaagagaggaaaaaaaaattaatgagaaagcctctgtatgggaaaatccaacttaacaaagcagggttaagtcatagactttttttattatccaactcccttcacacacatacatacacataagcacacatgggtgcacacacatgctgaaatcaagcacaaactaacatgaagattagcatgaagaggaaaaccaaagggcactattaggtgtccaggaggaacaggaaaacccttaggtttgctactgtcttgtagaagcatttattaagtgccacttaagaagccacttgccagctatctctttgggtcattgcctttgcttgttcagtagcaatttggagatatgggttgactggagttaaattacccatttatttgatactgtgaatatttacacatcaggccatataggaactaaaaataattctccacttcatctcactcatgctgtgactgagggctatatgtacccaataaacatttattgactacatgtcataactgaaataaactatgaattttgaagacttttagggaatagaaaaataaaccttcaaatgctggggtgcactattcaagtctctgatataagcctaaagtacaggaactgacagagacaaagcagcgaaggctggaggtgatttcataagcttaagaagaaaatcctgtcattgtcctgtctttgtcttgtttccattggggctagataaagagggtctattacatgtcattctagatttcaaagcaaggaatcttgtagtgatctttgacagcattcttctcttcatccacatgcaatccaatgtatgctttcaggtcattaatagaatgaaaatatctcagtttttatacatattattatctttttctgagcattgtttagccattatatacacagagtgttaaaattgattgttcctatgtatattctgagcatatcacttcaataggcatttttgagttcttattacatgttgatcaattaccaaggcacagaggttatgaagaggaataagacatagtttctgcatcaaggagctaacagtccaatgagtgagagacaaccaagtaaataattgcaatacagtattcacagagtacactgaggtcatagacaaggggcggtctgtttcttcagtccctttcaactgggggtgagagggactggatagtaaggaaggttgcttgacggtgatatagcctgagcttggttcttaagggctgaacagcatgttgaataactgaagaaagagtgaaaatgctttgaaaggaacgacagaagtgaaggactctatttccacataggtataaaaaggcgtaatttctgtacatctttagaaactctactgttgccttttatattggatctaatttcctagtaatgattttccactgcatagttttttcctttcactactgatgttttcaagtgacctctacagtctgctctagccaagcaaacctgtttgactcttgaaaaagactcaatctactatcaaaacttgctgtaggagtatcctgccactaaggattgtcaattccactcttctgccccaaagtctattttacaccacccaacagtgatcacttgtctgtgaaatccatttccttctaaactcttaatgagtaccccacccagcttggagcattactgatgatccaataatgccataatttctcaagaccaatatgtgttggttcagcggtatatttattttcgatgtttctcttaaaaatatcaaatatttaaatgtctgttagctctggttgctaaattagaggataatcatcaggaggacaggaatcatatctttttgtctctgaatgtccctccaggaagggttgacagcaggtgtgaggtgcttgggagcctggccattaaaagcaggcagatttgagtaggtaggacttgaataactcttcaagaccataaacaacaaaggccataagcaaccagagctcctccttctgagtcaaggatatatggtgtagtggacactgattttggtatacccagaaacaatgcactcttcacatctactcaaaaggagtctggttttattcatgaatctttgccaccagataccgtgcaactcagggggaagttcaacttagctccaactccaggggagctgtttttagtctaaggcagtcaacccacttgacagtgattggttaagaaatgggtacgtgactcaattcaggccaatgaaaatcaggactagcttcatgggcattcagcctgcatggtcacataggtcctacacatagaagggccccatccttagtgtaaggctcttggtgttgctgcctaaaattcttactgcgttttaaagaagcagcccatattttcatttggtaccaggccctataaattctgtagccagtcctgatgaaagtcaaggtgatggtgaggtgaaaaaacgtttaccaagaaggaatgatagtagcatcaccacaaggacaacttaaatgtcagttgagagggctctgaatagtgggttgaggttgtaaaaggaaagaaaacacaagatcggaaagcgatctctcaccatttgagaagtggagtgaaactcggtagagagaaagtgtttcagcactgtggctttgaccaccgtgtggtgcatttttatgtggttataactatgtgtcttaggggccactcttctatgctaaaggaagagaaaagagccctctaatgtccacagagcaataaaatcgagtgggtatttcagagtcttaaacttcataatggcttgggaaattaaaattatgggctccctgattagtaaacagtgcttgatttccttacaagatatgaaatcgcactcttgcttctcactgttttataaccaatgcttccatttcacctgctcctttgggactccaggaccctaattgtgttcctcgtttcccctttggcagagaaagtggtagggacaggttacttattttgtgagacccagttcaagatgaaactgtgtgaactcttccttgttaaaaaaattaataatttctggagggtaacagcaaagcactgaaccaagcatggggtctttctgagagtggggcgcttcgcaactgcacaggtaacccattatgaagctgcccctgaaggtagtccttgttcaacaggagcacttcctcttcacatacgtctctgagtgtcacacaagtgcctcctttcaactttagggggtgttcagatttcagcccaccttctagcccaggttctgaagggttcttttgtgctgcagtttgcaacgacagtatcagaaaactatgttactcttgagaagcaggcttgtagcatgtgggaaacattcaggcaagtctctagatagccttatcccaaggcacatggcaaggtgctgacagttctcctgtgaatttctttttgagaactgagtcccccagctgagggtatgcaggtgctggaggtgcgttggctccttgcctggccacatgtatgtgaatattttccaacaggatcatttatgttgtcctgtccttgtttatgttgctcatctagctgaagagaaaaggccttacaggccacagaagggcaatgatttatcctgacaggtgaagacccttcctgacaggagagggtctggttccatcttaacatgatagatggcatgcaagggtcaactatctttgagatgacaaaatggaaaaaaagtttcatgttattccttaagaaattaaaaagagaactaccatatgattcagccatctcactttctgaagacttatcagaaagaatttaaattagaatctctaagagatgttagcactcccatgtactttgtggcactattcaccatagccaagagatgggagcaacctgagtgtccatcagtggatgagtgggcaaagaaaatgttgtatagacataaagtagaatattattcagacctacaaaaggaaattctgcaatacgtggcaacttagcacaatcttttgatggcagatattatttctgctgtgttcctgcttgtttttaattgccgtatcttttgcacagtctctggcatgtattaggtgctctgcaaatgtgtgttgaatgaatgaatcagctagtctgtcaatgtttgccacatttttcttctaagcctgcgttgatttttgtaactaacctcacatatttatactccttggcacactcatgcagaatgagggattaagaagaccaagcaaaatacatgagagtccatttcctctcctttcttcacaacccacaaggatgagtcatttctaagttaggaagaacatggattatttttgtgagttgccatttccacgggtaagcttggggtgacaattctcagagctggatctagcacttggctaactggctgtaataatcaacaagtgatgccagtaacgagtcagcccagagtgagataaataactctcatatggatgtttcctttcctgaaacccaccctagtgatttacagcatccatgcaccgttgaattcgttcacttttctgcatggcatggtgggcgccagagttctaaaacaccactctttataccagtgctggcccattataactttttcacagatttgggaggggaggaaccatgaagtgagtttcccataaaagtaaatttatttagtttgaaagactatcactttaagttctaaaaacaaataatgaatgatattgatattaatctgtgaaaccccaaaacatgagaacaagtatagagccatagtttccttttatttatttaaatttcttagtgagaagagtattccttttaagtgtcaaccaattttgtagacttcttgaatgataataatcataaccatagcatcttttgttttgtggatcaaggaaacatatacatgcacaaggatttgaggattctttcacaattttgctgcaaccctgcagtggtttgcctctgataagttgaaaaacaccagtgtaggagattttaaaatgatacgaattccatcgtaatcttctcctccactccacaaccatgtgacaatgagcaagccacttgtttgaggaatttcaccaggaatgacatggcacatcactagaattgcttttccacgttggcgctactgtgacaacaaagtggcaaataggcagaagaatcctaaaagaacagtaagaattttctccctgtagccccactttcacttttccccactctagggattatcccttacttagtgaattgaggtctttttagaatttcttattatgccaaccaaggcaaaatggtggcacaggcaagaatgaggaatggacagtgcctgcaatttcaccatatgttcttgtcaaatgtgttttacataaatacaggagcaatttccatgtttcttgtatataaaatttgtgagtatagctaatcctctgttgttttaaacacacacacacacacacacacacacacacacagagtattatttagggcaatgagaagtgaatttataatcctcagaatttatccaacttttgaggacaatttgaaaatggacatgatttcctttgttgcaggggaatgttacaagtaactatgtaattgactaaagcataatcagttatctccatggttccataccagcaatgcacagagcacactctcacacattctagagtaataagaatgaaatcagattttccctgggagatgagaggcaagtatatttgacacctactccttgtcagaactgtgcttgatttatgttttgtatatgtgtttttgagtgagtgatgtcttgcttctcctcctcttcctctatgttattgttattctttactcttattcgtcctcctcttcctattattattactaatattattatatctgtagttctgggaactggtcttagaagtaacaactgatactagaaaagaacaaaggaatgctgattttgttgattttactttttattatatttccaatgggagataactcataggtaaaataaaatactaaataaacactgtcaatgtattagaatgaataatcaaaatatgtggtacctaattttcttggcgattaagagaactggttatgaattgaaggaaaaggctataaaagtaaaataagaccgtattttatgtaatgttaccgtaaagataacaaccattgtcttcttttatctgaaataccatcctctcccatcattataatatcctctaccgaccccagtacaaggagaaggggcatttacatcagataatccaggagaaaatccaaattgtttctaagctgaaaggaatttgtatacatctcttgttggggggtgggggaagttatccaatgttttgacctcatggggctatgtacacaactaaaagcgttgtttctccagattgcaacgtgtgctgcataaattatctcacagactttactagcttcttgactgcacaccaaaattctaactcaaactcagtttttcctctttctttttgtccccatctacttcattttgattttctgcctttttttcgtatgtctcttctcctctctcttccatttccatcctattgagatccaggggagaaggacaagaaggtattcccaatattggaaaggagcttttagctcatagccatttgaggttttatttccagcagggaagaagcatgataaagcctgcaaatcgaaagatcactgtgcttgctctgaagacaggagattagcagggcttatagtcaaatatgagctgtttaattcagaagtagaattggtataatatggtaattaactgacagggagaggattaataatgtctgggttttctggcttggaaaactgagatgatggtggtgatcagctcccacgataggaaattgtgaagaaagaaaagatttgaaaggaagtgaaaaatactagacttaagaaaaagacactttgctgatagaaagtcttaacaatttggggagaaggcagtatcctccggaatatacattttcactgtattgaagttacggaggaacattggatgaaattatttacacaatacaaaccctgtaagatgatagcaaataataaaataatgtaataataattgagtgcttacagtgtgtgaggtactattaaaaattaatttgtttaatcttctctaccctgtaaagtagttactattttcattcccattttatagtgaagtaaactgaggcacatcaaggttcattgtattccccaaggttacacagctaatgagtgggcaaaagcaagatcataaaccaagcagtctagatccagtcttccctcttagcctctaagttacactatgtcacaaataagttcattccttttgcaatttttgggttgagtttttcccatttcttcccaaagtgacatatttagacaaaatttaagttaagttaaaattaggaatttgggaagttctggctaattgagatttagccacagtcagttctggaagctcagtgccaaagtacaagaagccatggagctgtgcgtccacttttgagccccttataaacttgtaaaatacttctaatcagaaaaaaatgcaaggattggcagaatttcaaatccctgccctgttgagtttaaagccctgactgttgtcaggtgggagctgctatttgtcatatattctttggctttagacagaggccttgacgttagagtcctgggccaggcagaccttcattgaagaaaagcagcgttaggcattttcccactattaaccctgccaaccctcgcttgtatcacagccaggtcagacttgtacacatggctttgtgaaagttgactttgaacttctaattaaccattctcttcaaatgttcaaagtctggttgttgtgttggtggcgccctaatactagaatgtatcagaataaaaaagaaaagtctgccatctgctatgagacacagttttggggggtattttttattccaactgcgtctgcaatttttttttcactcacacatctaccaagggaaaaccaattaaaccaagaaaataaaactatgcatgcttctaggactgaaaactctttgtggattatgaaagagtaggaatactttgtgatcacatactcaggtgttagcacccagatcaatctcacacatacacatgataccatgataccattcactgagactaggacgtactagaagaaagtcaggtttgagggaagatcgtttcctaagtatttacatatattatctctagtcctcacataattctgcaatacacagttctttcctcattttgttcatgaataacttgagacttatcaagtttaggtagcttgttcaagttccttctactggtaagaaggaaaactaagattttaatcctggtcttactgtgatgtcaaagcccactttgtttcgattaaaggatctatatgaccttcctgttcccactccatttcaaaaatgagaacaatgttctaccagattgcctcttcccaagtatagacactataacaggactctgctaaaatgtaatagagtttgcatgcattaaaacaatctattgaaatacattagtgggcttgctagaatgtcagcaaataggagaggggaaaaaacataagctgaaatttaataaggagcagtaagcaacacaaaaatggggaatatctctgaagcaaataatggcatcagtgctataatgcacaagaaatcttaagatccgcatcaaagggatatgaatttgatagatactaaagagttttgatctttgtccactcctgggttcaggaggaagccagtaaaattccttcctggaggaatgtatttctaatttagaccctcaatatatgcagagattaagcccaacaaaatatgaactcaaatacataaatacatacatatttaaataaatgaataaaatccaatgcacaataacacaaggcactagggagagttggcagaaatgagatatattagaataataagacttatttgtggagttaaaaatggagaaggaggattactttcaaataatgataatagataaagagtattcatttattttcacttcttcatggaaacccactaaaacaataacagagttttctttttttctaaagacataaactcctatggataaagaatgaaaaaggaaaccatctgttactgtcttagcagacctaaaaaaggtgaatcttaaagcaacactagcaagcgttatctctgacgggatggatacatcaggctattgtacccatatgtcatagaattgttgacttgcacacctaaggcactgttttattgtctagtttttaattcctcatttctcctcattcattgccctttcctgtcttcacttctttttccattcagcattaaaattataacattcatttgcccttctacgtttcaatctaccttaccaacaatcctgcccttcaactttacccatctaagaaaatctcaaccctggatatacaggacaaacaactttccctaacactggtcttccagagatttccccaatgcaggtcttcaagagattgtcatgatgtatagcagtttgacctcttagaaacttacaattaccaaacctaaatgggcccattaccattctactgctttctactcttgacccaacttaccttctttcagttcctctagtgtgctatttttccaccttcctcaagaccttcatatattttttcctgctattcctctttgactacttaactcctatacatacttcatatctcagcttaattgtcccttgatcagatatacaccttctgattatcagttaagatcagatttttttttaatttcatagaatgcagtacgttcattttagtagcttatttcactgtgagacatgtactcatagagcatgatcatttgattaatggcaacctgtaagatctatgaaagtatccacattcctgtatttccaatatcagaatgcttggtaggtaataaaatcgaaaagtaagagtatattactccattcacacactgttttaaacaactgcccaacactgggcaatttataaagaaaagagatttaattgactcagagttccatagggctgggaaggcctcaggaaacttgtaatcatgatggaagggaaagagacatatcttacatggtggcaggtgagagagagcaaatgtgtgaaggaggaactgtcagagacataaaaccatcagatctcctgagaactcactgactatcatgagaacagcatgggggacaccaccctcatgattcaatcacctcccaccaggtctctccttcaacctgtggggattatgaggattacaattcaagatgagatttgggtgggggcacaaagcctaaccatatcactgagtgatagaaacaatcctttgaatgcaatttggtttcccatgtagggaaattgagataaaatggactggtcatcctgacagtaatagtatagccctcataaaagctatacttctttggtgagttaacaaattagctttgcagtttattcataaatagcttctgattaatgcactcacagctccgtatccaagagactgactctttcccagaagatgagtattcatttcatctattaccccttaatctggcttcatgcttgctaagaaaactggaatatccatgtttgtctatgtacagggagataattcactattcatgttggcactattatttccaggacatgggatagtttattactcaataaaagttaattttcaaaaaaaggttggtttctaatgcaacattcaatgcattttagtaatatgtgtctcagggcttgaatatatcaaaacattgacagagaggacgcttgagatgtatgaaaggaacagttcctaccaggttttccttacgtctgttacatgttgggagattatcttggtttggcttctaccagaaacagatcctgatacacaaggagtcatgtacaagtaatttatttgcaggtgcaggcatagggagaaaaggaagaggaatagtgaagtgtgacgagaaaagaaatgaagtgtcatttgttcaactatccttgtaggtatctagagtttaattcctctggggaaattctgagagctgatgtaaaacacatagctcagagttatttcatgtgagctgcgagggagcagagaaatttatgctccaactccaaacagttattgcctgaatactgctcctgggggacaatatgaccctgacatttctggccaatcatagagcaaaaactctccaggggcactgaaagctgtcctgaaaagacatgctggttctggtgaatggaaatgaggttgtgtgcactcaattagtaaggggcgggacatgtggatgaggccctgacagtggctgctacaatgacggttctttcttgtcagccacagacagtcttggtttatgtctgttgtctcaacatctcatccagatactgtttgtttcagatttttcattctgaatgaagtattattatctatagttttattaagtgagtaaggatggatgtgttacacctgtactttgctttagcttctatcattgtttcctctggttgtatgagaaatgcgtggaaagtaaatataatttttactttgaacacatggttaaatctatacaaaatacaattgataacccatctctcttttcctggtccttttgtgatataactagcgcttcccttttaagaaaagcgtgtagggtcctcacgaataccagttgtaaatgacatttaaatttctgatctgggagttaaaggaagaaatactcaacattgctgccacttggcacaccagtcatggttgctgtagcttgtgacgtgcatgaagctaccaagctgttagaagatagagttaggggtcgggagccggtggctcacgcctgtaatcctagcactttgtgaggccgtggcaggcagatcatgaggtcaggagttcaagaccagcctgccaccatgatgaaaccctgtctctactaaaaaatacaaaaattagctgggcatggtgatgtgcacctgtaatcgcagctactcacgaggctgaggcaggagaattgcttgaacccgggaggcagaggttaccatgaatggagattgcaccaccgcgctccagcctgggtgacagagcgagactccgactcaaaaaaacaaacagaccaaaaaaaagatagagttaggggaaaatttgagaaatcagcagttaggtgtgaataaagtatgttcaggaaatagaaaggaccagccttccatacagcatttacactctcaatacttttgctacagagattttgtcaattattatacattgcaacttcactatgtgtatatttgttttatgttttgttacatattttaatttcgctatcaacattattagctgaaatgagctcacaaacaagtgtgaatgtgaattttaaaaatgagtgctctacttctgtctcccaagcgaattgataatgaatatgtaacttgaacaaaatgtttgtcgatattcattattcatcagggggacagagtaaaatcacagacgaacactgaagacacaatgctgttaaagaagcagcagtttctactttaaaatttagttattattgaccaaaacaaaacaaaaataaaaactaaaaccaaaaggaacaatttaagaagtgcagttgcagagggtgcatttatgtaacactccatgaagcattactttttatttagataaaatgactacgattaaaaattttgtaaatcaattttcagtttctggtattacttttaaaagttcaggagtgacgtaataattcttctttcttgactccattagtatcatttcttgctaatgatacagtgtccttaattgcttcaaacagaaaaatcactaaattctaatgattattctatatttttcattcaatttatggaatcaaagcaaaatttttgtaaataaagttgccccccccccaaaaaaaaaaaagcagggtgttattgtgaaagctatttgttataaattttggtaaaagtgtaacactgataataaaatcatttggttttgcattgatatacaaatctaaagttcggtggaacatcttatagagcaggaatgtacttagcattacgtatggagcacacaatttttataaatagcttaagatttaattatgaagttaatgacatttaataactcttaaaaacctaaacaagcttgatattctaccaatgaaaatctaagctactgtcaaaattttaaaactctttacataaacatagagtaaataaaatacactgttttagatatgtgacaggtgaggacagttaaaaaacaaaaaagaaacttcaggccgggcacagtggctcatgcctgtaatcccagcactttcggaggccgaggcgggcggatcacctggggttgggagtgtgagaccagcctgaccaacttggagaaacccggtctctactaaaaatacaaaattagccaggcgtggtggcatatgcccgtaatcccagcttctcgggaggccgaggcaagagaatcgcttgaacccgggaggcggaggatgcagagagccgagatcgcgccattgcactccagcctgagcaacaagagcaaaactccacctaaaaaagaaagaaagaaaaaagaaacttcagcaagacagttcaaaatttctctcttagcttccccttatcaaccatactttaggaatgtttgaacatctatagtaatattgaaccattttgcaaattagctttctgaatttttatatttttccaattagttagaaatcaaaaatattcaataagtggacctctgaccccatgtatgaaagagtaactgctatcgaagttgccctttgatcagaaacaagagaaaactatatacagatagagatagagagatatatgatacagagagagagaaaaagatatctaatgttccatacatatatggaacactgtctttctttcagacattggcctgcaggcaatgaagaaacaaaatgagtaccgcagattccagggtaactgactagaggaagtttccaggctgcagcatagagaagaagaacccaaatagggtccagtggtattactgagttgagaataaagccatcaaagttacagaatcactttatccctggacgcagtggctcacgcctgtaatcccagcactttgggaggccgaggcgggcggatcaggaggtcaggagatcgagaccatcctggctaacagggtgaaaccccgtctctactaaacatacaaaaaattagctgggcgtggtggcgggcgcctgtagtcccagctactcaggaggctgagccaggagaatggtgtgaacccgggaggcagagcttgcagtgagccgagatctcgccattgcactccagcctggacgacagagcgagcctccctctcaaaaaaaaaaaaaaaaaaaaaaaagaatcactttatcctctaaataaaggaggataaagtggctagaatttgtgaggcaaaatattggagatgaagttgccacacacacacacacacgtgcgcgcgtgcacagagtgctgcatgtacaggagtttccttaatgtttcatttgaataattttctttacatatataaggtgaaactccataaagctgaggaactaaccaacgaaaagtagcaggttaaacaattcaaggagttcacagaactgggaatagtttgcattagccggagtggagagatcttataatacacaaggcatcaaacagagacatcaaaatggtatcatcttagttataggactaaattagccttacattaaaggctacattttagccatcctaacacagtgtacaagtgagcctcaaaagtactttgctaattgtgagtaacttaacttcatgctaaaacaaagtccaatactctctcaaataatatgacaaaatccaatagccaaaaaatgttcaaattaccaatgtcaggcatccaaatgaaaattactaggcatgcaaaaatgtaggaaagggatcacaaggcaaatcaataaacagaaactgactcagaatgttaaaaatgtacttccaatatgaagaggaaagagtaaacataatgaagagataaattaaaaagataaaaaccatgcaaattgacattttagagaaaaaaaaatacagcatttgatatttttaaaagtccgaactttggatggattaatggcatattatgcagtacagaagaagaaaattagtgaagttgaagacatagcagcatctgaatttggtaaaattttgaagagtcaaaaacaacgaaaactttttgacatttaacttatttgtgttacataaaatgtttgccaaagtggagtatgctgaaaggagataaaagacagtaaccatgagacatttggaataaaatagttactcatttcagtattttaaaaattaaaagtgaagatattctgcttttagcagaaattgttctgagcttaccaggtagcaccatagttgtagagactatttctcaatgaaaaatattgcagtatcttgagaaggataaattaaaaatgctaaaaatttcaaacttattaaccatacaattaagttttcaagattataggcaattctatcaaaaagcctaaagtatttagaccccgttgaaacaaaaaatacatttttcataagaatatcagtatattgtatcagtgagtgatagagctacaaaactgattaacatgtgtgatattcagcaggaataataattctgcttgtgttattttctaaggttcagataatcaatataaagaagaagctggtagctatgctttgacaaacatgaattatgcaatttttattttttgaaatgaattttagttgtaacaataaattttgaataggactattttataggccaactgataaaaataatttcttggccaacaaatatttccaaaacatataatttttatttttatccccatttagcctcaaaatagccccaatttagatgaaaaattacctggtcactcaatttatgcaccaattttcaatgtgtctttatttttgcatttaaacaatgttttggatcatgccaaagttctctatttaactaaaaaatttatcttaaaaacgtattaagttttagaaaatccatagacctccttgtaagccccaggtgttaataatttctgtggttgaaggagatagcaagaggttaagattagcagcagcttattttcctatgagaacccggtgtgtaaagatgaaaggcaacatcattcaaatggaaaaaaggtaaaaaaaagcaaatttgagaaggagtgacagctctaaggctccaaaatgatgatggaatgagggatttctggggtcaggaagttttcaaagtagcaaaggggtttgaattgagaaaacttttggtagataggtgacttgtgtaacacagattttcatgagtcaacaactgcctatttttccaaattgtccatttccaagaacaatctggtttatactgaagtctgtttacagagtacctgcaggatgccctctcctgggtcttgtgtaacccagtgaaaccccatctatggccctcacctctaactcttgactctctacattccattctatactttttatctttattgtagattcattatttgtgttacttttgccagaaaaaaacaaaaacacagaatggtgaaggctggatagtccttaaaaagtcctgaaaagtgggacaatttacatagtgggaaaaatgaataaggatagaggatatgactgaagagggagtgtgcatgtccaattttaatggaaaactcttctcttttgccagttgcatagccataggagagcaacccagttgtggctcattactaatatttgactttatgaataacagctcctgaaaaccctagcagtcaacctttgttcatttctcgtatgtgataatggtgatattattcctatgccaatagatatgactttcttgcacatctgtttctgtaatggaagaaaagaccctacacatcacatgaaaatataacccataaattatggggtttgaattgtctgcatattgcacagacggtgctgtacccacttccatttcaattattctcctctatgaatagagatagtcgtctataaatgcattattaatgtagaatatttcccttgtttttatagactttgccagaggccaaatataatttaaagttttgggttatttctgagtcaggaaactcatacatgtggataaaagccaaacttctaatatttaatcttaacttagcaggatattttatacacattcaattttatccaaaaaggtctcaactattttaaatccttcctagtactgacatacatatgggccaaaatttaaaggatcattgtcagtcattcttcttaaagactgctattaaccatgcataccttctgtcctgattgtgttatggaagtaaagatgtttgtttgtggcctagacctctcctgttgagaaataagacccaatgcttggtaattaaagcccttgcttattctaaatgtgcatattatgtgcaaagaatgtttgctgacctcttcaagagttcataggctcatagaaaagaaaaggttttctgccatagcaaatttattgtaacatccaagattgatatgtaacatgagatcagaaggaccacgataagtgagaatgagagcaggaataaaactttcatagcattaagcctaccactattatttataaatgtggaagttgtgctccattgtgatccagtgacttcttccggattagtgtgggatctccaagctggaaatacttttagttagctcaattttcgatgaacttctctttttttttttttttttttttttttttttgagatggagtcttgccctgtcacccagtctggagtgcagtggcacaatcttagctcactgcaagttgggcctcccgggttcaaaggattctcctgcctcagcctccggagtagccaggattataggcatgcaccaccacgcctggatattttttgtattttcagtagagacgggatttcaccgtgttggccaggctggtctcaaattcctgacctcaagtgatccacccccttcagcctcccaaagtgctgggattacaggcatgagccaccacacccagcctttgatgaggttcttattcatactcttcaattagccgtgtctccagttttatgatagcctcaataatttacctggtaaaaggtacttgcaatagtgcaattttatgagaaattaagagtagagtgaactagtttcaacatgattgtctcacactgtccaaataaaccacaaagtctagaaaatgtgtgtcaactgaatcacatatcttaaagtacaagggtaatgtatcatttccaaagattatttctttagtaagtaatctgcaatatacataattcttttaagctgagaattttataattgagctttttggtattttcatgtctactggaaggtgggtggaggacagcagagtgcagaggaagaggcaatttaaaattagtgctgagtaaggattttagctcctctgcctattagccatgtgatcttcaaaaacactaccagacattgcctaaatagttgtcaccagggttaaataaaattacaaattataaatgtagaaacaccgagcacagtcttggcacatatttagttctcaataatgctagtttgtctttcctctagtctttataatttgacccataagccactagccacatgtagtgtgtttgtcagagtccccatgttagccaccatagaaaacaagaaaaggatgtcataaggcatcactagctttgtaaatgtcatctgctaaaataacgtttaataataatattttatgtaactcattacaatatatgtacttatagatggtatatggaattttcaacttgggtaatactacaataacattaacttgaaagtaagtttaatagtagcggacacccatgtcaacaggtcttgttgacatggaaagtgggtggtgagactgaatttcctcccctaatgtgacatctgttccttcgtgaaacagtaagataaagaaaggccaatcatgaaatattagagctggatagtatttggcattgtgatctagcgaaactaggccctgggaatggaactgtcaattcagaaataactttcaaagttgagagatgtagggtaggccaaagatacattttcaacctcccaaatctctcttagtgtcttctcgtttcgattctgttacttcgttttggattagacatcatggtttcccacttggacttttgccaagatgtgaaattggtcttcctgcccccactgttatcaccttccaatccatcacccataatctctccaaagggatcttttaaaaacataagcctgattctataccttgtctgcctaaaatgccccctgatcatcctcaggttgaagtccaggatcatcagagtgtcattcaagagtgtgtattaattagcccttgcctaccatagcagtctcatccatcccactccagactcttcctatgttctagtcattcccagcagttgacggtcacccagtaaaacacagagactccagtctctgtatatttgtatgtgctgtttccccttccagggatatcccatgacctcactctgctgaagatcaagaaaagatttggaaaggcaatcaagacatcaggatgatcaactattaggtttttaggagcacatttgcactctaatttctaatgatctttcaaatactcagtcaagtgttatttttcctggcaagtcttcccatacttttccatcatcttaaatacgtgttctacttattcccgttcaaggtcactgtgggcattttacacacagaattgtaattcttaactaacagggctgtctcaactggaccatgcatttcttggtgttagggaagcatctttgtgtcctcgacatgtggaaaagccttagcttctacaaaatgttagtttttggattcattgacagaattgttattgtttggttcaaattaaaaactttatgattctcagactttggtcagaataagggatcacagcaagttaaatagtaatggacacctatgtcagatggtcttgttggcatggggaacagatggggagacttagtatcctctcctaatgtgacatctgttcctctatgaaacagtaagaaataaaggccactcataaaatgttagagctgcaagagacttgaggcatctccctatttcagagacagaaataaagtcctgaaaagcctcactaatgtcattgggatggcagtgctgggtccagaaccctgttatcttactgcccaatccagcgttcatccatttgccttttccactcaaacaaggctttttcttccaagaagtaagcaaacactgcataccaaagttcttgccaactagtcaggctgcagagatagtactaacctggtgagtcatgtcagcacctagggagattctcctgctttgatttggggctactcatcatttcacaaaaaaatagcctaagggctgcaagaaagccattaactatgctctttcatatttatcccattggcatgttctcatgaaatgaccttctattttcctctctttctcctttcctgcctcaaaaaaagaaacatcagtatgacatatggatgggctccaacatcagccagtatatatattaaagttttaagtcaattattgttctagtacacaccctgaggttgagaaagaaagaacatccaggactaacaaacctgattgttctggcaaagttgccattcaattcatgctggcatttctgggcttttctttttctttaatattccaacttcattttcttaaagttaatgattcaagtagcaatgtttaacagtacgattccattcatgttctctgtaagagtgctgcctcctggtctcttgtgggtttcccagggagcgtgaagcccggagtttgcttacttagttgcagagacagctgtcagtctgagggtgagttcagtaggccatggattattcctcactttattgctgtgtaagcaagagggagactcagcttgggaatatgggcacttcacaacttggcattcttatattgagaaaaagacccaatcataacagttaagaaaccaaattacaactgtgtataacatggggaattttaacttaacaactgctctgagttggacgtatgtgagtattctgattattactgctgtaattacaattcttatgaagtatgatggatgtttttcctaggcaagtattggaagtcagtaaggatggtggctgtgccaaggggctgtgctctggctggtgctcagttgcaagaggagacagagaccgtttctgccctggcctccctaacagtggatgtggaacagccctttgctcaggaagacagcaggtatgaatccaacgtgcgggaataatccgggtcagtcatatccaggctcatcgttgatatttgtgaatcttcctcctggctttccttcacctgtctcctccacttccaccacctgtcctctccaaagccacagatgccacagcacatgctttaggctatcgagaattcattgcttcattcttcatgtgaaatgcagagctggagcatgtggttgcagttcacagagaaatagaggggatgagataaatggtgagaaaaatcacgccttatcagataattgagtgcagatcgttatggaaagagctgcttgtgggcttaactccttttcctagttatctctgtttttccagatgttctttttctttctctaatcattttgaaattgctgatataacaaagagaaagaggagagtagaagatggaaataatgctagaccgttggatagccaaaatacatacacactccttacgtggctgtccttgaggtccaacaactggataaagggggaagttgcctgcaaaggagacaagagactgtgtgtaaaggactgtgtgaacttggggctgattttatttcattttgggataggacagaattggttttaatgtatcttcttatgaatatagatttctggagaaaaaatacagtgaaactaagatttgattcacttgttctctttttaaggaatgtttgtcagtttgtgcatttggtgttcatcattcagttctacagaaaatggtacattcagaatttctttgaagtctaccaaagccaccataaatgtacataaatattggtgatttctatggctgacttcaaggtcacatttcctcaatttaaaaataaatcaggtgaggctttactaaagctctgccagcttgcactcttaaattgctcctgagaaggaaatcagactccctccgtcaataacatcaccattaattacgcagatcctgctactagtgcacaggttggcaattttcccaagaatgcacaaatacgaacagttctactttcttgcttttactggatactcagagtttaatggatttaacatcttgttttggccaagaacaggagataaaatgaataagagattttatttttatgcaattattttctcttaccataaccacttaaacagcagattagcaataagggggaaaagttgtatattactctattgaaagataactttatatgaatatctagagcataagggaaaacttactttacatctttgataataagaactaaccccctgccgttcccagctaagaactgaaccaagttcataatccaaaggtgttgcaattattccgaaggccaaaaacagttagttgtctgtcatctgagagccataaaactgaggaaactaacatctgttagtgttggatataaaaggagcatagctattctttagaatttaatatagaaaaacgaagctaaattccaacctgagtgaaatgaattgtaaatatttttgcctgttaaattgcagagcttagaataattaacaataataagtgatgttatgagcctcaagtaatataaaaatctcagcagtttggcaggaattggccctgtaggcaaagttgtttatcctcaggtaaatagtgtgcttgactcatggtagtctatagagatttaaccttggcttcagtccacagtgatttttattttaagcttcatctgatggcagagagagaatgtgaatgttctgatgtgcaggaaagcagagtcaaagagtgtagcctggtttcatgttcatttatcacttttagacagattatatctattgtgattgatttttcttgtgggaagaaaaatagttttgcttgaaatatttctgatggctttgaactgaactccctttttcagcagaggaaaagaagaattcttctagaactggctcttgcatttcaattgaaccatgcatgaatttcctcagagacagacagacagacacacacacacacacacacacacacacacacacacacacagaaagagagagagagaatgctctgaaaagccacagagcatttactcttttcaggggaatactatcagtattgtccccctactcaaacaggaaagatggctttcaaaatgagataaagtggcggaaacgtttctgggcttttcttatgaatgcaatattataagcacacaggaaattgaaaaattagaaaaatcagagagctaaatggatggaaaagagtgaaggcaagattccttttataggaaattcttgccagttattttggagaacatattggtgtttggagtgagatgactcatttcatactaagattttgggtaaagcagctcttttcctggccaactcatatctgactcatttaccactagtgaataagggataaaatgctcctggctaagaaccattgtaagtattttttgttcgtttttcttggatgggggaggggatgacaacacagtgcagatagtcatttcgtttttataactacattgatgggccttgaagaataaattactaggaaaaggctgatatgtgggaattccttttggggatagttaattttcaaacataacacatacttttctgggggcaaaagacttgatcaaaaaaatgattgatgggtcaacaaaacaaaacaacacaaaaaatcttgaagggatccaagttatatagtcaaagaaaattaaatatatacgtctggtcacatatagcatactacttagaagcaagaagttttcttattgtttgctaggaatgtgtacctttaaacaattgtagtttgcatttgttgactatctgtttcaaaatgcttctactttggaaaggtcagtacagtactcaggtttactcttggatatcagttcaggctctgctgaagatcaagaaaagatttggaaaggcaatcaagacttcaagatgatcaactgttaggtttttaggagcacatttgcactctagaatgcctaacttggtgactttgtgtgtgtgtgttttttttttaactaacacaaaaaccaaacaaacttgaaagttagatttgcagttgtcattttgacctgtaaatcgtgttacatttttttttaacaaaatccagaatagttgtctctttaatcatttaactttcaacttttggcaacctttctcatgaacgtgatggtttcatgtcattagataatacagaaacatgagaaaacatattattcaaagtctgaccactttgttttttgggtaactatctagtttgtgaatataacagtgtaataatcagctaaatccaagtatcatctacctgagctttgaatggcttatcaatagttccaatgacatcaaaaaccccattttcctgaatcttaagatttatatagaaatatagaccattattaaatatacattcatatctaatgtacttagaaacatgattttcctcaaatagcccatcccaatgggattgtgtctccaaaggcttctagaagctaaatgttgcacaaattattcacccctcttattttattctatgataccattatgttaagtacttgtttaggtaactaagaacttatttagacaacttagataactaagtatgtgcgttaggctgttcttgcattgctattatataaatagctgcgaatgggtaatttataaagaaaagagatttaattagctcacagttccacaggactttcaggaagcaagttcctggcatctgcttggcttctccagaggcctcaggaagcttaaaatcatggaggaaggtgattggggagcgggtacatcacatggcaaaagcagaagcaaacaagagagagagtggaggggaaggtgccacacacttttaaacagccagatcccatgtgagctcagagcaagagcttacttatcaccatggagatggtgcaagccattcatgagggatctgcctccatgatccaaacacctctcatgaggccccacctcccacactggggattatatttcaaaatgagatttgggcaggaacatttatccaaactatattagcaggcaaatttttcaatataaattttgtttttaattttcatccagtgtcaacaaagccttagctgaaaattgaggtgagatttggaagctcctggtaaaaagaaaaatctgccccctcttcatttatctttcctcctcttcccagggccatcattttatctctattttcccaacgtgtctaacatgtggtcttgaggtgcatgtgaagtctgacttagaacattagggatgttctaatcctccaatgcccagttatgtattttggggttcagttctgtattatttacaaaacagtgtttactttgaaaaaagaaacaaaattgaatagaaacgtatataaaataagatgcataatttagcttcccatctcatctttttcttcactccttcaatcctatcctcttaccactacagaggaagagtagagcttgcctctagagtctccacacttcacagttgtttgctcaagggcaagttacttaatctctctgagtttaattttcctcatctttaaaatgagagaaaaatttcatagagttgtgagaatcaaatgaaacaacacatcacaagaacttaaaacaatacctggcatgtagtaaatacttgataaaacttgataaaggtttattatttttattatttttctatcacttttcttcttcctcgatttgttacactttttcttgttcttcttgttcttgttcttcttgttcttcttccttcttcttccttcttcctcttcttcttccttcttcttcttcttcttccttcttcttcttccttcttcttcttcttcttcctcttcttcttcttccttcttccttcttccttctcctccgtctccttcttcttcttttttttttgagatggagtctcactctgtcacccaggctagaatgcagtggtgtgatctcagctcactgcaacctccacctcccgggttcaagcaattctcttgcctcagcctctcgagtatctgggactacaggcacgtgccaccatggccagctaattttttttgtatttttagtagagatggggttttaccgtgttagtcagatggtctcaatctcctgacctcatgatcagcccacttctgcctcccaaagtgctggaattacaggtgtgagccaccgtgcccggcctgtttcttcttttaatatattggccatcattcagtaatctataatataagaatatagagcctatacttgggcatctatacctttagctgttcataggttaaatcaatcaggactatcctccaaccagcagaatgaggaagaagaacatgtgaaaatatcaagttcattcactctttcaacactttctgattatttctaggagccagataaagtgttaggggccaggatcacaaagctgccttgtactcctcaaaacgttcacatacctttttacagcagcagtagaatactgcaaatttaatggcttaaaacacacaaagtttgtcagtcagaaatctaactaacccaggtctcactgagctaaaagcaatgtattggcaaggctgccttcatttgtggaggctctggggaaaaattggtttccttgccttttccatcttctggaggttgcctgcattccttggctcatgaccccttcttccatctttaaagccagcaacttcacatctatctgacctttcttcagtcatcatatctctctctgccttcagctgagaaagggtttctgctattaagggctcatataattagattagactcaccaggataatttaggattaatttctccaccttatcacccctaactttaatcacaactacaaaatcacttttgccatgtaaggtaacatattcacacgttccaaggattaggaagtggatagctttggggactattattcttcctaccacagaaacaaacatgaacaatcaactataataaatgacaagtctttgataagattgaaatagggtcctgcaaaatgaaaaaaaaagcaaaacaaaacgccttataggccaaggactggggagcaaatcacagaaccagggagaagagaatcagggtggaagaatgtgtagatttcacacagtaaataggacaaaaggcattcaagatgtctttactttgacaagacaatttaagaagcccttactttacaagacaataacttgagacaatatatatatttttaacttctactgctgacactcagtccaaagtatcatcatctctcatccaaacttttacagtagtttccttactggttttcatatccagttttaccttctttctaatccattttatacacctcaatcaaaaacaaaacaaaacaactggaaagcatatctggtcatgcctctgcttgaaacccttcaatacttttccatttccattaacataaagatcatcatcttcaataggctccataaggtctgtattagtagactcatacctataattcctgccttacttctaacattcttcctctttcttttctgatgtggtttccaacaatgaccttaattaatttttaatggaggtatatcttacatataataacatgcacacgttctaagatttttaccaatgccaccctcatataaacaccacccagaacaagttcaagaacatttttattacctccaaaaagtttgcttctgccacttcccagtcggtgccactccctccagaggtaactaccgttttacttttaacaccgtcaattatgtttgcctgctcttgaatttcatttaaatggaatcatgcgtgtgtactgtatttcttaatctgacttatttcacctcattaagcatgtttttgagatctatttatgccattgacaatccggagtttcttcatttttattattgtacattactccagtgtattaatacaccctaatttgtttatccgtatacctacggatggatgtttggcttgcttacactttgagggctattatgaataaagctgatcaattaattattattgtggtttaaaaacacatgtaaaacttaccgtcttaaccatgttaagtgttcagtacagcagtgtttatatgtgtattgttgtgcaacaggtttctggaacttgatcttgcaaaatggaaaccttgtagccattgaccagctccttcatcttcccgcctcatccttccagcccctatcaaccatcattctgctttctgtttcagagtttgactactttagatacttcatataattggaaccatgcaacttttgtctttttctactggcttacttcacttagtgtaatgtccttaaggtttctccatgtggtaacatatgaaaacatttccttcttttttaaggctgaataatattccattgcatgtatatgccacattttctttatccactcacccactgatagattcttggattgcttccacctcttgactattgtgaatgaatgctgctgtgaacatggatgtgcaaataactctttaagttcctattttcagtttttttggatgatatatacccagaagtgatatttctggatcatatggaaattttatttttaatttcttgaggaatctaaatctctatgaaattttcatacaagttttctttttgtggtcacagcactcagtttttttggatagatagctaagatagctaaaattagaattgctgggttgtagggaagtcatatgttttacttcataaaaatcttccaaactgttttccaaagtggctgtaccatttttcattcccactagcaatgaatgacagttccaattgcatcatagcctcacctacacttggtaaaatcagtctttataattttagccttttattgtgggtgtggagtgatatttcattgtggattcagttttcctccaaaaagccatactcatgtccacatcagggcttccttggcacatgccttctcttctgtttggaatgtttatcctgtcctctaccttcttccaccaaccctttattggccttcccattcttttcatcatatcctgtagatttcagatcaaatatcacttcttcttcttgaaaaatattcaccgaccactaacccccaaattagatcaggtcctccatgctttctcatgtctcccttacacttctgcattactccacaggacataagtgaaaattagatacatttgtgtgcttatttgattcctttatgttttctcctgtaagctccttatgaatagaatctgcatccctttggcttagcattatttttttaatagcagtatattacctgacacaaattaggtactcaagatccattttggtagtaaaagacgagcaaaagttcagagagtatatgagtgcaaactttgggaaaggaaaggactctcggggcagttgggggtgccacagagttgagtaagctggctgggtagaaagggatcatggcacaaaatttaatggaagggaattaaaatatttattaccattcgaatttgagttaatcctgttttcagtattaagctttcacagagagagagagagataacttaggtctatacattgaacagagagtgtcatggaggaggggccagcatactactaaagggacagccaagaaacccttatggtaattgtggtaaagaagccaattaatcatggtagaggaaatggagaggaagaaaacctagtgtagataaattgttgagaaatagtgagtagttggcaattcatgaaatatcaatgaaatgggagagaaagaagtccaaattaatagtctggatgataatgccattagctgagagagaaaaaaggaagacgttggttgaaggtgactatgtattgtagaattaagaggcgaacatggacaaaaggaagcaataaggcaaactagggttgagtaatggtactgttagaaaatctatgtcaattccccacaaaaacttgctgccagttgtattgttatggtaggtgtgagtttgtgtgtgtgtgtatacatatgtttgcttttgttgggcttttatttctgcacagccttgtgatatgagggaatatattcccaatcacacatttaggtgtagaattgttacacaggaagtctgtactgagaatatttctggatctttatttttttttaattctttttctatttatttattattattatactttaagttttagggtacatgtgcacaatgtgcaggttagttacatatgtatacatgtgccatgctggtgcgctgcacccactaattcgtcatctagcattaggtatatctcccaatgctatccctacccccccaaccccacaacagaccccagagtgcgatgttccccttcctgtgtccatgtgttctcattgttcaattcccacctatgagtgagaatatgcggtgtttggttttttgttcttgcgatagtttactgagaatgatgttttccaatttcatccatgtccatacaaaggacatgaactcatcattttttatggctgcatggtattccatggtgcatatgtgccacattttcttaatccagtctatcattgttggacatttgggttggttccaagtctttcctattgtgaatagtgccgcaataaacgtacgtgtgcgtgtgtctttagagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttagtgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtatttttttccaattctgtgaagaaagtcattggtagcttgatggggatggcattgaatctgtaaattaccttgggcagtatggccattttcagaagattgattcttcctacccatgagcatggaatattctcccatttgtttgtatcctcttttatttccttgagcagtggtttgtagttctccttgaagaggtccttcacatcccttgtaagttggattcctaggtattttattctctttgaagcaactgtgaatgggagttcactcatgatttggctgtttgtctgttgttggtgtataagaatgcttgtgatttttgtacattgattttgtatcctgagactttgctgaagttgcttatcagcttaaggagattttgggctgagagaatggggttttctagatatacaatcatgtcatctgcaaacagggacaatttgacttcctcttttcctaattgaataccctttatttccttctcctgcctaattgccctggccagaacttccaacactatgttgaagaggagtggtgagagagggcatccctggcttgtgccagtgttcaaagggaatgcttccagtttttgcccattcagtatgatattggctgtgggtttgtcatagatagctcttattaatttggaatacgtcccatcaatacctaatttattgggagtttttagcatgaaggttgttgaattttgtcagaggccttttctgcatctattgagattatcatgtggcttttgtctttggttctgtttatatgctggattacatttattgatttgcatatattgaaccagccttgcatcccaggaatgaagcccacttgatcatggtggataagctttttgatgtgctgctggatttggtttgccagtattttattgaggatttttgcatcaatgttcatcaaggctattggtctaaaattctcttttttggttgtgtctctgccaggctttggtatcaggatgatgctggcctcataaaatgagttagggaggattccctctttttctattgattggcatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttattggcgtagaggtgtttgtagtattctctgatggtagtttgtatttctgtgggatcggtggtgatatcctctttatcattttttatcgcatctatttgattcttctcccttttcttctttattagtcttgctagcggtctagcaattttgttgatcctttcaaaaaaccagctcctggattcattaattttttgaagggttttttgtgtctctattcagttctgctctgattttagttatttcttgccttctgctagcttttgaatgtgtttgctcttgcttttctagttcttttaattgtgatgttagggtgtcaattttggatctttcctgctttctcttgtgggcatttagtgctgtaaattttcctctacatactgctttgaatgcttcccagagattcgggtatgttgtgtctttgttctcgttggtttcaaagaacatctttatttctgccttcatttcgttatgtacccagtagtcattcaggagcaggttgttcagtttccatgtagttgagcggttttgagtgagcttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctatcaggtccgcttggtgcagagctgagttcaattcctgagtatccttgtttactttctgtctcattgatctgtctaatgttgacagtggggtgttaaagtctcccattattaatgtgtgggagtctaagtctctttgtaggtcactcaggacttgctttatgaatctgggtgcccctgtattgggtgcatatatatttaggatagttagctcttcttgttgaattgacccctttaccattatgtaatggccttctttgtctcttttgatctttgttggtttaaagtctcttttatcagagactaggattgcaacccctgcctttttttgttttccatttgcttggtagatcttcctccatccttttattttgagcctatgtgtgtctctgcacgtgagatgggtttcctgaatacggcacactgatgggtcttgactctctatccaatttgccagtctgtgtcttttaattggagcatttagtccatttacatttaaagttaatattgttatgtgtgaatttgatcctgtcattatgatgttagctggtgattttgctcgttcgttgatgcagtttcttcctagtctcgatggtctttacattttggcatgattttgcagtggctggtaccggttgttcctttccatgtttagcacttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaatattgacccccactgtcttctggcttgtagagtttctgccaagagatccgctcttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataatatcctgcagagtgttttccaacttgattccattctccctgtcactttcaggtacaccaatcagacgtagatttggtcttttcacatagtcccatatttcttggaggctttgctcatttcttcttatgcttttttctctaaacttcccttctcgcttcatttcattgatttcatcttccattgctgataccctttcttccagttgatcgcatcggctcctgaggcttctgcattcttcacgtagttcttgagccttggttttcagctccatcagctcctttaagcacttctctgtgttggttattctagttatacattcttctaaatttttttcaaagttttcaacttctttgcctttcgtttgaatgtcctcccgtagctcagagtaatttgatcgtctgaagccttcttctctcagctcatcaaagtcattctccgtccagctttgttccattgctggtgaggaactgagttcctttggaggaggagaggcactctgcgttttagagtttccagtttttctgctctgttttttccccatctttgtggttttatctacttttggtctttgatgatggtgatgtacagatgggtttctggtgtggatgtcctttctgtttgttaggacagacagacaggaccctcagctgcaggtctgttggagtacctggccatgtgaggtgtcagtgtgcccctgctgaggggtgcctcccagttaggctgctcgtgggtcaggggtcagggacccacttgaggaggcagtctgcccgttttcagatctccagctgcgtgctgggagagccactgctctcttcaatgctgtcagacagggacatttaagtctgcagaggttactgctgtctttttgtttgtctgtgccctgcccccagaggtggagcctatagaggcaggcaggcctccttgagctgtggtgggctccacccagtttgagcttccaggctgctttgtttacctaagcaaggctgggcaatggcgggcgcccctcccccagcctggctgccgccttgcagtttgatctcagactgctgagctagcagtcagcgagattctgtgggcgtaggaccctccgagccatgtgcgggatataatctcctggtgcgccgttttttaagcccgtaggaaaagcgcagtatttgggtgggagtgacctgattttccaggtgccgtctgtcacccctttgactaggaaagagaactccctggccccttgtgcttcccaagtgaggcaatgtctcgccctgcttgggctcgcgcatggagcgcgcacccactgacctgcgcccactgtctggcactccctagtgagatgaacccggtacctcagatggaaatgcagaaatcacccgtcttctgcgttgcccatgctgggagctgtagaccggagctgttcctattcggccatcttggctcctctcgatctttattcttttgttgcaaattcttattttgttcttgatttaaattatcatacttgtaaagagcactgaaatcattccaacatatgtatataaacatttcaaaaagtatttatgggatgtctagtatgtatacaaaatggtataacattggaggggggagatgaaaaagaaaaatgaatgaggaaatgaaagaacataaaacaaaattcacaaaatacgaactaatatatgaattagttatatataaaatcagtttgtgaatactggaaagataaagaagtcatcaggctgggcacagtggctcatgcctgtaatcccagtgctttgggaggccgaggcgggcagatcacgaggtcagatcaagaccatcctggctaacacggtgaaaccctgtctctactaaaaatacaaaaaattagccaggtgtggtggcaggcacctgtagtcccagctgctcaggaggctgaagcaggagaatggtgttaactcaggaggcggagcttgcagtgagcggagatggtgccattgcactccagcctgggtgacagtgagagactccgtctcaaaagaaaaaaaaaaaaaagaagtcatcagtgagataaacagacttacttatgacacatacttatgaaagtcatttgattctctgtcttttactttagcttttgtggcttactaaaattcaaatctttgtccaaactgattagttatcaaataaatgcaaatttgaataacaagaaggtattgttttacatatattagatggtaaacattcaattagaatataaggtcaatggagaatgtgagttctatgagagcagggatgtttgtctattttgttcattgctatgttcctagtgcctagaacagaaccagggcacacagtacacagtcagcaactttttctagaatcaatgaaaaatatgagtaaactaagtattgctagcatgggtggagatgtggggctttagagcctcactgctttgggaagataaactatggcagccatgctgcatactaatttagtaccattttatatacacaaaatatatgacctggtaattttgctcttgggaatgtataccaaagacattctcagcataagtctttagagtacgtatactaggaagttcactacagctttattcatggtgaatagagagttggagtcaagcccagtgtccattattgggagaatgaatagttaaaatgtggtggatgcactgtatggagatgccacgtagaagttaccagcttcaaactagataaatataagtgcatgacagatctagtaaatacagtactgagtgagaaaattatgcacatgtgtataaagttaaaatttacataaaataaaaatatatacccacaaaacaataatacacagctttaaagaacacttgcaaacaaaataatgtaacaggcattgtattgcttgcctttcaggaggaagaggagtagaagtaagaaataagaattaaattaaatcagtaaaatgagaaaatgttttactacgtaacagtgttaatataaattaaacaaatgctatttttaaaaccacaagaaataagatttaagagagaatacaagaatttaatttaatactacatcttgtctcaagtgaaattacttccttttttttttacttttgtaaattatcttatggctgttggagtgaattgatccttctttaggatatgaaatctttgattatcaatgacagaaaactatcagtgttcactgtgacattgacttgctggagggaagcttatgtctttcaattcgttaaaccattatactaaaatttatctttgctgggttgattttatagttatctccgaacttactgtcttcagctccctgcatgtctttccttcccccagcttgtgtctttgttaatcaaggtgaagtagacatgtatctagggatggctgaagtgggaagcccccagattttcagagcactgcttctcattcctccaaacacagccattaaagggtcatcactcaccagatatctttctaaatgttccataaagaaatcatcttttttaaaaatgtagacatattttttgattatatgaagataatgccacctctactgagagctagggctatgagaagagagatactataaattgtcccaatggcagatataaataatccagttattttacaattgtttcacacttcacagtgtataaatcatgttttcttacattaactcgtttcaattctcataaccgtgagggcaagtaagggattattatttctattttaaagataaaattgacaatctagagacactgactgactgattcaaagtcaaattttcgaaagtaaaacagctgggacttgaacccagaacatctaccttgaaatccaggatattttccaacttactatgctactaacacttctatgctgcaagacgctggggagaattgaggctagacatggtggcgtacccctgtagtcccagcattttggaaggctaaagcaggaggatctcttgagcccaggagttcaaaaccagcctgggcaacatagcaagaccccatctataattattttttttttaattagcccagcatggtggcacatgcctgtagtctcagctattcgggatactgaggtaggagaatggcttgagcccgggaggttgaggctgcagttagctgtgactatgccactgcactccagcctgggcaacagagtgagaccctgtctcaaaaatacataaataaatgaaagagcgagagagagaattggttaattatgcatatgtgtagatggttcaatagaaggtgggcagctataagtggtttattccaaaaaaaagaggtcaatataaaatgatttcaaagagaggaaaaggcagagaagcatctgatggaaagctttctattgtacctgcaagttgccctgtttcaaccaaagaggcttaatttttggcagtgagtgggttgcagtgtagacagcctactcacatcctttaagcctaggttggacatgtggagaattcacagatcctccaccacagagacatgtggattccttacatctgtgacctctgagacatttcccacacgtgactgtctctggaattccagccacactgaatcctggattcgggggaaaagattatcctgctgcagcttgagttagaaattggaaaaatcggtctccattagaatatccagtttgagttctataactgtattattcacatattctcagatgtaaataaggctatatatttatgtatgaattagtttcaaaacttaaatgtcttccttaatttaaaatctttcttctttgaatgctgattatttttgatagaaaagacttttctgaagtatgactcatttatcttatgtaccacctctaaactctctctcacaacctccttatcccagacactctaggacaggctataacttcttaagaagcaactttttaaatattccacacagactcttttagaattttcttttttggtaacaataaataatgaagacttaatgattatcattctttatttttaaaaggatgctttaaaaatttttgattaccctcctatggttaaaatctttcttttaatgttttagatttgttatacaaatgctaagctactactttatttgtcagcacctttagagatgcattgaaatcttggctttttttcttataaatctgtaaaataacatggccaaacatttcatttgtttgcataaacagctctggtttaaacatagcatgttttcctaatatgaaagtaattcattatagaatcctggcaagtaggtaaacattatgaagaagaaaatgaaaaccacccctctattattccgctacctagagagaagcatcatccaaatattttttccttctggtagcaaaggcataactctgcatttgtgtggcaacatgagtttatgcatgttagacagcaaagggacaaatctaaagtattaagtaatgtctcatagtgtttattatttacaggtcaattttacctcctttattttttaacctttgctaattttataaggaacatcattttgttcatggtttacacctgaaaccagagcttcacaaaagcgtatttaaatcagcagttgcaaaattaacaaatggcagagctcagacgcaaactcaattcacccggcatctcatatcccagtaatcttcccatgacaatccaactacctcatgtatttggattcctcctacaatttattcttttgagtaaattaaaagtcattctaaaagtttgccttaaagcaccctgaaagggttactaaattaaggttaaatctcaagtataaattttcaagcaattagttttggttttgcctgcgcagaataccctgcagatgatgccgaataaaaactatttacacactaccatagtgcatttcttgtaaaaatattgggtctgtagcaacaatttgctaatcaaattcagaatttgatttgaaatgcctccggcaggcagccaatccagttatgaaagaacagaagcaaaaaccagagccctagtgagtctcctccagaagctagctgggtcctttgctctcattagcaaactggttccataggaaatcactgcagttgctcctaaaataaaatatcatagttaattttttcaataaattattgaactgtactagacaccaaacatgtacattttggaatctagagttataaaatattctgacatgttttaatataaacaggaacatttccagtgattgcttggatcgaaaatgtttttccccttgacatttgtttatacttcctaggaaagaaattctatttatggataactgaataacacaaataaacatcagagagagctgaaaaatcagctttgattatgcatgaaaatctacaatgtcattgtgtactcttatgccgtattctgattgcctgtttatttttacagaactgctggtgagcctatggaagaggagccagccttgtgaagtgccaagtccccctctgatatttcctgtgtgtgacatcattgtgtatccccccaccccagtaccctcagacatgtcttgtctgctgcctgggtggcacagattcaatggaacataaacactgggcacaaaattctgaacagcagcttcacttgttctttggatggacttgaaagggcattaaagattccttaaacgtaaccgctgtgattctagagttacagtaaaccacgattggaagaaactgcttccagcatgcttttaatatgctgggtgacccactcctagacaccaagtttgaactagaaacattcagtacagcactagatattgttaatttcagaagctatgacagccagtgaaattttgggcaaaacctgagacatagtcattcctgacattctgatcagctttttttggggtaatttgtttttcaaacagtcttaacttgtttacaagatttgcttttagctatgaacggatcgtaattccacccagaatgtaatgtttcttgtttgtttgttttgttttgttagggtttttttctcaactttaacacacagttcaactgttcctagtaaaagttcaagatggaggaactagcatgaggcttttttcagtatctcgaagtccaaatgccaaaggaacctcacacactgtttgtaatggtgcaatattttatatcacttttttttaaacatccccaacatctttgtgttctcacacacaggcaatttgcaatgttgcaattgtgttggagaatgaagtccccccacctcccagccacacacacatcctttgttctcatgacagtaggtctgagcaaatgttccaccaagcattttcagtgtctttgaaaagcacgtaacttttcaaaggtggtcttaatttgttgcatatctatcaaggacttattcactcacctttccttttctgccctctatcaattgatttcttcttacctttcatcattcattccttcctttagaaaaactgaagattacccataatctcctcttattacttgagggccttgactatttagtttattttgtttactttacaggttaacacagttgttttgtctgattgcattttattaactgtgaagccgttgaaatgaatatcacttaagcaacgttgctaaatttctatgtgtttgaaatgtgttaatgaaggcactgcttatttgtagtcaccttgaactgacttaacctagaagctgtgccttcttgtgaaaaaaaaaaaaaacaaaaacaaaaaacagcctttaaacaagtttccttagtgtcaaaagttaaaaataaaggacatttatttctgagataaaaagtaacttactaaatataagtaggttatcctcctacctcctaaaattcgatttcaacatataactcaaacacctaaacatattgaggtagaatatctcacagtatttaatatctgacaatgcttttgaaagagttgatgtttctttttatatatttttctaactcaaaggatatattaaagccataagtgaagattgtcatgcttttattcagaaatctgaaagaaaccttaattaaaacaaggttttagggaaggccatgatatgaaagatatggaacaatatggttttagttagagaggactctaacctgtaaatcaaagatgaaagatttcactcaagtagaattatataactccctttgttatacagtcagaccatatttttcatgcatttggtttttttaggattaccattttaattttaaagacttttattacatatacaaaaatggctcaatacttggtttaacttcttagaaatttgagacaccctttgaaataggaaatctgaaatggaatgtaacttagtattaggtaaaaattgctttcattgcgtaagggcaaattcagtctagattcatagtagtaatcaattttttataaattttattttcatgagaaattcataccaatcatatttgctagcttatgttattttgcagtgattgcttgaggatatttacttaaaaaaatagtagagccaaaggcttaacaaaagactctcccccattttaaaaaggaaactcatgttttaattagaaaaataattgtgtagttttaaaatcaacttcataattataaatctctgtcattactttttagtcctcccagatatttttttagttgttgaataagaaaataaaacagtgtaatgcaaacatgctaatttactaaagtttcctacaacagtttagccacatgtttatgccaagccattaatctgataaagccaaatcactaggacatctccatggttatttagatttaaaacttgacacattaatgagttaatcacacatactcccatatgacaccatacccaattggttgcacttagagtctttaaaatacctggagaagcaaatgaactgtggagaggattatccacagcatgtagttgtaagaacagaatgccattgctttttgattataccattacaagatggagcatagccctgagggacagaatggaggctttccgaaaatatcaacacttcttttgaaatagaccagcactttttgaaagggtagtttcacttggtatagtttttcttcacttacccgtttaaattttattgctcgcagttgttctgaatgagaggctagaagagtattatcaattttgcatctccttgtgatacttactttgaaggaaaatcacatacgctctctcatggtctcatggtatctcatacagggtgaataaaaatgatttttgataaatctactagtaaataatactaggaatttaataagctgtcaaacgtaggtataaaaagaaggcttaaaaattaattttcccaattgtataatttggggctgtatattaaactaaaaaacacagacagttttattaaatagtaaccaaaatggactcaaataaaaccagaggctatgttaccattgcttagtaaatggaaagaacattgtgagatgaactatctttaaatattgtaacaagtttataacatcaatagtggagacagaagtcagctttggagaaaatagagatatttatgaaaaaactactacaaatcacatttccattaccaatcctggggatggaaatattgccttcagtttttactccagccctatacgacactctcactaacctttcactgacaacatcatggccttgaaagcagggatctcctcccacaaaggcttcagaaattacaggactggtctctcttaatagtttagtcctgctttatttccaaagggcaattataaagcctcgtggatttactgggtttctttacagactccatatggaagtaaaatagaatgatcatttggaaagtctcctgggaaaaaattcctcttcaatcagcattttaaaacttttttatttttgagtcagagttttgctcttggtgcccaggctggagtgcaatggcgcaatctcgactcactgcaacctccgcctcccgggttcaagcaattctcctgacgagtagctgggcatgcgccaccacgtctggctaatttttgtatttttagtagagacggggtttctccatgttggtcaggctggtctcaaactcccgacctcaggtgatccgcccgcctcggcctcccaaagtgctgaaattacaggtgtgagccactgcacccggccaaacttattgttttaatcccagcatttatgtttagaagaattaatttaaatatttcttactatttctctgtcgaatgtttactctcatcttatctcaatgaaagaagtattaaaagtcttatggccccaaaagaaacaagccaaactgtactgtcttaaaagtgattcattctgagcttgaaacgactctgtcagtgtttgacattgtcatttctagtggcatgtatcttaacattcttttcctgcttcaggaatgaaatcacttgtcctgctgagaaaataaggggaaaacaagatagaagtaaaaaacaacacacctgttgaactattttcataaagatggcgttttcactttcaaaagaaatgaaaaccagatggtctatgctaagaagtgaaggcattttgttgtcttcagaactgatcaacatggtcatgatcatcatcaaatttcttgtttccaaaggccactattgtagtacagtctccagcaggattttgtaccatgtgctgcctttggaataaagtattataatgtatcttgtcaccttcatcaacaccaccattaaatatgtaagttcctatatgtgactttttctgggcatatttgcatcaaaaatcacagtccttgcctccttgcttgcttttactccatgaaacgcttcatgaagcagagcatgattgtcaagtgaccagaggatgacatttgtaagtgaacgtggtatactcacacatgctatactcatactacataacttagtttctccaaatcaactgcagtccgttttatctatgatattcctggcttcgtataatggttttgtaaaatacattaaatacaattaagtccgttattactatgctggaaataactaggtcagacaatgaaaccttagacttttgattggggctgtttggacttgatccaatgataaggtaataaggttgttgcaatttctcaaagcatcttaattctcaaactgaaacatttagcaaatacatggtgaatctggtgtaaacttacaatctaacaaataattttctttcaactcttctctttttctgcctaacaatctatacgaaattgccaatatctaagcaatcaaaagtttctgaaatctctgtttccttagtagaaatgaccttgacaacttattttctgagataccactaggcctactgtctttcatgccattttatataaacattttgatagatactctgtcttttgttttttatctcttctcttttcaagagtcacttgactttttcaaatattcttaaaagatagatttagttattgtattttggtctacaattttggacttggcagtttgttttactaatgcagaattattctttttgtttcaaacatagtttgccatcatctggctactacctaatcatgttgtactagttattgtggaaagaaaattgtacatacatttccttgtcctttgggagatgtctttgagtcaaacccacaagcatgaactctcacctgaaagaaaactggaaaaggagaaactttaaatcagtatgttttgaaaggaagagatttccagactttttaaagcaaattggaatcgttttatttttttgtttgggccttaggcacaatagaagcaaatgttgcaatattaaatataatagggagagttcactgtttcctgggacattgtggtcatgtccttaatccttcattgtgatgccccttcttggagttggcattttgtgacaattcatagagatcttgcagcaatatttggctattggttttattaacttaaaattcaacagaaatggagtaattaaaaaaaaaaacaaaaaacagagaagaattgcaaaatctgaagtggaatggcacttccttgggtatgtaagggttgtttttagataaaactcccgatttgttcttcctacactttaatagtctcaaattctttctggggaagcaacgtcagtgtctacctccacagtaactatgatataggaaattgtcctttcagtggtttctaggtataacaaacaagccgttaaaaatgagtgaccattttgtaggttacagcctcagcaatctgtgtcatttgaaagcaaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgttgccaaacttttcttaaaattgtgctgccagtggtattttcccagatgtgaaaaataataatctaataaaggattaatatctaataacaataccattgttgaacatgctcatggaatgtccaccttcttctgattccttttttgtatttgaaaatgcaatggtgtgttccaaattattgttggtgttgttaatgtcatgactctcctttgaatagaataaaataaccccttttgttttgtgttttctactgaattagattttcctctagtcctatgtgaataaaaagctatttgaaataaaagtgttcttatttttctatgtccttggtgcctaccattagactctggatagcagatatttgacgaatatttgttggataaatacaatattatgaaatatgaattaccacaaaatgtactattccattttcaaaaaaaaagatttacttgtgagtaaatctcccttaaaataatgtgaaaattcacaaaagaagaagtaaattaaaacacagttgctatttgattgtagcttgatggttagaataaagaacaataataactaccactgattaagtaccttccatgtgcctgtcactctgctgaacactgtacctgaatgatatttaaccatcacacgaaccctgcctcataggtgttattagtctcatttagagatgagaacatcaagcactgaaaaggttaacgcactgttacagtgacagacgggatttgacccttatctgcatgtatctatctttgaagtctatcctctccaaatgtatatatgacacatcaaagatggcatactaaagatattctttgactaaaaaactatgattaaccttcagaacagactgtatgctcagtctttgctaagttttattaagttatttaaatcgatctggtaattgtggctagatttgtacagtaagtacaagtttaaaaatggttgtttctattcctatatcaacaactttctctaatctagccaagaaccctaagatatctttagagcacatactccaaaaactgtttaaatattccaagaccaatacttatttttgtattttataaccccctgcaatgtttaacattctaaaatataactgtttctaatggacaatggtttgggttccttctgggaaaagatagtaatattttgtctaacaaaaggtaaatgagatggagtgggtgggtagactgagtttcaatggtaaacacctttgatttaatcagatttgtcaaatggcaaatgttactttgtggttctttgtttcatttaagtttccatggtaaaaagcgaacagttgaaaaagtggagcctatgtttaaaaattaagaatgaatgtcatattgttattttaaaagagtagtttgtagttgaaaaaggaagcctaaagaatatctttcactacttaacacttttgtggtgctttagggttattgaacccaaaatatttccaaatattgtaattacccctcaaatttgtaatatcaataggctatacaaattcctatggtcttccaggttgaccataaatagataattccccacatgtcctaataattactttggaaaagactgacagctgttctttcaaatgtcctacgaaaagcaaagtaagattcaggaaaatagatgaaaagatgaatgaattccttctgtaatctttaaaaaaaaactggagaaataagaggattttttaaaagattgcattcacctcagatcaaatcaaatttaaaggtcttagtgtatctagaaaaggtattaactccataatgaaagcttatacatttaaaatataatataatcccatatatattttttcctaaaaaatatttttttccaaaaaagtaaggtttaaaaacttaagatgtgataaagtgaatcaatttaatggtatactaaaaagtaaatcttttaataaattatgtatttatgaagatttattcttaaccaaatgtgaagactttacatccatgtaaaatgaggtggtttcttttaagaatgtgtatttttagtgcacaatttttattttttctcctttgttaaacaggttttgttttggttgtcttatttattctaaaaataaaaatattaatagctatttaccacttaccctgtgctcttatttaaatctcacaacaaacccatgagaggggtaatttaatgatgagtaaattacaatataaataccagaacaaagctcatcttatttactgctaaccaattagtgcatacaatgtaatcaacattcactgacggcctacaatatgtcacaagtattcagtacttgttctcagaatagcatgaaaaatagcaagaaaattggcaatacatataaaggaaatgaaaatttcattaaatctccatctgatataactacaaaagaaatattaccacaaaataggtttggctttagaattgtgtgacactaagactttctaaaaaatatgacttctcttttttcttcatagaattataatatagacgcagagatacaatagatttaagaaatatgtgtggtctaaattacatataattatattcatggaaagatttgggcacagccctatcaagaaagtagatatgataagagtatctgttcaagtccctttcatccctaaggtctaccagatcaacattcaatttaaaagcatgtaatgttaagatgtataaagacaggagattaattttgtagaaatccttaaaaaaaaaaaaaaaccttagaaattgctttctaaattccagtcatttgcttttctcccattattttgttttaaaaaaattagttgattataatttctggagagacacgtccccaacagtcaaatttgttaataaccattttggctttactccattgccccttaataaagcataatttccaaactcttttacttttcaaacactgatcttaataagcagtttttttaattgtttcatcggaccccaaatcctgacagactgtaacaccctcaatcaggcagattgtacttagaggtgttctctgggccattaatgctgtgctaccattttgaagttttagttttcctattttaaaatccagcctgtatttaaccagatacattctgacttctttttcatggttacatagagtgccctttctcccactagactattaaatttagctcagaagtcccaaacaaccaaaaacactgctttgcaattagtacatatttataaaggatggctacaggctataaagtagtcatttcttgtcaccacttcttttaagctcaatggaaagtggatggaaaagtatatggtgccccatataataatctgtgttaaaaaatcagtgtccttggtgttgagatcaaaccaagtcagatgtttacaactttaagaaacaattttggccaggcacagtggcttgcacctgtaatcccagcactttgggaggccaaggtgggtggatcaccaggtcaggagttcgagaacagcctgaccaatatggagaaaccccatctttactaaaaatacaaaaaattagccgggcgtggtggtgcatgcctgtaatcccagctccttgggaggctgaggcaggagaattgcttgaaaccgggaggcagaggttgcagtgagccaagatcatgccattgcactcgagcctgggcaacaagagtgaaactccatctctaaacctaggcattaccattcaggacataggcatgggcaaggacttcatgtctaaaccaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacatcagttagactggcgatcattaaaaagtcaggaaacaacacgtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaaggcacgtgcacacgtatgtttattgtggcattattcacaatagcaaagacttggaaccaactcaaatgtccaacaatgatagactggattaagaaaatgtggcacatatacaccatggaatactatgcagccataaaaaatgatgggttcctgtcctttgtagggacatggatgaaattggaaatcatcattctcagtaaactatcgcaaggacaaaaaaccaaacaccgcatgttgtcactcatagatgggaattgaacaatgagaacacatggacacaggaaggggaacatcacactctggggcctgttgtggggtgggggaagggggagggatagcattaggagatacacctaatgttaaatgacgagttaatgggtgcagcacaccagcatggcacatgtatacatatgtaactaacctgcacattgtgcacatgtaccctaaaacttaaagtataataataatgataataaaaagaaactccatctcaaaaaaaagaaacaattttaaaagcagataaatgtacaaatcttgtttatactcttaacaatattcaagtttagtagatgtattcccagagtatttccagaaaagagaatgaaggcctgggaatccagacttttagtttccagccctatttctgcaacaaccctgcttgtgacatttggcaagttcattaccttctcatagccttcatttctttattatttcctatttaatgatttgaaagttatacatccaacttttattatttaaaaatatacattatatgtctattattttactcaaactagtcaaatgcagaattgacttaaaagtcatttctcttaactacacgtctactctccacttgcagaaaacaaggaccaaaaactgtattgagtcctacatattctattttatcctacatatcattattgcctagcatttagtttcactttatttttaaacctt

SEQ ID NO: 288 - DNA, 83459 bp, Homo sapiens
gctcactcacctccttccttggctgggggtgaggattccccttgccctgtgtagctctcaggtgggccaacacaccactttgcttttcatttttatctgtgggtcatgccaaccacctagtcagtcctgatgctagaatatggataccttgcttgccagtgcaggattctcagctgttttggttctcctcagtgtgagcctccaaccactgctagtcagccatcttggccctgcctacccttcctttttttttttttttaatttgtttcttccatttaatcatgctccatttccttccctgtgaaaatgagctcttgggaaggaatctaatagattcattcacacaaaggctgattaaattaattatgtgatctccaggaccgtaatgctaatgattttgaacatcctttaatgtgcttatttgctatctattcatactctttgatgatgtatccagtcaatatttttgcccactttttgtttgtttgttttttttattgtcaaattatgagagttctttatgtattctgaatacaagtctgttgtcaggtacatttgcaaatattttctccaagtctatagcttgtctttttattttttcttaacagtgtctttggcaaaacaaaaatcttaaagtttgatgaaccccaatttatcaatcttatcttttatagattttgcacttggtgtcaagtgtatgaactatttgcctaacactaggacgtgaagtattttttcctatgatttattctaaacattttacagtttcatatttcacttttagatgtgtagcctatatttatataagatatgaggtttaggtcaaagctcattattcagcatcattttaaaaagaccatcttttctccattgaattgcatttgcgctattgccaaaaatccattggccatatttgtgtgggtctatttttgtgctctctcatctctcctattaatctatatgtctagcccattgcctttacagttctgtataaaatactatagctttatagtaagtcttaaaattggatagtgtgattctttcaattttatttactttttaaaaataattgttttggttattatagttattttgcctttctatatgtattttggaataaccttacctacaaaaatttctgccagaggttagaattgaaaattaactcatagatcaatgtttatggattcgacatcattactatgttgaatgtccaattagtgaacttggtattcttcaattacttaggcctttaagatacttcataagcattttgtaattttcactatacagatcctgtatgtattttgctagatttataccaaggttttttattttggggaactattgtaaatggtattgtaaaaaacattttgatttctaattattcatttctgatacatagaaatatgattgattaatttgtgcacattcatatattcatgaatgttaacccacatgctaaattggttcaaggtatttaaaaaatagatctcttgttttttttaatgcaagcaattatgttctctacaaataaggatagttttatttcttcctctccaatccgtatgcctcttattaatttttcttgcttcattgcactggctagtacacttctaagtaagagtggtgagagtgttgctttgtttcagatattaggaggaaggcattttgtcttttaccattaagtaaaacataatgctaattttaaaattttttgcagagatggggatctcactatgttgcttaggctggtttcaaactcctggcctcaagcaatcctcccacctctgcctcccaaagtgctgtgattacaggcatgagccattatgcttggccaagttttatcttatttttaagatgtcctttatcaagcttagtttcattttgttccaagtttgctgagaattgtgaatggacataaattttattaaatgtttttctcttcatcaattttactcctaggataaagcccatggtgtattattctttttgtgtgttgctggatttgattttctaatattttgttgaaaaattttgcacctacattcatgaggcatattggcctgtatttttcttgtcttgtactgtctttggttttggtatgagagtaatgctgtcctcatagaataaattgggaactgtttatctcttcttctgttttctagaagagattgtatagaactttttttttaaatgtgtgttcccacagtgaaactgtctggtttgaagattcctttttgggggaaaattactacaaattcaattcccttaatagttaagattatcattcagattatcatttcatcttcagtaagttttgctagtttatggtttttgagaaattgaccgatttaatctactttatcaaatttatgtacatagcattgtttgtagtagtctcttattatccttttaatgccttcatgctctgtagtgttagcgcctttcattcacgagattagtaatttgtgtgttctgtcttttctctttgtcagtctttctagaggtgtatcaaaattactaatttttaaatttaaattttaattcttttgaaacaagagttttgctctgtcacctaggctggagtgcagtagctctatcatagctcactgcagcctcgacttctctggcttgagtgattctcccgcttcagcctcctgagtagctgggactacaagtatgtgccgccatgcctaactaatttttaaattttttgtagagatggggtctcactatggtgcccaggctcatctagaactcctgggctcaagtgatcctcctgccttggccttccaaggttctgggattatagacatgagccactctgcccagccaaatttactaatctttttaaagaaccaacttttgcctttgttgatttgctccattgtttttctgttttcaattatattgatttctgctgtttattatctctttccttctgtttgctttgggtttattttgctcttcttatctgtgtgaaaggttagattatttatttgaaatctttcctcttttataatacacacatttaacactgcaaatttatctctcattactactaaagctgcactccccaaattttgatatcttatattttcatttttgttccgttcaaaatattttcttatttttcttgagactttctttttgatatatgaattgtttcgaacaatgttgtttaacttctgtttggagactttcctgttactattctgtcattgatttttggtctaattccattatagtcagagaacagtttttttgtattatctcaattttaaatttttttcaggtttgttttataactcaggatatggtctatcttggtatgtgtttaatgtgcactaaaaataaatgtttattcttctgttttgggtgaattattctataaatgtcagttagatccagttaattgatgatgttctgttctcctatagcagtggttctcgactgagaatgattttcccccacttcccccaggggacatttgtcagtatctggagacatttttgataatcacagcttaggaggggatgctgctggcacctggtaggtagaaaccagagatgctgctaagcatcctacaatacacagaagagccttaccccacaactctcaccataattatccagtctaaaatgttaatattcctgaattttctgtttgccctaacagtcaattaaagagagagaagtattgaagtttccaactataattgtggttttgtctgtttctctttttagttctgtcaggttttggtccatgcgttttgaagctttgttattaggttcatacgcatttaggactgttttgtgttcttagtgaattgaccttttatcatgtgtaatgtccctctttatctctctcttctttgctctggattgtttgtttgatattaatatagctactccagctttcttttggtcagtgttacattggtgtatcttgtttcatccttttactgtttttttgtttgttgttgttgtcaaatgatcattcatttaaatattttcctttgtagttgttaactagctggacattccactatgccattgttgatgtcatctatgatgcggagtgtggtagccatcaatagtgcagtccaccagttggtgggcagtctccaggagctctttaagggttccagagagttctctagctaaatatcagtgctgcattgggaaatgctgacaattgcaacaaaaatgatatttccactctgcttactgttttttttgctgttttctgtcacagagcgattcttggagaactttgatgatagtgcagaggcagaatcctcaatctgggcctgcatgttctgaatggttcatttcactgtaatccttagggtcttccagtcactagctttcttggcaatgtcattaccaacatttatttggagacaggtccatggagttgatctcaggggtcagggcaggcatgacactgatttccccaccagcgtccctcaggtatacaactttgattttggtgtgcttgaacctggatggcatggaagaggcggctggtgttatatgaaatcagatgctgcatggcagaagaaggttgcactttgttttcctctgagctgaaagcccagagtccatacttttactttgaatctacttatatttttatatttgaagtgaatttcttgttgacagcatatatttggtttgtgttttttctccattttgacaaactttttaattagcttgtttagcccacttaaacatttaatgtaattactggtatgtttgaagtctactgtttcatcatttgttttcttctgccccctaattttttttgttcctctccttttccgtttctgccttcttttggaactttttttgtatcccacttgatctattgcattttgactatatctctttgtatatttttgtttgccctagagataacaatagaaaaatttagctttgcctacttttgccacttcaagtagaatatagaaacattcccaccatattggtccctttagcctcaattctttgtattgcagttgtcttatatattactctacatacattgaatacctcatcagaagatgttataatttttgttttcaactacaaacatattttaaagaaatccaggccaggcataggtggctcatgcctataatcccagtgctttgggaggccaaggcagaaggatcacttgaggccagaagtttgaagctgcagtgatctataataggattgtgccattgcactccagtgggggtgacagaacgagaccttgtctcttaaaaaaaagatcattacatagcagaaaaatagtctattatactataatggtctattgtattaagaacccctcacagtagagtaactatgatttataaaaatctattgtatatttcaaaatagctggaagaagaaaaaataggacctcgccaaccaggagaaaatttcccatatcacttcagccttctgtttcttcctgcagcttctctcctggcctcacatatcaggagacctgaatttcccactgccttgagataggcttggaccttactaaactcaatacaactggcttgaaattattttttgaaattttgcttttaattaacacataataattgtacatatgtatggaggatggtgtgatgttttgatacatgtatacattcttttttttttttttttttttttgagacagagccttgctctgttacccaggctagagttcagtggcatgatctctactccctgcaatctccacttcccaggtccaagtgagtctcctgcctcagccttccgagtagctgggattataggcacctgccactaagcctggctaatttttgtatttttagtagagacagggtttcaccatgttgactgggctggtcttgaattcctgacctcaggtgatccccctgcttcagcctcctaaagtgctgggattacaggtgtgagccaccgtgcctggctgatacatgtatacattctacagtgacaaaatcagggtattttgcatgttcatctcatttatttatcatctctttgtatgagaacattcaaaattcttttagctcttttaaaatatacaatacaatattgttaaccatagttaccctactgtgcagtgtaaaagcagatttttttttttatttaaaaatatttattgaacaccttctctttacttggcaataggtgacatgctggatatacacggtgaacaaaacaggcacagtcctcactttattgggttctcattaaccaaagaagttttattgatggaaaggattcacacatataatgttatataagttatttaacccctttgagtctcagttgtctcttctataaaatggggttagtaatattttccttccagaattattatgttcccatcttgttcataatgcatatccctggttatctgccatatagcgggtactgtatgtttattacagaactaacgaatacataaaaaatgaatatataggtcccttaagcaatgggtccacattatacagtagccaatattatggacaatattttctcctcctttttaaaagtcagtgtcacagataacaacaataagtgtgacaacttgtatttgtttactctcactttttttccttgctaatttttaaagataatatgtctttcgtagggacatggatgaagatggaaatcatcattctcagcaaactatcgcaaggacaaaaaaccaaacactgcatgttctcactcataggtgggaattgaacaatgagaacacttggacacaggacggggaacatcacacaccagggcctgtcgtggggtggggggaggggggagggatagcattaggagatatacctaatgtaaatgacaagttaatgggtgcagcacaccaacatggcacatgtatacatatgtaacaaacctgcacgttgtgcacatgtaccctagaacttaaagtataataataataataataataaaagaaatgagccaggcacagaaagacaaatatcatgtagtctcacttacaggtgggaactaaaaaagttgaacttagaagtagagaagagatggtggttaccagagactgggggtagggggaagacattggtcaaaggatacaaaattttgattatatagaaggaataaggtaacggcagtatttattcttcctgtctaacagtaactttgtacccctggaccaatctcttccccttcttccccactccctactatctccagccactgctaagcactattctactctctactactatgagattaactttttgttttttgttttaagatttcacattagtgagattgtgcagtatttatccttccgtgcctggcttatttcattttacagaatgtccaggttcatccatgtagccacaaatgacagaagttattttttgtggctgaatagtattccattgtgtatctatatatcaccttttctttatccatttatttgtcgattgcacacttgggttgagtccatatattggctattgtgaacagtgctgtcgtaaacatgaaaagtacaaatatctctttgacatactgatttcccttcctttagatgaacatccagtagtggaattgctgtatcatatggtagttctatttttaaatttggaggatcctccatactgttcttcatgatggctgtactaatttacattcgcactaacagtgtataatagttcccctttctccacgttcatgatggcatttgttatttttgtcttttaatgatagccattgtaactagggtgaggtgatatctcattgtagttttgatttgcatttccctgatgattagagacattgagccctttttcatacacatgttagcaatttgtatgtcttctttagagaaatgtctattcaggtattttgccattttttttttttttttgagacagagtctcgctctgtcgcccaggctggagtgcagtggcatgatctcagctcactgcaacctgtgcctcacaggttcaagtgattctcctgcctcagcctcccaagtagttaggattacaggcatgcgccaccatgcctggctaatttttgtatttttagtagagacgggatttcaccatgttggtcaggctggtctcgaactcctgaccttgtgatccacctgccttggcctcccaaagtgctgggattacaggcatgagccactgctcccggctgccaatttttaaatcagatttttgttttttggctgttgtttgagtttcttatatattctgggtattaacccctggtcagatgcatagtttgcagatattttcttccattttgtaggttgtctctttagtctgttaattatttcctttgctgtgcagaagcttggcttgaaattattaaaagtgtgatttctatgtgtgaatcaatcacaagacatgtcaaaaggaatttctttttcctctggaggaaaaagattaaacacaagggttcacaattgactccacgtggttatccacattgtgttgtcacaatgattgcacctgaaaactcatctaggtctttggaaagaagagaatggaggactaacatttactgggacactcccatattatgtatctgcctacttctattaatatagccctgtgcagctcagatgtgctagcttttgttgtctcagaaaatgtctctctctctgtctctccacacacgtgtcccccccccccacacgtttcattactgaacaatatatataatacttacgttttctcctgaccttttagctagcagagtgtatgctcagcacatgagcactaactagggtgacctaacaatttatcacataaactagaatacttttgaaagcaaaaggggaccctatgacaaatgccaagacagctgggcctcatgaagtgcatcataagcagcactgcagctgggaatgaacaaccatcagtgacttgaaccacagcttggtgaagacagtggcaacagccttgacctcagaggatttgaagagaatctgtgagcaatccccggggatgaaataatgcagccattcagaaccttgtccctgagcagtaaggggtttccttgagcacaatctcttctcatatttacaatcgctctcctgagcaataaggggtttccttgagcacaatctcttctcatatttacaatcgctctgcaagagagatattattattcttacgccagagaaaaggaaatggaggtttaaagaataaatgcaaaatgtccaaaatccatacagccagaatttggtagagcagacactaggactttgccctgtctgattccaggcaccaacttggaagccatgcaatgtcctgggctggatacaaattttggtggccaccgatcagggttcaaattccagctctggttaccgtggctgccctgtatgatcacagtgcaatgttgagtgtagtagctcatgtgaatacagtgcttgccatagtccctgctctgtactacatgcattccctatgctatcccatttcatgctttgtactaaccccatcatgtgtgtactattagaaacaccattttgcaaatgagggagatagtctgaaagaggctggaaaagtgcccactgcatgaaagatacacaataaatatatttcccttctgtcctgaccacagggtcagagcacagtagaggtcttgaaccattctgtgttttatgatattgttctggaaggtcttaggaggcaatgccctctcctaatgaatgtgcctgcttttccagtttttccaaaggctcaaggattacttgttatatggtgcatattaattatttttttggtgtggccaaaatccttcccactttcttgaaaccattttgtcccgtgcagtggttgtggccatgcataagaaacagcaggtggtgccagatgacagatggtgtgggagcgcgttccccggtaggagggggcgcgagcgagcaagcaggcaggcagctgccaggagctcttccctgctcgctcacgcctgctctcagaagctccgatccagacacacgcgaggcgctgtcctttcagcaccacaagctcgggctgaggagggaggactcctggccgtcctcctcctcttcaaattggcttgaatctgctctgaccccccacgagtgcagcacagtaagtaggcatttgtttttgctataaccactccccaatatcctccaacccctttcacccccacaacaaccctgttttgtctaaacgttccatcagcaggattgagagaagaaattcagttgtgttgagcttctgggggtgggaggggagcaccatttgacttctaagggatctggagatgaataaatgtgatttgtttatttagttggcaatcctgcaatatgggggctgctaactttccatggaaccaaaaaaaaaaaaaaatggcccttcgctattgaggaaatggaggcattccatggctgaataacaggatcaggttcaagctagccttttttttgtttgtttttattttaggaaattgcacctcatgtacaatccacatatgatgtaacagggtacacattgagacgttgaatgtatttattgtgttttagggtattgctgatggaaaaccaacataatagaatagcaaccagagtggtgaggtgaaatttatcatactgcaggcggggggggtggtataataggacttcattttgcactaagtataatctttttactggcattgtgtgagcactttagctctagtgtcttgggtatttgttttacacttatattttttgtgtgtataggtttaggattttccttgaattccttaaatttgagtgctgttgaaccccatgggaaggtggcatattttgatgattaaagaagttttgttggacaatgggaatcatgtctggaaatctagtggaagatcaatgactgatcactagattgaaagccacttgagtggagctgttgaggacagtgctattttctctgtcgtcagccctctctttctgcctcacctcctgctgtaaccagaatcccactgcttgccttaggtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtaaagcatgtcctcttgctctcatcagcccccaggctccccccatctcaggaaataaagcagcaaaaaattccaccccccaaatcctttcattctcttatctgccaaatgtgctccctttcttgtaaaatgtagttattccttccagagccaagacatctcttgtgttatttcagatttatggtaagtgtttattcattttttgttcatatctgcataaatgggcaagcaaattgatctttccttgttaaagttttcttacagctggtgaatactaataagcttctaggtggtgacagaaaattcatcttgattattttgggaaggtctttcaaaaattgacaggtatagatttgaggacagaggattggattcactcaaacaagcattcagtttgtacctgctaaggccctgtccctatactaggagttggttataaaaagacaaaattacaaaatccttttctagtatgacagattaattcatcctggtaaatgttatacctgagcattacaaagattgtgagggtgcacaggtggaaacaactaaattctattggggtggagaaggtttgggaatgggactgagaagacaggttaggcaaactgcagaggagagcatttgaattgggcttttaaaggtgagtaaaaacccttcctggcagaccatggagtggggaagggaaggcatttttaaggcaaagggcacacatatgcaaagcatggagagctttaggggagcagcatgactgcaggagagtgtcttttggggaggcgtggctggaaatgagtgactggctgatggcacatctcctgacatgggagtagtccatgaagaatggaggtgggcattcacacaaaggtgggatgggggttatggacacagaagggagaaatagtatcatttcaggtccacctgagacaacctggggttttattatgtgagcttttgtacacggtaagggagagacttggaggccaatgatggagttccctggcttaagagcgaacaatggatcattccatctgtttgatttcccattggcatctgcaggagggcattgtgtgtcttaaccaattggcttcaaccaatcaacagaagaggagccaaagctagataaaggggctgctgattggccagaggttgaatcatttgttttgaaagtgcagagattgtcaataggagaacgtgcaggggtggggtggcagacagagagaattcttaagtgccatcctaaggaactggtaaagcctttaaagataaattctgaacaggcaactaacactaaagagatgagaaggggcaatattaatagagtatgtgctacatgtatatcagagcttcttggttttgaactgcatattagaatcacctggggagattttgaaactcctgctttctagaccatgacccagaacaattgtatcagagtctctgagagtgagacccaggcattaatatgaatgaaatctcccaggtggctcctgcatgcagccaaagttgaggaccattgttttaggtgtgcattaacctgggagtcagggattattcattcatatttgtagatgaaaatttggtgagttatccaagctcacagaaggagtaagtagaaatgttggagtttgaacccagatataagtagaggttgggtaggagaagggagagatattctcttggggctttatgaggccaacagctatagccttgcagatctgcatgtctttaagaagtgtgaaaagaaaagggattgtggtgaggtcatctctcccctagccttctacatgcctgcaggtcatctagagattatcatggtctctgtccccccttactctcccacccacctcccagggctttattctttccttgagagaggaggcaggtctgataaccactgagtatccagtccaggtgcaccagaagctgtcccaaagcctgaaggataatgcattgtctctcatagtgggcctgcatgcatgcaacgtgaagccaattatcctgaaagatccagggcacccagtttgacactctgattgtcatcacacagtctttcaccagggtggcctcagtttcctgtttttttgatatggggaggatcacatctacctcacaatggtcagaacaaagttagatgtggcattatacgtaaagtgcctggtaaaaaaaaaccgcaagaggctgggcatggtggctcatgcctgtaatcccagcactttgggaggctgaggcgggcggatcacaaggtcaggagatcgagaccatcctggcgaacacggtgaaaccgcgtctctactaaaaatacaaaaaaattagccgggcgtggtggtgggtgcctgtagtcccagctacttgggaggctgaggcaggagaatggcgtgaacctgggaggcagagcttgcagtgagctgagattgtgccactgcactccagcctgggcgacagagcgagacactgtctcaaaacaaacaaacaaacaaacaaacaaaaaaacaaactacaagagaatagcgtcaccatttttcaagtgcttcctaaattctaagctatatgtgcacgcgcacgtgcacacacacacacacacaatcactcacacatgtgtgcaattttctttcttcttctcaggaattaataggccccagtgagggagtcactactttggtctgaattttacagaagctgagacacagagtggtaaagtagttccccatagcaaatagctgggaaagcatcctggacatagagcccaggcagtgctgttccagaaccttctacctcagcaggaatgaggagtgagccagcctgggagtccccaggtgtggtctgtggctcaacctcagccactgacccacagtgcgctccattcccctctcttaggtctgtgttctctgagtggaaaattgtattatcagttttctgtgctaatatttagattttagaatctttacaagagtaattacattgtttccctgacatgagaacagatgtgttcaaagtaaattttgctcaagaagccaaaggtcctctaaatgcttagaatagtgtccagatgaccagcaaggactctgaagccacctctttaggtgggttcaaatcccactccaactcttaccagcctgctttggctaagaacttggagggtagtttcttaagttgcctcagcatcagtcttctagtgtatagaatggggacgctaattttgggactcactcacaggacttttgtagaggaggcagagtgagccctgacacagctgtcagctgtcagccctttggttaggctccagtcagatggtgagtacttgaagctaagatggttatcacaaagaaggatatttgaccccaatgtcagatcatggcttttctttttgaaaatgtaaaatacagagtatgcttgtaatactgaaaatcagtattctaagtatcctttagtagtatgaaatctgaatttcaagagaacagcttctggaggctagctggagtcctctcgtggaacgtgtctgaagacttgttccaggccagggaggggactatgcagggcattcaggttatttcagttaatcttcccagtagccttgtgaggtggatctcagtgcacccatttcactcatgaggaaactgaggctcaggacaatatagtggcctgcctaaactttacagatgaagagtggaagggctagggttggaacctcagtgtacttgatgttccaactttttttttctgcattgcactgccttcagtaagaagtctctcattctgggagagtgcttcctcaaactctaggcttcctcatccatggctgccccttgagccctccccctggcaggctcctggacctggaagggacctggactggtcccccagacagaacaccagaggccccagtgctctctccctgcctggtgctggagagactggtgtttgcctcagggaagagcagcaggctcctgagttgcctcctgcctcttctccctttcatgcgactcactgccgccaagcctccacactgcccccaagcctccccagggctgtgccttggtccttctcccatggaaaccttctgcatctcctcaccccacaacatcccatccctgaatcttgaccttgccactccagctctttcaccatctggcctgcgctggcctccattcctttcactcccacgttgcgcctcgaatgttagcgtgccagacctacctgcagcagcggtgctccatgggggcgattctctctccctggggggcagttagcaatgtctggagacatttttcgatgtcacaactagagggaggattctactggcattttatgggtggaggccaggaatggtgctaaatatcctataatgtacaggacacccaagtcccccagtcctgcccctgggtagaattatcctgccccaaatgtcaacagcgccaaggttgggaaaccctgccctagagtcttgcatactccccaggatgttccatgccttcacctccatgaacatgccattccttctgcccagaatgcccttctggctcctttgcttgtatgatgtcaatattaatctttctaaacccagttcagacagcacctctcctgaatgccttccttgaccactgataagtatagctgtagttgtacctattcattcattcgtcgtccatctatccatccatccaccaatccatccatccatctacccatccattcatcatccatccatccatccatccagcaagtcttatagggtaccctctgtgagccaggcactgtgctaggccataggtacacagcaatgaaaagacagcattggccactgctttcatggagcttccagtccaatgagaaagagagacttcaaacaatccatcatacacataaaagcatatagatgcaaattgtgagaagggctattaaggaaagaacaagatgttgtaatgtaaggagagataagacatataggggacctaattataatgacaaggtggtcaggcagcaggcctaactgagccctcagaagggtggaggaacgatcagggggccacattggctggtgatgtcaaatggtggggagagacttaagagatgaggtggggtgggtaccagtttatgtggattgtttgtttttttcaaaaggtatttaaagcaggagagtcacaggatcagagtttgattttggaagattgccctcattgctgtgagccaccctagggacaagggacaggttcagtctcatgcttggtcttctgatctcctctacttctttctgtccaatcagtcctccacgcagcaccagattagtgtcccccaaaacaggggtgactgagttgcctgaagcacccccgatatgggagtagaagaaaggaatgggaggtctgacaccagttagaaggccactactacattcagggaggagagggtagtggggcagtggcagtggggtggggaggctagtggtattgagatgtggtaccaggttgattgggaggagaatttgctttctctgctccatttgcccactagacctgaggccccagctagacctgaggctgtgtcatctcggtagccttaggcctggcctgcagtgggcagtggaaattactggctgatcccctctcttgcctagcttaaaactggactcaatttctctacttggtagctgaggaaatagactcaaatctaggtggctttctccaggccatgggagcaagctcctgaaaagctggaacattagtttgcagacatcaaatttcaggacatgcctttggtgctttgctgcctttggttcatctaagtagccacaataacccaggtgtccccacaagccctgtgacgttgctaccataatccccattttacaggtgcagaaacaggctcagacaggtggaaggctgtcctagggtgcatcaaaggaaaacagtgcagccaagatctgcatgcacgtgtgctgggaagggtggcaggtgtgcagaaagcaaaccatagacaggcacaacccaccttggcagagccacaggggaaccataatcggcaagtctgctgctgcgctctgggcaaacgcttcttttctttctattgattattaagtctttatgcatcttggaggaggtcacttacctgcttgtgggaggagaggaacacagatatttagaaactaatgactaatgtatggcatgctttaaattttgcacagtaggccacatgcacttcatagtcctagagacctgggttcaaatctcagctaagctatttacttactgtgtagctttaggcacattgcttagcatctctgggctttgagtttgttcagccctaaaacaggcaataatatctacctcagagggtgctgatgagggaaacagtgtgacagttgtctaatgggcccagctcagtgcaaggcatactgagggagagcacagatagggtttcctttctttcactgggcatccagaatatgtctcttgaagatgataggtttagaaggagactgcagaattggagcatgctgagaaggatggggtttcacaggtgggtgtggggcggggtggggcctgatgatgctctgcaggggaggcctgaaaggggacctatggctgtcactgaggcctgtgtgccttctgggcctctccctgggctttccgcagtgtttctttttctctccgagacacaggatatgagaaacataggctttccccagggaacaacagaaatgcacatcactgcaggctccaggccctagagccccctggttcttcagagaatctcaagagatgaattgtaaatcatctcaaattgggacaacatctctgattaggcagatccagcaaatagctaatgatcaataaatgtagcaaaaataccttataatttaaaaacacaatcttaaacaaaatatacttttttacctaccaaattggcacaaaaaaatggatatttcctcatgttgacaatactggggcaaacttgtcctcagtttgctcttgttggttatgtaatgtgatgcagtgtttttcagagggtattttgacattgtctgtacaatgtaaactgtgggtagcatttgactggtatgcttttcactggtaggaagttaccctatgggtatatatttcaagtatgcaaaggccactatatattgaaaagaactgggaacaacttggactattccctgagaagggcctggttaactgagctctggcacacgcatgtggaatcctaagcagaggttttgagaatgaggctgatctgcatgcgccagcgtggaaagctataacagacacactgcttcatccaaacagctttaaagagaatggtgtggagtgatcccatttggggaaacacacatagtgtgagcatgttttattcttgtaattcataagacagttttggaaggacacacagaaaactgttaaatgttagggaaatgggaattggggtaggtgcgttccatttgaagaattttattctatactttttatctttttttgtttttaaccataagaatgcgtcgaattttattcatctgtttttagagacaaggtctctctctgtcgtcctgaagctggagtgtagtggtgtgattgtacatagctccctgcagtcgcgaactcttgggctcaagcaatcctcctgcctcagtcccctaagtaactgggactacaggcacatgctaccacacccaggctgatttttaaagacttttaatagacggggccttgttgcccaggctagtctcaaacttctggcctcaactgatccttctgccttggccttccaaagtgctgggattacagatgtaagccactacacctggcctcagattttctattaaaaaaaaatcacccccatttcacagacagtgaatggtctcagggaatggatgtaacttgttcactttgacacacagggagatcactgtgaagccagtgtctctctgtacagggaggtgtcagaatagcacagtttaaattcaaatcctaactccacctacttgcactgtgaccctgggtgagtttattaaccactttgaccctctgtttcctcatgacactagtatctttctctaaggattgttgtaaagataaaatgaggaaaatacatagcaaatgtttatcatagtgtctagtacgtagtagatgcttaatgcaacggagtaattattattgctgttgttcttaacatgatctatttagtcccagaaacaggttccctgtttccggaggtcacagggctaccccaggcagcaaggagaggtgaacagtgacatggtctgggcctctggactgtggaagacccaggtggcagagctatgggctccactgtaatgattccagcctaggcagcttgcctctgttcagagcagaaggagctggaagtcccccgtagaggatcctgtggagagcacctcatcttgccccatgctatgcattgccatagaagtggggagttggctgggcatggtggctcatgcctgtaatcccagcactttgggaagccgaggtgggcggatcacgaggtcaggagatccagaccatcctggctaacacggtgaaaccccatctctactaaaaaaaaaatgtaaaaaattagctgggcgtggtggcaggtgcctatagtcccagctactcgggaggctgaggcaggagaatggtgtgaacccaggaggtggagcttgcagtgagccaagatatcacgccaccgcactccagcctgggcgacagagcgagactctgtctcaaaaaaataaaaataaaaataaaaaagtaagtggggagttatagatttattgaggcagatagttcatttgagaccaacttttatattgcctctgagaaagcaaagcaaaggcccagcaagaaagacaaagtttattccatggaaagagctccagactgagagttggcattcatactagagacctgcttccgactcagtcttactgtgtgacctgtggcaaatccctttcccgctctatgcctcagtctccctatttgtgaattgatgaggttggacaacactgccactaaagtcttttgagcactgacattttaccctgtgttcacggcccaataccaaccttcaaggcccaggaaaaaacttgaatccaaagagggagtgtggagtgaggagcgagaggtgcaaatggggaagttcccaactaaggatgcaggccccatctgggcaacttcaccctctctctttagaaataggatttatttgttcactgattcattccacagtttttatggcctccctattgtgtcttggttccccaggatcagagttcaagtgttaggtggcacttggaactgagcttaggttcaagtctgggctctgcctcctagtggccatgtgaagttatgaagtcatttctgctctctgggactcaggctccttatctgtaaaatgggaataattacctttacctcatagaatgattgaaaagatttgctgagatacaggatgtaaagtgtttggcacagtgccaggcacatagtgggtacctttacaaaaaacccaaaaccatgatcaataggaaagagtatggtattcttgagtttgaatgtagctcaacccgaggccagtcatttgatcacaggcaagcgactgaactctcagaggctaaatttcctcacctgaaaaatgggaataatcataatgattttgaaggagagaactgaggcttggagagaatgttgtcaggagaattatgagaattgaatgagtccacatcagcagggcacctggcaccgtgcctggctcacagtagggattcagtgccagccatttattgtcctggctctgaacctgtctctttgctccagggatgatgggtatagcttagatctatttttggactgtgcaagtccagctcataaaaatacaatcttgctccttgtcagcacttctgcacttgtatttattgttcctgccaatcctgggacctctccatgtgggaacgtcttcattattgataatcctgggaagtagtattttaaatttttatgatctgtactttgcactgtctgaaccaccatgtattatctggccttgccagtgacacgggaattatatccagacaaggggtcctttagggatgaataatttatcccattttcacaatgccaattatattaaattatgttcttcatattagcagctgacaggacaatggggatccaatgtgtaaatatggaaagaaaacaaagttatttctttgcccaaatccacagtcatatttgaaaacctggagtttcatttttccaaatatccataaaaccccacttttaagaataaaaagagtaggagaaattttgcccctcccctctctacttttcttctctcatttctgctgatagacaaggcgctcagggctctgttttgctccattttcttttaactgcgggaaaaagaagaatgtctagaagagaggctttctttgcaaatttatttttctcctgtcttgttctctttgcctatgcgagctgattcctccaaggtacaattaataacgattggctaacatttcttaatgctttccctttcagagtactaaaaaaaaggaactgtgactttatcgtttatggaagggaaatgtttctggctctactccacaggaacaaaacactaagctttatgaaagtcctctagctggctggttgtagtgactttgtagggttgtattttccctgctctctgccggtccccatgcagtgtaccttcactgtggccagaggcctctcctgtgcctgaaatgcatacctgcaaagccgttttctcatttataatcattcctcagctcttcactgccctcacattaatcttcaaggtgcctagcatggcattcagagcctctgtgtgcctctctagcttcctccctgtcacctactcacctcacccatcctgttccctggccacttaaaactgcttctctgtagttgcctcaggtgctggcctcccggatgtcttctgaaggtttgctggtattgtctctccctcgatctagagggatctttcccctgggtttggaaacaaggaagctggccagggcaaaggtccaaagagagatgaccatgtcctatattggggtagaggccgtgcaactggatgagtgggttgatttaagggaaatttttgaggaagctggagctggaatgggtggaataatggaatgaattttgagactaaagggaagggaggaatcatgagagattctgtgtttgatttgacataaacagtagtttggataatgctgctgttatcttctaagttggggattacatggcatgaagatgttgagagtgaggtggctggggcaggagggtcaagggtgaatgttcagtagggtcatctgagtgttgagtgatatctgagtggaagtaaatatttgggagtcatgaggataaacaatgaacttgattagccaggtgtggtggcacatgcctgtagtccaaactactcaggaggctgagacaggagaatttcttgaacccaaaaggtagaggttgcagtgagctgagatcatgccactgcactccagcctgggcaaaagagcgagactctgtaaaaaacaaacaaacaaagaaacaaaaaaaccaatgaacttggaagtgatgggagtgagaacatgcagagggggcttgtagatggaaagaagagtggtcatgagctggctttgagaaatcccaacactgagagatcagaaagaggaggagcctggagtggagacggaggagggctgctgggtgagccagcaacagaaccaagagagaggctgccatgggcccaagggaggagaacctttcaaggaggagagagagaacaagcttgtcaaaaatgactgagaggtcaaagaagatgaaggcagagcactgtccatttgttccaggcaaacaggccaagaccttttgaaatggagatggagttccaaagagctaacacttcctcggggtgaagacaaaatattgtgtagcagcctgagttgcttttggagaaaatgtggcttagctaaagaaaacagcagatgactgaggacccacatggtatcaggcacctgcctgtctcttggcctgtatttgaactttgtggtttgaggagtgaggacctgaagctaaagggactattttcattagaaagtcactcaaagcctaagtagcatttcataagggttcagagcaaagcaggacatggatttgaagagagggttatggtcccaactctgcctaatttcagtaccctctaaccccatgactgcaaatggtgagtggcatatttttatgataaacatattatacatataaattattatatgtatacttgaagttgatgtaaatgacatcacgcagtatataaaaacctcttggtatctaatttcttttgttcaatgtaatgtctatgaaattcatcaatgtatatgtagtatagcggtgaggcattccattttctgagtaaaccacaatttatccattctcctattagtgtacatttgagatgttcccagtttggggctatcaggaacaaagctgctatgaatgttcttgtatcttttggtggacccattatgtttttgagctgactttttgctgacacctaggaaatctattgattttggtttacttatttagtatttggctaccttactaaattctaatcacttttcagttcattttcttgggttttcttggaagacatgtgtatcagatagaaagcttttagtttcaagtaacagaaaacccagccaaaattatattaaggctcaaagagtaggtatttgcccctataactgtggatcccagagtaggtctaacttcaggcaaggtgcaatcccggggtaggatgtcatctggacccagctccatttctctgggttcctcttggctctgcccttctttgtgtgctgccttgttcttctcctggttcccatcaagatggcaacaattccaggactaaagtcttcagcataccatccagaggaagaatcactcatgaagacctacaaggcttctttcatcaagacactagtcaatactacctcatagctcattggtccaaattgggtaacatgcccatgtctgagtcaatcaaattgtgtgatcaataggatggtatgccctgattggctcaacttcactagggaccatcactgtcactaaggaagtggtcaatcccactgaaccacatggctgccacacagtgaggcaggggtgggttcccaaaaggaatatcatagcgcttttggttgaagaaggagatggatgctagagaagcaacctcaaaatatttattattatgagaataaaaatgatattgcctgtaatgattattcatggtcttgttctgacagtaatatttttcagttctgtctcctgtctcaacatgttggttagaatatggggtcttttaagtttacagagaatggaaacggttttcagatttttcaaaagctctgggaaggatgtttataaaaatagagagggagcgagaaagactaagaagcaagtacttcttaatattttttttttttaaatttactagtctctgagtttgcatccaacatttgatgtgaggattctcaagaacagttggaggactgtggatctagaaaggaagggatcaagccaagagatgatggaaatagacttggcaatgtgggaaggtggactagttttcaattgctgtgtgacaaattaccaaaaattaagtggcttaaaacccataaacttattatctcacagttttcgtaggtcagaagtccagccataggctagctgggttctctgcaccagggtctcatgagcccgaaatcaaggtgttggccaggctgcattcccactgacacttgagatcttctttcaagctcattgaggctgtcgacagatttcagttccttgtggttggaggactgaggtcctggttttcttgttggctcttggttgagggttgccctcaggtactagctgcatggctgtctttcagcatgtcagtttaattcttcaaggtcagtggagaatctctttccagtctgttaccctggagttttacatagcacaatgtaatcatgggagggactagcccatcataaccacaggtccagcccacatcctaaagggaggaaattatacagcacatgaacaccatggggcaggaatctttggagccaaattagaatgctgcctaccccaaaaagcaattattaccccaaggcttgtggctcatgctgaccaagaaatacatatattatatatattaatagatatgttacatgtatatattacacacacacacacatatatacatacacacatgcatggggagataaaattaaaattgtaaatccaagtttgtgaatatttctaaaatcgtggattaagagaaataatcagacatctaaattttctgtaccacttcataatctgacagttgatctagtgatgtccaaaatatttctaataactggaatttgtagaatatccttttagttcacaaagcacctgcatgtatgttctttcatttggtccatcccagaatgctgtgaactagcctaggagctttaccatttgctcttttgtttacatcagcttccgactctcgtattcgcattgcagttcacatgccagcaaagcaagttcttgtagatcacatgctatttcacacttttgtttctttggctctgtggtacactttgcagagactgtcttcccttgttttgtccacccaggaaacttctattcatcttccaaaactcttttttttctttttttgagacagagtgttgctctgtcgccaggctggagtgcagtggcacaatcttggctcactgcaacctctacctcccgggttcaagtgattctcctgcctcagcctcctgagtagctgggattacaggtgtgcgccaccatgcccagctaatttttttaatttttagtaaatatggggtttcaccatgttggccagggtggtcttgatctcttgaccccatgatccacccgcctcagcctcccaaagggctgggattacaggcgggagccactgtgccgagcccccaaacttttttttttttttttttttttaggcagggaagttgggggcattcttgaatgcccatgttcctgagaagtccttgtgttgctcttgataggctaggtagggtgacactgcagcctgacaggtgcaaggctccactctacagctgcctcagtatctatggaagaaaatgtgatagcacccagatgttattggattaatgttctgaatgtctaacttgcatcaactcatttatgcctcccaacaatccaacgaggtggtcatggtgatttccccattttatagatgagaaaatcaagacacagaaggcatcatcaactcacccaaggtcaccagctagtaagttctggagccaggatttgaactcagcccacacttgtacactcccctacaatattgacaatattggtatctgctttatagtgtagaattaagtgaggtaaggcatgccaaatgctcaatgcctgctatatagtaaatgcacaaagtatgagaattatttttcttatctgtggtacaagagcttctgttttcctattctttggcctagtgggtaggaagaaaataaaaataacagagcatccttctgcccccaccccctgtaagctctcatccatgtttggctgtgttgcttccctgtttgaggaagccaggggctctctttttgttgtttggaggaacagattgcaaagagggcaggaaacaacagcagaatttccatccagaaatgggttctagaggtaagagagggtggggtgctgatgggctggggtccagggcctccttaacccccataagtccagccataggttagttgggtttaggtaccacctggtagatgttccgtgtatggtagcgccgtccctatcccttcctttttgagctgcattgagtccatgacatgcctcacagatgttaaaggacattcttcatagaagaattcttgctctagttaatacgcttgactgttgtctccagggaaggttggtgggcgttttcagtgaaaattctgttaatttgagccataatgggaagtaggagtgatcatggttagaagattacttcattttagctgtgtgaccctggacaagtgacttagcatctctgagcttgagtttccttgttaggagaatggaaatagtagtgataggtaggtgaggcatatgaagtgcttgatctagttctggcatataataagtggttcaaaaatattgctcattatcatctcacttaactctcaaagcaaccttacaaaatagggatatgaattagaattatttgtctctattttacagatgagaccctgaggcttagacagcttctgtgttcctcatggcactgcagcacttggcaatagttattgattatctgtcaggtttctttttctttcactttgcctgcacagtgggatggagttacataaatgtcttgtcaggttgacagcatatcttgataagatgttaaccacctctgcaaaaatattcagactttagaaaaataagatgatacaacagattcaacagaactttctatttttcttctcacaagtccccaaatcaaattggaattaagtgtgtgtgcaaaggcttagaaacagaatcttcatcataactttctattttattttattttattttattttattttattttattttattttatttatttacatatttatttatttaatttttgtgggtacatggtatatatatttttggggtacaggagatattttgatacaggcatgcaatgtgaagcacatcatggagaatggggtatttatcccctccatcccctccatttatcctttgagttacaaacaatcccataacttgtttatataaccaaaactggaggcaacctaaacgtgtaacaattaaagtttaattagatcagttgcagtacacacatgcagtgaaatgttatactatgccaaaaggcaaaatacaatgatatatttgtttacattggaaaattggagaaaaatatagtgttgtgtgataaaagcaggttataaactataaagtatgaattcatctcataaaatatatattttcacaaatagtaaatatataacaatatgtacatatataagtctatataaatatctaaaaaggtataatcaaagttgttacctagggttgtctctgttggaatggggaagtattatgagtaacttgaattttctcttacgtgtgtttgaaggggggttctttatttttttgatctttatgtcatgtgtaataaattctggttactgaaaaaaaagaaaggaaaatgtttcaagtctccatgcatgctaacacactggttgactctttcaggtgattgtgaagacaagaacggaatatcagccggaacagaagaacaaagggaagttccgggtgccgaaaatcgctgaatttacggtcagtttcttgatggtgtaatagaaagagtaaaggagaggctggctccagccagctcagcacacctcgtgcttggagcaagtactgctgtgggtggggaaatgatgcaggctatttctggaggatttcttgaagccatacagtctggccactgagtttaatcaaataacaagaactctgcctctgaggtctatcatattctcgtgtactctggaatgttctgataaatctcataattgataaatgcctcttctattccttctcctttctcctgttcccttcttcctgctttttcatcacaatctccaggaaatgtgatggaaatgcagtaagtgactcacattttagtccttcgttgcaacaaatatgagaaaaacaaaggtggggggaagaaaagctggcttcttggtggtgaaaccctaatggttggcttcctatttcttggtggaggggccgcgaggagcactggagaatatgttgctagctgtgatgaattgcatcaaggatccacaaagcattctctgtgagggtgaaagaggaatcccagggaatgccccgaggaagtcacttaggagctgaggtgggtggggaagtgggtatgaagcaggtacaaggtgcttgcagctgaggagagtgcagcttgtgcaaaggccctgaggcaggaaggaggctagccccaaccctgaatagaaacagaaatagaaaccctgaatagaaataaggacagtgagggccgggcacggcggctcacgcctgtaatcccagcactttgggaggctgagtcggatggatcacgaggtcaggagatcgagaccatcctggctaacacggtgaaaccccacctctactaaaaatacaaaaaattagctgggcgtagtggcgggcgcctgtaatcccatctactcgggaggctgaggcaggagaatggagtgaaccagggaggcagagcttgcagtgagccaagatcgcaccactgcactccagcctggatgacagagcaagactccgtctcaaaaaaaaaaaaagaaataaggacagtgaggccgggctctaggagggtgcagggagcagacacagatgaggcagaagtgggcggagggcagacagttccaagcattgaaggctgtatgaaggcatttagggtttaatactaaaagcaacaggaagcctttgaaggacttcaggaagagaagggacatgattacatttgggttttagaaaaagtatgctggcttttacatggctaatggagtgtggtggatgaaaggggatggaggggcactattaggctactgcagtcattcaagtgaaaaaacacacaaaaaacggtggcagatcagataagggtggccagtgggtggagagatgcaggcagatctaaaatatttaggaggcaaacaatcagccctggaggcagtagaacaagtggtcctgtggatggatgatgcagcagcctggctgggcttgagccttggttccaccttatcctagctgtgtggccacaagcgagtcactaagcctcacttatcaaatggagataatagtagggttgctatgacgatgaagtacaaagtacctgcaaagcacttggatctgtataagtgcgcaatagtagcctttttatgtcaactgtgactgggagctttgaaagtgaacatgactcgtggttggttatctgggaattgaagcgtatgcggggagaaacatgtgggtttgtttgtctttgactatttttctccccactaaatcaatactgaagcagctgcgtatgtggcccaggggaggagtgtggtccctctgtgtgcattccctggaatgtggaacttcctagatgccaccctcctcttggagagcagtggctggtcttacttttttattgtactttcagtgtctgccacacagcacaggcccagtgaaagtggaccaagacccagctgcgtacaagtacttgcaggaataagcaggtacctgcatgaatgagcacagagcttgcaggagaggcctggggtatcttggtgcaccaggccacggggtcaaatttacctgccttcctggcaagagatcacaagaaatattcccaggttcacatgtaagaatgtttgctgcagtactatctataaaattaaagtattggaaactagactttcaacaactttcttgtgatttcataaatgagaacacatccatatgatgaactactttacagtttcttaagaattaccttttttccctcagagagtagttttctctaaattatatgtatatgagatactttcatctaatttttacttctctatgctttccaaattttatgcaatgtgcacttaattatttcaataatcagacaaaaatgagaattatttttaagtgtgcttttttaaaaaaaaacagagtgttaggcatttttaatgaaattatcctttatccagcagtcatttgaaatgatggctgtgtcacgaggtcaggagatcgagaccgtcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaagaaatgatggctgtgaagtgcaataatttgggcaaatacttaaagagagaatgttgagtgagtaaaatagagattaagattgtatgctttctaggattggagctatgaaaaattacaaataaatgtattaatattaaaatgctgtctatggctgtgttattagcagtgatatagggctatatattttttttgtcttctttgacaacttttggtgatgtggctactttttcatatctatgtgagagattgatataatcccctatggctccgagaggtgacataacatgctgacccaccagcaagtggcagagccagggcctggcggcctctctgctcagccatgatgcctgcagtaggtaactgctgggtagaacagaaatgagtcagctaagagaaaaagggtgctgggtcagggaccagggcctgtagaagttctccacccccgcgcagtttgactcaattagtcttgggggtcaggaaagaagggctttgtggttcaggggcagccctctgtcagccctgtcaggcatgggcagagggggacctgcacttgaagcaaaatgggaggaatggagcagattctcttatgcttatgtaaagctgcaagaattaattagcctggtttttcactttcttaaagagagctccttctgggccccatgaaggatgcacctgcaggtgcagaggtggatgcagggaggctagggaggaggcgtggaggtaattaagaagagtctgagggtctgagctgagtaagctggctggggctcatgatccagggaggggctgttatggaggtggaatttacaggacttgctcctggttggaggaagggcattgggggactctttggtgtttggcttgtctacctgccactgaggtagggagctggggggatgctctgagtgtgaggtgcctggagaccatgggtggggagggggaagacaggtggtctggccacccttggaactaataggtttggagctcaggatggagatttccactggagaactagggctggagtcagggaatttacagttagagagcttggtgctgttacacagtcactgggtcaccctgcagatatattgcccggggctgagggaaccttggaaactgcaaaggtgcaccccttctcattccaatcccttcatggatctgggacagcttgtgatttgaatttcaaaattaacctggagaaagcagttcatggcaattattctgtaagagagaaaagaagggagcagggtggggagagatgaatagagaaagatgagctgaaataattgcctggaatttttgtcatttctgaaactaaggaggccctgcagtcattgtaaagggccacagacttgaaatattttcatcagggttatgtgagaaaatgggaaaatgcagagaaaaaaaccctcctttcttaatctgagagcaaggggttctctaaaactgattttgctatggatggtgctggtgctgtggtgggtgtttgcgtcatgggatcctggtgctgtggaaggtgctggtgatgttgggggtgctggtttcctggtgatcctggtgctgtggaaggtgctggtgctatatagggttctggtgtcacggtgatcctggtgctatggaaggtgctggtgctatggagggtgctggtgtcatagtgattctggtgctatggaaggtgctggtgctgtggaaggtgctggtgtcatgggaatcctggtgctatggaaggtgctggtgctgtggaaggtgctggtgtcatgggaatcctggtgctatggaaggtgctggtgctgtggaaggtgctggtgtcatgggaatcctggtgctatggaaggtgctggtgctgtggaaggtgctggtgtcgtgggaatcctggtgctatggaaggtgctggtgctgtggaaggtgctggtgtcatggggatcctggtgctgtggaaggtgctagtactatggagggtgctggtgtcttggtgatcctggtgctatggagagtgctggtgtcatggtgatcctggtgctatggagggtgctggtgctgtggaaggtgttggtgctatggaggtgatcctggtgctgtggagggtgctgatgtcacggtgaccctggtgctgtggagggtgctggtgtgatggtgatcttgctgctgtggagggtgcttgtatcatggtgatcctggtgctatggaggcagctggtgccaaggagagtgctggtgctctaaaggttactggtgctctgaaggttgttggtgctatggaagatgctggtgctgaggagggtactgaggctctggaaggtgcttatgcacctagctatgctgccaggcctggttgtttccaggttcgtctgtgagttggagctgagtttggatttggaagtcattggtgctaagctgtggagaggcacagctgtcctccagggagatacctgggcttgagactaggctcgcctaggcatcttagatcttggctttgccatatcttagcttcatgaccttgggaaaaatctctccactcccaagttcccaacttttcattaataaaaccagacaataataatgaatagtctgtctttggtgcacgctaggggcttaataaattatcattttctttctttcctatttatatcctttttcttcctcttgtgttcttagcttcctgtctaattagctggattttgtttgttggttgggctctgggcctctctttgcaggcttttctccctgggaatgtgactgggagaacctggaggaacatttcaaggggtagccagttcattgtcaggattcatgggtggtctctggcttcccacagtgattcctggaggcacgtgtttgcttgttggtaaaggtaggccatttttttttttttttttttttgagacaaggtcttactttgtcaccaagactggagtgcactagcatgatcatggctcactgcagccttgacctcccaggctcaagtgatcctcccaccttagcctcccaaagagctgggactacaggcacaagccaccatgctcggctaatttaaaaaggtttttctttttttggtagagatagggtctcactttgttgctcaggctggtttgaactcctggcttcaagcgatcctcctgcctcggcctcccaaagttctgggattacaggtgtgagccatcatgccccgtctggtcatttttttcgtgggctattttttagtacttcagttataagacaaataataataatgtcttaaatatgcttttacatctacttttcagcctaacaacaatcttgggaagtaggtacttttattatccccattttacaggtgaggaaactaatgcttagagaagtgaggtgattttcccaaggtcacttagccaggaaatgtcagaacaaagcaagaacccagcttcatggctccatatcccattctctctgccacaacttgatgtcaccctgccattgtcctggccaagctgtgaccttcctgccttctttccttccttcttggtctccctcccttttcttctttgtcgttattaatattggttctggtctgggctcaatgcctgttgctgggagatacaaaaatggataaaacaaaacctctgccctgaaggagctaacaaatgtgtggatcagatgagaaacattctgtgcagcttctcagctgtgctcttcctggagtcagcaactctgggaccccttcctgatcctctagctggatttggggcctcctctgggctctgtagggtcatgaggcctcctttcccactgtcctctgcctggcctatcccgcacctgcagccccctctagcttctgatccctggagggcagggaggtgtctggtgcatctctgtgttcccagttcccagcactggcctggcatggagcaggctttgggtgtgttgcattgtgggccctgtctcttgggatggtctcaggagcatccctgaccccacaccctgatccagcattcagagaatctgcctcattaggctctggccagggccagctcagactggagggtgtgtaggcacttgggaaggatcctgggaatgcctgcagtccagacctagagcacatccagtggggagaagctgcagtgggagggacaccttagcccaaagggaccagagctcaccattctctcattaaaatgaggtgggaccaagaactggaaatgagagggtcagtcctttttaaacaaccagtggctcatgcctgttatcctagcacttcgggaagccaaggtgggtggatcacgaggtcaggagacggagaccatcctggccaacatggtgaaacaccgtctctactaaaatacaaaaattagcctggtgtggtggcacgcacctataggtcccagctacttgggaggctgaggcaggggaattgcttgaacccgagaggtgcggcttgcagtgagctgagatcgcaccactgcactccagcctgacgacagagcaagactcagtaacaacaacagcaacaacagaagaaccagtgtcagtgggctattattaaacaaacagcaacaagtaaaacaaaaataaaaccccagttgcagtttcaggctaacattagaaggtgtggatttttgctgtttcatccgctcaccgatccattccactctttgggctcctgcctgtgactagcactttatgtgcactaccccgctgaatggtcccagcacgtcaggctggcgggattgttaccccacttgcatatgaggaacacaggctcagagaggcagagcgagccatctgaggtccacaccctggaggctgtgcagctgggccacctgcccgggtagacagggtcagggaaggttgctcaaatggaaggggatccccggctacacaggaatggctcctaaggatgctgctgagctcacttacctgccagtggctccttctcctttccttttataatctagggccaagaaatgggggccttggctccctgtctcaagcctcaaccctgctcacgttccctccaacactaacaggagaagaagcagggagaaacacagaaaccagcctcctcagtgctggccgctgcacctagcagccatagagccaggcccctctccctctggaagtctctagtgactgtcctttcttctctgttctcactccaacactctggttcaacccacatcaccacctgtcccagccctctccctgatccctggcccctttcctcagcagccccagtcctttctcctccccttctagagcacatgccccacagtggcatttctgtgcctccattgcttacctgcctctcccataggtgcatccacctcccagaagcagtggcccttccctcatgatcctgtccattggatgtctccctgcctttgtctgtgtcatccttcctagctggattgtctttcctgcctgccatggggccatctccctattcatccctcaacaccaaatgcacatggcctgggcctgtgcagtgttgcttgcactgacatgcaaagcctgtcctttctcctttgggttcctgcatgtcctataggaccctccattctagtaccaattaaacagagttggcatcagtgagttacctactaggtctcctgctgactggaccaggagctcttgtacccttctctgtaccctaagaagctagccagcacctggccggatgaagcagtaaaaaatgcccttaataaatgaataaggctgggtgtggtggctcacacctgtaatcctagcactttggaaggccaaggtgggaggattgcttgaacccaggagtttgagaccagcctgggcaacatggcaaaaccccatctctacaaaaaatgcaaaaaattaactggatgtggttatgcatgcctgtggtcccagctgctcaggaggctgaggcaggaggatcatctgagcctgggaggttgaggctgcagtgagccggattgtgccactgcactccaacctgggtaacagagtgagatcctgtctcaaatgaatgaatgaatgaatgaatgcataaggaggtgaatgagcaaacaaaaaaaatccgtatggctgaccaagaaactccacatcgatcacatcaacagctctggttgcctcatttccagtatctttatataaaatcagggccctatcttttcttctgaactcttgctgataacacatcctcataactctcttcctgatgccacattcttaagaagttagacaacatttctagcttcaccatttgcttctaccaatttttcatcaaaactccagggccttcattccatgggattctaatatttgctgacagcagcaaatggagataagcgattttactttattatctgttgtcttggtttttattgctctctctttcttttaaattttgaggaacatttttaggcaagttattaaaaacactgcctgctgggttaggagcagagtcattatttggcatggaaagaatttgcacatgaggacttggtggagaaaggctgccagagtgtttcatgtttattatttcacttctggccagggttttattgaaaatcagactgaagatgctggcctatgtttttgtccaggtgctttcgcctggctttgtgagtgtactattagaatgaccttcaaaaatgtatgctgttattaattgatagttgcaaagcaatcgtggcttaattttttaacgaaacattcctctgagacagaaaacacacattgtgctgccttaggaggaatgtgcatagggtttgatgagagacggggtgattcaatgaccaccccatcgcaaaaggatgggcttttattaccggctttacattctcattgatccaaacaaacattgttaagtaaatgctgcaataaagcaagtcacttgttaataaacatagtgtagaagaagacttctagggtatagtgagcactcttgtttcctatgggactcctgcaggggtgggctggagtaactcacacccactcctgagagctgattcttccaagtttgcaagccagttgtgaaactgttggaagcttgaaatcaatcatggtgggagtgtttacaccatggaaatcagcaaaggctacaaatctcctcctctccccccaagagctggtctctcagcacaccactgtggaaaggcgatatggaagaaacacatgggttaggggtttgatcccatgggtttgtgaactggaacatgtcatttcagctctctgaacctgcgtttcccaatctgcaaaatgggtggcgaaggctccatcatagacctagtgtgaggcctaagtgaggcaatgtaagctaacacagttgttccactgtggctcgataaacgtgagcttcctcttgtagctgcatggtagttttatttctggggagggaggtctcttgctagatggatgctgccacctagcttgggtctccagtgggaagctacgcctggtacctgtgggcctccatcccaggtgacgctgccgtagctcagttgctcctcttggcttaccctttccactgtgccagctcccagctctccatctctgtcccaccccttcacgcaatatgagaaaaaccagattacgtcatcagatcactctcctgcttgagaaatctgcgatatctccctgcttcctaggggctgcagtgtgatgtccttagtacggcactgcaggctcttccaaaggtgggccttgctgctgattcctgtccctctgccactgccttcctacactcccagtgttctggggctctcatagcactgcaaaactgccatgccttttcatacttccagcattgcccatgcagtgtcctctgcctccattgccatccatgttttctgcttggagaccccgcttagagctcatctcccctggaactggtccttgactccccactttcatacctggaagtcctaggttcctagcattacaacttttccttctcttcctgcacctcactgctgagatggcacatcggctttcctagagttctgctacctagctggattgctgaaggtgccactgaaaagagggcttcctaaaggtttctcaaatccttggttggagtaataaaaggaagatacagaaagtaaaacaacattttaaaaataattatttgcagtaataaataataacagctttattttattaaacttctattatgtgccagatagcctgtgagtcatttcccattttatctttattgtaactcatgaaataggcatatttttaatatacggatgagaaagctggggatcagcatgattaattaagccactcggggtcatacagccaataagggggcagagtcggggttttctgacccagagcggtatgtgcaccgatgtgtggttatgtgtatgtgtgtgcatgcatacacgtatattcttttatctataccatcttccaaattgggaaaccctgcacatttggggaattggctaaattaagctaaactgaaatgtggttgcaagaatactaaaactttgctgcagatccctgttatttgccgagtgttaggttaattttgcgttggctctctcgtcctcttttttctctttaaatacactgtttggccgagtcctgaaatgtgttgatccaaaagggaaaaagagaagcgacaatttcccaagaaagagatgccgttttccccagggtctgtcatgccacctgctccgcaatcccagtcacaaggtgggagagctcatctcctggcttcctcgctctctgggcctttgctcctgcaatgcatgattatattaaatgtgattcttaaaaaattgatgatgtttaagctcctggaactgtcagaagaaggccctaataagatgactgtatgtgcagcttttcatgttgccagtaggttctataattataagaaaatgagttgttatagcaactgccatgtaggcctcgcttcctcctggggatgctgagcgctcagctctgtgatccaagtaactgggagggaatttggttctttaaggggtttcaaccctcacttgggtgatcatcattcattcattctaattcttgacaacctgaacccagttttactttgcaatctgacagacctggtttgaatgttagttctataactcactggactgtgtgaccttgggcaagtcacctcacctccatcagcctcagtttttacttctgtaaaatggggatgccagtgcccaccaattgagagagccattgtgatgatggtgcttgggatgtggctagcacagcgcccggcatgcagtagcccctaaaatagacgggacacattccccttaacttctttcactgggagcaaatgaaaaatgaaaatgctacaagtagggagggtaggtgttttcatagtctttaaaaaagtattgtcattaatttgggtagcatttgtggcttgaaaaccaggctactgaacagaaattccaggctgaatcatgtacaagatatgagacagggaaaaaaagagagacgaagagagagagaaaaaaagctaaatataaatgaatatttagctaatgaaactgacttgaatgaaaactccaactttactttatattgcatttctctgaggctaagaaaaaaaaatttctaatttctaaaagaatctccaaactgagtcaagaaacctggtttctggtctcaatctttgggcctcagttttcccatctgtaaaatgaggtagttgggtgagttcatccccaagaggcctggaacaatcgttctcagtcagaggtgattttgtttctcagaggacacttggcaatatctggagacagttttggttgtcacagctgggggtagggatgctattggtctctagtgggtagaggccagagatgcagctaaacaccctatgatacataggacagctccttacaacaaagcattttccagccccaaatgctgagaaaccttgctctaggatttaccagcatgttcgctgggtctaaaaccagaaatcaaaccatagtcacgccaccaaggataagtcagatttgttcagtatttcagtgtcttatcctagcaatctcccagagatttgaagccttagaaaaattagaaaaggtaaagacaaaaagacttctcaaggttgtaggaagctcaataaaaaaatgagatggccacaggaagtgcgatactgcacaaccctaaacagacccaatatgattgttttgtgcacaaagcaaaatgtacttgatgcaattttaggtctataaatagctttattttttttgtataaaggaggataaaaataaatcttgcagatatttcaactgcccttctcatttccagctcctctcttcggttttgacatgtcaagccacagtcagagtgtgtctcttctgaaactcacaggcaatcacttcctttccctgcttcaaaccattctggggcttctcttgatcattagggtaaaatctgaactccttcacctgctatatacttggtctctcgagcctgtctcttgctcatctcttcagtctcctccgaacaagctaaattacctgtcgaattctcgacacactggacccgatttcatctctactcctccgcttagctgttctttctactccgaatgcttttctcttcccacagtctggtggccacctattcatctcataaaactggctgggacatcacctcctttcctagtagctgcacctctcttcctcattttcagaaaggactgaccatttcctttctgggactttaatcactgggcagaattggtcatctttccctccttcatgcagttatttcctttcctgcgtttttctggtgctatgaaagcctgggctcttgcggacagaaactgccctgattcagttttatagccccgtatgcctatacattctggggccttgaatacagtaggtggtcagtaacctttgttttaaaataagaataacatacaaatgcacaacattctaacagtacagaaaggcattcactgagaaattaaagtctccctttccctccttcatagttctcacaaaaaatatctgttgtctacatctgtgctgtccaaattggaagcccctagccacctgtggctatatacatttaaattggtcaaaacaaaatacaatttaaagtttaatttctatcacactagccacatttcaagtacttagtagccatgtgagcctagtgactaccatatgggacagctcaaatttagagaacatttccatcattgcagaaagttctgttagtccaggagcagcttcctatgttcctatgatctcatccagggacatttcctaaaggtcttatatgtacagtacacgcacacacaccacacacacacacacacagacacacacacacacacttaaacttgatttcctcattcatcttttcaaatgtaaccattgtatacacattctcttgtaccttgcttctttctcttaataatatatctcagagatctttccacatcagcacattgagatcctttttcttcctgttaatggttgtagacagaggatgtttcatcatctttctcaattagtccacgattgttctagctttcagccttctgctgctgaaatcaagctgcagtgaacctccttccagtgaactacatgcactactacagtttgaatgtttgtgttttcccacaaattccgatgttgaaatgctaacccccaagttcatattagttattaggaggtggggcctttgggaagtgattaggtcacgggggtggagctctcatgaatgggcttagtgtctttataacagaggccccaagaagcttgatctacccttccaccatgtgaggacacagatagaaggcaccatctatgaaccagaaagtgggcccatcccagataccaaatctcctggtgccttcatcttaggtctctcaactttcagaactgtgagaaataaatgtctgttgtttctaagctatccagtctatggtattttcttataacagcccaaatggactaagacacacgcacacacacacatgcacacgcacacccctttcatatgttctgcaagtgtaagtggagggcatgagagtcttcaatcttaaaaaccttgccagagggtatatacaccttcccttttaattaataaattttgccaaattaccttccaaatatgttccaccagtctatactcccccaacagtgcctaagcgtgagctgctcctccccgtgtgctggcaccaggttttaaccaactctaagtcctacccatctgataggtaggaaatggcccttcctcttgaagtctgcatgtctttctctctctttctctctctctctctctttttttttttttagatggagtcttgctctgtcgcccaggctggagtacagtggtgcaatctcagctcactgcaacctctgcctcccgggctcaagcgattctcctgcctcagcttcctgagtagctgggaatgcagacgcctgccaccccacctagctaatttttgtatttttagtagagacggggtttcaccatgttggccaggctggtctcgaactcctgaccttgtgatcagcctgcctcaacctcccaaagtgctgggattacaggcgtgagccaccatgcctggccatgcacatctttcattatcagtgagtttgagcttctttttgggttcttattgcctgtttgatcattggttcttttctggaaaaattcttatctggctggaccatttgttccttcctcctgatttgtgttgctacctcccaaagctacagacttagtttttctcccttgtttgttatttcctcagtcgtcctttgccttttggttttgtttatggtgtaactgcttttttcattctacaatatttctaacttttgctttaactcaaattaatcatggactccacaaggcatgagggaaaatattgatacatttgactttaaaaattaaggccatctcccaccctaaatttatgttttcttctggtgcttttatgattgtgttttatatgttacaattttgattcatttggaatttgtctctgtgtgaagagcaagctgggaatccaagtttatttgtttttgaatggcagtttgtcaggtgttctaagatcatttattaatcttttccctctctgacttgacatacaacctttaaaaaagctactgcatttccatatgggtttcagtctacttctgttctctcttttcttctattgaactgactgttttttgttattgtataccaaattctttcagttacagctttgttacacatctttatatctgtgtaaattattcttctctcattcctttcactccttacccattcttgcatttcacttttgcaggtaaatatatatatttatatatgttatatatatataaaatgttatatataaccctatatataaattaaccttattatatataaccatatgtatgtggatattttactactgttactgtttacttggattacataaatttatagatttcaatttgaggagatgctacgtctttaaaatattgagattttctttctttccctctttctttctttccctctttctttctttccctctttctttctttctctctctctctctctctctctctttcttttctttcttttctttcttttctttcttgacagagtctgttctgtcgtccaggctggggtacagtggtgtgatcttggctcactgcaacctccacctcccgggttcaagtgatggttgtgcctcagcctcctgagtagctgggattacaggcacgtgccactacacctggctaatttttgtattttttagtaaagatggggttttaccatattggccaggctggtcttaaattcctgatctcaggtgatccgcccgccttggtctcccaaagtgctaggattacagatgtgagccaccacgcctggcgtaaaatattgagattttctatctagaagcaagattgcatctgttgaagactttcatcactttcagttgagctgtaagatcatttttgcagttcttgttaaatttattccaaagtattttacctgttttttttttgttgttgatattgtacaaggaatcttttcttttgttgttttttaactgggtattatttatacttaataaaaatgcttttgaattttgtatatttatttgcctccagttaccaacttctcttattatttctaataatttctttaaaattttgattctttatgtttataaggaatatacaattgttccatctgcctgtaattctaatattgctcctctttttctgatatttagttttcttatgttatttcctgtttgcaatttttagactcctgatgtcattttcctgtctaattgcagtggtcagtactttcagatttgctatttctagtgttttagcatttacattttgatgtttttttcccccccaaataccctttctgcatttacggacatggtgatatggtttgtcttctttgacttggcattatgataaattatactaatatattttcagatattaagccattcttacatgtcctcatttggtcatggtgtaccatggagttctgtttgctaatacattactgtatttaaaatttttgctttattaatattgtgaggttgtgttgagatttactttttgtgctgtcttcatcaggtctggtattaatgtcattctgcctctgtaaaaagaatgtacgagcatttttttaaaaagaatgtgcaggcagatcatgaggtcaggagatcaagaccatcctggctaacaaggtgaaaccccatctctactaaaaatacaaaaaattagccagatgtggtggtgggcacctgtagtcccagttacttgggaggctgaggcaggagaatggcatgaacccgggaggcagagcttgcagtgagccaagatggcaccactgcactccagcctgagcagcagtgagactccgactcaaaaaaaaaaaaaaaaaaaaagagagagaatgtacatgcatttttctttctccatgtcctggaaaatttgacagtagagaaataatctgtttctttatatattttttaaaaacagaattaacccacaaaatcatcttagcatttggaaggatgtgggtagttttcagtaaatatgtgaagaattaacgtacaaataaatttcatttgtacccgaccacctgtctgaagctttgaaagattacatttagaaatgcacccattgccattctcttaattgtaactcccttcagcaattttttcgagtggccccattcagtcaataagtgtttacacagtagcttccatgtccggagccttggggtagatggtatggatgattcatggaagtacaagacgtggcttacaatttaatgttcccagggtgcggacatacagctgaagcttctgtttatgtgaatttgattctaaagcaatatcatttatcattgaatattaatggagcagtatttgcagattaccctttaggcttacattagtcatccttggatttagagttcagtagctcagtccaggctgcacacactgagccagcacatggtctttccttcttgcatcagagtctggcttccctccctgttgcaggtctgcagagtagagcatgttgattgctctgtggggtgtggctctgccactggctccctgtgtgactcacttctcttccatgaatttgggtctttcacctgtgagatggagacaccgatcttactttgtcatacttagatagtatatgtaaagcatcaaaacacagttggcacccagaaaatctacatttacctcctcgttttggtatctcccaaaatagctagctgagtactgggctatgaagtactatggggtatgggacagttgttcaagtctagattatttttagagcccttgactggtcttcctgcttccaaaatccactccttccagtcaatttccatccaagctgccaaagtgattttaaaaacgccaatggaaccatgtccatgaatgccggatatgacagacccactggctctctagtgcccccagtaaactcttcagtctgaaccttatgctccttcctcaggcttcctctgcttaccatccaagacttgtctttcactgtcatgggccactccaacgtccacaccctggggcaggctgttctctccacctggatcccccttttactctctccttccaggctggcccaggagccccactccccagtgccatctccatcacatcgcttctcaccttgccttctatgagtctttcctgagagccgacaccacgtatacgtcatccctgactcccatgtgcctggcccagggccagcgaagggctaggcattcagcttgtatctattgtccagtgaacaattaggctttggcttgcatggtaaaatatgaatgacattttctccattttagttctctggggatccctgggggaaattgttctttataacagaaatgaggccaggaaaatcaattgtgtttctcggctgcaggagatgatggaacagcgtaactttcctgaatatcccagggcacagcactataacagagtggcaagaggtggactgtgctggaggcccctttcattcttacgtgcatttcaagccaagctcaggcgagaactcaccattcagctgcccactgctcatgaaattcaggagctggcgtgcttgcaaagcttccttgcaaagctccttttttctttttaggtcataatgagctggttgggcagctgcttggttgccaatgactttatagttaaacacccacactccaagactctgccttcagtaaatggagggagaacaaaagaccgcaagaaagacaggagaatgaacattgatacagcatcttctgggttctaggcacagtgactgctgcatttgtctacttccttgacctgcataagtgccctgtgatggggacattattgtaatcactccctttgtacagaagatagagaatgagagagaagtgacttgtccaaggccacatgcgttagataggggccatttgtgtgtcttctgagcaatcagtttgcttttatcttctggactctatgaatattatcgccgacccatttcctatcattggtcaggtttctggaaaaccttgagctatatgtcttgcccgcctgctgcaagtagggacactgttaacatacctgcctccaacttatggccatcctttttccttccatttcctccattactatttttctcatctataaaatgggaataacagtaattatactgatcacaatattgttgtggagaaaccaagcaaagtgctcagggcagaattgggcacagtgtgaacactcaacgtggagcctgtcagttgccagaagtcatttctggaaaaagaggaaagtgtaataaagataagatgagcgaaacaagttaggtggcattttatacttagcataggtttatcaagcacctactgcaaccaagtcctggccagatgcaggggctatagagatgagtcctcagggcctcgggcctcaaggagcaagcggttcagtcaaaacccaggtctgccacaggtgaatgtcaaactggctttctcagctggcctgatgcgagttccttccacggagcctgtagtgaagagcattccatgctctctgcatctcctgtcctgctttattttctgtgtccaggaagcagcccagatctgaagctcacctccagccatgtggtttgtccatagcccctcaaagaagagctttgcataaaggaagacacccctgggctgacgccccaccctcggttgtgaggccccattcatcctgccagggctacggggtcacagttgaataagcacacaaacaggggacccaatttgcagctgcggcaggcagatcggctgagggaagataatttcattaggttccaggctcttgctctaatgctctgtggcgatgtctctgtggccttgcaggctggctgtgcgtgcactcctgtgtctactggataattttcttgtctttgtacagtcagaatggtggataaggatgtgcacgtccatcttttttggagccaggaagagtgggtgaaatgcaagagtctgatttctgctctgatcaaaccatgggaaagttaattaaggctgtgactcaccagaccatcttgatgaaattaagcagtgcagccaggcctctggctattttagtggcaggaagtcaaatggttggctctgttggtgactccataagtgtatatttaaataataatgacagtaataatatccaacatttatgggagctttacatccagcatctttggaagtccacccaatgtacctagtaggtaggtgttatgattcagataaggagatgcagataaggagactgaggctcagagaggtggcgtcgtgtactgaaggtaacacagccaggaaattgtggagcagagattaaatcctagtttgatggtaaggcctattctccttttcccacctcacactggttctctttcaggttcctgcatcccagtctctgaacagccaaaactaaactgctatatcatctgtatcctgaacgcttgctagcccttcattttcttaatagcaaattaaaattatcatcatggcagcagtaaataagcttcatgacctcactgctccaagcccatttgcctgcattttgggacaaatttgtagctacaatcattgcctgtggaaacagcaagactgtgcgatgacatcttaatttcccgagtttcactttgtacaaaatgaccctggtgagacttgtgagggttttcttgtttggatcatttttcccaaacgctagtgattgacaagtttgcggatgaaagctccacatcccaggccagaggaaggcctaggtgtattgagcaaatgtcagaaagaagagactccacctgacctggctgtgcgaggctaggaagtcctttcaccttgccacagtcagatggggattaatgacatcttcgtcaaaccgttgttgttattttggacttaaactaaagcaatgcacgcaaagcccagctcctggcttacagggatgctcaatgaatattaggtccttctcctctacattctcaaatccctcctttgtggtagatggtggcctgtacatatttggagattttttgtggacacatgtttcagacccgtttaaccccctgccctgccctgtcaagtacctggccacaggagcccatggtgccagctggaagccagctcctggctcagccccagacaagtcacactcctggcctcaccctgggccttgttgaacagattggggtgattgctggctaactgaccccgggccaatcactttctggaaacttatttcctctaaaatagggataaaaagcccaaccagacagggttgttgaaaggcttaatgcaagtaacaaaagaaagtaatgaaagcaccatccccaagttaaaaactgggaaacttcatgtaatttcatgatctctacctttcttgaaaaatcagatcagccatgttagaatctcattcccgtccttgacaacgattgtctggagctgtgcagctgctgtcccctgtcaatgaggcaggttccctctaggtcccgagcatgccacagcagccttcttcactcattggtggtgtgtgcctgctccctgcttgcacagagaaggtcaccaggccaggttggctcctttcctctcaacaggtcggtgagatctaggtaaacaggtttccatctatgacacacttgcttttgctttgttgccttataaaggcacaaccttgtgagttaaggcctcagcttctccatcctgtaagaggttcactgtcaaaggtcttagtattctctggcccatgttgagtgatgacttgaacttttaaaatgaaaaacatttcgggagcccagagatttatctcctacatcggcagggccctcggaccctcgctcttcttcctaacgattataccacagcacattaatttgggaaatgaattactgctttggaatgttccagttcaaactgtgctttttctctttcaaggattccacaaatattaatgagtttctggctctacacccaggaatcacacttctacacccctccttcttcccatggggagctttcctctctgggttctgaaagagattcctgaattattgctcatataaagtttgaggccatagatgtttcattttccttttactttcaaaaggcaatttacttagtgagattcattggggccctagagaatgggcttctttaatgggttttggggggcttccatggggagctgaccaaacattatgataatgcaatctttttggtttgcggatggagagaaccggtgtattccatgctgcaacaatcatacagccactccagaggctgtggagtgagtagaaggtgcacatggcctttatggtcacacctgaattcaaatcctggctactccattcattaattgagtttccttataggcaggtgacttaactactccgtgtttcattttcttcatgtataaaacaggaaaaatgacaggctctaccttatagagttggttttaaaaattattagcaagaaatgaggctgagcattgtggctcatgcttgtaatcccagcactttgggaggctgaggtaggagggttacttgaagccaagagtttgagaccagcctgggaaacacagtgagactccatctctacaaaaaaataataaaaaaaaaatagctgggcatagtggtgcacccctgcaagtcctcctacttgcaggaggctgaggtgggaggatcgcttgtgcctgggaggctgaggctgcagtgagccaagatcgcaccactgcactccagactgggtaacagagggagaccctgtgtcaaaaaaaaaaaaaattgttaacaagaaatgaagttaaaataactacatcatgttttataaattctaatatgcatcttaagcctttccagtgaaatcatcttggatatgagagcacagcccacagacaaagccaactccttctctagggattgaccctagagaattgaggtctctaattctgtctaattgagggattagacagaacaatgggcagtaaacaggccctccacagatgttacctcccatacctgtcttgccattttagggttgtcatttctatccaagagaggatctttacaggaattcttctgatatattgacttagatgccatttactgaacacatactgtttcagaccgaagccagacaggtgagctccataatctcattccacctttcggcgttttggggtgtgagagaacattctagttcctgttttatgaatgaagaaactgaggcttagagatatcacaaaagttgttcaaagtcgcacaggtggtaatagtgggagaagctgcaggcggagagtccgtctgtccccagaggctatactggctccagaccagctctggccagtaatgaaggctgtcttcagcctcattccagtatttcacaacaccccaaggaaacgattccttttcttctgattaggccaaatagaccaacagaaacatcatgatcaccctggttatctcctattctcagatatgtgcatgagtctgataaatccaaaacaggagaatgaattcattcgtattgaataaatgcagtctgtttggcatgaaaaaaactcatttgaaacatgggaactatgggacagggagaggaacaagactttagatcctaaggcatgttccttctcccagatccttggtctctgggcacctgctctatgccaggcgctgggcttggcatttccacacaatgatttcatttcctccttacatccgtgcttcaaggtggctattaggattctcgtttccagataagacagctgagcccaggaaatgtaataagagacccagaaagtgatgggtgggaatctcagcaagggtgtttctggcttcaggacaaagctgaggtcaagacctggtttttctctttatcaggacagaacagatggatgcaaaggtgaagtcacagtgaaacatacttcctggcctgggaacatgtgggctttgagggcagacttggcttctaggtattatttaaaggtgaaattggtaagccccttgaaggggctgagtggatgtggaatcagccatgacccccatctgcataccgatactgacagggatcagaaaggggctttgggttctggaatcccaccactcttgccttctaaggctcactgacaaggaggtctgtctataaggactagccccaaatggcaaagaactgctgtattcacctggcaagcatccctaactccgaggggcagcacctccagtaagcaaagctggggttgaggctcagggtggggtcctcaatgaatttacagattcctgtcctgttgtgcccaccttcgccccaaagagggatctcatcctgcagtgcaaggaggcagtccaaagtgtacgccgccaccagagggaaacccatgaggtggaaggtaggagagggtgtatttttttttccatgtctagtgtcaggctcactgaaagatagctgaagtcaggatgccacagggaaggagaggaagagcgtcttactcttcctgcacagaggagcctggcccaaaaaagataccccaggcttctccgtgcaggaagaataagatccctaccctcatcctgacccacgaggaaagaaggaaaggaagagtttgtggggattttgttgtttgcatgtttgagacagttcttgcttgatttgttgcccaggctggggtgcacgactcactgtagcctcaaactccctgggctcaagtgatcctcccagctcagcctcctgagtagctgggactacaggtgtacactaccacctccggctagtttttacttttttcttttttgtagagatgggattttgctatgttgcccaggctggtcttgaactcctggcctcaagtaatactcctgcctcgacctcccaaagtgctgggattataggcatgagccaccacacccagccaggatgagatgttagtggggcctgggctctgggaggcaggaagagaaaggcaaagggctggaacctggtgcctgccttttaaggcacagggtccccagtaaagcatagctcgttacaagtttgactctgaaaaataagatatggaatgccttctcctgccttcacattgggcacaggggcagctgtgttgacggtccccaagaccatccccaggttcaataattcaccaggaggactcacagcactcagcatatggctgtatgcatggctgtgatctcttacagcaaagggatacgcagcaaaatcagcaaaagaaaagaaaaaaagagcatgaggcaacgtcgaggggaaaccaggcacaaccttccaagaatcgtctcccagtggagtcatggaggatgcgcttcattcccgcagcagtttcagaggcgcgtgggcaacgtccgccagggaagcttgttagagactgtctccagggttttcactgggggctggtcacataggcactgtttgcttagcacccacccaagtttcagactccaggtgttcaacataagccatattgtaagtacaagttaggcagggtgagccactcctatcagttctggggatggtgggaacattcttaaaatccagcttcccagacaccagccaaggggccagtcttgcatgcagacctttccaggggtaccaatctcaggctggctgtgtgaactgttttgtgtgaaaacgccctccaagactcctcccaggtaaggtgtgtctgtgtgtatttgttcagggcagtggggtggggaggtagaagacagggtagagattccttcctcctcatggacaaggtagcaaattgagcacgggggcagaaatgccgtcttccccaacatggctgacttatgtccagaggagatactgctgggtgtgctagactgtggtattagcagaattattcttatccttgcaagaattacagggagacatggagtagtttatctggcaggggaacccccactggaatgcctagcagtgccacacattgaaatttgggaatgatatttaattttccaaaccaactttgctgatctgattctttcttttcttcttccttccccttcttcttccttttttttttttttttttttccatcaacttttctgccaagaaaggggattaaggaatggaagtagcttaatggaacaagctatttgggctgccgggctcatgtctccatggagatggtaatgcaggctgtgtctagacagacggttggcggggatgcagtgagacagttgtgcgcctctgactggagccgagatctgcacggatggccctctgggctgagggggatagtctggccctgctatggggcctgtctcttggggttggatggagcaactagatgtgagttcttcttccgagttcacctgtgtgccctttgtgcaggcccaggccaagagctgggcaggcggccaccgaggcacaggccctactcttgaggagctcatggactgctagggcaggctgatgtgttacgtggctgtgatagcacatgtgatgtgtggctgcagctggaactgatggccttgggagcctggggggatggggggcttgctcaaaggggaagtctgggaaggcttcctggtgtgtgtgtggagcaccctctaagtgggaggccgtgggaggcatgccagtagcagacagcctagaactttcaggaactaggactggtgtgtgtgtgtgtgtgtgtgtgtgtgtgtgtgtgtgtgtgtctggggcaggaacaattagtgaagtgggacaggtaagcagggaccagatgatggaaatagcacagtgccaaggaaataatacgtgttttggatccaggcaaacctggcttctaggtcttgctttactactaattggctggataatccattatttaatccacaatttacccaacatctgcaagcctcagttttgccatctgaaaaccaggaatatcaacagtcctcactttatggaatcctgggtaggacttagtgagatgatacttgtcaagtgctgagtagctgatgatttaaggatgtgagtttcttgccctcctttattcagaagccagacaaaggattttgaacattgtcttgttccaatgacagtctccaggctacttgcattcaaacctcctggatttgtgtggaaaatgctgatttctgggtgttatcatagaacagggggatcagaatctatgtgtactcaggactctgcatcttaccattctctttagatggttctgatgcttagtcaagtcatagacctgctgtgccaggagatgggaagtcagggggagggctttcagccccaccatgcaatgttcagaagagtaatttaagaagatagctttggtggccaatagggagaatagttagggtcggggatgcaggaggggtcagagaggaaatgatccctgtcaaaggtgcttttctgccccattaatatgaatcatcagcaaaacccttaaagggtggggcccttgggccctggggaaggtcaaacacagagggtatggccctgcccttgaggggctgtcagttggttggggaggacggatcacagatgtaatacagtgtaatacccaggcaacacagagtaatacccagtggcttcgtgctgaggcgatagtcgaaccaaattcataaatcctgcataattacaaaaataacaacaatgacaacaagaagcattaatttgtcactttagcatttacatgactctctttccttttgcattaatcatcttgcttgtacctcatgatagtttttcgtacattagcgcactgatttagagccattgtgtaggtggtggggtcaaggcttgtcttgattctgaggtggcccagactcggcacgtgaggatgctctatgtgactatacaaagttggaggggccacagtgtgtaaaatgggatggaacagaaggaatcaagatttaagctgggatccatgtagatgggaacaagaagcaagcctgtaaaaacatatgggggattgatggcaggattgtaataagtgtttttccttttggattttcaatattgttcttataataatggtgcaatatatttttaataaaaatgaactgtaatgttattgtaggtttataggcagtctaacatatggttaaccagctgggcttctgagtgagacaggtctgagttataatcctcaccctgcccctcacatatgtaaggtctttccatctatctctgatacaacattgtacaatgggcacactgatagcacctacttcatggagttgcagggccatgaagtattgaaatgtatgtaagcattccatgtatgctaattaactaaaggcattcccgggaaaggctgagcatctactaggataggctaggcctatcctgagggcttttatgcactaccacgccccgccatccaacagctattgtgaagcagccatcagtgtcacctacctttcagagaagtaagctgaggattccaaagggtaagcaactttcccaggttcattggtgagcaggtggcgagctgtgctttcagtctagaccttctggcttcgaaggctctgcttcattcactacttggtactaggggaagggctaaaaagaacccaggtgtcatctgggcagaatttacagaggttgcaacccctttgaactttctgctcaagccctattgtcaggatctttggggctcagccaggaacaaggtgccgggaggcctaattctgtctctggaggttccagctgccacatacagaaggcaaatgtctgtttggccgccctgtttttatttccccacaaagtttaatttccctgatgtgagtggttctattgctttgaagtttccagggtttgcattcttcataaaaaagactggtttatggtgcactgtggtgctaagatgtggcagtacctgagtgttaatgaagttcatgtttcctgacatgatgagggtcctagatcagcatcctggcttgacagtggaagggtttttggttttctccactgtcttcctaattcctgaggtttctacctgggtggtgacatatcttcctagaataagtttacagtatgcatcgtgcatggtatcttgcttcgttgcactattacaagcaaatgtagctgcaggacaggaaaatatgtatcacaacgccaattaaggtatggttagggttgagggctttagaatgagatactctagagttctaagcaggctgtactccttcaggaaccatgtggcctcagacaagttactaaacctctctgtgcttcagtttctacagctataaaatgggggtaataattcagcttccagggctatcatgaggtttaaaggagatcacacataaaaatcactcgccaaatgccttgctcattattgaatagtcaataagtgattgttattatcaggtaagcccataggctgggccagtaataccaggcaatttataggcaccatctcatttaatcttcacagcaatcctatggggtgggattgatttttctggtccccatttaacagatgaagaaaaaggggctcagagagatgaagcatcttacccaaggtcacacagctcatcagaagcagaagcgagattgactcctgtcacgatgtggccatagttacctcagagaactgcctaaatactttccagaatgcagggtccagctctcccagctgtgagagagaagcttctcatctttgaggggcacagcaggcagacaaagaggccacttcagggtcaactaaggattcttccagcatcagacaaactatacttcagatgaccatatgcagtgatttcatccaactgggttcttcccttcagtcactctgccaagctgtagaacagttaagacgggtcctgaaaactcactgcagccagtgctttgtaccaaaagtgaggataaggtgtgggctagggaatgaattagcctctcccctatcccatgccaggtcatgagttggaagttgggaataagatttggtccctgtccacatgacacacgcaatgaacaattgtgatccagtgggctgagtgctaagtggtagatggatgcacaaagtgtaatgagagcaaaactaggcaaaggaaggcttctcagaggaggtgacatggtgagttgggctttgaagcatgactaggagttcaccaaggggagagtggctgaaaagatatgcaagagcagttcatacggcagtcttcctgagtggttggagcttttgaagtgcatgctgaggagcatggcagacaatatgggggaagagaggagtccgcatttgtagcacgtataccaggcactgtgggagggcgctgtattcatttcctggagctgccaaaacaaatgaccataaactgtgcggctgaatgcaacagaaacttgttctctcacagttcagggtgtcagacatccactgctgaggtgctggcagggccacatttcctctgaagtctccagggaagaatctctcctttcctctttgggcttgtggtgagcgcaggtgttcccaggcttgtggatgcatcactcaaatcccgcctcccgttttcatgtggcttctcttctttctgtgggtctgtctccctccgtgtgtctctaataggggcactgcttgaattcagggcctgcctgcataatccaggatgatttcatctcaagattcttaactaaattacatctgcaaaggccccttttctaaataagatcacattgacaggttctggagatttggatgtgggcatgtatttcaggggccaccactcgacccactttcaggtcccacatgcattatcccacgtaaccctcagaactccgagagacagatgttgttacaattcccctttgacagaaaaggaaactcaaaagattaaaggtagactttatgcaagcagggattcccctgtcctctttttatgcccaatgtgtgcagttatctctgacacactgtaggtgctcagttaataattagtgaataaaatatctcagcccaagctttatgaggaggatagcataggctaagagcccaggccacactacatagaactagatgcctggctggattacttaatgagctgtgtgaccttgagaaaattatgcaacctttctgtgccttagtcttctcatctgaaaaatgaggatacaataccacctacctcatagggctgttgtaaggtttgcaagagcaaatccatgtacagtgccaagaacagtgcctggcacaatcagtgcctagtaaatggaagtgagaagtattaccccacactgtgtcccaagaggggcggcagacaggtgaggttaattaaagtgccctaggagaagtgtcttgaagagctgtgatcagacagcgtagcggctcaacattgcctgaggacttctggggagactttggggaggaggagatagttgagctgagtctagggtgagcagggacttgacaggctgaggagtgggaactggcattctaggcagagaccagcagctgcaagatcatgggggtggggaaaactggggtacctggagcttggagggccagggttggggctgaaaagggaatggaggttaaatccaaaaatgccttgtctgctctggcagacaagagatgagccctcatcctgtaggtgtggtggctcgttcatcagggaggcagtgtgaccaagctggcttgttggagagtctagggcggactggaagcctagaggctggaggcccaggagcagtgaggctgctgcacccaggggagaggtgatggtggtctggccagggggcttatgatgaatatgggggcagggggagataaataagctgtgtcagaggcagaagctgccagagctggtgtctgcctaggcatggctctgggggaaaagtggaggcaggggtcgctgcagagtcaggccccagatgcggtgggcagcgctgcctcctgccacggctgaggctggtcaggggcatggtgaggtcaagatgcccatgatataacttggtgccttttctcgacttacctcttaccaactggggaaccttggggaagtcacttcacctctcagagcctcactttctccatcagcaaaatggggataataattctacttcgtatgattgtgacgatagtgtgcactacgttcccaataactcttagcatctgttgttattgttacgactcctgccactgtgattagatggagggagggtggtggggcagcggtcgctgtgactgtagtcccggcacatctttgccagagtcgccaactctgtgctctattttgaattcttcctctcttctgtcttggatctcacaagcctgaagaggaatcttgggtgcatcttcatgggtgccagcccaaaccctgattctcctcaaggttaaggtgcttttgttgggcacatgtgtggggtggcggggttgaggagagggaagagaacaggaggagacatgcaggtgcttccgtgcaccactacacctgcacacggcacggtttgggccaggttgccgtctgtctgcttgtggatgtctggggggaggctgtgtgtgtgtatgtgtgtatgtctgtgtgtgtgtgtctttctcagtgtgtgtgtctctgtatgtgtgtaactatatgtgtgtgtctgtatgtctctgtgtgtgtaactgtgtgtgtgtctgtgtgtgtgtaactgtgtgtgtgtctgtgtttctctctgtgtgtgtctctgtgtgtgtgtttctctctcagtgagtgtgtgtgtgaatatctgtgtctctgtctgtgtaactgtgtgtgtctttttgtgtgtgtttgtctctgtgtgtgtctctgtgtctgtgtgtgtgtctgtgtctctgtgtgtgtacctttctctcagtgtgtgtgtctctgtgtgtgtgtgtaactgtgtgtgtgagtgtgtctctttgtgtgtgtctgtgtgtgtgtgtgtgtgtgtatgagtgtctgtgtgtctgtctctctggtcttaattcaactcaacactgcaggtcaggaaatgtttctgatccccactttgtatgagtcactactgggcacagagaaaagggtgcgactcgcttgctgcccgaggccttcccagcagaaggtggctggtaggcgagaggggtgatggggatgcagtgtgctcctatggaggaggaactggagcaggccccagctacacagcagggatggattaggggttcagggctggagctgaatgctgaggagatgttctccttgctgaggaaaggcacacaggggctccaggcctggcccaaggcccagagaagcaactgcaggagctgtcagggtgctggggctggaggggacagtgtgaaccagtggggagaggtacatgagactggagggtggttgagggggtgcaggctgagcaaagatgttaccccgacagcaccagggctgcctctgtggggagctactgtcttgggcaggacaagggtgatattggcctccaaagccctagggggctggaccctgctttccttccagcctcacctcagcgttctctccttgtccccttcgtcacagccagactgcttcttccaggccctctggaacctcgagctcctcttccttgtaggatctctgggcgtcctagaatgctgcaatgctctggcccggggttgcctggagcccagtcccctctcgcttccaggaccaccccgtcaaagggcccccctcgtgtgctctgttcagaccacattcagtgcttggtttgtggttatttctttggtgaattgctcattgaatgtctcactctctccctcctgtgaactccttgaggcaatggctgtgcacagcatccggctcacagtaggccctttagtagactctcagtgagcggacgatgagtggctgagtgagtggatgaggggagacgggtgcagagagggtgattccgtggtgaggactgtgcctgtaatgaaaccctccaatgtagcgctggagaactagcgagctgtttatcgcgaggctcaggttgttaaattcaagaagtgaaaccaagggctttagaacgtctctgaggatggaggttatataaaccgagtcaataaatattgatgtggagtccggctttcatgttcagaggtgctttgtggggaggtgggagtttctctccccgaccctcttaggctcacccggcatggcgggagctttgttgcagggatcaggcacgtaggcccctgaatttcacaaatccaccagaaagggaggccggggaggctgggtccagcaggatgcctcgcagaactgaaacctgcctgtaggaaatctcgccctggaaccaaaccaggactctccagctcccgccccaccccagcaaccattgacaactgcatcatccagaatccagaaagctcaccagtggaactcgccggcctgagccggcccttcctcctcttgtctcgcagtgctgtgctcacctcttatgccatcttaggccattgactccaccccactgccccgtctggcctcagcacctgggacacgccctactacatcagccttcccactggcccccttgccttcagccatccccctgcaaacatgcctcctgttgcccccagagacatcactccaaaacataattctcaccttgtcgcttccctgcttagaactgtcactggctccctgttgtccttgagatcaagtccaagtgtaatctgttctttgccccctgcccaggcccccaggcttccccatcactcacaccccttgggccagccatgccaaggcctgtgatgcctctagaacagcctgtgtgctctccacgttctttccagggctgatgccatttcctctgctcagagccttcttcccctcatcctaatgttcttccatgaagtcacttatgatgtcacatcccccaggaggacgtccctgatgcccccgcccccaggttgattaggtccagcagccccctgtgctgatggcctcagtcatggtgtcacctctgcgttgcaagtgtctacacccatcagtccatctcttcctccccctgtagactgtgaggtctcaagaaagagcctgtgcctgattcaccacaacgtactctctgacctccccagactcttagggaatgattggccttcagttgcagaagttaccaaaattcaggacagggaggcaaactctccttcagctaagacagcctccattgagcctaattctggggtcatggagcatgtggggtggcctggcagaagttagccctgcttgggcagaatcccatgggctgggctgcacccgtagcaaccagtcagcattagacccttgactctgacagtcacggaggacaccccagcaagtgtcagcacacaggactgcttgcatgtggggaaccacgtgggggcttcgaaacatgctgaggcctggactgcacccccagagattctggtgtagttggtttgagatagggctagagctccaggatcatttgaaacgtttgaatcccaggggattctaacatgtgcagctgcttgagaaccactcacagctagtcctactagagcagcgcttctcttcctggttacacacggtaattacctggacagccttgtcctggacccatggaattagaatccatgggggtggtgacaacctaggcatcagcatttccgagctcctcagctgcttctaatgtgaagcagggtttgaaaccactacctccaacgtacctccctccctcccttttctttttccagaagcatttgctggaggcctgctctgtgctcgtgctctctagccctggtggtgctttggtgaatcagcccctgcagttcctatttgggatttcttaactcaggggacgttagcagtggaagagctcaccctgtaaagggaacctgtcccacaggcaggcttgctgggtcctgcaccagctcctagtgcccctttactaacctgctgttggccaggggccttatccagccctgtctgggcacgtccatacccatgttgggaggtcttgcccagctcctgagtctctcaagaggcctgggactctgcctaggcaaggtttggggttgcacatggtcattgggatgggaagctttccagcagctccctcagaccctgcatcaggctggaggcaatggcaggctggggctgaggctctgaactccctcctgagcatgcacgagctcgacagctgcactgtagtctgtggatgagcctgcgactataggcaactctcttggctgggcccaggtgtgttctctttgaggggaggggatgccagcaggattttaatatccctttaacagaaagggtcaccacttaggaaattggctccctgtccctagggcagagctgcaggtgccaggatgctgcctgaactctgggcatttatttttaaaaactaagagaaaactcgtgtaacataaacataatgactttaaagtgagcagtgcagtggcatttagtgcatccataatgttgtgcaaccatcacctctgtctagtttcaaaatgttttcatcacaccaaaaggaaaccctataccccttatcagtcattccccattcccccagaccccctagtcctagcgggctccagtctgcacctgcctctgtgcatttcctcattctgggagtctcatcagatggaatcacatgacatgtggccattggcgtctgggttctttggctcagcatcacgtttgaagggccgtctgcatctgcagctggtccttcattccctttcatggctgaataacattccgctgcatggatagaccacaatttgtttattcattcatcagcagatggaaatttgggctgtttctaccttttggctattgggaaatctgagcatttaaaatttttttatatctctactccaaacacatgttgatcatgtgttcctaggtcctcagcatttgtgagtcgtggtcttgggtggcctcctttcctgtactattcaaataggagtttcctagggtgcatatgtgtcttcatggtatctcttgctttaagtccaacttctcttgatttctccacctcagctccacctcttgcctgtgtgataccggactgatctctgcaccatctcatcccatactgttatcactccaatccagggcaggaggctgataagcatgcaacaggcttcaacttctggcttggggtaatggagagaatggacagcacatggtgtcaacagtagcttaaaattgaatgttacacagtactgtcctaaaacttcatatacacactcattaggaattgctcatggacggtgtctgcccatgagatttggacagaatcctcccgacatccatcttcctcttttccttttcaaattcctcccgtccagtatttaaaactgccaacagacaactccatatttttggagcaatgtaaactcctgtctcctcctttccttataaacatgccctggggtgggaaagagatggcatgggcactcccaaagttaattttactctttttctgaatcaaaaggaacctttcctccatgagaagaatcctgccatatttctaggccaactgactgaaagggacaccagctttaaaaaataacacacacacaaattctgcttgtaatattagatgccccggtatcatggggacttccctgcccccttgtacatagatggtgggatggggtcagtgcaagcctagaggtgcctctgaagttaaccaattactggtttcagatgaatcctgatggtgcccccactttgtttggtgttgtattattttttttaaaggttgctttcagatagtggataggaactgggttatatttaagctggagaccactgcaggctttcgagcagaaaagggccatgctttgttttttttatttatttatttatttatttatttatttatttatttatttagatggagtctcactctgtcacccagcctggagtgctgtggcacaagctcggctcactgcagcctcctcctcccaggttcaagcaattctcctgcctcagcctccccagtagctgggatcacaggtgcctgccaccaccctggctttttttttttttttttttgtatttttagtagagatgggctttcaccatattgggcaggctggtcacgaactcctgacctcaagtgatcttcctacctcggcctcccaaagtgctgagattacaggtgtgagccactgcacctggcccctgctttgttttagattttacaaagctctctctggttgctgtgtgctgaatacaccctagaggacaaggaagtcgtcactagttagaaggctgttagatgctgtaggtgagagatgatgatggcttccacccggttggacatgattgaggtggtaaaaagtggtcagattatgggtgtatttgaaggcagaaatgatcgtttcttctggtagattggatgtggtgtttgagaaaaagggagtcatggatgacttcaggatatttggcctgagtgactgcaaatgtgaaattgacatattctgagatgaagaagaatgcaggtggagcaggtttgagttgggaggagagcaggaatcctgtttgggaatgtgttgaaagtgtgtattagatgtccaagtagaggcgaaagaagcagttgatgtccgaggttgcaatgcaccagtgctggggcgcggtggggatgtaaagcaggaagcactggaagtgacagcttaatgatcaactcccccacatcccacatagttatcaggaaaaggaaaatgagggggaaatcacatgttaaatcagaaaggagtggtcgggtgcagtggctcatgcctgtaatcctagtactttgagaggccgaagcaggtggatcacctgaggtcaggagttcaagaccagcctggccaacatggtgaaaccctgtctctactaaaccctgtctctactaaaaaatacaaaaattagccaggtgtggtggtgggtacctgtaatcccagctactcggaaggctgaggcagggagaagcacttgaacctgggaggtgaaggttgcagtgagctgagatggtgccattgcactccacctctccagcctgggtgacagagtgagactccatctcacaaaaacaaacaaataaacaacaacaaaaaaaaccaaaacaaaaaaaatggagcttcagagattatcctgcagaagggggaaagaggcccaaagactgcaagttagtaacaaagccaagacagagccagttccttgggcctgtccccctttctagcacaccatgctgcctgccagttctaggctctgaaagctgcatacggggactgaaggtgggcagactgaggctggatgacttaattttgtattcctccaggtcaccatccttgtcagcctggccctagctttccttgcgtgcatcgtgttcctggtggtttacaaagccttcacctatgatcacagctgcccagagggattcgtctataaggtaagaggtggttgagtagtcccaggtcactatcaaattcagttagagggttgatcaatgtcttctcttcactggtgtccaaattctgggtatgacgacctctctaccgactgtttaaaatggaatatgtgtttggcaaggagtttccaagttttcttgagggactcagtctccagtaagcagtagagttcctcccccaagatggtgctctccagggtcaggaggtggtccagcttggacggcacatcagcaatgagggaagcagctcactacctcttgacatggactgttccattttgggaaagctcggcttggtgcgggtcttcctggctcaatggctgtttgcttacccttgcagtggccttccagaggtgtgaaggtagggctggtgcctctgaggttctttgaagctctgtctccaagtctccccttgacccacactctgattaaactccttctctgaaagaacggaacctgctgcatgacctctgggagttttcttgcccctctgaacctcgttttcttgcctgcaaaatgggggctcataatgccttttcccaggatttttgggaggccttaaggagagaatttaagtaaaatcagttaacaaagggcctattagataatgaactctcaacaaatgttagttgcaataaagacagagtctgtttcagagtgaacacagctgataatatttataattaccatttgctgagtatctctaatacatcagaccctttgctagatgtttccttaaacattatctcaattgagctgtacaaccattctgagaaatagggtttctttggctcccatttcacatatgaggaattaaatgtagagagtgtttagttaagaaggttgtccaagacatcacaataattatgttttgatgtggggagatcaaataggaagtgtgccagcctgaaaatgtgtatacttcggttctgcactgcctagattacactccaatctgaccgcctctagctggttgactcacctatcacctggttgcctctctgggccactgctcacagccaatgactgtttatttcctccattatatacttgcatctcttttctcttatatcaaaagtcttggctcctaacaacgttcacgtaatgatgtatttgccttatcctacaatatacatagaacagtcacaaaatagcaccaatgttactactaagaggtaatgaacctggagactactgaacgaacgtggaggtttctccgcaactccatgtgtccttagaatacactccaccaagggtataatctgacttcctagacttccatggagggggttcagatctgccttcctagattacactccaagtggtcagaagctgaggttctgagaccatcctgaccaacgtggagaaaccccgtctctactaaaaatacaaaattagccaggcgtggtggctcatgcctgtaatcccagctacttgggaggctgaggcaggagaatcactttaacctgggaagtggaggttgtagtgagccgaggccgcgccattgcactccagcctggggggacagagcgagactctgtctcaaaaaaaaagaagctgaggttctggaagactcaaaacaatgggaacagtaggggacagttgaataaactgtgacacatccacccagtggacgtcactacaactgggaaaatgaggaaggcaggcctccatacacggaaagagaatgctcattaagacagtaaggatgagtgatggaaggaaggtcctgcctatgtgtgggcaaaggggaggagagtgctatttgcttattgttttggaaagaaattcaggaaggatacattttaaaaattaataaaaatggttcatcaggaggaagggatggacgcaaggcttcttcggatctatcttcttaaatatttgtccttgaaatatgtaaatgtttgacatatttaaaaataaatacatgagaaaaaacaagaggttcgttgtttaaagaacctagctctatatcaagttaaggacataaacgtgcaaagaaaataaatatttcaaccggttgtagatgacagcatgttcgcctcacacctttggtggagtgtattctagggacacatggagttgcagagaaacctccaagttcgtccggtagtccccaggttcattgcctcttagtagtcatattggtgctattttgtgactgttctatgtttattgtaggataatgcaaatacatcattacatgaatgttgttaggaatgaagcctttttttttttttttttttttttttttttgcgacggagtctcactctgtcgcccacgctggagtgcagtggtgccatctcggctcactgcaatctctgcctcctgggttcaagcgattcttctgcctcagcctcctgagtagctgggattacaggtgtgcaccaccatgcccagctattttttgtatttttagtagagatggggtttcactctgttggtcaggctggtgttgaactcctgacctcatgatctgcctgcctcagcctcccaaagtgctggaattacaggcgtgagccaccgcatccggcaagacttttgatataagagaaaagagatgcaagtataaaatacaggaaataaatagtcattggctgtgaacaacagcccagagaggcaacaaggggacaggtgaatcagccagatagagggagtctgtgggggtctctacagcatccactacagccggacagtcagtatgcagagaaggctggccttgaatcagtgtcaatatcaggttcaggtcgtctggcttcttctaagtggagctttgctgtttgtgctggtgctggtgttgggaaggctgctgcgtgccaggcccaggtcaggagctgtcacctgccctctggctgacagcccgatgcagctgcactccagtcagggtggctgtgttgctgggcaggttgggagcagtttgctgaatgacccctgactctgtctctttcttccccagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcagaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccgagctggagagaagagctgattttggcattactaagcccagaacgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcgcctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagagtcttgaccttcctttgcaatgttctttatctcctgctcagtgagcctgatggggaagatgctgggggtgggggtcccggagggcagggtgagccctacagtgtcctgttgggctggggctagaattggactgtaggggaatgtccatcctcaggcaactggggcctgagatggtgttgtggtcctaaggaaggaccaagaggtgtacctggctgcttatctgccagctcaatgtccttcatgcagcagatgcctactgggcagcttctagggccaggctgtgctgggcatgggggatacagaaacggatgacagagaatcattgccctgaggtctggcgatggagtcagatatgaaaataaaggtgtgataatgcctttgacttaatgcaactggtgattagctgcaactgaggaggaagatgttgaggacccctttttaaattgctaatttaggacttagcatgaccttggcaggtaggggtcattgaccccattagacagatgaagacatggaggctcagagggtgaaaaagagactgtactagggctgtaacagagcagtggggggtccaatcccaggcttgtgggactccgttgcacccccacactacttctgttccatgtcagaccctgagcaacactgcctagttacttttccagaaagtcaagttgcagctgtaagagtgaattagctgattctcagccagaactcggtatcaatggtgactgtgaagaaaagccaacacttaaatgccctgtgctccatgccaagtactaaatgccgcatgtatcttagttcctacaaccctcctaccagttctgtgaagtaggtgctccaccttcagcaccactaccatccgctttgtcatcatcatccccgtttggagacgaagaactggaggaacagagcggtgaagcagcttgctcgaggtcacgcagtcagtgagcagcagagctgtgactgaagcccacacctttttggtaccagggtcttaagcactgtgccatgcagcagtgaccatgcatctctgcatcttgctttgtaggttatagtttgtgctcacacatcttctctaacgtggatggcaggccatctgaggaagagaccagggttgactttgggcagagttggaagctgagtctccaagcgggttgctgcgctaggggttggggctgaacatgcatggtgggtgggagagagaagggagacgacgcagcacctcccagctggggctgcacaggctgctgaacacagggcctcagacaaccctacccactcccatacagcctcgggtttccagcccggctttgggagatggtgagtgggagagtgcagggatcggagctggcatcctacccacaaagcctggctgatccacaaagccagcacagaaacacccaacatgtctttcaattacacagaatcagtgaaaggcttaatgaacacatgtacaaacactctgtcataagtggatttgccactccagtgcctcaaaaagtaagaaagctatcacttctctggaatgaacaggctatgggtgtatgagtagaaacgagggagaatgagagggccaggagatgggtgcagatatttctggtttaggagtgactctggggccaagtgctatccttattggaacagacgatgatgcctaactcttcccatgaatatatccaaggagtgtggcatcagttagaagagtttaaccaaagggggtttggccagggacatctcctctgcattttgcaggatggggtgttacagagccctgctggctgatggagggtcaggggagccaggcaatgatcctaaaaacagcaccttggtttgtagatcaagctctatttgtgtgttttgcctgctttttaatctattcaccaacattgggaacctccccagagatccccccagataagacaggatgaaggctgtgcagagagggtggctgggctgggcctgtgtgtggcaagaagttctgaggcgggagggcatgtctgtgtgggtgtcagactgggttctgggaggacctggccttggaactgggccttgaaggacgggctgcactatgacaggaagaattcgggagggtggaggagagacaccacagagccatcctcccaggtaatggggacagcattgtaaaggtttggaggagggaaagctcggggcttctgctcataaggctgctggggtgcctcccccaagccagtgccagaggcaaagattcaagtccgtacccctgggctcacagtccaggctgggggagaggaggagtgagatgaaagagcagcccatggctgcatactggggagaagcagtgatggcgcccggagtcatcccagcggccggtcggatcagaaggtatttagcgagatacacattttttctggaaaattgaaaggccacctgtcagaactgctgttggtcaatttatcttccctcaactcctgcaatgtgctctaatccaaacggggagtcatgtggaagaagaagaaattgatccccaataattcttccaagaagcacacaataccatctctttaaaaaatagcactcctggacagtggagagaaaaggactcgtttccatggcaacgtcaatgccgtttcccatagatcagactcagtctagaacagcaggctgtttatctgagtctgtccttttgtcagaaatgacctgtttctggaaacacagatctagagttcaattagtcaaagtagcccccaaaggtggttgcacctctctctctggacactccccgctcctctctctcctcactgtctcctctctttctcttaatctttctctttttctgtctctgcctcactatctcctgagggaatgttgtctagaggctgtggactgagcttacataatttatttttcaattccaggcccttggtgagagcctcgctgggtttgggccaggtgttgggggtgtggccggtggcacaaggagaggttggacccgggaggagagtaggcagccctgggacccggtgcgactcctgcacctgcctctgccagttcccttcgtctcttcacaccgcagcttcctcatctttaaaatgggaataagaattgttcctacctcattttgtgagaattccatgacatagtgtttaaagatttacctagagcaggaactggacaaattgtagctactgtggatcaatctctctgcctcagcttccttatttgtaaattggaattacttgtaaatactgcccccccaccaccaatagggttgctgtgggttaaaataaggcaatggccttgaagtgactataacagagaaacggattacctcctgcctgccctcaggaagctcccaggccctgtcccattcctcgcagggcagcctcatgtcacctaccacatatgccacatctaccacacaaagccacaggctgccccattttcttcatgtctactcacagtttttaattgctacatttagttacacaaatacatcatcttaaaaaaaattcattttatcttaagttctggggtccaggtacaggatgtgcaggtttgttacataggtaaatgtgtgtcgtgctgatttgctgcacctatcgacccatacccatcacttaggtattaagcccagcaagcattagctatttatcccgatgctctccctcccccaaccccacccacccccagacaggccccagtgtgtgttgtttccctccctgtgtccacgtggttctcggtgtgcagctcccacttagaacatgccatgtttggttttctgtttctgtattagcttgccgagaatgatggcctccagctccattcatgtccctgcaaaggacatgatctcattcctttttatggctgcatagtattccatggtgtgtatgcatcacattttctgtaaccagtctatcattgatgggcacaaatacatcatttttagattacaaataaagtgttgctttgaggtctctgtcacattttccaaaaccattttgattaaattatttacatgcacttcaaaacaagcaataaatacataaataaatgaaataaaacaagattacagactttattcaaatctcaccagtctttccactaaaatcctttctctgtttcaggatctgatccaagcccttggactgcatttagttgtctcttcagtcttttcagatttgtgacaattcctgccttacctagtctttcacaaccttgacactttggatgtgctgatcaggtactttgtagcctatctctcaattttgtctgacatttttccatgatcacactgaagatatggattttggaggaagaattcacggaggtgcccttcttagagcgtcatatcaggagtacaagatattgatgtgtcttattactggcaaagttaaccttgaccccttggtttaggtggtatttgccaggtttctctattacaagttacatttttttctttgtaattagtaaaaatttgagggaagttcctttgaggacaatgcgaatattctatttcttctttcacacattaattttagtgttcatcaatggatcttacctgcagcaattaccgttatagtgttctcatagcaattttatatttcccccatttcttgtacatttataaactggaattcctctataaggaagagttgtcccatctccacatttatttattcaatcatttatttatattagtatagactcataaatatttacttattctttggattaaaatctaatatgatttttattttgtttctcaaattgtttctgattagtcattgagtgctgtttcaggttagctcacgtgtctttttgatgcatccctttaacagttcctaattttctggcaccacaagatactccaggctcatcttatattttccccttttcagtcctggaatcgattgtgtccccagggagccctggttcctttgatgagggaatgacatttagaaacccagttctggatgttagctgtgctcactgctgcagggtgtcattgcttccacgctttcttggtatacagagctaggaagttatggatgtatactagcctgtgtatacatctgtctatttgtctgtctgctatctatctatcaatctatcaatctatctatctatctatctatctatcaatctatctatcaatcaatctatctatctatctatctatctagctatctatctatcaatctatctatctatctatctatctatctatctatgtctcacaaacatgagtattttaatccctcttactctaatgcaaaaccataaggttttttctaggattccctcttcacttgcttgtaatttctttctctgacagtgggaaatatgtctctattatttacaatatatttacttattcattcatctctagtgtacatgtgaagtcacttcagacacatgttttttggcatttagaactgacattgttagagacattttctgagtcactaacattgcgtttgagagtacagcatctttgtgtttaattgtaagggctcatatataaagccacttcatgttttctgaaggctaacatttttgcaaggggcaatgtgttgtattatatttaagctgagtttcccaaggcctcatcacttagagtaacaatgaggacttattaacaataatctcttacacgtcatagacacctactcccatctgctcatgcaggatcctgacccccttgtaaagatctcactcatcagcccgctacagatatttctgggagctcccaggtggactctcacatgtgcccaagaacaggtgtgtacctgctggacttggctgctcctctgagctccatggatgcccagatgttctcaggctctgatggacagctccacagatgcccaggagttcttgcagtttccagttgcctcaggatccagtggagtaagtgaagatggcattcttattttatttattctatttattatttttttagagacagggtcttgctctgccacccaggctggaatgcagtggcatgactttagctcatacggccttgaactcctgggcgcaggagatgcttccacttcggccagaggtgttctttttcttttgaacttcgttccattatcagcggcccactgcaggattgcttttgcttccagtatcccacagaattttaaccaaaatggttctttgttctttctgttttatccacagcacccttacctttgtgctactccacgtgggtcccacgcatgactccacgggggctgcactgaagacaaatctgagtaatggctgtcatgcttgacacacactatacctgttcctatctatacccatggcaggctctgcaaatcagtcgcatcgctctttcccactgagccctgttgcagccaagtaatctttccctgcacagctctctgtgctccctctgctactcaatttgatgctgatagtgacagagatttctggctctctagagtgtttcatgacccctgttcatagcatggagttgtttccaggaaggacatgactggtgggggattttctttcttggcccctcttgcttcaagcttggtgacatactaggaatcaccactcgaatgtgagtggaagtgacgtgtgtcacttctaggatgtcatttttaagcaagtggtaggtgcttctctagtctctcttctacaccaaccctccctaccctgtaatatctggaagctgaggcctctcaggccttaggggatgatggagctacaggctggaaggagcctggatccctgaatctctgggtggacgagagccacataaagctgcccacgttgggccgttgcctgagtaaaatataacttttacagtattattagtgaaatgttggggtttgttacagtggaattgccctgccccatacacaaatgaaacccattttccatgtggacaccatacctggtttaagatcggttataactatggctgggctcatgatgcttaacctggctctcccgtaggtgagctctctccagaaagtgccttggcctccaagctttctcatccatcaactgtgttccagttcatacttcaggactcagttcaagcatcactttttccaggaagtcttccctgatcttcgcaaactaggtagtatcctccactgtagtttcctcgaatcctgtatatccctctttagcagaattaccacaacctatttttatcttctgattacttgtctgtgaattgctggatggatgtttgaatcaatagatgaaaaaatgatctctatgccaatgactccaaaacatctatctccagctctgatctttctgttgagattcataccaatagacacctcttccttctggctatttctaattgaatatcctttcaggaacttcaaactcaacatgtcccccaaaacctttgtcatgtctcccccaaatatgctccatttcctgtgttccttaaattggatgatgacttcaccaaccacttgggtttccagacaggaaacctgagtgtcatgattatttcattgaatagatgaagaaatggatgctcagagaggttacctgcagggagtggtgaacctgacttgcagtccagtgccaggcaaatgcccctgcaccttggtgtggggcccctttgtgcccttcttggcctcctccagcctcctcgcagccctctcccagtctcagtctcctgccggactacagcatcactgacatctccaccggctggctttcccccccgccgctttaaataaacacatctgattaggaagatgtgccttccaatgttggtaatttattcccttctatgcaaattgtccaactaattaaaaaggaaaaaaaaaaccaacacaatttagaccagtgagctcttgagagagaaaatgaagatgctatcagcaaattggtagcatgtagaggatcccgggcctcgagtcggacagatactgggtctgaatccagctccactgctttctggctgtgagaccatgggcaggtcatatcacccttccagcttcactttctccatctgcaaaatgaggataagaatcccaagatgcttccttgcaaggctctgaaaggaccaaccctgtggataccttgatcttcacagggtagctgtgaagatcatttgagaaaggatccaggtctttttgaaactttaagatgcagtagaagtagaagaataatattcctttacatttgattgcacaaaaacaaacaagtggcccaggtatcctcctgaggacacgagagtacgtggtcaccctgctagaaactcatggagtcgtgatgtgactcagggatgtctaaatctattatgggttgattgtgccccccacaaaagatgtgctccagccttcatctctcagttcctcaaaatgtgactttatttggaggtagggtcttgacagacatactcaagttcaaataaggccactgggagggctctgatccactctgacgggtgttcttatgaaacggggaaattgggtgcagagacaaagacacagggtagatgccccatgaagacagaggtttggggtgatgcatctacaagccagggccccaaagattgccaggaaaccaccagaagctgggcagggcgggggaagcgaggcatggaacagattcttccttgcagccctcaggaagaaccaatcctgctgacaccttcatttcatactttcagcctccagaactgcgagacaattagtttctggctgaaataccttttaagctaccatttgtggtactttttatacagactccaaaccctgtaccccttccttccttccttccttccctccttccttccttccctccttccttccttccttccttccctccttccttccttccctccttccttccttccttccttccctccttccttccttccctccttccttccttccttccttccttccctccttccttccttccttccttccctccttccttccttccttccttccttccttccttccttccttccctccctccctccctccctccttccttccttccttccttccttccttccttccttccctccctccttccttccttccctccctccctccttccttccttccttccttccttccttctttctttcctctctctttctctctttctttctttctcctttctttttttctggagtcttgctctgtcatccaggctggagtgcggtggtgccatctcagctcactgcagcctccgacccccaggttccagcaattctcctgcttcagcctcccaaatagctgggattaaagatgcatgccaccacgcctggctaatttttgtatttttagtagagatggagttttaccatgttggccaggctggtctcgaactcctgacctcagatgatccccccaccttggactcccaaagtgctggaattacaggtgtaagccaccacgcccggcctgtgccgtttctctaaaccgcacatgatgactgtttactgtgtagtcattataataaaataaatacaaagctgagcggatctattcaattcagcatccactgacctccagccacatgcagggcctctaggaatggagaagccagccatgaccaaaatgcagacccccaccttcaaggcaatagtgacagatgccaaacacagtccaaaaatggagtcttttcattcttataaatgtcccacagtcattcaggcagtgcccatactgcctggattggctggtggggacataaaagatgggagggcctggccctgcccttaggaagctaccaagtgaacactggtgtggctggacatagggttacaaaaagcttggagaggaccctattaaggaagtataccacagcatctaatgctgggggttttgcagtgtggtgacagagaggacagtccacagacaataataacatcatcatgctcacggtcacacccacaacagcaacccaaccgttagccagccaggaacaaaagaagaggagagaaacttcgtttggactcgatgagctggaaaacaacctctctttcttacatatttgctggtag

SEQ ID NO: 289 - DNA, 149903 bp, Homo sapiens
agtaatggtgctagcagagaaaacacaaggcgctcagaaatattcttgatatattagactgtggttccttgaactcatcctcctatttcctgtccttgtaccatggtgcatactggtgcctgtgactcaaacatgcccatcacccttttccagctggccatctcacccgaggttcagagtcaattcattcgtctatccagcatttatctgacctaactcagcagggtctgtgccttcttctgtgctcccacatctcccagggctaagctttatcccccaaatcaccccactgtaatgtacttgcctctgtcccctctgtcagtctccaatagagaggttttgaggacagaagcccagcagccattcagttgctctttgctgactactgaatgcatcttgggaagaaatgaagtttgttctttttagttacagaattgaaatctaatgcatcagagaaatgaggacaacatagatggcatctgagctttgatttttctttctttcttcttattatttttggagatggggctcgctctgtcacccaggctggattgcagtggcacaatcacagctcaccacagcctcgacctcctgggctcaagtaatcctcccacttcagcctccagagtagctgggattactggtgcatgccaacatgaccaattaatttttttttcagagatgggggtctcactatgttgcccaggctggtcttgaactcctggactcaaataatctggccaccttggcctcctgagctttgattttgtgacagttgtaaccagtatgatctcagggaaagaggaaagatacaggcaacatgttctatgaccatctaacaatgtgatttggggctataacaacttctctggctattaggtgagtgggaagtttcacttgtgtgagtgaatggccaataccctggaagcaaagcatctgggctcaggcctttcagggaccagggtgggaggaggatggctgatggaaagcagtagcactggtgaaaacagtaaggtgacaacaggaggctccaaggaggagagctcagtcacagggctctaggtgggcctttccattgattccttaacagtgcaggatgggtgtcagctgcaaatgagattcttgtaaagggcaaggacaggaacaggctaaggtttcaggggcagaggaagaaggagcagcagagggaggaggaaagatgaaaaaatgcctctagagaaacagtggagctgttggagcagaaatggtggaggcacagagagagcaacctgagtaggaattcctagcctgcagtggggctgggtccactgtgtatggtgcagacatggagacagcaacccaagtgagctccaagcctacagtgggcctgtgtccactgtgtccatagcagatggtgcaggcatggagacagcaacccaagtgagttctaagccaacagtggggctgtgtccactgcagatgttgcaggcatggagccagcagcccagataagctccaagcctacagtggggttgtgtctactgcagatggggtaggcatagagtcagtaacccaagtgagctccaagcttagagtggggctgatctgggggagcctccagaacttgacagcctcactactgatttattttggctctgtggtcgatgtaaaggaagagaaaagtgtgagatgacctggaaggagttgagaaggcatcctggggggactggaaatacctttgaggctaagcctaatgtcatcccctctgtgaggtcttgtctgtgttttcattgttggagttcttctttccctcgagctcactcctggcctttaagtcatccagtctacccccactctgtgttcttagttctgcagtcaccacttttggacatagggctgagatctgatctttgcaacttgactctggggccttccttgagaacagagctctggccttttgtgctaactctctgtactttaaactgcctcagtgagtagatctggccttgggtggaccattggcctctttctggttgacatccatccaaacacattcagtttcccttggagaggtggaattcagacaacaatcctttgtcccccctggcttagcaatctgtggcagcatgagctggaatactccgcattccagccaagcctctgccccctccaggttttcctagctagaacaactcaataatttctgcaagacaaaactgacttaaggtaggaagagcagaacttacttaccatcttccaaatgatgtacttattacttgcttatctccacctcaagggggagcaaagatatgatgccccagggattaacccaggactttcatgttagttctggttcctaactcattcctgggtgccatgtgttactctctgggtcccctattgcttcttgggtccctgtaatgggctggtattggagtcactttactttttccctttactacaacagacaatccagatgaacctccacagtcagtcagccagccagatagtggccataagtgtcaattgatatttgtcagtttctttcctgctcttgtctagtttggaggagataaccaaactttgatggcattctacaatgtgctgctgaccacaatatgccttaattcagagaggtaatacaggtgaagtgattagcacagtacctggcacagagtaaacactcaggaaatggtagctgccatcactaccatcaccatcatcaccatcataaacaccaccagctaccaccaccatcatcaccatcataaacaccatcaaccaccaccacaccatcatcactatcgtccccatcatcaccaccaccaccaccaccaccatcatcactattatcaccactaccatgatcaccatcatcactattttcaacactaccatgactgccatcatcataaccaccaccatcattgccatcatcactactaccaccatcactcagtctgtgcttttgcccttctttgaatgttgaatgaggctcaatttgtccttcacatgaatgttgaaaaataataaagcatttaaaaatccataaattgatataatggcctgcctctataatgttctgaatgcaaaaacaaatgatgaaggcagtgaacattttaaaactaatgagctggttgaataagaacattgattattaggtgcacttaccatccgcagagttgaaggcattggggttaatgattacacattagactgaaaaatagtttactggcattttctgagccagccccatctcccatgcggtcactgtcatgtaagttgtcacatgtcactccattcagtgtggcagctctccatgggaatgtgtgggaagtggccaagggtttgagagacaatgctggctcttctgatgacagggcctggaagatgttgcaggccatttgctacacaaggccccggtggagaatgaagaagccaagttttagaggtttgtgatcttgggatgatgctggcaggcaatggctcagctcctgaagtgttaaatgtgatttgacagcgtcagctgagaactcagaggtccaggcaatgggaaacgggaggaagtcggctgtgggaactggtcccggggctgctgtaggtctggcccctcgggaacactacagatccattatataacagggagtggtgcagttggactggatttgggctgtctgccccgcagaagtggcctgtgctgaatctggtaggggcagtaacttgtggctttgggagaatgaagtaggggccgactatacagtccagtctctacgctagaggccgctaaacaagagggaacatacggccaaggggcagggtttagggcgggctccaggcccaacagggaaggcacaggccaggcaacagcagcgggaggcaggctaggcagaccaagtcaatacatgagacctgggaggactcagggctcattccaggcacagtagatcctatgcccacagcagtgcaggtcactgcgggcctcgcgtgccaagctctctgagccccccaacatcctggcagcccagtcacaatcagctcagggctggggaaggcccggtagcaactggaagcatctgtgtccatagccctgaggggctggggggcacaaggactagctgaggaaggggacccaatcatctgaagggagaacaatccaagggactgttgagtgtgtgggggacaccaacaaactgtcagtgctaggggccagtaaggggtgctgctaatgggggcacagccagcggccaagagggaacagaaattggaatgtgtatgggtggctgaattttttttttttttttattttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttagccaggatggtctcgatctcctgacctcatgatgggtggctgaagttatgtctctcccaaggtggtttaactggtaagaggcaggacctttcattcttcgttatagacagttgggtgtaacaaaaacctgttccctcggctccttttatgcaggggagggatggcaaggatttgggtttgtgtatgggaagaggtcatatagaaagaatgaaagaaatagagagaagacctccccaaatgtggtttctccccaaccccctaaagctcattccagctttccagcttttctaatttgtggttataattgggatggtgccattctgacccccacccattcttccaggttgagggacatagtctagagaggaaggaggtgtgcaaagaagcttggtgctttggggtctcttcctggggctggtggtagaaactcagaagtcagtgtcaaggacctttcatctgagatgcacatgcatgagattcctaagccaagaggccaaaaacaacaggcccacagctctagcttaatttcaacactgctgcaaactcagaaatgttaacctcaaaagacatggtgtctggctagtgattcccaatgtagcctcctgatcttcccaccaaagtccctaggaacatacagaataagataaaagcttgtcatcaacgctggaaactagacatctaggttgtcgtagaggcatgtgaattgtttgaggaagtcattcaacaaatatttgttgagcatctactctgtgccagacatcgttctaggcacttgggataaatcggtgaacaaaacaaagatctcctcctcattgagaatacaatctcttcataaatgcatagttctggcctcccaaagactagggcttcccatatttttatacaaatgtatatcccctcccccctgttttaaaatatatgtaatatataatatatatttatatataaatatatatatacacttttttttaagagacagggttttgctatattgcccaggctggtctcaaaccccagggttcaagcaattctcccaccttcgcctcccaaagtgctgggactacaggtatgagccaccatacctggccctatttcctccctttttgtcaaggaacaaacatgtttcttttggcaaaaaataaattagcaaatacagaaaaaataaataatcccactagcctgagataatctttgttcaaacattggcatacagccaataagctattaacaaaaaaaattatgtacaaacatgcaaccttatttatttccatgtgattgaatgtcgactcttaaatctccattgttgtggatgatggaaagttaattttgtcaattcaaagtaaatttagtcactctaaacttaaaacacagtctcctctgggtaactactcactcaattcaggattttccctgctgggctgctgtgtagtatggtggtgtttggaaggtgcacacaactcgcagttgcctctctgctggaattcattgcggatgtcacctgtcagcctctcctttgtccagggaggtcccatcctcaccacatgggctgccgagacatctggttctctgatccgtgaaggtcatcctgcttcctctgtgtctgactgtcaagagctccctggggcagctggcacatcaggacaatcctgggtacctcttcaaggcacaggaaactttcagctatactcccacccccaaaggaagactcgggagagtgtcccagaatctttgtctaaatatcccaggtggatatttctactctgtgtagactcacactcaaagaggctcttttctcccagaatctcaggcagggagtgggatacaggtctctgagcagttttctccagtgtggatggcccctatctctcggtgccgacttcggaaaggagcagagtgggcagagaccctctcaggctccaacctgtggcctttgaacgtcaccctcccttcagctgggcagacttttatctgcttttggataagaagaaagctgctcagatagcatctcatgttctacccaagttcgtggttaatgacataaattttgcgctttgcatcctccaggcttttctctttgtagtcaaagccaagctttttgcatcaaagaaacaaacaaaataaaaacaaatcaaatatatttatctggataagccacacaagtttagtggcttaaacaaggcaaagttattagcttacatttccggaggtcagaagcccaacatgggtcttcctgggctaaaatcaaggtgacagcaggattgcacttctttctggaggctagaagggataatccatttccttgctttttcagcctctggaggccacctgcattcccttggctcatggtcccttcctgcatctttaaagtcagcagcagagcatcttcaagtctcactctgactctgacctcctcttctacctccctccactcttaatataaaacacagtctcctctgggtaactactcactcaattcaggcttttccctgctgggctgttgtgtttggaaggtgcacacaactcgcagttgcctctctgttggaattcactacagatgtcacctgtcagtctctcctttgtccaggaccgtcctcactatattagctgctgaggcatctggttctctgatccttccacttttttttttttttttttttttgagatggagtttcactcttgttgcctgggctggagtgcaatggcatgatcacagctcactgcaacgtccgcctcccgggttcaagagattctcctgcctcagcctcccgagtagctgggattgcaggtgcatgccaccatgcctggctaatttttgtatttttagtagagatggggtttcaccatgttggtcaggctggtcttgaacttctgacctcaggtgatctacccaccttggcctctcaaagtgctgggattacaggcaggagccactgagccgagctgttccttccacttttaaggatacttgtgattacactaggccagcctggatcatgcaggatgattcctttatttcgaagtcagctgattagcaaccttaattccatctgcaatcttatcctcccttgtcatgtaacatcacatattcacaggttcccaggttcaggatgtggacatctctggagaagccatttttctgtccatcacacttttgtcaaaggcttgattcatatcattatgaaccatggttttcagtattatggtctttgctactgatttaacaaagtctatttagaaattctaaagccaatgctttgacttatttttttttaataatcatatagatggcatgaattgaaagtgaaaagcccaaagggatattgaaaagctcatggtgaaaataaaaataaaaaactcaattttattctccagatctgatcttgtttcatgtatgtggatcgtatttacaccatgtttttttgtaagcggttttattcacttaataatataatgcagacatctttctatggcaatacatcttattttatcacatcatcttaatttcttttcttttctgtctttcttttttttttttttttgagacaaagtctcactttgtcacccaggctggagtgcagtggcacgatcttggctcactgcaatgtccacctcctggattcaagcaattctcctgcctcagcctcccgagtagctgggattacaggcacatgccaccacacctggctaatttttgtatttttagtagaaatggggtttcgccatgttggccaggctggtcttgaactcctgaccccaggtgatccacccaccttggcctcccaaagtgctgagattacaggtgtgagccacggtgtctggcctcacatcatcttaatatctgcagagtactcccagaatttatctagcctattgcttattgttgctgccattgggtacgactaaaatgcaaggccagtttctggccctcacagtgctcctggcacagctgcagcatcctgcagtttcagagcctaggcagttcattcaataatcagagtaaggaagggtcaggaagtgccagtgtagggtccccaccctcacccaggggtgatgatggctctcagggagctgttctgactccaggtgctgatagcagagtttctctggcaacctgtagcactgccttgagaaatgattatctaaagtatatttgcatgggggtgaggggtgcagagggagtacgagagtcacagtgtcttggcagtggattgagcagagtgatggtgatgccagtggccacgactctttggagccctgagtggtagcagtgatattgaggccagaggcaccacggcagggggcccatcccagaaagacctggggcccttggctggtgacagataactcagggactagaccaggatctgtctcacttgctttcctggtaagtttttctctctatcaaacagagcaggttttccctcccattcagtctcacattgctatgtccagaaaatcatcacactcttccaccagaggggtggatattactttctcagttttcagttttgtttgcccactcactgtatattcttttggtctttccaatggtgatccaaggatttatttaacccagcagtcaaattggtcattttaaataatagtacatcttgtccaagtccaaaaataaaatgtcctggtatgagaaggcaagcggaggaaattgggtagagtaggctgaaaatgttttatagcaccattacccggagcccaagcccctttttcatttatcccttttttgtcccggcatggcaggagtcagagcgccttctgtttgtcttgattaaagtcagcctccaccttcccccgagcccagttgcccttctcaggacacaggctgcattcaccatgggtctctctgcccaagctctttgcagattttatgaaaggcgttttcacttggattaaacaggcgctgtgtttgtgtgtggtgtgtgtgaaggagaaaatgaatcacttcaactttgggcaaggattttaggtgtagtgtttgtcccatgcaattacataaacacaccagaactcattaaaaaaaaaaagtagaagaggggggcagagattcaagtgcttgcgatgatctaaacagtgcggcacattttccatacattagacctcagaaagggttgtgttctgccctctcacaacagactccaagtccaaaggaaagtttgaggttttacatttctgtttgtggtacaggaaaaggcttatgctctgagggcttgattcagtgaaataacattgcctttatacacatttgcttctcaaggagggcaggagttggaagcgaccgttgtgaaacgttaaagattttctggcagagggaaagggattttttttttctccctccctgccgaggaaaaaacagttctaacgaggagttactttgtagttttaactcatattcaaatactcccagccgagaagctgccatcgatcctcccatggacccctgatcctggtttggaggaacttttcacagctctctctccctccctcaaaccctgtgcaatgagtttgcagaagagagtcttcccgagaaggcagaacggtgagtggagctccttctcctatcccaggggactcaggggaggttggaatggaggggtggacccttcctgacatcctcccaggggaatggaagcatggttttggtcccactgtgtagtatatgagtgagtgtgtgtgtgcacacgtgtgagtgtgtgtgcacacgtgtaagtgtgtgcacacgtgtgctacaataggacacaatgcctgtctttgcagaggctggctgagtgctcaccaagtgcttggcagagagttcgggaagggcaattgcaggacccccacaggggaggagagtgaaccctggccagggcaatggttttccatgtgccccggcttcctcttcaaggggcagaggcatcagtgtctaaaacgctagctgtcagggtccccaccagttccgctccagtttcagcagaagcagaacagaagagggagctgctcagctccgggagaagtgaacggagtgctggtctctggagcagatctgagaactgggaggggcctccatccagatcccctaccttcctgcaggtacagcccaacagatgagagcatttcttattaaaatcttcttcttttgctctggaaacataaacaggcatcagggcagaacgttttaacccttctgcccaacttttaaagttaacactggcgaaacttcagctctgttgcaactttggcataagagagtaaacacatggttttccttaaaaaggagaagtaagcaagtcaaaggcatattctgacttttctagctacagaaagatatggctagaaccctggcatctacttgcttaggttgcattaaggcatccgctgaagtctgaagaaaggcagtggggtgtagggaataagaacctgggccatggggcgtggccacctgggatggaatcttggctctgagggtaacaggctccttgatcttggaaaaggcattcaaaggctcactttcctcctttgcaaaacggtggtcataaattcttacctcagaggacggcagaaacaataactaagataaagtgtgtgaaatgacccaaatggcatgtacgtattcagaggatatgtcagctctcctaagcaggctgctcccctcttctctcacagcaaccatcatagatatacaggcttgaggatgaagaaaagagtgcttgagggcccaaagtagccctggctcttcgtatagcagaaagtagggtgagcattcaggcggcctccctttggaggcagatgacatggatgcatttacttccactggggatcttcgagggtgggacttgacctggtgtttactaggtgctccgtgtttggtgaaaccattttattcactctgattcacagggaggtcttaccacttcctaccctggctgcactgcctttggttgggtttccctggtaacagatggtgagacagagatttgcgcataggaagttcattggtgtgtgctctgggaacaacaccagcgtggggtgagggagacagaaccagacagatggagaagttgggctgtgatgcagttgcaacactggcctcagcggatccaggggatcttatggggttttgtatccctgcagtgaccagtcattgcttgtgggctgcccctggaatccaggcataaccttgggtgaggcaactgtctttggctgaaggcagtttcccgagagggactcagttgtgagttgtcacaggcaacacttatgtcagctgtgggaatgaacacctcggtccaggggtgaggagcttatccgggcgatgccccatcaactactcaatacatttgacacagtgccttctttctctgagttaggctgttagaagattgggcattcacatgcagggacacctgtccagttaaatccttgcatagaagtgtgcctttggataagcccctttccatatctgggactcagtgtccctgtctataaagtggatggaagggtgttggactagacatggcctctaaaaacactccagctctgctatttcacatgtgcagattctgagcatgtggtcatggtggttggatgtgtcctcaataatagttgggtcctgtggtctccaccataggtgccttgactccttctgctgggaaataggaatcgagtcacctggggatccttgggacttggcccctgtcagcaaggaggggctgggcctgtgggaagcagagggaggctctgcatagggctggagggtggggcgtagggtttgaggaggattctgctgcacaccttcccccaccatccccccaacgtctctccaataaaaaaagtaaaaccacatgacacactgccatatgtctttgatagttaagagctatgtaatgttgcccgggacaagcatggatatagttttattactctccgtctcctcctaatttcctatttacttttcaatatacaaagagtgaaatcactttcccaaacacttggaattcattttcattgctttttttcttttcttttcctttttttttttttgacaggatctcatctgtcgcccaggctagagtgcagtggcatgatcatggctcactatggcctcaacctcctgggttcaagtagttctcccacctcaccctccttagtagctgagactacaggagcgtgccaccatgcctggctaaattttatttttttgtagagatggagtcttcctatgttgctcaggctggtgagccactgtgcccagcctggaatttattttcaacaaattatttatttagagtattctaggcttcaagcactgtgctgggctctggggatctaatgggacacattaaacaaacaactgtacacacataaatataacggcaaagagggttaagttctatgggaggctgtaacagggaactggcctagtctggcagatcagcgtggggcttccctgaggaggtgctatttgagttgttttctgaagggtgtgtgggagttacactggggcagagatggagaagcaaatgggcgaattgtagaatagggatgggaaaagaaagtgttttaaatcttaccagcttaacctagccactgtgagttttttaagtgtacatccatccagtctgtttttcttgcagcatcttaaacaaattatggtgacttgttagctaagggaataagatctttttgctggtggggcaaggttttgcctgtgtatcagccagttgtctctgttccccacatctggcagccaacccctcagtgtgcatccctcactaccagaggcctcgccctgaaccctggaaagccctcagtaataccagcagctccctcttcctgagtgctttcagcaccaggcattgatttaggatcaacctgcatgagcactgactcatttgatcttacctacagcgctttatttttatttttattttttatttttacctacagcactgtggggtacatgctgttgtctttacttctcaggtgaaccaaaacaagacacagggagtttaaccaggtggtgagtggcaggacagatttgaacacaggcgggtctattccatcctaaagcctgtactcttagtaagcagtatgcagctgaaaaagcacggtgagctttctacatatccatactgctcacatgctgatgcttccactcgacattgggttgtggataacttctcagttccgacaaagttatctgaaccaccagtcttaccaacctcagaaaaacagatcagatgcctgtgcagtaatttatttaaccattccccaattatggacatcttggcttgctttcaattttatgttttccaaaatatcatcataaatattttcaaacatatggaaaagaggaaagaattgtagtcaacatacctatgtccactatctagattctacaaataacattttagtatatttgctttatcacatctatccatctctccatccctctgtccatccatgcatccatctttttttttcatttttttcttttttaaatatagagatgaagtcttactatgttgcccaggggagcctcgaactcctgtccccaagtgatcctccctgcctcagcatcctaaagtgctgagattacaagagtgagccaccatgcctggctatccatctcatttttgaatgcatttccaaataagttggggattaaataaagagtacctgagggcccaaagtagcccccctggcttcctctctagtagaaagtagggtgaggatataggtgatctccctttggaggcagactatgtgtgtgcacttacttacactggcgaaccttccagggtggaacttgacttcatcatacatctaactttcaatatttgtttactgttgttctttcaggtaagatttacatacagtgaaatgtatgtatcttaagtgcactgttcagttcattgtgaaaagtgtatatcccagtgtaaagcacacccctagcaaggcataaaatgttatcatcactggctggatgcagtggctcacatccgtaatcgctacacttttgtaggctgagtagggagatggctgatgcccaggagttcaagaccagtctgtgcaacatagcaagaccccatctctaaaaaaattaaaaatttgctgggtgtgacggtgcacacctgtaatcccaggtacttggaaggccgaggcaggagggttgcttgagtctgggaggttgagtttgcagtgaactatgattgtatcactgcattcccgcctgagtgacagtaagactttgttcacccccacccaaaaaaattaccatcatgatcaccccataaagctcttttgtgcccttctcagttgctttcaatttttgctgataatacacaacttgttgctaactttaaagacctgattaaataaagtatggcacctgctttgtcctcctttgaccgtgggggcagaacctttgcctgcaaaggcccccagttgtggtgagcagacctcatgatgagttcaagtgcagactttggctgggggttctgggataagaaagcagcaccaagccatgggttattctgggctaaagggcaacaaggtacggagagtggtcctggctatctctgggcttgggattagggttgcagttttgggttctgacagtgaggttagaaacaggccagggaagaggagatggagcaggggccccatgggtggtgagcactgtattgaggctttgtatgtccttgtttatcctgagggcctcacctgagcccccatggaccctaaggcccagtgatgggtgccaagctgttcccactagagttgtcctcatatttcctgctgcagtccagactagaatgggcattggaggcaatgcatgtacctttcgctagcaagatgaatacaaaaacagcacaaaatagattgcaggtagtgtcgggcagatgtgctttcagccgtctgaatcgctatgttgttatgaggtggagagggggagggtatagacacaggcatttctggctcttgcacactgctgttcttttcttcccattgcagagggtgtgtggagcactgcgggcgagatggagctgagggaaggcagagctggtacgtgttgaacgtccactgtatttcaggcagtgagagcgttctgtataagtcttataataacccattttacagatgaggaagctgatgctcagaaagaggactggcttccctcaggtcagacactagtcagcagcagcccaggggataggtactcaggctgctggactcctggaccagtgctcttttcaatgcaaacccctcctgtgactagggtgtgcacgtgcatacgtatgcctgtaacaggttagatccatgtgttgatgtgtctatattgtctctgtgtctatgcatctgatcacaaagaatccctctttccctccttcctttgcccttcttcctcccggcctttttttcttctttctcttcctcttctcatcccttcctctcacagctacttagcatccagtttgtgtcaggtactatgctcaataccagggctacaaagaaagatatggcacagcccctggcagcaaggctttattctcttactggtaaggcagacacacggatgagagaactcagcatggagtgctttgggaggacagaagggcagctccttatttatttcttatttattgaaacaaggagtgcagtggtatgatcaaggctcactgcagccttgacctcctggcttaagcctgggcttaagcaatcctcccgcctcagcctcctaagtaactgagactataggcacatgccaccatgccaagataatttttttttttttttttttttgagacggagtctcactacatcacccaggctggagtgcagtggcacgatcttggctcactgcaacctccacctcctgggttcaagcgattcttttgcctcagcctcccgagtagctgggattacaggagcctgccatcgtgcccggctaagttttgtatttttagtacagacagggtttctccatgttgacccagcttgtgtccaactcctgatctcaaatgatccacctgccttggtctcctaaagtgctgggattacaagcatgagccactgcacctggcccataccaagctaatttttcatttttatttttgtagggacagagtcttgctgtagagacagggtctttcccaggctggtcttgaactcctggcctcaagtgattctcccacctcagcctcccaaagagttaggattacaggtctgatccactacgaccagtcaagtgatttaatgtgtgagttgggagggggtgtcagggaagtcttcctggaggaggtgattctgagccaagccttgaaaaacatacaagagttcactggaggcagggcttgttgaagctcttgcttagaaagggcagagtgtgctgacatgtggaggtggaaggatgcacgaagcatctggaggaacttcaagcgtcggagagacaagcctgtgttcttgggcagggatttaaaatttttacttattgagtcagtcatgtcatgacaacaacaaattaagagaagaaagtagggatttcttaatctttaaaaatgttgctttctgatgcaaggcaggaagcggcgttcctcagatacttgtgtgggcagaaagactgaaagcgtgggacaaataactgctttgcacagctgggcaccatccacctcgaactccacccttgtcctgtctgaagccacgcaggccagggcccctggccagggcatctcggacattctgtgacagccagaaaagacgagggactcaactgcctccacacccttgtaaaaggcaagaccccaaactgaacacatggttcctgccaaagtcttgctgagtggaaacattctcccccttctcccccgggtgtgtcactcattaatacctggccttttcttgttgccaggtggtgctgtgcaaaccatcctaatattggccttaaaaatagcaccacccaggcactgaccactccctcccagtgtggcgtttaaccctttctaagcccacccatgtgatagggctgaaggggatgggtaggaatctacagatgctcagcacggcaatgtttacttactcagcttttgttacaaggacaagaactgactggattttgttgtcagataatcctgggttaacatcctggctctgtactttgggctttgagttgttttactccctgtgatgtctcttcctccctttcttataagaaaaaggggaaatcattatggtaccaaccctccaagtgaattgtggagctggatactgtgtggatggtacttagccttgtgtctagctgttccatggtgagcaggcctatgcaaacctacccccaaaggctgaggaagttgaggggccaaagaaagaagctgaaaaatccagtttcttagaaagaaatgttgaatagggacttatgtccagaagccatgtctgtgtctaggacggcgagacaagatggtgaatccccacaattacaccccagacccagggtttatatatcataggagaagggtacagtgcttcagaaggaatgggtagggtgattgctcaaggtcaggatttatggtaagtacaataacatcaagattgttttgacctaagggtaggataagtacatgctcttatacaaggaacagtagatagactagaaaccttacgagactttcctggaactggagttaatcagaatccaacatgggggattagcacccaagatggagttgcctcagcctccacactggcccacagcaagtgctgcacaaatgcttgttgttgctgttattaatcagccaaggttctatatctctgagtactttttatttgttttagagccatgaattaaaccaagtgattcttcttgtcataaccggagggtcatgaatgctcttggaactaaactctcttcccttggagagaacattctgtttcctaatctgtggcttctaggagctaagagagatactgtgaatatgttttttaagttccatttaaacctgggcctaatcacataaattacgctaaggaaatgtctggaagagctctttgtaaactgaaaactacaaacaaatgtagaaactcattacatggcattagtcatttattcattcatttatgcattgattcactcagtaaatgtttatcaaccctttatgggccaggcatgctctagtgctggggaccccacagtgaacaggctgatgaggtccctgtgtgggacctagatggggcggatgggtggtatgtaagtacccaagcagactaacaagacagcttcaaatgctggcaagttctatgaagaaaataaaataaggagaggtaacggtgagtgcctggtttaggttgagtggtcaagaaagatcccacttaggagatggagtcagggaagagccagccatatgaagatctggaagtggaactttcctgtaagagaaaacagctagggcagaagtcttagggtgacaagggcatggcttattcaagaaagagccagaaggccagggtggctgtgggatgcagcgagcaggagaggcagaggtggaagctggagtttgggagataaacaagggtgagatcatttagctcctttgggacactgtaaggaatttgggtattattttggaaaacaacgcaaagcctttggaaggggtggagcacagggcatttttggggcagtaaatatatctctctgtctgatactacagtggtagatccataacgctatgcacttgtcagaacccatagaactgcacaacacaatgggtgaaccatcacgtaagccatgaactttagctaataatcatgtatcagtattgatttatcaattgtaaaaaggtaccacgccaatgcaagatgttaatagtatgggaaattgtgtgtgtggagagggagatcagtattcgggagttctgtactttctatgcaatatttctgtaaagctaaaactgctcagaacaataaagtttattaaatttttaaaaaagtggttgggtgcagtggctcatgcctataatcccagcactttgggaggccaaggaaggaggactgcttgaggccaggagttcaagaccagcctgggcaacacagagagaccgtgtctctacaaaaaaaaagaaaaaagaaaaaatagccaaatgtggtggcatgtgcttgttgtcctagctactcgggaggctgaggctggaggattgcttgagccaggagtttaaggctgcagttagctatgatcataccactaccctgcagcctgggccacagagcaagatgctgtctcaaaaacaaacaaacaaacaaaaaacagtttttaaaagtaattcaaagcccttgcaaattttatgctgatccaatttatattttcaaaaagcctacctgctattatgtgaaaaatggattatgaaggtctgcataggaaccagaatcccagttagaaggtgaaagctataatcagacaagaggcactggtaagaggagggtggcggcagtgaagatggagagaagcggaaagaaagtgggatagcttctggggatagagccaacgagaatcactgataaattggatgtgatgtggaaggttagagagatggagggatcaagatgaataaaaactcacagagggcttattctggcaggcactgttctaagaaccttacaagtattaccatatttagcccaaacaaaccttgtgaggtggatgttagtgcactagccagcctatagatgacaaaaccagtccacagagaagtgcctttttgcctgcctatgatcatgcacttgggcagggacagacctgcgagatgaacccaggaattttggcttcagagcctgtgctatgttcttcccaccttgatactgaggattttggcttgggaaattgatggatgctagtgacaattaccaaaatgtggaagtttagggaagaaacattttattagggggggaatcaagagtactgttggcagtgttccttttttttgcctcactgaataacagccaggcaatgttacttttgaaatttaagttaaaccccagctgaagatgttaagcaagtggtaggaaaaaagagtcagaattcaaggagaagtccaggcctggagaagtgaatttgggagttgttggcatgtgcgtggtatatttgcttgtggactggcttcagttgcttgtcgtgattgtaagtatcttagtgatggaatattactttgaaaggatgcaagcctgatggacagtttgaaagaaaaaaaggccagagagagggcagcatggtctacatggaagtcagctagaattttcgtatgaagttaaaacccttggtttgaatctatatgttgctgtgggccagggaaagaggggaagagagccggggagcgggaatcaagggaccaatggcttctgactgcacagccttggacgtgcactttttggacatgtaacttctctgagtctcagtgtttgcatccgtaagtggggacgtacaataaaatcatcaagttttggcctcaacattctgtctaagttgaaagtgctaaatgcagagagaatttattatcatcatgtccattactgtcaggttacattactagtaacattacattactagttaaaattgttacattactagttaaaattgttaaattatattctgcgtcatgttacattactagttaaaattgttacattactagttaaaattgttaaattatattctgctcatgataatacagttcgcatgaccaaaagtgtacagcataaagaattcccaaggcattttatagattgcaggacagctctttgctcagacctctgagcagccctgtcagattattgggttattgtttccattttgtggacatggaaactgagactcagtaaggtaaaaggacttgcagttgacagagccgcttagtacagaagctggggcttattgctctgaccctaagctctttattttgccattgtttgaacagaataggagatgaccctgttgtgtcattttaaggacacactttctttttgccttctgaatatgtttacttgccacaacaaacatgtattacttttataactaaaattttgaaattaaaaatttttgtaattttaattttttaaattaaatttaaatttgtaattgtaattttaatttttaaaaattaaattagaatttttaaaattaaaattttttaaattaatttttcaaaatttataattttaattttgtaattaaaatttttgtaattaaaaatttacttttggaaataaaattttgtaattaaaaaataggagaattagaaggaaatacaggttattgattatgaaactttagcaagcatcagaatcacttgttgaacagatttctcagttccgtgggctggaagggccaaaaaggtgagcaggcttctgcttggttagctgttggcagcatgcttcctcctctattgcctcattctctcagtaacactgtgcagtagaagtttctaatttcatctggcagacaattaatttcatctaattttcatcgtagcaaactaaggctgtgaatgaccaagatcacacaggaagctcttggttgagcttcaagtggtgcttgaacttcctagttctaaccagggcggggctctctcacctgcgtcttcctccccgtctcttctggcttgcagtgagctggactatggagtgttgggcagggtggagactctttctgcaggatgtcctgaagggcagaggggtgataaaatttccaccttgaagcacaaaccaccccgtattaggaaaaatcagggccaagtctcaactacactttggaataaatttaccttctgagagtgagaaagaacagatcttcggaaaatagagggagaggcgggaactggattcaggtgccgatgacaagagagagcttagacttagtggaggaggggggctgtggggccctcccaggcctcaggatccaagaagggcaaggccagcccccatagccctggggtgctgaattgctcctcagcctctctgccagagcaagatggaagtggggcctgagtctgtcctggccccaccgcacccaggccattgtgagagagattgtgggtgtgagctgagcaggcgacactgacagaggcgctcactctctgcaatttagaaattccttcactgcactccagactcactccagactcagccctacaatgtcccctgtgcctgctgacaaaggcagctttatccccagagtgctccctcctcccgtgcttcccttgggaccgtgggcctgtgttctccagcagcagcggctagatctttgcagccttgcatggaatttcaagggcttcctacaggttgcacctacaccctcattaaagcccccaggaagccctgaaacatttggtgctgagcgttgggaaacattccattctttagaagagaggtccatacaaaaacctcagcctagcatgtacacagggctcacagagactgagcttaggagagatgtgtgggatgctctttgcggggcagatggattaaatgccaccttatgattagattctccaaggggctacgtgggggaaaggcactctggtctcatgacactaatgccaacaggacacacacaaaagtgccccattcttttatgctgcagttttcaacatgctctgtatacgttaggtcatgggctctcgcacctgagcacgcaccaaaatcacctggaggctttgtgaaaacagagtgccagaggtgctgcttcaggaggtctaggccagggcctgagaacttgcatttctagcagatgctgctgatgcagctggcttgaggaccactgagttacataagcttctgagagccagtctgttgtttttgggaaagggtggcacagacaagaaatgaaatgctatggaaaaagcctgggctttggagacaggtggattttgacttgctaacttgctaactgtgtgaccttggggaaattccacggcacgtagtaggtgtttaatgaacgtttgtgcagtggctttctttgtctgcaaagcaggtgatatatttaccagattgatggcaggattgtatgtgatgacttttttcctctttttattaaatttttatataatttgagaggagttcttgctatggtttgcccgggcttgtcttgaatcccccggctcaagtgatccttctgcctcagcctcctgagtagctgggattataggcacgtgccacagcttccagcatgtgatgaggtttatagaaagctcctagcagcgtgccaggcacattgcaggcaccgagtcatgtctgctacctttcggctctcctagtcatttctgtgttgtccaaagaaggcaggggcaactgggctggaccaaggaacctcactgtggttctgtggctctgcactgggtttgcctcctgggtgttgccggccagcccagcagatggtggaccttgttctgaggctgagcttctcagcactggcagcccccctttttggatcaagccttttcacgtggagcagtcagatggctcagatcaggagtcttcgagcaaatccatgccaggtgggacacatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggaggtaggtgggcaccaggtgagtgaatgtctgtcaggcagctgctctgtccaggtggccgttaccggagggaggaagctggcctctctgacctgaatggggagggtcttggttgctaggacgtaacttcatatttggaagtggtgctggggtcaggggcaggagcagaagccaggattgtgttggtaggaatctctgtgtcaccatgtcacagttaggtacaggaggaagcagcttcagaaggccagagcgggcagagggatatcgcttgacctggctctgcagcacggggagaatttggtcctgagatttctgacttttcagcctcgtctcatccttggcaatggggtgtggaaggaggtggaggaaaggaaggcagcaggagagagaaaggccacggggcacctgatgggggcttctctgctgcctggccagactccttttctccaaagtgggcacagcgggtgggcatctctgcagattgaccatgggaaaagtgttcactctgcttgctttttgataagggtcccgtgactaattcctgcattggtaggtcccaggattggtgtttttttgtttttgttttttgtttgtttgtttttttcttttttggtccatagcaagtttgctttctgtagctggagaatgaggtaacagcataagaatagaggttccctgtggaatacagggaagcatcttctcctcctgcccttatcaggtgaaatcctcccacttcaggctgagccatacaaagacgacccctttgtcccaggaggccagttcaagctcccactgggttcctggaagcagcctgggagctgccgtctctgtggctccccttcctatttctccagtttcccccggaaggagaagaccgttcagcctttttcctcctctgttctccttctttaccctgaagttaagtgatggtcaacatttacgagcacagtagaaggcacctcccctgctgcagatatgacgtgggcatgagccgtcaggtgggtcagacccttgaagcctctactgctcatttattcaatccccagtgagtcttttaaataaaacttagtaccccaaccatttcctggccactcttcaagccccaggcaccaagctaaaatattcacatacctcatttaatttaaaccttacaacaacctggagcttagggagtatatccccaaaccgagaggtgaggaggcttgcacaggaccactcagctagacgttcccaggacccaaacccagcttgactccaaaatccatgctctcactggctttgtggcatgcctcaataaatacttgagtttcctcaacacaaagatggtcatatatccatagggttaaaaaataatctctgttggatgcaattgactatagaattattattttctaattgtttgtattcatggaaacctttttagaattaaaatctatcatgaaaactcatgtataatcagttaaggcagaattattttggcagaggcagaccaggaccttgagacctgcccttttgtcaacccctccccctttctggttcccagcagtggcccaggggtataggagtgagagggagggaggtacactttgaattgaaatctactggccaggtacagtggctcacgcctgtaatcccagcaatttgagaggccgaggcgggcggatcacttgaggtcaggagttcctgaccaggctggccaacatggtgaaaccctgtttctactaaaaatacaaaaattagccaggcgtggaggcacatgcctgtaatcccagctactcaagaggctgaggcaggagaattgcttgaacccgggaggcggagactgcagtgagccgagatcatgccactgcactccagcctgggtgacagagggagactccatctcaaaaaaaaaaaatatatatatatatatatatatatatatataaaatacatattttttattgtgcatttgaattggtaatacattttcatatataggttacgttttgctattaaaaagcaattcattgtgaatagcaatatgctcataaacacggggagaaaataggcatggggcaaaataaacaaatagttccaagaacttggagttgtggttaactaggaaggcagcttgaaatcaggaatttacttcaagttcttcttttgaattcctgttgaaataaggacgaatctatgtcagtcttgtaaactagacagtgttgctcagtgtgtgccagaaacactgagaagtctcagtggatgtctcaggtggatgtgaaggacgttgggtggaagggcggagcccatcaggagggaggcgctgttcttgccacatctggagatgctggaggagaggtttgctttgagtgggagcaactggtaatgctggacagtgacccgatgctgggatcccgcgtggagatctccatcggtcttgcccctggctgagtcttggcatgtgcagctgggatggaaatgctcctccagtggacagttacagcagctaagacatggctaccttgctcagccaataggaggcggtcacctacaaacatcccttccaaaggttcaaggctcccctgagaacttggatgctggggaatggtgcaccttccctgctgctcactgcacctctcacctggcaaagaaaagccacaggaaatctaagccctttctgcagtctggcatcggcatatgaaagattccaacgaggaatttcagaactcatcccagctcccgaatctgagtaagcacagacctcttgagtagggctgagcaaatgcggcaaaatcaatgcacatatgacaagattcagtggcccaaagaagggagctaaatgaggaatcaaagcaaataccccatatggaattgctgtaaaaaatcagagaaaacctgaaagtagtggttttcaagcatgacccactagtggattgaaaatcaacttagcgggttggaaccaacttcctttttctaaaacaaaaaaagaatagcatacatcagattgcatcaggttcttagcaaaatcatattttatattatctttttcataccaaagatattttatattatttttattataccgtagtaaaggtattgtttcatgaaagtttttagttatatatatttatttatttatgtatacatataaatcttatgtgtatgtgatccatgtactatgatgtaaaatgtaaattattatggtaagtcaagatttttttaatttttaaaattctttaaaaattatttttatttatttatctatttattttttgaaacagggtctcactctgttgcccaggctggagttcagcagtgcaatcccggctcactgcagccttgactccgtgagctcaggtgattctcccccttcagcctcccgagtagctgggactacaggcacacgccaccacacctggataattttttgtatttttattagagatggggttttgccatgttggccaggctggtctcaaactcttgagctcgagtgatctgctcgcctcaacctcccaaagtgctggaattaaagtcgtgagccaccatgcctagcctaggtcaagattttaaaagtttcataaatagtcctgtagaacactgggtggagtttggaatggtgaaaatgtgtcaggagagtattgtaactgaaatattcctgatcttctctttcaaaaagatggccttcttcccattatccaaggcaaggatttcaggcctgagtcagccataagctcatctgtctttttttctgtacttacctcctcataaatggattaagagagcctcgagcaatggtgagggttggagaaggtggacaggtggcccagtcttatgcgctttccctctcttccttccttctcctcatcctccaaggatggttgtagccaactccagccaaagtgcagatgccagagaatcctgcagcagttgctgagaacacaggatacctgtcacatttactgaagcagtggcaggacaatgcatcccctgcattgagctagttgtcagaagcagaaaataaaaagtgtgtgtgtgtctctgtgtgtgtgtgtgtgtatgtgtggtgaaaaagagaaatatatctaaaaataatcttaaaagacatgatatgtaatttcttaccaaaactcaagccaaagcaatcacacatacacccacacacatgcacgcacacacccccatccacacacacacacacagaagtaaatgacagcagttggaccatcaaaatctgaaaaattctttcaggccaaagactccataatgctctatagctgttattttgcatttctttgaatctcctctcagttctatttagagatcacgaaatgtctaatttaatggccctgcccttagttctccaggaaggagatcttagttgttcatccacgaacaactttttgagccactttcctacttctatttcttccagtaggcagatcatattttgggtttctttgttttaagtttgtggtttttgtttttccctctttttctttttaggttgtagttaagtggtgtatacaaatttattagcaatttattatattgccactttgtattttaatctttaatattaaattttgtgtttggtaaaaatgctgtaattagtaaaatgtagagtaatcagtttttacccattctctgctcttcaataacagcttgttgagtattctctctgatttattctagcatcagacacacacacgcgcacacactgtgctgcagcatgttttgttttccaattctatgtagcacaaaaagacttaacctcattcttctccatatctcaacagtattccatgtatcttgatgatcacttacaatataaggcaagtaagcataggcaattcatcagatttgaaccagagatggggttactaagtgaactattagttccccagaagaattagcccaagcaaaggtgttgtacagtatgtaaaatgtcttttcctactttatacattttatctggccagagaacacctttaaacattaaatgcaatcatccttagtcattcaacaaatatttactgagcaattgatagaggccattcgccaagctaggcctcatggatcaactcgaaatatgacagacagactctgccctcagggagcttagagttcagtagacatgaccagtggtgacacaagccactggagtagcatcagatgagtgctttggtagtggaagaacctgttctcagagcacagacagctttgggggtctgtattggtttgtggtttcattttaaagaagtgttatccaaaaatagggtttgaagagtgatgaaaatttagcatcatcaaggactatagaaaatttggaaggcatatctcctaatgctatccctcccccctccctacacccacaacagtccccagtgtgtgatgttccccttcctgtgtccatgtgttctcattgttcaattccacctatgagtgagaacatgcagtgtttggttttttgtccttgcaatagtttgctgagaatgatggtttccagtttcatccatgtccctacaaaggacatgaactcatcattttttatggctgcatagtattccatggtgtatatgtgccacattttcttaatccagtctatcattgttggacatttaggttggttccaagtctttgctattgtgaatagtgccccaataaacatacgtgtgcatgtgtctttatagcagcatgatttataatcttttgggtatatacccagtaatgggatggctgggtcaaatggtattcctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatgatatctcattgtggttttgatttgcatttctctgatggccagtgatgatgagcactttttcatgtgtctgttggctgcgtaaatgtcttcttttgagaagtgtctgttcatatccttcacccactttttgatggggttgtttttttcttgtaaatttgtttgagttcattgtagattctggatattagccctttgtcagatgagtaggttgcaaaaattttctcccattctgtcagttgcctgttcactctgatggtagtttcttttgctgtgcagaagctctttagtttaattagatcccattggtcaattttgtcttttgttgccattgcttttggtgttttagacatgaagtccttgcccatgcctatgtcctgaatggtattgcctaggttttcttccagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctattccattggtctatatctctgttttggtaccagtaccatgctgttttggttactgcagccttgtagtatagtttgaagtcaggtagcgtgatgcctccaactttgttcttttggcttaggattgacttggcaatgcgggctcttttttggttccatatgaactttaaagtagttttttccaattctgtgaagaaagtcattggtggcttgatggggatgacattgaatctataaattaccttgggcagtatggccattttcacgatattgattcttcctacccatgagcgtggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaaagcttgtgatttttatacattgattttgtatcctgagactttgctgaagttgcctatcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcttccctgtcttgtgcccgttttcaaagggaatgcttccagtttttgcccattcagtatgatattggctgtgggtttgtcatagatagctcttattattttgaaatacgtcccatcaatacctaatttattgagagtttttagcatgatgggttgttgaattttctcaaaggccttttctgcatctattgagataatcatgtggtttttgtctttggttctgtttatatgctggattacgtttattgaatgctaaatgacgagttaatgggtgcagcacatcaacatggcacatgtatacgtatgtaacaaacctgcacgttgtgcacatgtaccctaaaacttaaagtataataataacaaaattaaaaaaaaaaaagaaaaaaaagaaaatttggaaggcattggaagcagcctgcaccaagtcctggaagctagagagcgcatgggacattcaggggactgaaaaggtttagtgctgtaatagaatggagttcaagatagggcagagcaagagcctggaggggttgggggagcagaccatgatgataaaaaaattgacaggccacaaaacaagacaaattttaagtctcagtgacggttgttaatacgattttgaaataaagcaaatgataaatcttagaccgggcgcagtggctcacacttgtaaccccagcaccttggggggccaaggtgggtggatcatttgaggccaggagttcaagaccagttggccaacctggtgaaatcccatctgtactaaaaatacaaaaattagccgggcatagtggcacgtgcctgtcatcccagctactcgggaggctaaggcaggagaatggcttgaatctgggaggcggaggttgcagtgagccgagatcacaccattgcactccagcctagatgacagagcaagactccatctcaaaaaaaaaaaaaaaatcttgagagatgatatataatgatctatgatgtcccctaaatagtcaatcactctgagagcacctagcacctcacctcttgcatagggaagaggcatcagatagtgccattcttgcaatcaatgaagaggaaaaatacaggctcaaatattgctttgaaaaattctttacatagccaccagtaatatcaaataaaatgaatgaaacctatgattcattaagaaggaaaagaaagtgtgaataagttgactggaaaacaagaaaaggaataattaaggagccataataagaaaaacaaaacatgtgagaagaaagatgaatcaattaagctctgtagtaagattacacattaaaataaaagagactctcagattcagtttaaaaaagggaaacaaaaaaagcctaaagaaacaaactctctctccccagtccaattatatcccactttcaagagacacatttaaaacttaatcacataaagttacaaataaagggataggaaaatactgtgcaaatgcaaattaaaagaaagtgaggtgtcagtgttaattttgtcagacaaaataaaaattgaggcaactattaaatagatcaagaattacttttttacaaaatgataaaaagagcactcaatgaaggcatgaaaatcagaaaactttgggtaaacataaagcgtcgaaatatgtaaaacaaaaaaattagagatatactccaaatatggtgttagatttcaatgtacaccactgttaagattttttcagattaattagacaaaatgtacataaagagcttgaattctatgacttacaaaattgaatatgtgcttacatatatatgcagtcatgtgttgcatggcaatgaagataagttctgagaaatttcatcgtcgtacaaacgttacatagggtacttaaacagacctggatggtatagcctactacaccccaaggctatatggtattgcctactgcttctagtctacaagcctgtacagcatgttattgtaggcatttgtaacacagtggtaagtatttgtgtatctgaacatttgtaacaaaaggtacagtaaaaatatggtattttaatcttatgggaccactatcatataagcagttctttgttgaccataatgactgcattttaatatcacatttgaatatatacatatttgaaacccaaaacacagaataatcattcttttcaaatgtgcacagaacacataaaacacttagtcacatcacatactggctaacagagtaaacctcaatgaattccaacaaataaaaataagacacatcctgtggcacgatgcaattaaactggaattttctaataaaaaattgtaagaacagcaacactaaatctgggaaatttaactacatgaaattaacaataacaccaaaaatctcctgaagaactgagtttaaattgggaatcaaaactgcaattacagaccattcctaaaataacatttagaatattgtatttcacaattcctgggttggggccaaaaggatgttcagaagagaatttcgggctttaaataatgatgatgatgatgatgatgatgatgacgatgacatggtggcaataaaaccacccaacaaaccatgctaagaaatttacatccaggccaggtgtggtggctcatgcctgtaatcccaacactttgggaggccgaggcaggtggatcacgaggtcaggagatcaagaccatcctggctaacacggtgaaaccccgtctctactaaaaaaaccacaaaaaattagccaggcgtggtggtgggcgcctgtggtcccagctcccctggggaggctgaggtaggagaatggcgtgaacctgggaggcagagcttgcagtgagctgagatcatgccactgcactccaggctgggcgacagagtcagactctgtctcaaaaaaaacaaaaaaaaaaaaaaacaaaaaaaagaaaagaaaaaagaaatttacatccaatatttcaatttataatcacagtgttgctgtgagatggctaatcatctgcatcttacagatttttaaaaagtgattcacaaaaaggctaagtagattattttaaatttcaactttattttagatacaggggatacatatgcagatttgttacatgggtatattacaactagatagtgagcataataccccatatgtagtttttttaacccacgccccacctcccacccaccccctctagtagtccatggtgtctgttgttcctctgtttatgttactatgtggccaatctttagctcctacttacaagtgagaacttgaagtattcggttttttgtttctacattaatttgcttagaattatgtgtggtctctagctccatccatgttgctgcaaaggacatgatttcattctattttatggctgcatagtatttcatggtgatacgtaccacattttctttactccaccgttaataggtatctaggttgattccatgtctttgctattgtgaatagtgccacaatgagcatacaagtgcatgtgggttttttttttttttggtataatgatcggtttttctttgggtatatatgcagtaatgggattgatgggtcgaatgatagctctaccttaagttctttgagaaatctctgaactgatttccatagtggccaaactagtttacattcccatcaacagtgtataagcattccctttcctctgcaacctcaccagcatctgttgtctgttgactttttaataactgtcattctgactggtgtgagatgatatctcatgatttttatttgaatttctctaatgattactgatgataagcattttttcatatatttcttggctgctagtatgtcttctttcaaaaagtgtctgttcatgtcctttgcccatttttaatggggttatttggtttttgcttgttgatttgtttaagttccttatagtttctggatattagacctttgtcagatgcacaggttgtgaatattttctctcattctgtaggttgtctttttactctgttgatagtttcttttgctgtgcagaagctcgttagcttaattaggtggcatgatctcagcttactgcaatctctgcctcccaggttccagcgattctcttgcctcagcctccagagtagctgggattacaggtgcccaccaccatgcccagctaacttttaaaatatttttagtagagatggggtttcaccgtgttggctgagctagattcaaactcctgacctcaagtgatctgcccaccttggcctcccaaagtgcttggattactggcatgagccatcacacctggtccatattttggttttaaaaatgtttttgcaactcttatctcattgtctccttttcccccaaaccttgggaggaaggtagtagaatatgttaatgatgcatattatcaaatatacatataacagcagtattgctatttctgaagggcaatatggcacaggggttaggtgtgtgggctcattaatctgccggggttgtggtctgactttctcagttactagctgtgtaatcccagacaatccactttacctctctgtgcctcagttttctcacctgttaaatggagaaagttaaaaatagtatatatctcatatggatattataaggataacattataggtacttatatgagaaaattcacctaaaacagaacagtgcacatagtaattgcttgataaatatgatgatgattattatttctattttagcatgggggcactaattctgaggaattgagcactcaatgaattcaatcacatttattgagtcccttcaatgttccagacagtgtgcaagagttatggttgatggtgctcagaggataatgatggagacagggacaaaccagatcattcttatttctgatgtggccaaagtgcaggcaaagacatgtcagggaaatcatgggtacaccgaggagggcagacagtgtggggaggggcgtcctgggggaggtggctgttgaaagcaggatattccaggaaaccagtctggatggtggtaagaggtgggaatgggcagagggatatgggctcgcaggggcttgcaggagctcacaggggcttggaagaatttgctggaggtggcagaagaggtgatgagcacagtggagtcaagtctgaggcagggatgaactgggacaacagagaggggcattgtccagttcagaacctgagctctcttgttcttttttttaaggagcacaggtgatccttaaagatccaagagtgaattctaagcaagggagggtttcagttgtctaagcaagtcctgcaatcaaaggttccaggtcagcaaggccaaaggtgacagcaggtcctcatatcctttctggagaagctcggagtactcaatagcccacacccactcacttctcccttctcacggggacactctagtccatgtcctgtctgcctacctccctgcctcccctcgccagtggccctgcacccaggcgtgactcagttggcccagatgaactctgcaggctccagcaatgccatggttacactgatttcaaaacaacatctggaattgtcacttcttgtttttgttgcaattgcttttggggacttggccaaaaattctttgccaaagcagatgttgacaagggtacttcttaagttttcctctaggatttttatagtttgagatcttatatttacgcctttaatccattttgagttggtttttgtatatggtgaaaggtaaggttctggtttcattcttcagcatatggctagccagtttatccagaaacatttattaaataaggagtcctttccccattgctggtttttgctggcgttgttgaagagcagatggttgtaggggtgcagttttatttctgagttttgtatttcgtttcattggtctgtgtgtcattttctataccagtgccatgctgttttggttactgtagccttatagtatagtgtgaaattgggtcatgtgatgttcttctgttctttttgcttaaaattgccttggctatgtgggttcttttttgattccgtatgaattttagaatagtttttctaattctgtgaagaaggacactggtagtttgataggaatagcattcaatctttaaattgctttgagcagtatggccatttaaacaatattgattcttccagtccatgagcatggaatatttttccacttatttgtttcatttctgatttctttcagcagtattttgtagttctccttgtagagatctttcaccttcttcgttattcattttctttgtggctattacaagtgggattgtgttcttgatttgacactcagcctggacattattggtgtatagaaatgctactgatttttgtacattgattttgtatcctgaaaccttgctaaagttgtttatcagttctagcagacttttgttggagtctagggttttctaagtatagattcatattgacaacgaagagagatagtttgacttcttcttttcctatttgtatgcttttcatttttttcttttgcctgattgctctggctagaacttccagtactatgttgaataggagtggtgagagtgggcatccttgtcttattccaatcctcaaggggaatggttccagctttttcccattcagtatgatgttggctgtgggttttcatagatggctcttattattttgagttatcttccttagatgcctagtgtgttgagagattttttgggttttttgtttgtttgtttgtttgttttcatagacagagtctcactctgtcacccaggctggagtgcattggtgcaatcatcgcgcactgcagcctcaacattctgggcctgagtgatcttcccacctcaacctcctgagtagctgggactataggcacatgccatgcctggctagtttttgtattttgaattctttttttctttctttttttttttttgtgagacagagtttcactcttgtcacccaggctggagtgcagtggtgcaatctctgctgactgcaacctccacctcccaggttcaggctattctcctgcctcagcctcccaagtagctgggattacaggcatgcaccaccatgctcagctaattttgcagtttttagtagagacagggtttcgccatgttggccaggctggtgtcaaaatcctgacctcaggtgatccacccacctcagcctcccaaagcactgggattacaagcatgagccaccgcgcttggcctagtttttgtatttttagtaaaaacaaggtctcactatgttgtcttggctggcctttaactcctgggcttaagcaatctgccgctcttggcctcccaaagtgctagaattacaggcatgagccactgcacttggccatgtttaggtgtttattattattattgttattaaggaatgttgaattttatcagaagtttttttctgtgtccattgagatgatcatatggtttttgcttttaattctgtttatatggtaaatcacatttattgatttatgtatattgaaccaatcttgcatcctaggaataaagcctacttgatcgtggtgaattaacattttgatatgctggattcagtttgttgaggatttttacatctatgttcattaggaatattggagtggggttttcttacttcattgtgtctctgccacattttggtattagactgattgtggcttcataggataagttagggaggagtgcctcctcctcaattttttggaatagtttcggtaggattgataccagttctttgtacatctggcagaatttggctgtgaatccatcttgtctagggcttttttttttggttgacaggtttcttattactgattcaatttcagtgcttgatattggtctattcagagtttcaatatcttcctgattcaatctttggagattgtgtgtttccaggaatttatctatttcctccagattttctaatatgtttgcatagatttgttcacagtattctctgaagaatgtttgtttgtctgtgggatcagttataataccatctttatttacttatatatacatcttatgtgtgtttatgtgatctatgtactatgatataaaatgtaaattcttactgtaagtcaagattttttttaatttttaaaaatttttaaaaattatttctatttatttattttttgagacagggtctcactctcttgcccaggctggagtgcagtggtgcaatcctggcttactgcagccttgactccctgggctcaggtgattctcccacttcagcctcccaagtaactgggattacaggctccctccaccgcacccagctaagttttgtatttttagtagagatggggtttcactatattggccaggctggtcttaaactcctgacctcaagtgatctgcctgcctcagcctccaaaagtgccaggattacaggcatgagccaccatgcccggcccttctctttttaaatatagctagctgtctatcaatcttatttattttcttgaaaaaacaattcttggtttcactgatcttttgtttggatttttgcacctcaatttcattcagttcttctctaattctatttatatctttccttctgttagtgttggggttagtttgttctttttttgttctagtttctttaggtgcaaaggcaaattgttaatttaacatctttttaatttctcgatgaaggtgtttagggctctaaactttcctcctaacactactttagctgcatcccagagattttggtaagttgtatccctattttcattaatttaaaagaatattttaaaatttctgccttaatttctgtgctcatccaggagttattcagaagcaagttgtttaatttccatgcatttatgtagttttgagaaagcttcttgatactgatttctatttttattgcactgtggtttgataatgtgcttggtatgagttcaataacttatttgaagttattgagacttgctttaggacttaacatgtggtctatgttagaatatgtttcatgtgcagatgagaagaatatatattccgtgattgttgtgtggagttctatagatgtctagtaggtccaactgttcaagtgctgagtttaagtccagagtgtcttcgttggttttctgccttgatgatctgtctaacattgtcagtggggtgctgatgtctctcactattattgtatggttgtctaagtctttttgtaggccaagaaggacttgttttatgaatctgggtgctccaatgttgggtgcagtatatatttaggatagttaaattttcttgttggattgtatcctttattattatataatgcccttcattgtcactttaacttttattggtttaaagtctgttttaaaaatagtgactcctgttcttttttgttttccatttgcatagtatatctttctctatccctttattttaagtctatgggagctacgtgaaataggtctcttgaagataataaatggttgggtcttgtctttttatccagcttgcccctctgtgccttttaagtgggaacatttagtccatttacatttacaaggttagtattgatatgcgtgattttgatcctgtcctcatgttttgatcctgtcctcatgtcctcatatagctgattgttatatagatttgattgtgtagttgctttatagtgcctgtgggctatgtgcttaagtgtgcattttgttttttttttgtttgtttgtttgtttttgtggcagtaggtattgttcttttgattccatgtttagcattcccttaaaaatctcttgtaaggcttgtctagttaaaacaaattccatcagcatttgcttgcctgagaaggattttagctttctttcacttatgaaacctagtttgctttacttataaagcttagttagctatatgcttaagtgtgttttctgtggtagcaggtgtcatccttttaattccatgtttagcactcccataaggacttcttgtaaggctggtctagtttaaacaaattcattaagcatttgctagtctgagaatgattttatttttccttcacttatgaagtttagtttggcaggatatgaaattcttggttggaatttctttgctttgaaaatgctgaaaataggcccccaatctcttctgacttgtaaggtttctgctgagaggtctgctgctgcctaatagggttctttcagtttatgatttaccctactctctaattgcctttaagattttttttttgtttgcattgaccttggtgagtctggtgactatgtgtcttggtgatggttgtcttgtgtagtatctagccagggttctctatatttctcatatttgcatatcaacctctagcaaaattagggaaatttttggggactatatcctcaaatgtattttccaaggtgcttattctctctccttttctctcaggaatgccaatgaattgtagatttgatctctttacatactttcataatttttagagattttgttcatttttcttaattcttttttctttccctttatctgattgagtggattcaaggaaccagtcttagagctctgagattctttcctcagcttgatctattctgctgttgatatttctgattgtagtatgaaatttttgtagtgagtctttcagctctagaagttcagtttggttctttcttaaagtggctattttgtctttcagctcttgtaacattttactggattccctggattgattgggctccaactttctcaggaatctcagtgagcttccttgctatccagattctgaattctatgtctgtcatttcagtcatttcagactgagcaaaaaaccattgctagggaactagtggactcatttggagataaggggacactggctttttaaattgccagagttgtaactggttctttcccatctgcaagggttagtgttcctttaactgtggtgtaagttgattatacttagttggctttgtttctggatgttttcagaggatcagagctctgcacaggatctttatgcttgggtgaattcttgtgtttggtttcacagatgcatatattagtaggataatttttggtgttgcagcttaggctgtgatccagtagatggtgtggaagagtgatggccaatagctaggctgatagccagtcacactactcttttgtatctcctcatgttggcaggtgtgctctgcagtcgggggtggagacaaatggccccttcaccaggtctgctcatgagccttggggagacccttttgatcaccagttatgtgcccgtgtttcttttgttaggtgttccaggatgcagggccccctctgggaaaggctgtaacaggaagatgttcttcaccctttctggattgaccctgtggagggaggcatagcttgttcccaccctggcccgggaacccatttgtctcaccccttgccacactctgagggtgggggatcctccctcactcaagtgccaaccacagatcctggctttgtattcctgagctgctgtactgtggccctggggcaccagaacatcccatggctctgtctgaatccatggttggattctggctgcactggggattctatgtgctccagatcaccaggaaagtactcaggtggagcaatgcgctcaggctgggccaaggaggctgtgctgtgcacctgctcctgcagggtggctaggcatgggccctgggaagggctagcatgtaggaaggcttgcagaacagatgtgcatcattcccagggaagccagccctgctctctcctggctggaaggtcagctggggccagcgcctcccagaggggaatagagagtcctgggggatgaccatctgtggctgctctctgctggagctgtcctgtgcacacaaactcctcagctccatgctgtctgaaggcctgtctttgcctgttccctggggagatccccctccagctcccacgtccttgtgtgatgcagggtcccctgtagctagaatcccagaggctggtggcaagagtgaggcatccttcagttccctcactcactgctttcccaggagctgtttgggccaggaactagcctaatagcgtttgggtacccctgcagggttcccagcttcttccctcttcagcctcagcttcagcatcacttctacccacccctggctttttctttttgaagagctacccaaattatggtggcttacttgatagtttggtctctctcagtgggagcaacacatcctggctgcatgtagtcggccatcttgtttccgcctcctgctgtctttgaggaatgctcagccaccatccagctgggccacatctgtctgtcttagcagcagcagcagcagcagcagcagcaggaggaggaagacagcaatgatgaggctgcctaccgagcattcatgaggacctcctatgagaagaacccaaagctgttagcatccctggctgctgaataggtctactgtgcctggcaccccaagcagccctccttacagccttgcagccaagcctcttccagcctccctcctctccactgcatactaagtagatttcttcaaggtcaggcatagtaaattgttggagtgggattgacacctaggtctacttaggctgtaaagctacagcatgtaaccacgacatgatatgctatcatttctaaaatagaataaatttaaggaaactaaatattcaattcttgaagatagaaaaaaaataaaacaaataaaagcaagaaggagaaaagtagctaaagcagaaataaatatgttggaaatcaaaccccaaaaagcagatgttttcactgcttctaagaatgagtccttggaaaggactgatagaacagatagccctcagtgaagacaaagcaaggcaaacagaaggggaggccaacagaaatgcagagcactggtcaggagagcatatgcacagattttagaaaatatttaaaattatgagtctgtgatggacaactttatactaacaaacctgaaaatctggatgaaagagtacttttatgacaatgtaagtgatcaaaattaacagaggaaatttttttaaaaattaaaatagaccaaccaaggaagtaatggaaaaagtttcaaagaactacctaaaggggatgccaggaccaaaaaattttatggaaaaaatatttcaagcttttaggactaggtgtactttaaactattaaactatttcagaaagtaaaagaaatgtccagcttctctttgctctttttataaaacctaagacaacccaaatgagatggcagaccattcctatttgtgaatatagatataaaagtcctaaataaaatgttagcaaactcaatccagttatctattgaaagagacgcacactgtgatctaatgggacttaaaacaataacaaaatataagtagctcaattgtaagaaaggcattagtttatttcttcattttgacaaatcaaaagaggaaagacacctgatagtgccaaacagctaaaaaagcatttaataaacaaccacccgttcttgatgaaaatgcttccaaaattatcattagtaacatgtatttccttaatatgataaaaaaattatgtctcaatatatcggtcaacattctacatactagaaaacactgcaggaatttccattaatgtctggaaagagaaatgaaaatcctgtattgtcatcatgatttactaaggttctagaaactttagtcagtaaaattagaaaacaaaatgaaataagtgacccaaatatttgtaaatgaagcaagtttgttaatgttcagaggttacatgattgaaaattcaaaataacctactgaatagttattagaattaatatgagatctgcaagtttgcaagttatgaagtaaatatacaaaagtcacttatgtatatacaaagactaaccaattagaaaatatattttacaaataattcaattcaaaatagaaaaaaatgttccggaaaaatgtaattaaaaatatttagagcccaaataaagaagagtgtaaaatgttattgaaagtctgaaaagaaaatttgaacgaatatagaaacaaaacaacaattttctaaaaagtccctggatgggaagactttctcccctaattcatctataaatgcaaagcaattccaatcaaaatttccaccagacattttagaacctgataaaattatttcacaactactagctgacaaaattaagcataaatttctattttgttcctgcaaatagcaaatctttattttctcatcataattgagacgtgattgttgtaaaaagaaatcaagtgtaggaaattacgcagaaaggaaagactccttgtaaatatcatcccccagcaccttgctgtaccttcccaaaaagttattaatagtttgattttattgatgcaagtaagttttttgtaaataaaactcaactccagctattttatgctttttcagctttacaatatattgcagacatatttccatatctatatatgtatctattttattgttgtgattggctgcatggtattccatcatacaaatgtatcataatatatttaacaaaatctcccattcatatacatttaggttttttctcctcttttactgtttttttgagtaacaatttttttttttttagtccatactacgtgcaaggcaataagctaagtatctctcagaattattttctttagccttcacggtcgttagcattgttacctctaagccataaaggtgttaaatactttgcttaagttgtccagatactaagcaacagatctggcatacagagcaaggtcaatttcagagcctaagcctttaagcggtatatttataattctgcttgtccatcttcccaattattaacaattactaattaacgacactgtgtggacatccctatgtgtagctttgtgcagttgacctctcatttcattctgcagtgacattgactgagtgcgtcctaagtgtgaagtcctgctgtgggcactgggattccatgaggaatgagctttagccagtctttcaagaacaatgatgagtggatatgcccttatctatctgggtggaaatgcctttatttatctagctccttcttgcgattgactatatagcaggcctttggaggtaatatattacctccatattggaggtaatatatactgattgggaaatccctttcctgacttatcctgtgccccaggggcctggatcttgttgaggcccacctgatgccccgctcatgcctgtgcactgatggttaggttctccttccaggatgctgaaagtgcaatggtccctgtgaggggcttctccaggatcttaaggacttttctgaggagcagcattgagaatcttccctgatggctcttgacttgtcttctgctctgaggtcagcccactgtggctccttgtcactctgatgttggttggttacctggagtgcatcattctgtggtcctagctgagatggtttccttgagaacacttcacatgatgttggtgcaggaaaagtctgttggaaagggcctctgaaacactcatctgccgttcattcactgaacatgcaaatgccccttctttgtgtcaacccccatcaaagctttggggacaaaaaatgaatgagactatgtctatctctcctctccaggaggtaacagtatagaggaagaaagataacagatatgaaactaacttcaacacaacttgcttaaattaccagttgggaaactgaggcccagagacactgtcttcctagtcctgtgtacaatgtatagagacatacacagaactactcccagctgcagatccaatggaatcctattaaagatacttcttttttttcgagacagggtctcactgttgcccaggctggagtgcagtgctgtgatttcggctcactgcagcctccacctcccaggctcaagcaatctctccatctcagcctcctgagtagttgggaccacaggcacatgccatcatgctggctagtttttttgttttttgttttttgttttgtatttttggtagagacagggtttcaccaggctgcccaggctgcccttgaactcctgagctcaagcaaatcacccacctcggcatcccaaagtgttgggattacaggcttgagccactgtaccccacctaagatattcttttagaaagagaaagaaccatacatttcttcatttcttatcattgagttattctttaattgacaaagacaaaaattaccccctgggctagagtgaccaaactttaaaaattgcctttgatgtaggacactgttggagaattcagcaatttgaaacacattttaccagctagttcttctctctccatgtggttatttaccctcccaaagatctccagtgagttaaatgtattttatccaggtggaaatactgtggcctttcctccggtaggttagctttgcctagcacaaaaacaggcacatgacagtttctcaacaagtgcttgttgaatgaaaaaaaaaaaaaaatgaaaaggaaggaaggaaggaggaggaagggagggacagactaacagatcctgcttcacagtacatattctgcaagttttttgaacttctttaaaggagaggaactatccatttcttttcaattcagctctatccttttggctctgcattttctaaataaatgacagctctgccatggtaaaaacatatactgataactatgatgatgagtcagtcctgccccactttttttttggcacagtgtccttacccaagatgtgatggggagaccccttccagatctagtattctgtggaagatataaccaaagaacaaatacactagctctgttggggaggtgtggggaagcctccagggagttggagagcagttttctagggagctgcagaacttctcggtttttctgcttggaagtaaaacaactgatcgcattagcttagccatgttagaaaccttcattgtgcttcccccccggaatcctctggaggagacccacaaggctgtcttgtggagggcccaccagaggcagagaaaatctggcaagagtttgacaagtcgtcatagagcctggggaaagataagggaaagctcattagttccaacctttcgaaggcagctggactggaggaatggcatgggcttgccccccagctctgctgacatttggttccattagggagcaatagctggttccaatgtcctgagctcaattactgaagctaagctgaaccatgtgaccacagcactgtgttttcaattattctctctcccttcctccctctcgatgccaggcctggagggaaggcaatctcccacagaagtccaattctggcttctctactacagctcttttgcaattgttctcttcctttaaaaaaaaaaatccataatgacaaggctcattttgaaaactgccttcactcttaaccaaagtgttaatgccttgccccctggttcattgccatctcccatcccatgggccctgccatcccacatgagagcctaggtcatgaaagtggtgattctcttgggaagagcttgttttttcaaagctgccggtactcatcagacactcctgcaaatggtgcattgggattagcacagtttccaccaaggaatttgatccctctgttctcttaaatgctacatgcagccaactattccaccactgagtgaagcacacagccttgcacctagccccaaaggcccccaaatgtttttttgtcctggaaaatgcctagtgagtgaccttactattgctgggacagttattgtacattggaagaggatgtggaagggaaagggaattgggtttgcattccaagaacccatgcagactgtggcaattcttggtgggacaagaatgcgagaggctgttataccagaatctgacactggaggatgaagggggcagagttgaggccttgactgggtatgatggcttctctcctaggcttggggtgggataagagagtttcaaaaaccctctcggcccttggatgtcactgttttccatgccttatgccagcaacggcaaagagaagagctactattccaggagggtttttttttttttttttaagcaaaaagaaagtcttttggtttgcataactgcataggtcaatgcagtttcaggcatggctggatctagatgcccatatgataatgtctgaactcagtccctctcagattttctctctgtcctccttcctttatctctacctctctccccacctctatgagttctgtaccttctgtgttggcttcactcacaggcagcctctctacatggtcgccctcagcatccccatgtttatatctttcctgtttagcaccagcaaagtccagaaggattttaacacagcactgattatcttacaaatttccaaatgcctaatggaccagtgttagctgtgaccaacacacactcacagacacacacacacacacacacacacacatacccacacacatctttccctgtgaaaccctggtgaactatggaactcctaaggaagtgatcaaaatggaaagaagtttggacatattaatatttatagcgacatttgtgtggagagttactagttttgggaagtggaattggcaggatgcagagaaactcttggattggggatgggggcagaggaacattcacaatttgcatttggaagatgacatctggaactaaaggcaataatgaggtaaaagagaaaactactctaaaagcttaaaacgtatgtattcttctgccaatggatctgagcattgatatactggttaacaaatcctctcaaaatgcagcaagctttttaaccaagcagatttggcctctggactttggttcatggcactggggtttgtaaaaggcagacctgatacaacagtttcagtggctgtagggaaaggaagctgactctgtgggctgaggcttgaagaggaggtaagcatgaggggaggaagtacaaagtgcagaacattttctcaagaagacatgaaggggataaaggaaaagcaagtgacaagaggaggacatggagttaacatatagtgtttgaaagacagaaaatgtttgagtgtgttcatgtgctgaggataaagatccagcacagaggaagagactgaggctaaaggtgagaaaggcaataatcaatgagacggtagagccagggtaaagcatgcaggcttaagagccagattgcctggtttgattcctgcttttactgagtcctagctgtgtgatcttgagaaagtcacctaacctctctgtgccttagtatctcttctgtaaaatgaggatattgatggaggctaccacagagtttatgagaactaaatagtaaagcaatgagagcaatgcctggcacaccatagtgaagttttcaaacagacattgttggaaatgtgttatcaagctgattactgaaacagtactactgttggccagagctggaggcccagttggtggccacgaatgtttcatgataccaatctgttcaggagtgagagtgtctccttcaaggcttagagacccacagtcaggcatgaactctgcagaggcttggatttgtctgtgattggagttttactatcatttgagatggaaggacatggagtacaaaacttaggcatgttgacaagagggtgcttgataaaatggatcaaaaccgaattaatttatactaaagcatcaaacacagtgcctgatatattgtagactttcaatcaatcattaattcatttttgtttattgctattgattactgggatggttggtgaataaattgataaaatcaaagagctaatacagaaaacaataaatgtgtgcaattcgagtgctgaaaaacagtctatttttaggcagaaattctccttttggaggatatgtgaaagggttttgatgtaatgaaatgttattaggtctctgctattccttattcaatactggatgtgcgcaaacagcagtaccaatgggccaagagcatcccacaatttgttgttctggccacagcctctcttttgtggcttgggcctgagtcagaactttttaggatacagcatcagggctcctttcaccacctgcttcatggaaactgaatccatgggaggctcctcttggcaaagctgagccaggatgttggcctgactggaaagcccatctttggtctctctggctgtgagagtttgacccagtggggataggtgatgaagcaggagcccctgggcctgactgtgactctggccaagtgtttgactttaggcctggagaaaggcactcatgtttgccaggagcctgttatgtgctcatccctttggcaggcacttgccaagtgtcaccttcttttatgctcacatcaactctggcaggtcagtgttaggtaagacttccaaccttcctagccttgggctcttcatctgtcaatggaggacataagacatcagtggtcttcagactcagctccatggattctggggtttctttggagatgccatgggagttatcaagggtgaagttaccaaggggaccaggaaagtggaacttagttttggttttcccatctttggtctgctctatagactggagttcactgcacacttttgtttaaagaatggcttccaagtttaaaaacctcacaaagtactggcctctaagatccctaaactgtctcctgtaacttattactggctcttctgctagtgccttgggttggtacttcccctctctgcacctcagttcccttgtctatagaatgagaagctctggggctaggtctccatgacactgggagtggagtgggtgttaaccgcttgggttaactgagccccatttggctggcacactggaagggccagtgatcttaaaggatgatctgcccatctgtcctgcttcacgggcaccaagaacccgtggctcagatccaggactcgtgtgcagctccacttgtcagcagcaagtcacattgcttcttcccatttcctctttcctctagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggtatgcccaggctttgcaggcctgaactagcctgcagttggtttctggtgctgtgaattaaagtctttgaatccatttattcaaaaatcatgaagctgcagagttataattctgaaagagagcaagaaaaaagttgaggcagggcccactggaactgtaacaatgagtatgggagtgaatcaggctcagttaacactcttgcttgagaggttcagggaagcactatgtcactccaaggtaaactgagcctagatccctgatggaaaatgccagatgcagtagtcaatacactgggaagctcttttctctagacaggcattatagagcataccataggcaggccaaatcacatctttcttgtagacttatagaaacagacttatagggcctgggcagagaaggaggccttatggcaagcaaggtaaggggtgccggatgagtgagtttgttccctgaatgctgactgtgaacattttccaggtaccttctgccattttcaacataggtgtagatgctgaaggtggcaagtggagccatcaataggggagggggaaataagcagtgtctggggacctgccagaattcagaatgttttcctttctgttatatcatatttcaatttttgtcatcataatgagatggagattgcagaataccagaaatctagaccaagtaaaatattttgctatcaagtgctgtggcttctatcaaaggtgagatttttcaagagtccagatggccctaaaccatgggatcagtgctgctaacgcagtgataagccaacatacagacatttctcctatagcctactgccagtctatgcatttaaatagggaagacattccagtacctttgaaaggggtctgtcacctctgtacagcttgccttcttcaggagggaaatcactatttaacacacataataaacaacatttgtgttaagggccttaaggactccacagcatccttaagagcctcacccagcccagtctgctctataacccatgatgtgacttctattaatatgtcctgcactcacttaattgggtagaaggagaagccatcagcccagtgggtttgggggaggctcgccaggctcccaggctgccattaatgatgtgaaaaaatctaatccaccaactgagagtcaaatttattagtgacattatgaatgtatctagattagcgctcacctaaatgaaattcaaaaagtatttcaagacctcagcagaatcctagaatggattattcacatgcttcctcttaatatcataggtatttcctgagcacctattatctgcaaggcacagtgggggtccagtctttgccccgaaataactcacttaagatagagtgaaaaatacactacaagaggggtgtaggagggctgtgggaggctcaaaggaaaaaggcatcatgtctctggggatgctgtcattccttccttcattcagtaaatacttaagccaggcacgggagtgagcaaaacagactcagtcctattgcaacttttattctgatttggggatatagataataacaacttgatatataatataatattatattaagtagtgaaggactatgaagacatattaagcaggataaggggatagagagtgatgaggaggggttactgctttttattgaaaaggtaatcacaaaggcttctctaaagatgtgacattttggcaaggacctgaatgaagtggaggggggtgcatcacgtgcccacctggggaagggcattgcaggcagtgggaacagcatgtgcaaagacaggaagcaagagtgtgcctaggagcatcaaggagaccggtatgcctggggtaaagaggaaagaggaggatggtagaagaccaagttgaggtggcagccagggaccagaacaagggctgtggcaaggacttggagttttattctacgaaggatgggaagccatgggaggattttgagtaagaaagtgacatgctcagattggtgctttaaaaggagcactctgactgctgagtggagaatggagtgtagggagaccagtgagggggactgcagcaataacccaggccagaaatgacgtggcttggactgaggtggtggtggtagaggcactgagaatggccaaggtagggatttgttgatgcaaggatgtagcatgtgagagaatgagagaagtaaacttcaactgcaagtttcagcctgtgagcacctgggggtagaagtttcagcttgagcacctgggggtagtaggggaaggaggtgccctgtcccaacatgcaaaacaggaggggctggaaaaatggtcaggaaaatggtgagttgtgctcttaagggtgcgcagttgtactaagcagaggtggaggggagagaattccaggcgaagggacatgcgtctgcaaagacaggcgaggagaggtctgaatgcttatgctggggtctccgggcacaggtgagcacgtctatcactctgtccttgtacctattccacagcaggaggctggatacttgagaatggctagatggcatggggaaggagtgggcatggggagggacccgggcaggggaaagaacaaacttcaccttttcatctctttgtgattcacatgtacaacacattttttttttttttttgagacggagtctcgctctgttgcccaggctggagtacaggggtgcgatctcagctcattgcaacctctgcctcctgggttcaagtgattctcctgcctcagcctccagagtagctgggattacaggagcctgccactacacccagctaattttaaaaatatttttagtagaaatggggattcaccatgttggctgagctggtttcaaactcctgacctcaagtgatctgcccgccttggcctcccaaagtgcttgggggagtgagccaccacacccagtccatattttgggtttaaaaatgtcttcacaactcttatctcattgtcttcctttcccccaaaccttgggaggaaggtagtagaatatgttaatgatgcatattatcaaatatacatatactaatataataatagcaatattgctatttctgaagggcaatatggcacaggggttaggtgtgtgggctcattaatctgactgcctaggttgtggtctgcctttcgcagttactagctgtgtaatcctagacaatccactttacctctctgtgcctcagttttctcacctgttaaatggagaaagttaaaaatagtatatatctcatatggatattataaggataacattataggcacttacatgagaaaattcacctaaaacagaacaatgcatgtagtaattgcttgataaatatgatgatgattattatttctattttagcatgggggcactaattctgaggaattaagcacttaatgaattcaaacacatttattgagtcccttcaatgtgctagacagtgtgtaagagttatagttgacaatgctcagaggataatgagggagacagggacaaactggatcattcttatttctgatgtggccaaagtgcaggcaaagacatgtcagggaaatcatgggtacaccgaggagggcagacagtgtggggaggggcgtcctgggggaggtggctgttgaaagcaggatattccaggaaaccagtctggatggtggtaagaggtgggaatgggcagagggatatgggctcgcaggggcttgcaggagctcacaggggcttggaagaatttgctgggggtggcagaagaggtgatgagcacagtggagtcaagtttgaggcagggatgaactgggacaacagagaggggcattgtccaattcagaacctgagctctcttgttcttttttttaaggagtacaggtgatccttaaagatccaagagtgaattgtaagcaagggagggtttcagttgcctaagcaagtcctgcaatcaaaggttccaggtcagcaaggccaaaggcaacagcaggtcctcatatcctttctggagaagctcagagtactcaatagcccacacccactcacttctcccttctcacagggacactctagtccatgccctgtctgcctccctccctgcctcccctcgccagagtggccctgcacccaggcgtgactcagttggcccagatgaactctgcaggctccagcaatgccatggttacactgatttcaaaacaacatctggaatgaggccctgtgatgttagcctctcctctggaaacgcctaatataaaaattaaagaagaggaagttatataaacagccaacttttttttttaaagccttattggatgggttgtgtttggcccagaaaagactgggtaaattaatgccccaggatgtgccaaagcggggcatgggcgtgaagaatccaaactaattaagcatttgaatctgtgttgtgcatgaaagtactgattagggctgtttgttctgggggagcttctagacccctggagatgaattcaaatgggagaatgtcaaaagtcaggcttcctaagttaataaacaaaagcaaatacaatttatcagacttagaactttgaaagaaggaatacagggacttactggctactccagcccctgtctgtttgcaaatgggaagagtatttttaaatgccctttaagtaggatgttaaggccaaatggaaggcagctcagttagagggaacgaaaggtcaaactctccctctcctctttcctctcttccttctcctttcttccttatttctttctctttcttcagacattggcagggacttgttatgagctgtcctctggagataaagaaatagatttgatattataccctcagggaacttgcagtctagagaagggggcaggtgtaagcatagttaattctgtcccttatctcttccccaacctgaatggcattccttgctcagttttcttaaggaaaggtctcagccagagaatgagtagtgggggaattatatcctacaaagagacttctaggttacctttcatttccctagaatattccacaataataggatttacacccttcattatggagcttccctagaaggaatgggtacagctaagatttctgtgaaatctaagcaatcttagaaatcagcaaatgagctctggtcaagctgactctcctgtccacctctccaggaggctcagtatacatgggtggcggacaaaggtaggattccctggagagttaaagggcatcagagcatgggggatgcaggtgaagacggaggtgaaaatgcagagggagacagtggaggaaggggagagaaagctggaggcaggagtgagagggatcactcctacatctcagaagtcaaacctggccccagattcacaaataaatcattttctggctgggcacagtggctcatgcctgtaatcccagaattttgggaggctgaggtaggtggatcccttgaacccaaggaggttttgagaccagcctgggcagcataacaatataacataatataacaataacataacatagcaacataacataacaataccttgtctctgaaaaaaggaaggcaagcaggcgggcaggaaaggagaggagagctgaggagaccagaggagaggaggggaggggaggggagatctacccaaggtcggtctgtctctctctctctctctctctctctctctctctctctctctctctctctctctctctccctctcttaagacagggtcttgctttgtcacccaggctgggatgcaatggcatgaacatgggctcaccacaacctcaacctcccaggctcaagtgatcccccctttcagcctcctgagtagttgggactacaggcacatgccaccatgcctggctaatttttgtattttttgtagaggtggggtttcaccatgttgcccaggctgttctcaaacttgtgcattccagcaatccactcaccttggcctcccacagtgctgggattacaagagtgagccactctgctcggcctacccaaaggtcataaagatatttcctcatgttttttctagaagcttggttgttttatctttcacaattggatctttaattcacattaaataaatttttgtatatgttgtgagttagctgctaacttttttcctacgtgaatatccaatgtagtcaacaccattttttggaaatcctgtcctcaccccactgcatagcagtgtcatctctcttataagtcaaggatcacatatgtataggtctatttctggtttctctattctgatctattagtcttttatttttcctatttttgcacagttcaatttactgaagctttctaataagctttatgatatttggtcatgtaagtcctccacatttgttcttgttttttttttttttttttttttttcttttttttttcacatttgttcttaaaactagacttggtttttccgttggaatttttattggaattgctttggctttatagatcaatctgaagaagactgacatctttacagtacttgatattccagtccctttacatgatatatttctgcaaagtttgattggagatttttgttgttgttgtttatttttcagcatatccaatcgttacctaccatttctgaataagcggagctctatttctccccttccaatttttatacttttttcccctttattttacaggctaaggcctacagtgcaatgtcgaatagaagtggtgataacaggcatccttgtctcattcctaatctcaaggggaaagtttcattattattatgtctgtacatatgatgtttgttgtagtttttttgtagctacccttcattagattaaggaagtttgcctctgttcacaattggcagaggttttattttgcccgccacccccaccgccaacataaattgttgaattttgtgaaatgattttttcctgcatttattgagatgctcgtatggagttttatactttactttttcatgtagtgaattgcactaattgacttttttgaatgttgaaacaactttgtcttcctggaataaactcaatttagctatgatgtattgtccttttaatataactctggatttgatatgctaatattttgttagtaattgttgccccttgtgtttatgagagagataacctaaaactttcctttctggtaatgttttggtctggttttcaaactatgggtattttgacctcatgaaatgagttaggaaatactttctcttttccattttctggaatactttgacttacattggtgctatacttttttaaaatggttgaagaattcacctatgagccgtctgggactagagatttctttttggaaaggttttaaattatcactgtatttatttagtagaaataggactatacaaattttcaacttcttttgatatcagttttggtaagatgcatttttcttctgagaatttgtttcatttgaatttccaaatttattagcatgaagttgttaataaaaatcttatatttttactcaaattttgagatagttgtagatttacatgaagttgtaaagaataatagaaagatcctgtgtaccttttcccagttttccccaaaagtaacattttgcataactctagtacagtagcacaaccagcatattgattttgatgcaaaccattaacgttactcacattttctcagctttacttacattgatgtgcgtgtgtgtatacttgttattttttaggcattggtaaaaaccatagtgatgttcatttttcattcctaatattgatacatatgtcttctctttctgtgtgtgtgtgtgtgtgtgtgtgtgtgtgtgtgtgtcttgattgattcctagactaattgttccatagttaaagaagagaatgtattgcgaatgattttaatcactggaaatttgttgagaatatatatacatgcatatacacacacacacatatatacacacaaaaaatgtgtatatatgtctgtgtatgtgtatgcatatatatatctgtatatacatatatatttgttgagtgccatcttctatatttgtctattaggtcaaattccacaataaccattaatttgcatgaatagtcaaatagagaagatatttgtctacccatttcccctatgaatagcttgttagctattttcccaatcttttttaactttatcaattccagctctcaattatttgctgaaagaagcatgttaaagcctctcattattattgtagattggtctgtttctccttttagttctgtcaatttttgccttatatattttgaagctatactctatgtgcatagacctttataactttttatgttttcttggttgataaatgctcttacaatttcgaaatattcttttgactagtgctgatttttttctgaaaaattgtctgatactagtatagcttcaccactatcttttggtgagtggttgcgtggtatatcttttttccttctttatcttcaatctgtgttcacatatttaaagtatatcacatgcaagcatcatataattatgttgttcttccttcaatctttgtctttagaattgtaggtgtttacactatttacatttaatatcatttcagatgtgtttggatctatgtgtactctcttattatttagtgtctaattgtctcaagtgttttatattctgttttctctctcatcttgccctcttttggactaacataatttttactattccatttcccctatgattagcttgttagctataatttttttacttttttaatcattaaaatatacaacatacagtcttaatatattagtcttatataaatttgtactttttactagttctcaaataatgctaaaaccttaggacacacaactccatttatacttgcccactttttggtattattgtcatgcattttaattctacatatatttaaaactccagactatatcattattattctatagagtcaatattcatgtacattaatttaaatgtttacattttccattatttttcattccttcctgcatttatgtgtttctcggtaagatcacttcctttctgcctgcagcaggctgcctctaatacaggtaggccctagaatgaaagtacacatgagatctacatgttaagtgtctaaaaagttataagtcaaggtaaaatatgttaaaaatacatgttctaccttcctaccttgacaaatataccttgataagaacttggatggccaagttcaactgatttcttggactcctcagagttttccactggaaggtgatggtgtaggaaaagccatttcatggctcctggctgccagctaggattctctttcttgtaccactctcagcactgttcatcaccactaggggccataaatgcatgtatgtgaacacctgtagttctctaatcactgcccccatgcccagtaaacagctaccctggtacctctccagccttgaactgtgcataccagtggtgtgattctccattgatagcacagacccagagaaaagataaggttgggggctgtgttagtccattttgcatttctataaaggaatacctgagactgggtaatttttaaagaaaagaggtttatttggcttaccattctgcaagctatacaagcatgggaccagcatctactcggcttctggtgaggtctcaggaagcttttactcatgatggaagatgaagagggaacagttgtgtcacatggcaagagagggagcaagagagagagaggagatcccagactctttttaacaaccagatctcatgtgaactcatgaccacaaaaagagcacaaagccgttcatgaggaatctgcccccagtgacccaaacacttcccactaggccccccctccaacactggggatcacctttcagcatgagatttggaggagacaaaacatctaaactgtatcaggggcacaagctctcctgatggagtctcatgcctcccatttctcaatttctctccagttgaatgtgagcaggtcacaaagtagacctggaaccccatgttttacgacacggtggagcacagaactgaatgagactgggaacggcacataataatggctctataaatgtttgtgaaaggagtggcattatacccataaaagggtataatgagaccacccttaaggcagagagtctattcacatggcccaaacttgcatttgtttatttgaatcaacacatggctttacactgaatattgctttgggcattcccattgggtgggatatggagttacaggacactcgatctggaagaaggacagcagcagatgagaccgaatgtgtgggaggtccccacttcagagctgccctcctaaaaagatgtgaaatgctttatccacatgagaatgacctccatagagtggaaaatcttgctttctttaaaaattcaaagtaattggtcagacagtgtcaccactcatatagcatgactcaggatttgatgaggtcagatcagtcgtctgaatctctggcatgtgctgtggttggagaaaaggtggtcaaggccttccttcagcagacaaaatcctttgctttgctgcctgtgagcaactcagcctgtggctttggggcctgggccttcttggcaagtgggaaacccaatcttttggctgcctgcctcttcctgccgcagaagagcgacttatggatgctgagagcagccactgagagggaagcttagggctccatgactcccacagagccagctgtatcccctgagtgtgtgggaggatgagcagggaggcaagggtggtccatgtgcaggaagcaaggaggggctgcccacaggtatgattaatcttcacttgctgactgtctccccaattcaatgtgatttctagttgctgtttttattgccagaaaacattttgtactattcctgaaagctagttttaggagttggccttttgaatttcattagctctggcagaacttcatttggttagtgaagaggtgttaggtagaaaagaagaggagaataaggccgggcgcggtggctcatgcctgtaattacaatactttgggaggctgaggcgggtggatcatctgaggtcaggagttcgagaccagcctggccaacatggcaaaaatcctgtctctacgaaatacacaaaaattagccaggcctggtggtgggtgcccgtaatcccagctactcaggaggctgaggcagggagaattgcttgaacccgggaagtggaggttgcagtgagctgagatcgcaaccattgcactccagcctgggtaacagagggagactccatctcaaaaaaagaaaggaaactgggaagaagtagtaaaccatctacctttccaactctatttctcaatacggcccttcatttgtacattacaacccatgtaggcttctccctgtccttcacatataacccactggttactgcctccaagcctttgtccttgtggctctctgcctggaatatcttcctcactctcatctttatgaacccaagttttagttatcctctaaggctcagcttcagtggagcatccgccataaatcttttcctgatcctcctcttatcctgcacccttagtttccaccatccctgcttgaaacaacaaacaattaagaaacttacatattcccattgaagaatggcaactagctgcaggtaggaggaatttactgtaacaatttgtgtttccacccccagtttagaagaatgtctgaaaaaaggtttaaggctgcatgagattctatacatcacacacatgtatcatagtttattattttaagatcttcaaagtattttattaaatattgaacatataaaaatgaatttgtaagatgtatacacactctaaaaaataaagatgccctatacaccggtgtgtcaattatcaagtttaagaaacaaaccttaccgttaactttgagattatttgaatgttcctacctgatgcctttccattctcactcctctctaaggtaaccacttaattttgggttattattctcttgcttttctttatactttattatacctgtttgtatatctgaatgttttattatttagttccacttatttttgattagcatttacatggtgtctattttttatccttttattttcaacctatttgttatgtttcaagtgagtttcttatggatggcatataattgggtcatttagaaatttttattcactctaccagtctctttattttattttttaattttatttattttatttatttatttattttgagacggagtcttgctctgtcacccaggctggagtgcagtgatgcaatctcggctcactgcaacctccgcctcccaggtgcaagcaattctctgcctcagccttccgagtagctgggattacaggcacctgccaccaagcctggctaatttttgtatttttagtagagatggggttttaccatcttggccaggctggtcttgaactcctgacctcgtgatccacccacctcagcctcccaaagtgctgggattacaggcgtgagccactgcgcccggcctagtctctgtattttaactggtgtatttaagcaatttatatttaaagtaataacttgtatgttagaacttaagtctgtcattttattatttgtttcctgtttgttccctttatttcttgttcctccatttattttcttttgccatccggtgtaatccttgaacattttaaagagttccactttgatttatttattatgcttttgagtatataactttttatagttttcatagtggttgctgtatatattaccatatatgcacataacttgttatgcagcctattggtactgacattttaccacttcgagtaaagtgtagaagtcttacttatatttagatcactttacttttctccatttcttaaatattattgttttaagtactttctctatatctattgaacacctcattaggtgttgttataacttttgccccaaccataaaatataagtaaaaaaactcataaagggaaagatgatctattatgtttatttatatttttactcattctattcttcttctttcctttccaaaggttccagacattttatcattttctttgtatttgaagaatttcctttagccattctttaagggtaggcctgctagcaatgaattcttttagtttttttttttttttacctgagaatatctttattttccatcattcctgaagggtagtttcaatagatataggatttatggttgacatgaatttctttatgcttaaaaaaatgtgtcctgacttctgaccttcatgttttcagatgtgaaatctgctgtcatttgaattggtgttcttttttttttttctttacaggtaatgtgtcatctttttgttatttaaacaaattttcttcatctttagtttttagaagtttaattatgatgtatctagttgttgatttatttgggtttattttagtttatcttttctcacatgactcgtgaattctcagttcttgacattataagtgactcaattgtatcttggacattttgattattatgtgagaagactcttcatctgacttagatcttttgttttagtaggcagccactctgtttaggattagcatgtagttctggcctactcttatgagcttttgttacaatggcatttcagtgttcagagcccttgcagtgctattctggtatgcttcattttctggcactaccagtggtcttgctcaatccctgcagttctgtctactggggtgaaaagacctttcctgggctgcctggtaccactgggtgaccatctgctgcttaggtttggggacagaaaaaacctacagggcctgggcctctttttctactaggtggagagcagaaaaaaatgaagcactcagctgatgctgcccctgaagatgaactggaccacttgccagtgccccagtgatagagtggggctgagttaacctaggattttgctgctgctaaagtagacatatcagaccacatcttggcaccctggttgtggaacagaggctgggattccccactaggtctttgctggtcttcctcctttcctggtgttttagccaggctggcgagaacaggcttgtctttgtttgtttgtttgtttgtttgtttgtttttggctttgcctattggcagttctgggttgcaggcctctccagcctctagtttggggtagatagtagatagaaagaaaatccagggaactcaccctattgttgtttcccaagtcctgaggtaactaaccagttcattctgactttcagaatctttatattgttgtctattaaataattcccagggtatttagttgtatttagcaaagaggaggaaagtcagtctctaccatcttgtcctggaattggaagtctccgttcttcttatttgtgaacatgatatcaatgctattgcactgtgattcctctttggtaaatttgtttatgttattcaatattatgttccaggaattcattcatattatttcattttgttgtagttcattgatttttctctgctcttgagttttccattgtgtgaaaaccactcaatttatccattctactattggtggacgtttgagatatttcccctttcccctcacctactttaaattagagactatacttccatgggcattcttgtacatacctccagtggcatctgtgcaagttcagtagagtataaatctaggtgtggaaatggtgagtcaaagggtatgggaattttcatatatactagataaagccaaattattttctgaagtggttataccaatctacccttccatcagcaggtgtaagtttctttgttcctttgcatcctcatcaatccttgataacatcagattttaaactttctccaatctcagggcaatgaaattgtttctaattttagttgcaactttcatttccctgattactaataacgttgtacgtatataaaccttttttcatattttatagaaacttcaatgttatatactcattcaaacctttttctatttttcttttggcttgctagtcttcttccttcttttcccagctttctctattttctcccagcttttaatttgtcatttttactcttttaatcgatgagtagaagttcctaactttaatgtgggatttatcaatcctttcctttatactttatgcttttgtatcttattaaaaattgttaccatttcctaaagtaataaacattattttataatgtctattcttttttgttgtcttctaaacatcttagagttttgccttttgtgtttatgtttttagtctacctggaattgatgtctgtggggtataggggtacattattttttttccatacagttagcccattgttccagcgccctctgttgaaaagtgtctctttccccacagatctaaagtattagttttgtcagaattcaggtttcctcttatgaacatggggttgtttctaggctctctattctattccatttggtcagtttttaagatttgtatgccaataagccattgtcttaatcactatattttaaaacaagtattgttctcttgtatgaaagtatctccttcctagtgtttatttagatatacttatttatttgaggccctttgcttcttgataaatatttaaggataagcttaaatctaaaaaaaaaagacttgaaagtttgatactgcattaaatttgtagataaatttgggggagaattgacatctattaagcctaccactttaatagacatgatatattgctgcattattcaggccttatttaatgtatttcagcaatttttataattttcttcagcaagggcttacatatctttcattagattagttcccaggcattcctcattttctggtgcattgtaattcttatctttttaataattctatttatgaactgctatttgctggcatatggaatgcaatttttaaatagttattttaattaaacattttattttgcaattatggtagattcaccaaaagtcacaagaaaacaatacagagaagtctgtgtataatccagtttcccccaatggtaacatcttgtaaaattatagtagaatattactgatgttgatgcagccagtatatagaatatttccatcatcgcaaggttccctcatgttacctttatatagccacagtcacttccctcccaaccccacctccaccttttctcctattttttctagaagtttcatagtcttacattatacttgtaagtccattttgagttaatttttgtgtgaaatgtgaaacttaaaccaagctttttttttttttctctcctgtggatatccaattatagcaccatttgttgaaaaaaactatcttccattgaattcctgctgcatctttgtcacatatcagtttggtatatgcttcaggcttatttctgtgttctctattctatgtatatctcttaccaaatatcacacagtgctgaattctgtagctatacattaagtcttaaaattgggtagactgattccgcccattttattcttctatttcagtcgttttagctaatgtaatccctttgcatttacatataaattttggaataattttgtctatatctacaaaaagtcttactgaagttttggtaggaattgcgttaaaccagcatatcagtttgggaagaattaatctttactatgctgagtttttcaatctatgaatatggtatgtctctgtatttatttagatcatctttcatttctctcattagtgtctttgtagtttgtagcatacaagtcctatacatgttttgtcagatttatgcctaagtattttgctttcttttgagtgattataaatggtatgcattttaatttgggtgtccaaatattcattgatagtagatagaaatacaattgatttttgtaagctaattttatacctatgaattactgaaactcattagttctaggcattgagtttttctgtgtagacaacaacatcatcaacaaacaaggacagttttatttcttcctttctgatctttatgctttttattttcttttgtttccttattgtagtaagtagaacttccagtagtatgttgaatgagagtgttgagattgggcattctttctttgtccccagtcttggtgaaaacgtttagttttcattattaattatggttttagccacaggttttttgcagatgttctttatgaggttgaagatattctcctctagtcctagtgtactgacagcttttaatcatgattgggtacttaatttggtcaaaaaatttttttgcattcattgatatgatcatgtgattcttcttgtttagcctattaatagagtgaataacatcaattgattcttgaatattgagccatccttgcattccaagaataattccacttggtcatcatgtataattcttttcatatattgatgaattcaatttgctaacattttgcttatatattagctatataagtatatatatatatatatatattttttttttttttttttttttttttttttgaggcaaggtcttgctctgtcacccaggctggagtgcagtggcacaatcatggctcactgcagtcttcacctctcaggctcaagaaatcctcccacctcagcctctcaaatggctgggaccataggcatgtgccaccatgcctggctaatttttattttcttagttttttttgtagagagagaattttgccatgttgcccagtctggtttcaaactcctgagctcaagcaatccacctgcctcagtctcccaaagtgctgttgttataggcatgagccaccatgtctggccatgcatctatatttatgaagactattggcttgtagttttctttttttgtaaatctttgtctggttttggtaccaagataatattagcttaataagatgaattgggatgtattttctgccattttctggaaaagactgtgtacaatttatgttaattctttaaatgtttgatagaattcttcagtaaagccatctgaccctagaggtttatcatttggaagttttgaaattacaaattcaatgttcttaatagttatagaactattcaaattatgtttttcatatttgtagagttgtggtagtttgtgctttttgaggaattggtacatttcatttagtacatttatgtgtgtagagtggtttgtagcatttcattattatccttcagaagtcttcagggtttgtagtgatagcttctcttttatttctgatattagtaatttgtgtcttctattttttattgttttaatgttgcagtcttgctagaggtttgtttcattgattgtctctataaaaaatcttgtatagcttttttagttgttgttgtgggctttacattatatagacataactcattatagtctactagtgatcattttaccaattcaagtgaagtgtagcaaacttatttccctttacctacctcgtttatgctataattgtcttaaaatatttcctttacatacacttaaaaccacatcacagtgttaacattttttgcttcaaccatcaaatacaacttagaaaactcaagagaagaaaagtctattgtatttactcatattttgtttgccatgtgtttttccttcctgacgttttaagattctttttgtttgtttgtttgttttccttctgtttcgtgaatgtgctttagctgtttttttgggatagttctggtggtgacaaattctattcattttccttcatctcagaatctcttaatttctctttcatttcagaaaaaaatattttttgctacataaaggaccttaggctgacaatttttttcttccattacttaaaaatataccacatccttctgtcctctttcagataagaaatctactgtcatctgaattgagtttcctttataattaatgtgttatttctttcagcttgtttttaagataattttatgtgtctagtttttaaagttaaattataatgggcttttatgtatgtttctttggatttattgtttggaattctctaagcttcttgaatctgtaatttcatctcttttcctaaatttgtgaagtgctcagccattatttatgaatcccattctctttctctctccttccacaaccctatgacacaaatgttagctcttttgttatagtatcacagatccctgaggcttggttcatttttttcccagtctatttttctctgtcttgttcagattgagtaatttctgttattccgtattctgattaattgattctttcctctgtcccctgagttcattcctttagtttattttgataattatattttttagtgataaggtttccacttgattcttcatatcttctatttatttgttgaaactttctttttcattgttttgagcatgtttgcaattgcttatttaaaacattttatgacagctgccttaaaatctttgtcaaatatttctatattttctatcatctcagtgttggcatctattgatggtttttcttctatcctgttcaaaatatttctggggtttggtatgattagtaattttcaattgaatcctggacttttaaaaattgttatgaggccctggatcttattcaaaccttccattttagctgcctttgacattattcttgcgagtgtggggaaggggccaccatttgttactgccaggtaaaggtagaagtccagcttccccattcggtctttgttgacacccaaggtgagggacttctcattaatgttgtatagagatgtgatttacagttctccagatgttttacactaaggctgtgggtgaaaagggctttttgccgtatggcaggatgaaagtcccatcgctctactcagccttctctgacagtaccccaacggccgggttggagtaagttgttactacctgggaaagatggaagtctagccactgctggcatgggtgggacagggccccatttttctttggtggagtggagcagttattgtctaatgttttctgtctcgctgaacagtcccttcatggtcttttggctagagagatcagacttttgttttggcttttttttttttttttttttttttgcctgtacctactggcaattccagattgccagctgcaattctggaatacatgaggcaaaagaattcctagagaagtcatcttgtcattccttgggtaccaaggttcctatctgatctgtcttcttgctacctttcagagtcttcttatgtttgtttaacatcaaatatctagagtttttagttgtacttactgggagaaatagggaaaagtctgtctactccatcttcccagagtggaactgcaatttatttttgttcattgttgttatattcagcatcttcaggctctttgcaaatcttttatctatagattttattttctacataatcatatcatctatgaataataatggttttgtttcttcaaaccacctttcttttaattttttacaagcctgtaaaaattaaagaaacagagtggttttaactctttccgcaaagaagtttgccacccttctaaaatgcgagagttttatgaattttaacatatgcagggtcgtggaaccaccaccacaatcaggatactgaagagttggttctgtcaccttcgaaagttcccttaggctgcccttttgtcctccaaccatctccccacccctaacccctggcaaccacttacttttctattctctctttctttttctgcctttttcagatagcgtataaaatgaatacatacactttgtgatcttttaagataatttttcttcttaatctgttaaagtggtaaatgatttcatttattttccagtgttcaacaaatctttgaatccctggattcagtcgactatgattttatttgtaatttttatattcatgagtgtgatggccttggaatttttctcctgtactggttccaaggttacactgacctcacactgataccatgctcatctcttttactgatatcaatgttttctttttacttgccaggtaactaagtttgccacccttctaaaatgtgaggtgtggtttctcattatctacattctggaattcgtattctaggtttggaattatttatttcttcaatgatttatagaacttactgtttaaaaccatctggtaccagtgttttctttgtggaaagagttaaaaccactctgtttctttaatttttacaggcccctaaaagtttccttgtctttcttgagttgattttgatacagtttattttcctcagaactttctcatttaatctagttgttcaaatttatgctatacagttatttgtaatatcttcttgtcatcttttaatctttactgtatttgtaattgtgtcccctttcaaccctcattttatttgtgttttctttcttttcttttccttttttttttttttttttttgatcttgagtgaccttgctggagcgtcatcagtattttaaaatcttttcacagaaccagcttataattttgtcaactcccctattatacgtgtatttttatttaataaattttgtccatatctttatcgttttctctactttctttgatgattagcccattattttcagcttttcttcctttttaatataagcacttgagataacttttcctgtaagcactgttttatctttagctgcattccacaagatttaatatgtaaaattttattatcattcagttctaaatgcctttaaatttccagtatgatttcttctttgacccatgagttatttggaggtatgtttcttgattttcaaatatgtagttattttccagttacctcgaagacaaaaatcaaaacctttttcttttcgagtaactacatattcacaagaagttgcaaagatagtacagagaaatctcatgtacccttcacccagttttccccattggttccctcttacataactatagtaaaacatcaaaaccacaaatttgacattgctatggtgtgtgtgtagttctatgctattttatcacttgtaacctctacttcagcgaagataccaaagtgctccctcgccactaagatctccctaatgccacccttcagaatcacaccccacccctcttcccaccatccttaacctctagcagcaactcatctgttttctctctccccagttaacatttttaagtgccttataattaattgtggtgttgtcagaaagcatggagtgggtcattccagttattcagaattgttgagaattatttgatgaccccgtataagattattttcatattttgtttatgtttaaagagacattgtatatagctattaaccttactgctttttgtctgcttgatctatcagtttcttaaggagtcggttaaaaatctcatgctagattttccttttagttatttcagcattatgaggctatgttataaggtgcgaacatttagaattgttatatattctttatgattgaaagcagttataatttatatcctgagtttatctctattatttttgtttgaatctaccttgtctataaagtggtactagctttaattttattagcagttgtctgagctatctacccacctatctgtctatgtctgtatctatctacttctatctagtttttattcttttgttttcaactacacacacacctacttatgtatgtgtgaatgtgtatgtgaatgactttttctttttgaactgtttgtcttcttttattttacctgtatatttcttaaatggtttatggttggatttacaatgtaaatctgtcttgacaatctttgcttcttagatgaatctctttaaaattatttttattattatatttaaaattattaaaaattatctttaaaattatatttatctttaaaattatatttaacctcttaaattataagtaaaattatttcatgtttaatacttattccattttccctgttttattctctgctttcttatctttttattgattatattttctcattccctttctcctcctctattgattctgtttctaattctatttctgtgattttttttctttctttctttttttttttttttttttgaggcagagtctcactctatcacccaggctggagcgcagtggtgcagtctccattcacggcaaactccaccccctgggttcaagccgttctcctgcctcagcctcccaagtggctgggattacaggcgcccaccaccacaccttgctaatttttgtatttttagtagagttggggttttgccatgttgcccaggctggtcttgaactcctgagctcaagtgatctgcccgcttctgcatcccaaagtgctgggattacagacagacataagccaccgcacctggacctatttctgtgattttatggtgaactcagaaaatttggcatgtatatgaaggttttcaaagtgcaaaagttattaatttttacttttaccctcttcctgaataacagaaaaaccattgaatattttcaccccaatagtatgttttcctggttcatatccttttgttaataggtaaattgctccatttttatttgtaaaaccataacatattattattacttcagtcactttttgtttagatttacctgaatatcaactctttcttttaatcatcattctttgcctcacaggccttcatcttgggtcacttctcttctttctaaagaaaaaaatatttttggaatttcttttagtgagagtatattggtggcaaactcccttgggattttttttttctgtctgtaaagacctttattttactcatttttgaagatattttagctggtatacaattctatgttgatgattacactgaactaatcattacactgctatatgacttatacaattgctgttgagaaatgagctttaagtttgatttttgcccttttgaagttaatctgtcttttctctctggctgctgttttaaaatcttctatatgttttagtgttttgcagttttgctaagaactatctagatatgcttttttaatttatcttatttgggatttgttgggtttcatgaattgatgcatttcttcaggactgaaagatttttaataattacgtgaagtataattctaccttattattcctattcccttcttgtggaacactgattagatgttaggctttgtcactctatcttacatgtttctttacctctcttttatgttttctttatgttgccatctgagtattttgttagatatatattccaattctttcatcctctctttaacactgtctaatacacttttcatccatctatttaatttttaatatgaataatttttttaaattttgtgcttctttttcaagttggctgggaagccttattttctctcttctcaaatttctcagtcacttcttttttgttttaaaaatattaaatatgtattgtattctgtgtctgctcactccataattggaagtcttcgcaggtctgattatggtgtgttgctccttgtagttctctctcttagaatcttgttttttgttttgagacaaagtcttgctgtgtcgcccaggttggagtgcagtgacgtgatctcggctcactgcaacctctgcctcctgagttcaagtgattctcatgcctcagcctcacgagtagctgggattacaggcatgagccaccactcctggctaattttatttcttttttattttaaatagagatggggcttcaccgtgttggtcaggttgtctcaagctcttggcctcaagtgatctgcccacctcagcctctcaaagtgctgcgattacaggtgggagccaccacacttgacctaggaccttgtttcaatgtgtgttttatcttatgttttattttgctttgatttttttttctgtgacagctcatatgttttgtcatcttgtggggagttttgtgactgaagtcaaagctggttcctgcagagaagattcaaatttgtttctgccaggtattggggcaccaccagcctggaatcattttaaactaaattcttatctagaggctttaaaaagatgtccatatgtattaattagggttgccaactcttgaaaaggccatctggtaatgattattcctctggggggaagattttcctccttccattcagggtcatttccagattaattgtttttatgcatttcctgagggaggggattaatttatttccaattcaaacttaaaatgaagatataatcctttggggctccctttttatccaagagaagtatcctgttaaactctctttcctaggaagggactggtatttctcttctcttcccaatatcccataaggctatgaaagacaaagttcaagttcaaccagttcatcaaattatctcagagcaacctccagcttctgggctctgcttgtttctcagaaaaactatggtacagcttttatttactttttggcctccaggtattccttacccatttgctattttgttgatacatttacatcccatgcaacctttctacttgtttttgtttttgtgtttctagagacagggtctctctctgttgactgggctgggatgcagtggtgtgatcatacctcactgcaatctcaacctcttgggctcaagtgatcctcccacttcagcctcccaagtagctggtactacaggttcgtaccaccacactggcaaaatttttaaaaactttgtagagatggatctcactttgttgcccagactggtcttgaactcctggcctcaagcaatcctccaaccttggctcttttccttttatttagcagaaggatccactgtactaccagacatagaagtctcctgtcatgacacctttagttattctcctatcattgaatgtccccctccatgttttctattacaaacaatgtgatgatgaacatctttgtatagacatctttgtgcaccttgtccagttagtttctataataaatttctagaatataaaaagaaagcgacagaactgaggaatatttggaaaatagcttggcactgcttgtagactaactagattcttagggctcttgatagtcattgcatatattactttgcttactcctttcaaaaatcccactggaactagcataatggaaactctactgagagtcatttctattaagtaaataaaaatatagacactgtttctggaaaaaaatagccaattattttaatattacctacagttttttttcaagaggaacttctcccaaattattaacagaaataatttcttagtaacataatgctgtaatgtgtttggaaaaacacgtaagatgagtcaagatgaagagcaatgaaaaactggtcctatcaggtttgaaaacaactgtaaacaactatggatattttaatccttcctagggtctgattggtggagaagtccatggttttctcaggagacagctatttgtctggggacatcactacaaaggttctgtaaatcaattctaaattgattccagaaggatgaaggagagaatggatgggtaactatacaaacagcaggaaataccaggattcactggtaggaagtggactaacaaagtgcaatggagatttggggctatctgggtagtgtcagaggagaagggatgttgaatgacataccaaggggtttggatttggacttgaattcgtgaaagacagagccattagttttaatcagaaagtttcatgggtagcatttgcatttttataaaattatgctggcaacaaggtgcagaggaatttaagggagaaaagattaaaggcagggaaattaggaatagatgagtgaatattctattttttaatggttttattaagatattaactcacataccacacaattaaaccatttaaagtgtaatgttaaatggtttttagtatatttacagagttgtacaaccacaccactgtctagttttagaacatttttgtcccccgaaaaagaaacctcctgcccattagctgttactccttatacccctcattcctgcccgatccctaattacccactaatccactttctatctatagatttgcttattctggacataatataaatagaattatacaatatgtggtctctcgtgactggcttctttcgtttcatttaatgttttcaagactcatccatgttgtagcatgtatcagttcattcattttaattggcaatcttctattatatggatatattccattttattcatccatttatcaggtaatggacacaggttgtttctatgttctggatatcatgaataatgctgctttgaacttttttgtacaagtttttgtgtggttttatgttttcatttcccttgggtatatacctaggaatggaactgctgcatcatatggtaactctatacttaactttttgaaaaactgacactgttttccaaaccccctgctccattttacatttccatcatcaatgtaagagcattccaatttctcatatcctccttacactagcaggtataaagtggttgtgattatagccatcctagtgcatgcgagtggtatctcattgtggttttgatttgcatttccttgatggctaatgatgttgaatatctttttatgtgcttctagtctcttgtatatcatttgaaaaaatgtctattcacattttttgcctatttataaaaattaggttatttgtctttttatttttgagtggtaagcatcctttgtatactctagatacacaagtcccttatcagatatatgatttgcaaatattttctccatttctgtaggttgttttttcactttcttgatggtgtcctttgaggcacaaaagttttaaattttgatgaagctcatttatcttttgtcatttgtgctttttgtatcgtattgaagaagcctctccctaacccaacccaagatttactcctatattttctttaagacttttatagtattagctctcacatatagatctatgatctattttgaggtcctttttgtgtatggtgtgatagaggagtccagcttcactcttttgcatgtgaatatctggttgtcccagcactatttgtaaaatatatttttaaaatagtttttctataccccctagggcattgtattaataatagtccaatctaaaacaaatatcctgagctatgccattggcagtgggaatgggtgtgctggggaaggttgagaaggtaagattataaggacatgggaactgcagtcatgcaggggtcggagagtaagaacttgagaagttttagatttctggttcccaaccttcccctccatatcaggagatctgtggcctcatcatcccacatgacatgtggccatcccagaaccaatctgctggggcctacttgtttatcctcatgactggaggatcaaagcctgtagccgtatgatcaattcaaccacaggaaataagcctcaatcaggaggacagttgaattctattttgtggttctcttagactggagcagctatggcatctgagttcaaagagaaaatggtaaggtttggatggaaggggaatgcagtcagccaactccagaagcatcaggcttctgtcagtaatgccagtgatgtcagccagggctggctacataaaaaataaacactcctaacagagcaatggaattgtcatgatctttggggagaagtttaggctttggaatcaccttgtttgcaggacacaatgccccagaattctccatcttcattctgggtccattccttggttgcatgagaatcttgtttgtttttgtttttttccccatttcttggagttgactgtttagccctagcagtcacatgaccaatcctaactttggaaaaaatatttaaagagttctctggacagttgaccccatttctcgctcagttgccatggggactggcagatggagagactgctacccaggtaattacggggtgtatcacccacagaacctctgcccagggccacagtctctgatgagaatagggaaaatgtgtttagaaatgattttgacagcccctgacctcgatgacaaatcctcagctctgacagcagccccaccttgagagcagaaacagaagagttctgttctgtgtgctgggagggagtcacactgtgcagacgttcgtggggctcctacagagaatcctttgatgagaaacctctccacccaggacatacttgccagagagagaccagatgctttgttcttatgtaagatgttctgacatgtgatcatttgagagaggtgccctttaaacataaccatcagttactattaaaagtaaagagctgaaagtgattttagagattgtttagttcaccccttagctttactaaagaggaaactgagcccagataattgacaagctcagagtcatgagagagttagtgctgctggtctcatgaccctttccctacgactcatttctgatgaagaaactgtttagcttgaacaataacttgaaatagtcccagagtatagatgagtactagacccttgttggtgtcgagaaaacagaaggtccaaaaatgtgtgcactgcctctgtttcaggaacctttaggagtcatatggctttatatgtgtttcataggaaattgctacttagacctcaacttgggtcgagatagaacatttctattctctcctatagtagccatctaatgagccacttcacaccacggccatgttgaagtgaagcacatcaatttcacaaaactgtcaaagaacttgattatagcctagtgagatacaccttactggagcctccagctacttcagagactggctgcatggcagtgggaagggaacaaccttctgtcatctgtgtctgagatggctttggttggaggatacagacttgtgaaggaaggagaaggactcatctgcatagccttgcgcatgcacaagaggctacacctccctgcatgtggaaactgagattgctgttcccaggtgccatggaaagaagagactgagccactgaaatgtggagaactgaggggccaagtggggacccagtcggttcagtgtcttttggataaggccttctacagccaacattgaaacccccagagaaagctttccctctaacacggcattaagtatttacagctaatctgggtgggcggggcagggagaggctccacttcctatgattctcctgccatcaattggctttacaggccaggcaatttccaactgtgccttggactcaggacttacaaagaggattaaaagaaagatgtttaaaaataagcaggctttaagtctaccaatgtgacaattgaaataaatgtaaaagtaatcatttatttttggtttgattctaaaagtagtatattctctctatggaaaatatagaaaatacagaaacatgtgaaaaaatagtattcataatcccatcacccaaacccactcttgctaattcatgagagcaagaccttgtgtttcatgtctgctgtcacatcctcagtacttggaacagtgcctggtacagagtaagtgcttaataaacatttgttgaatgaatgagtgttactgttttggtatacttatttccagcctttttgccctttttctatgtatattttacatgattgtagtcagtcatcatcattagataatatctttttttaacttactatgataacacaggtatacctatgtcacaactctttacaaactttttttttttttttttttgagacagagtctcgctctgtcacccaggctgaagtacagtggcaggatcttggttcactgcaacctctgcctcccaggtttatgtgattctcctgcctcagcctcccaagtagctgggaccacaggtgcatgccaacatgccggctagtttttttgtatttttagtagagacagggttttgccatgttggccagggtggtcttgaactccttgaactcctgaactccagtgaaccccccaatttggcctcccaaagtgcagggattacaggtgtgagccaccgcacccagactctacatttttaaaggtgcttagtattcgatgtattgtgtacacatcatttacttatttacgctcatgcagctagatatttgagataaaatacaaatttcaaagatcctttgcacatagggcttgctcctcatggataagtagaccaactggctgttttactaggcttccttatgctcaatggacccgaaaaaattaataaaatcacattttattttttactttcatagtcttactggattacataaagaagttttcacttctcagtgccagagggaggtcttgaaattagaatcaggacattaccttctcaatctactgtaactaagaaatatcttttgcatattgtgttttatgaagcattgaattcagagaacgactcattatgctaagttctggcaatacagagtctcaagaattcaactgaactcaactaccttctctatagtcactgctttctcccctttaaaagaattccctggttagcctggttatagaaggtaattttgtccaagttaatatagcaccatctgctgctgaaaaggagtccttcaggatgagttctctagttttaaacattgacttgtttaagaaataaaagggaattgacatgtggtttcttgcaggatccccttgtgtcagaactggaaacaatctttttcaaaaagactgagtggacttctggctccagttggcgacagagtacacttgattaactcctccacctgttagaaatttctatcaaaattcaaaaggaatatacaaatagggagaaatgcatgtcagaaacaggaaaccatggaaaggggccaacacattctggaactcatgagaactttctgcacgacaaagtgcaggtgagattggattgagggaagggctcattagcctgccattgaccacataagagggaaaagccaagggaatgagggattccagcagagcccctcaatacctactagctcacagtggcaggggctggagctgagggtgggttatttggcacacagcgagaggcaagcatagatcctccctctgctctggaaaatgcaccaggtgctgggttctgcaaacccttggcacatgaaattaaccaggcattgctaagcctggcttctaagaaatgcagttaagtcagttaggatagagttataatagagtgtcagtgtctccaacaaactataccctgaaacactaagtcccagaaagcatttaagccatctagtttccaagttgagtaaccaatatccaaagattctatactcagccaatcattcacatgtgacagccacagaaagacatccctagacatgcagatattcagagagctttcctgaaagaaaacacacacacagacacacacacagatgtacacacacacagagcatgtgcacacacatacaagaattatggtagagtaataaaaccaatataactcaagagttaagtgaagatcattgtggctaacaaagttacaaaatagaataaccagaaaacagcttcaggaagagaaataaagtaattaataccatcatcctcattatcagtctctatccctatacccatccctaaaatctcaggatgaggagagggaagaaagtaaaagttgtctcaaaatctcatcttagatgagggagagtcatgttttctgtttcattactgaccctggtatggaaatgagtccaagtatgttgtttaatatactgcttacatactcaatactataaaatattttctaaattattagtataaaaagagagcaaagaaaatttgattgtctagtcacgatgactcacgcctgtaatccttacactttgggaggctgaggtgggaggatcacttgagcccaggagtttgagatcagcctgggcaacatgatgaaactccgtctctacaaaaaatacataaactagctgggcatgctggcatgcatctgtagtaccagctactcaggaggctgagtgggaggatctctggagcccaggaggtcaaggctgcagtgagccgagatcacaccactgtactccagccagacaacagagcaccaccctgtcctgacctgctctctctctgtcactcgcgcacgcgctctctctctctctctctgtcactcgctctctctctctctctctatatatatatatttgtgcatatacgcacacacaacatgtgcacacacacacaaggattatggtagtgagtaataaaaccaatataactcaagaattaagtcaagatcattgtggataacaaagttataaaatagaataacaatcagaaaactttcagaaagataaaataattaataccgtcatcctcattatcagcccatatccctacacccatccctaaaattccaggatgaggagagatatataataaattaacatatatatatttgattgatacagcaaggtagaaaaaggataagagaaccataagcaagtttaacaatattgatttttaaaagccctaaattaaatatttgcatatagtaataagcaatatagtaaaatcataatacccttaataatgcatggatagttcaatattaagaaatccatttatataacattcattccgcaaatagttgcaagtgcctgttatgtgccaggtatgccagaacaatgtaacttgctcgatctttctctctaaaacataccttccaggctccctatccacattgctctctagttcttttcttcagagcacttatcattctctgtaattatctttcacctttattttgcttgtttattgtcagtcatctttcactaaaatgcattttctccaagatcaacatccttgtctgtcttggtcacagctatgtgcacaatgtctaacaaagaacttgacatctaatagctgaaggattcattcaatttgtgtcgcattagtttactattaatgtaatctattcattcaatatttgtaattaaacaaatgaatgtatgtctatgagtgaaaggatgatggtgattctaaatccctgctcttatagtacttatcatttcagtaggggagacagataatctgagtacttctatggtcagtgtcaaaatccaattttgctaagcacaagttttctattctaacttgctgaataaaaagacggcaattgttttgcaggaatcttccacagcttcctctcgagaaaagcctggaaaactagaagcacaaagtagtaacttcctgtttcctaaagcctgccaccaaagggcacgcagcaactcaaccagtaagtgtcttcccaacatgtcttcaggaacagagctcagctgttcctggatagcaggactattgggaggatagcggctctcttctggtccagttggagtaaactagcattggagtctgctcagcttcatagtgtgtgcatgctctggctagccagagttctgtgttgtctagccagctctcctcatggctccaagtgccatgctggaaagacctgggtgtggggaagaagagaccgggctttactcctgctgtgtctcctaacatgctccttggtcttgggaaggcttctgtctcttagctgcaatatgatggaagttgaggttggaagagctcatgatttttattagctgaaaatagaagatggctagtacaaagtcaagaaaatgtgaagaatgcaataatacagaaaaacctgaagaaattaaaatcacaccaaatcataatattagagatcatctatgttaacatattcagttatttcccttctatgcctacatatgctataaaaaacttcacacacgcatttatttatatataactatttcaggtcatcagaaactcttgaaaacaccattttttagtggatccatggtattttattatatgaatttatgaaatctagttaaccaactccctattattagatatttataaaatctacttaaccaaatccctgttattaggtatttaagtcattctcaggttttcactagtctaatcaagttgctgaataggtacatgagattttgtctgagtttgtgatgatctttcaaagaaaatacagaaggcagtggcctggttaagagctcacatttgggagctaaggcacttggatctgggtcccgcttccagaactagtgacctatgtgatcttgggcaagtcccctctgagtctcacatgattctgctgtatgatgcaccatccttagtgatttcctattattggaaataaaaatatttttaaaaagttacttgcttttttatcatcaatttttacttattctagcataattttctagaaatggaatttggggttaaacggtagatgtagtttaaggctttttatctgtattgccaaatttcagtagctaatattctttcaataatatatatgaatacctatttcttcaatcatagctcacatgggattatgatttttgataaatatttgctttacagcaatttacagatttacaggtttttctcctttccctttctccctcacccattctttgcttttttactgttttgttttgcagccaagaccagctatacaattggtaggactcactgtaaaatgaaaaggcacgattgctgttcaaaaaatatatgaataatttcaaaaaggtagaagaaaatctttgaaccaggttgggattcttcaatcacagggccccaggtgactgtgcaggccacgtgcccctgaagccaggccctcttgccccctgggagctgaaccccgcagagctccctggctccctggcatccccagggctccctggctctctggcttctgattgagttcagtcaatgacaggcatcaatggaggactggcagggggaagagagccaccagggtgtttcttcctctgctcccccaccttggtgctgcagtgctggtggtggctgtgcccctctatgacagtaaattgtgttagggtggcctgtcggttccagtgcccactgggctctggtaacaccatttccccaccttactccttcaagcctggggtggtaacagtgtctggtacctcaataggcctcgttatttttctaacccggcccacccctctgtgtatggctcctttacccaattctcagaatcccaactgagtgtgccttttgtttcttcccaaaccctgattgatacactgataaaaatagatggaaaaaaaaagtacctaggctggctgccacagcttctgcctgtcattctagccctttgggaggctgaggcaggaggatcgcttgaacccaggagtttgagatcagcctggacaatatagtgaaaccatgtctctacaaaaaatttttttaaaaaaagaaaacccactaggcatgatggctcgtacctgaggtcccagctggtaggaggatcccttgagcctgggaggttgaggctgcagtaagccatgattgtgccactgcactctggtctgggcaacagagtgagagcctgtcctgcccccccgaaaagaggtgaagttaaacattcatacaggtgaagttaaacattccttcatttatttattttgtttttggtgagtttgcctattctttactgaaataatcatctttttatcattaatttataaaaagcctcttggttaaattaatatttgacgtcatacttgttgaaaatactttctccagttcgttgcttttattttaattttttaacattaaggtgttttaatctttatgtaatcaagtttactgatcttttcttttttaatgtgaaagttacttccacattcagataactattaagtctgtgactatatatacttctaatttgtaaatgatttatcttttttccctcaaatttactgtattatctgtagtttatttttggtgtttgatatgatgtaagaatctaggtagattttttttttctaaatgaatagagaattattctagcatcacttatttacaatcagttccttttattttgcgttttttgtttgttttgttaatctcatgcaaacgatatgcagttaggtccctgaaagcaaatttggcaatttttttaagaagagaagcttaaggccgggcgcagtggctcacgcctgtaatcccagcactttgggaggccgaggtgggtggatcacctgaggtcaggagttcgagaccagcctgaccaacatagagaaaccctgtctctactaaaaatacaaaattagccgggagtggtggcacacgcctgtaatcccagctactcaggaggctgaggcaggagaatcacttaaacctgggaggcagaggttgtggtgagccgagattgtgccactgcactctagcctgggcaacaagagtgaaactccattttaaaaaaagaaaagaagctcagatagttgaaatcagtgttatagatcatatttatttttacttagctctttttatgctttttattttgatgattccttgccatttgtttgttcttggcctcttgctataatgattgtgaaaggtttatttaattattgtctctacttctgatttccttaagttttaattaattacccaattaagtttaatcaattaattaatatctgacataacattttccaaattgtccccctcatgaaagatgaagaagttagcttggtgttattcatcccttttccatggatttttccattttgtaattcaacataactttataaactcatgacaatatgtagctctaatatagcttttttgtatataatcatgacaatatatagctcccctttcaaaaactatttttttttgttttttttttttttgcattgggttgtaataaccagctttcagttaactcacttaatactctacacttaactggtttaaacttcccccaatggagatgataattttggtacatttcctagttggctggagtgcgtcaacaagcaatgttctgaaacagtgggccgaagtgggcacagaaatcgaccccagaccagggagagttttggagaacccactctgtcctgactctggtctgcgtccccacagatctgaatgtctagtgggaactggaacccccacacaagtggagctgggtgtggcctgagcagttgcactgggctctcctgtggctctgaggtcaggttgatctgctctgtgaaccattccaagttggcagcctgtttgttcatcctcattccctctgaacccaaagcatgcaccactggccaccttcaagtcacaggtcacccttgcactgctgtggatggagagaatgcagggagactgggattctggaggctgaggtcatgcctcagactgtttcttcactgatccggaaccctctgggcttccatttcctcactgatagaggaaggagtaactccagcagggttcccaaaggacaaatgacgagccacctgcatcatctgcacaggctgacaaacatacaggtttccccagacccgaaacgtgcagatatggatcaataggttgggtggagcactgaaatctacctttctattaaacactccggataaatataatgcacaggcagagttagcactagaggatgtctagcctctcctctcacccccctttcttgattctgtgtcctctctttgcagcgtgtggttttctgaatcttctggcttcctctccctcctggtccatctgggagcagttggtccctgtaactcagagagggccacctacttgcgctgaagcagctgctgggagcagctgttcttgcaggggcaggtttccccagccactctctgggccccgatggaccaaaacctctcccttcttcaccttgtctttgttcctttcctcatccccttttagggatctcacaccctcagagataccactcctcttttcttctcaagctaccctggccagtggcttcctctcttcagcctataaataagcttaagtctttcccatcctgaaaataaaagcaaacccaaccctgctccatcctgtgtttcctttgaactaccaccaatcttaccttttcctctaggggaatttttcacaaaagcctgtccattcactcgagcctcacttggccctcaggatactaggcaaaccctgcccctctcctggcctctagaacggaactgcccaacacattagccacatgtagtcttgagcacttgaaatgtgacttattcaaacagaatgtgcagaaagtatcaaagacccactggattcaaagactaagtgcaagaagaaaaggatgtaaaatatctcactaataattttacatattatttatatgttgaaagaacaatagatataacagaccaaataaaatatattattaaaattaatctctcctgtttcttttcactttttaaatgtggctactagaaaattttttaattacataggtggctggcattatatttcatttgggaagcactgttgtagacaatgacaggttaaatcagatcatctgtgaaggttttcccagctggatgtggtagggtagggaggtagggtagagttcccggttggatgaaaggaagtctgtggtttccacaaagtagaggaagcctgtcgctttgcatttttgcagatatccaaagaatcaagagttgtctccgtgtgtgtgtatccctgtgtgtgagtgcctgtgtaagagccagtcagataggatctcccctgcccctgttcctactgggtctcgcctgtttgtgcttgtcctcggaaacctttgtgttttcctcctttctctccttggttgggattgaaaacaccggggcctggatctgatgcagcattgtggtttctgagagctcagcacactgattgacttgcaggaaatgcctgtcaactcttgttgcattgaatggaggtaaaatggaagtgagagtcccatctgcaccctgcagtacagacagcatgcgtggagatcatgacaatgctgctcatgtcttccgcggccacctctccccaccacgcacctggcacagggtgttaagtggtttacagtcacactggcccctggctaatgaggggctgatattgttcttagttgaactttgcattttgagagcacaaatgatttcttgctgtttttcctcttctggtttaggtgttaatccctattgcacaagagaaattgattttccaatgaccaagaaatctgcagcgcccacggacaggcagccttactctctctgcagtaacaggaagtccctctctcaacaattggactgtccagcaggaaaggctgcggtaagaatggaaggagggaaactcagagaagagtttctcccggggagaagggaggggcccaacattaacagtggctgaagaggccttcccagtagtttttttgtccgcagaactacagaggagagggtctcgcttagtagctgcaagaaggtacaaccatctctgggctgagaaccgcattagaaatggtcatccattgagcgcccccttgtgccaggcacttgcaactgctgccacgtgtgtgctattaagagctaacatgtagagaacacggcacgcggggggaccctgaactatggctttgcgtggatcgctttatttcatctgcacatactcctaagaggtagaagagggagctacagcttgggcaagttaaaggatttatgcacattcacactgttgaggagaaacagctgggacttcaagtctgatctttatgactctgaagcctgtgcgaaaaggcttttcactcctataatctagtgacctgctttaccaacattgcctctaattcttaaaacaagcttagaaaggaatatgttgttagtcccattttatagtaggacactgaggcttggcaaagtgagtagctgggtttatgcatcttaaaacctataggaccagaatttaaactgccctgtgtgctcctcagtccatgaccttcccactacaggtgtcagcttgcaggcagagagctaagcagatataaagcacagtgtaccctacacacgtcccaccagcttgcctttcagccccagccaaagcacgctgtgctgcacgctgccacttttggtcacacagcgccctctgtctgtagcatctcacccctccttctctgatctctatctctagaaactgccccagccttcaaaaaccttcctaaggttctcttttgcctgggaaagctcctgatctctccaaaggcgtggacttcacattttcccaaatgcccatcaggaagcaactgcactcctctcacagtgctcacccagcctgtcttgtgagtgtcatttatgttagcatttcatctcaccaactgactctcccaaggagggtctccacggtcaagcaatgtttccctgcatagtacataatagatgctcagtgaatttcatctctctcttcccttcctttccttgagtcaatgtgtttttcattcccaaactgggagtgtggtgtcctagtgttagaagaaggtggcttccctggtgccaccctgagctgagaactttcccagtccctggttttctgcacatctggggtcatacaggagtacactggagccctccaatatctgcagccagcgctgggtccctgaggattgggctagcgggtacttcctgggggaagctgcttcctgtctttgctgcctcatgcactaggatccaggtccttgggaacaggaggcctacctggccagcagggatgggctaaagatcagccagtagtagctgcctgggaggctgtgctgaagagaattgaggggttacattccaccaggaaggagtgcttcaggagattggcagtgttttggggacaggagtgggagactcagttattccctctactcaactcctcaaagtttaggaggcaattagacactatgttagttggagacagaaccaataagagatgtatagatagacacacatacacatacgcagacacacatacacagacacacacacacacacacacacacacagagagagcgagagactgatcataatgaattggttggtttatgggattatgaaggtaggcaggttccaagatctttagcatgaattgacaagctggagacccagggaagcctatggtttagacctaattagagtctaaaggcctgagaaccaggagagccaatggtgtggttcccatccaaaggccagcaggctcaagcccaggaagggctgatttttcagttggaatataaagacaggaaaaaggctgatgtcctagttcaaaggcagtcacgcacgaaggatgctttctaactcaggggaggtctgtcttttctctattcaggacttcagcagattggatgaggctcacctgcatcagggcaggtgatgtgctttggctacagatttcaatgctcatctcattccaaagcaccctcatagacacacacagaataatggttgactaaatatatgggcacccatgtggcccagtcaagtggacacagaaaattaaccaccacggatgtccatgcgtgatttcacattgtcttcataacagccctccaaaggaggaggagagggagttatcagaggaaggttgtttctgggagagaagaagagaaagtgggatccacagtggacgggaaggccagggagtggcttacaggacctgggtatttcctgggtgactttggagagagcggcccatcaggtgtgggcaactgcaagccaacaagagagagggtgatccagagaagagcagctcgttatccagggaatgctagtaataaagaaaacatgcattccatgttcgctgccttccaggcatgaggcgatgtgttttacaaacagctatacagccaagggagtacaacccaaagagctaagtactgttaatatccacctttgacagatacagaggccaggctgagagaagttaagtggccttccgaaggtcatctaattcatagcaacaggatggatatgaacacaggcagctcagagcccatgccctgctgcttcctctgcccaggtggcatggggacagcatgggcctgggagtcagcagcccgggatcctggttctgccttgcggcatctccgatatcagagagcagggagcaagcagctacctccacattcacagctgatgtgtctgctttcgtggacatgcaggaagcacagccttcagccccagactctttccaaatattaaatgctgaaagtagcaaacagtcttagaatttataataatgacaagaaacatttctaaggcacttgctatgtgtcgggcaccattttaagcactcgcatagatttattcttcaaaatgacactattagataggccccattaggaccatgcttttacagctgaggaaactgaggcagagagggctaagtcactaagctaaggtcacccgccagctgataatgggcagagtcagaagaacccagacaatggggttcccaagtctaagctctcaccactaagccgtatttcccctctgcagggcggcttcctgtggcacatagctctggttctcattcatgaatagttaagcctgtctgcctaccccaaaattacattctgagttttgaagtctttgggctccgcccccttgcccaccacctcctgcctggcacaaggggagttctcagtaaatgtgtcttggattgaacatagtctcagggcgttcttggtagctggcttcccaaattctgcctgagacctggcttatgaggacttgtcctggaggcagcgtgttctgtgatgttaacctgggccctacttccttgataaaccttagtgagccttttggctgctcatctacatcaggctcagcaaagcaggctcctagaaccaaggaagtccctccccaccataatcctacccacaccccactaaccacattctggttgttacgctgcctgcccttaggagaaagaggacttggttcctctctttggctgggcttttccccttccttgtgaggcatgtgctgctgtcctatgtggctaatcttctgcctactctggttccttgttgcagggaacttcgagaccaacacggtccctgagcacagctcagctcgtgcagccatctgggggcctccaggcttcagtcatctccaacatcgtgctgatgaagggccaggctaaggtgagaagggattgtggccaacaggaagtcctggggggcagcaccagtctccaaggagctgctgtgtccagggaaggatgggaataggactactggggtgtcctggcgcatcagaagagacaaacacaagagtggctagtcttaaaactcacacctggctgagtccaagcagcacacatttttctaattaaacaaagtgattgttttcttgtaaaggatgccagtccctgccagctgccttagcactttcaaagcttgttctctaattcattcctggcacagtagtttccaggacttaattttacctgatacataaatccaaattgtttacatagatttctggatcctgagtttacctctgccattcagatgttggcataataaagcagggacccatatattaatttataaaaacatatgctacctactacatgtgggaaattcaatggttgatagtgcttttggctgtcaattgtagcatctggaagagtcagaactaactctacctctctcaagatgatgaaacatcatactgatctctgcttcataatggagatatagccaaaggggatacaaaagtattggtggtgatggtgagatagggggcgtacacaggtttgcactgctcccagaacatgccaccttgtgcgtgaggttgactgcaaagctctcaggccagcccaagcaacccaggtgctaaagtaatgaaagggtggtttctttatgtaatataattttttgtgtggtgtgagaggaggacctaattgctacttatggtctgtccagggggaggggccccaccatacacctcaagtcctctttccctccatctcctgtcccttctgtctgctgggagcttagcaggaaataaaaaagaagagagacatgagagatgctgggacgaatgctcctctgatcacaagggagtaactgtcttctatgctgactttctctgaaggacccattttctgattagtaaatcacgatgctttttccccttcaatttaggtagtagtatttttttggattgacttttaaattgtttgcagtgcccaaaagaaggtgaaatggtaaacgccaccaaaactcatgtgaagatgaccaaaaatggtttaagttatcttggtgtgcacaaaatatgcattcaatgagtaatctttatgaggccggggggtggaagaagatgaatcatttgatatagaaatcctcatgtacagagcagtgatgatgagttcagaaataaagcaggcttcccactatctggcgataaaacctacaccccaagatctcgtcactaacaggatgacaagtagcagtgaagcagggggaggaggagttagagccagagggatcagcaagtgcttgaggtagagtcaaaagcaaatcacacaataaaaccagccaccaaaacccgggcattgtgctatgggctttgcaaccataactcctttaatccccacaacaaccctcctattatctcccttttatagacgtgcagccgggcgcactggctcacgcctataatcccagcactttgggaggcctcctgtttgagtcctggagttggagaccagcctgggtaacatagtaagaccctgtctctacaaaaataaataaaataaaataaattaaataaaataaaataataaaataaataaataaatatataaaataattaacccggtatgctggcacatgcctgtagtcccagctgcccaggaggctgaggtgggaggattgcttgagtccgggaatttgaggccacagtgagctgtgatagagccactgcactccagtctgggcagcagagggagacgctatctctaatgaatatctctgtgtgtatgtgtgtatatagatatggagacgggggacctgggaggttgcaggactcgtccaaggtgacttggttagtgaggagccgaaccaaggcaatgaccccaggctgtctgacccctgggccttgttcttaaccatgacgccatcctgagtccccaggatgggtgagactttgagtctagagcagccgtctcagccaggacaaggctaggggcccgtggaggagccctgaaggggctcctacctcaccttttcctaagcctgtgctactcccggacaccatttgtcctgcccatcctggaacacacaccaccttcaccagaggcttagaacagctgctcatccccacggctctcccactgactccctacagtgtcaagaagatggaggacagcgtgttgtctctgtggcacggggtgatgctcctaatcagcgcagcggctctggcctgaagtaaactgcccatgagcaatggttctgttacagcagtggccatcactttaaagggtctgtctaggagccaagctactggccactgcctggcatgcttgtacgttggacccaaaagcctggcctccaggtgcatttatgcctttatcctgtaatacgtgcttcttgagcacctgcctgaggccagacacagaaataagatgcatttactgtcttcagagagcttatagtctagaaagctgcttattagactcaagctatgccctctagggcggcatggggtgccttagtcctcaacaaaattgagcaagtcacatggatttcctttgctgcttttcaggtctgccaggccattctgtgaactcactggccgatttgcaggggaagctgtgcccaccctcccttctcttcctgctgtagacctcactcaacctttcccgggacttattcctgtttggccttctctactgccttctggctgctccccagctggaactatctgctgagctatgagtttattctcccagagccacctgtacaattccaggatatgtttgttggctcatgggaatcacctaggacaatggcagatagagcaggtgcaggagggagagcacgtgattggagggatgtccttgagaaggggattgagaaggcctttggtgggagaagggctacattgtaaagctgctactattattactattgttggtatttttatgattgttgctaggcattttactttcaaacacaaccctgtgagttaggtaatatcattattattttaaaaggagggaaactgaggttcagaagcagaaagtgattggcccaggattgccaactggagggacagagccagggtgctggtctccatccagcctccctctgtgtgggaaacttcagattcccgcgaaagctccagacactacccagcccaggctggccttcatgccgctgctcttcctatttttgttgttgttgttggtgttgttgttgttgttgttgttaacctctgagacctctgagaccaaaggcaccttctctccttcccaatccctttgttcagggctgaggcaggccctcagaaggcatcaggccaatgagaagcatggaatactacccctaaatcagaccttctctttttttccccagggtctgggcttcagcatcgttgggggaaaagacagcatttatggccccattgggatttacgtcaaaaccatttttgcagggggagcagcagcagccgatggaaggctacaggaaggtaggcttcccagcccttttcagaccatggtggaggaatcagaagcagaatccagaattgctggggccatagaagatgttgggaatgcaaaatgtgtcttgagttgtcaggatacggccagcatgcatcctggggtctgcaagcaatggggacacagctcccccgagggggtcttcattatgactggcaggttggttgtgcatgtttgcacatttagcccctggcaccgttaccccttagctggtcttggggccagcctgggtgggactgaagtctgaggggtctgtttctgacccttccctcctctcacccattctctcggctgtctttccctttccatccaagatcctgtctcagttgctgggatccgttaacaccccctctccttcattctccctgtccttcctaacccacaaccatagggaaaccaggttcaatgcttccaacccttgtaacggatgagtctgataaacatttgctaggagcctactgaatcctagggtctaggaatacagatagaaacaatcaggcatgattcctgaagagctcatgatctgccacagggaccctctcttccactccccacccacctttcttccatcaacccaccccctctcaactctttcatatcctcacaagacagaagcctcatccatcctgggagtgaggggccagggaaacagagctgcctgtcttcttgtcctgtagagtcagggttccccccacccccacctccaccctaaagtcattcatggattattgagcaacaggtttggcccaaagaaattgccaggtttcaactcaggaggcaaagttcaggggctggaagtcacagggcagagagtacccactgcaggccaaggactgggccatacaccagaggtctgaagagaagtgacttcatagcattttcactcttctctgtcagctcgctttctataagctatgctgggagcctaaccacctttaatcatctaacttgcttagggcagggtaggcacactacagtctgtgggccaaatctggcccaccgcctgttttcaatgtctcatgaacaaagaaaggttattacatttctaaatggttgaaaatttaaaagtgtttttgattattttatgatatgtggaaatgaaatgaaatccaaattttagtatccataaaaaagccttctggggactcgagcacgctcatccacgtacctgtcatccagggctgctttcatctcagcagggtgcccccatctcagcctcacaaagtgctgggattagaggtgtgagccacagtgcccagctagaaaaagaaaccagagaaaaaggatggatcatatacaatggaaccatgattaggtgacagcagattcatcagtaacgaccaggtccagaagtcagtgtaaacatagtatttatatctgagttgcttggtgtaatgttgaattcagagaaagtgctccctgtttgtgtattgaacaaattgaaagaaagggagaaagtggttttctgttcacatagaaatggattttatgttacagcatagtgtggagtggttgcagctcacaaaggttaaaacttttaccatctgggtctttacagaaaaagtttatcaacccgagcactatgcagaattacacatacagattttagggtgtgggcaatggcgagcctttgaaggtttttatactatgggagggacctgctgtgaccagggttttcagaggcttcaggaagcagagtgtaggatgaagtgggccattgtgagccccaggctccagctccaaggactgcacagaggcggtaaccctgggaggagaagggagcagatgagagaagtgacagagcctgagcagaggtcgcaaagggcggggcgggtcagagagaactggaaggtttctggtcttagtaaactagagaaagacattgccttatatagagtaagaggcactggaggaggaggaggaaaaggaaggcaaaccaggatgtgtaggtttgagtggcagaagggagagcgatgtccctggatgaccacgagatggcgctgtccagcagggaaatgacatccgttctctctccgttcagggagttagaagtgaatgcagacatttggggagcatggacattagaaaaacagctgaagttaccaagcagttgacgggggaggaggggggggaggggaggggaggggaggggaggggaggggagggcccagatgccgttctaggggaatagctaaatcaagagggtggtggagaggaaatgtcaaagagaggaaaaaagaacagtgggatcagaattgggagtgtgccatcatgtgttttattatcttttgtacttttctgtgtttaaacaaaggggtgggggaagggttgaagtggcaagaaaagagaatattgtgttttgttctctttcctgaatgtaagcctgcccaagccaaactttttattttttctgagcatttgcctcccttaattaacagcaatcataaaaattgaagatttcaatgagtcaagactctcagctagtatatgatccctgattctagcctcaaacattgaccaaatcatcttttgtaacttcttttaaaagtaaatatttgaatcttgaattcagggcaaatacattagttgcaacaaaagtttggtgtacagatcaaggctactaatgttttacttttattccccttccaagaaactattgtgtaagatttatttggcaaaacctaatcagccagcttttaccagatatagccaaataaggacaggacattccaaaaagcccagagctgggctgtgtggccccagtaagatggacattctaataacttaaagagaagtctagccccttaggtaattaagaatggacattctgaatttttgttgtctatccttctttcagcacacatgtaattatattctgatgttttaaatgtatctattttccttcccagacttggagtctcacaatgacaaggactggttccttttatttttcactttggctccagcaacctaacagacggaactgatctgaatactctccccaccctgcctccagcccctgtttccaatacgtagacttgtgaaataatatagcacatccaaaatcaaaataaagacgtggaaatgcccagctgctaagaaacaaagaaacaactttaaatctaagaatggcagactcaggggttgatgatgtggcggggagggctgctggatgcttatagaccttaagggctggaactcagatttgaatgcccacatgggcagaggggacagagccttgggtccatgtgaggctctgagaacctgcacacagccttgataatgaaagagtttcccctcagtaaagccaacaggccccaggggagcaacaaggaaacttaactttacccatggctcctcagttggccaaaaacatctctcaccaaaaagtgaatatcaaaattgtgtcatatatgggcatgcaggttacatttatagttcctgtaaagcaaaggtaatgccaaggtaagaaattaatatgaaaactagtcccaaaccagtgaaaaccttggggtgccaaatggaaataaaggaaaaactggcagtgacctggggtgtatgggaatcccatagaaaaacagaatatcctgaaaatgagtttataaagattacatactatactacatcaggaaatgtccactgttgaggagagtcagcagaaataacaaagaggagcgttagcccttaacaacttaacagaacaatctaaaagagactatagaattgctatgtttaaaatcattttaaaaagataaaaaaaggaatataaactgtaagacaagaccggaaacagtaaaaaaaaaaataagtggaagtgaaaaaaataacttttggaaatgagcaaaaaaagcagtcattgaaataaaaaactcaatggatggcttaaacagaagattagatgcagctgtaaggagaattagtgaactggaaattatccagtaggccacgcagatcaaagaagaaaaagatgagcactaaagaaatatggagaataggttgaaagggtccaaaatacatttaataggaattttagaaagaatagagtgaaaagggagagatagtatgcaaaaagatagtggcttataattttcaagaactgacttaaggcatgatatttctgcttgaggaaacacaaaatgtttcctttctctctagtgcatcatagtaaaactgcagaatatcaaagacaaaggaaaaagaaatcttttctttcctttttttttttttgagacaggatctcatcctgtagcccaggctggagtgcagtggttcaatcacagctcactgcagccttgatctcccaggttcaagtgatcccccacctcagcctctgaagtagttgggactacaggtgcatgccactacatccagctaatatttgtacgttttgtagaaacagggtttcgccatgttgcccagggtgcccccatctcagcctcacaaagcgctgggattagaggtgtgagccacagtgcccagctagaaaaagaaaccttaaaagaaaccagagaaaaaggatggatcatatacaatggaaccatgattaggcgacagcagattcatcagtaacgaccaggtccagaagtcagtgtaaacatagtatttatatctgagttgcttggtgcaatgttgaattcagagaaagtgctccctgtttgtgtattgaacaaattgaaagaaagggagaaagtggttttctgttcacatagaaatggatttttggttacaggaagaatgattctcctacaagtatactgttgtgaaaaaaggacttgcagtcaaaagatccaagtcctatttatttatttatttatttatttatttatttatttatttttaccatatgacttcggacttctctgagttcacttttctctattgtaaaatggggtctacattgcattctggaaaatcgtatccaaaccacatccactgagcaatctgtagacctcattcagcattggtcctggggatatatcatctaataagacaaaatccctgtccccaacaagctgccagcctggccagggagtgactgagggtgcaggccattgatcaccacccagggtgacaagtgcagtaggtacagtgtgacatgaacatagaaaggagctaaaggtagcaggggcctaaagattaagaagggataggaggagaaagtggaagtatattttatttgagaaaatggcatggacaagcatttaactgcacagaccattgtggaaaatgcaggtcgtgttgcatcagaaaatgatgcatgggagcaaatggtgtgagggtcagggagacaaggaggaaggaggtgaagcaaagaggtgggcaaggaccatatccagccaggacttgtgtgcctggctaagaaccctgggtttcaccctggaagagagtgggtgccagagaaggcccatgttgctgccctgcctgcttcgcaaggggagagcacaaaatgagaaaatgttcttccagagcttcgtgcatcatacaaaaagccgggcagttggggagactagagttaaaggtaatgataatgccctttgattgggcaacactcttcttagctacactttctctctctaaacaggtgatgaaattctggagctcaatggtgaatcaatggctggactaacacatcaggatgctttgcagaagttcaaggtgaccatttcttatcaacacgtgaccaaactctggggccttcaggcaaagaaaccaagctctcagcatccaaacctacaaattcaaactgtggaacccttcacatgaggcacctcactgatgctgatcttggcgcagggttaaaagaagacctgactcagaaaataatagtgtgatcgggattgttgtgggggattttaaaactctttaatatttataaaattgttttaaaacactctgtgtatttatcatggtatatttacaaatctgttttaagtttttaagataattgctaaatgatattcctaagtctccatctagttagttcaattcatgactctatccatccatctatctattatcaatcaatctatctatctatctctatctattcatccatctatctatccatccatctattcatccatctatctatccttccatctatctatctattcatccatctatctggcatatgtaaatatatatagtagttgtgtgtatatatacaaatatgtcataatataatttgtaacatgtatgaatatatgcgcacatttatatttcatacacatacacacacacagaggtgtgtttccttaaacagtatttcttcatctcaccctggattgctgctgggtgttgtagccctctctctttctttcagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaaggtaggagtgctgcagctgtgtcccgtgcctgggtctcccagcactggctgagtctcccaggctttcctcacttggaatcagtccagaggtagggcaggatgttgtcttttagcacattttacagctactgcttggagccaggtcgagtcttctgtttatagaagctcaagacataccattcgaacctagtcaatgtgttctgggtcagtggtttaaataaagcaaaacaaagcaaagaaaaactcaaacacaaaaatacccagagagagagagagagaaacaatgggccaggagtggtagctctgcagtaaatatgctaagacgccctgggcaggccaccttcccttccctgggcctcagtttccctacctgtggcagagaattgaggtcctttctacctctgacattcaggaacagacagccattccctttgccacccccccaggtgggggctcggagccctctctgcctgaatgcaaccgaactgagacctggaggataaagaggaggcagcgaggcacagagctgggctccagcacaggggccagcatgtgttctaggagcagaatgaaggccagcatggctggagctaggtgggcagagtgagagctgacatcagggtacttggcagaggcagagagaccctgtggggctttgcagctcgattctcttctaactggagttggaaatcctttatagatttctaagcaggcgagtgacacatcagcttatgcttcaaaaaatgtctcctagggttcttcacggagaatggcccatagtgtgacaaaagtagaggcttggaatccacttgcagccatttgggtcagggattgggagtagtggatttggagagaagaggatgggcttgagatatattgtcgaagtggaagggaagcatacatagttaattccttgcatacagctttgcctgatgtgtgttttaactctcctgctaggttgaaagctccctgaggcctcagatgcctctgtatgcctgcaagcctggcacaatgcttggcataaggactaggggcagacaagtctgtgctggcatggtcccaacagctgtaaccagggctcccgcagtgcatttgctgagcaggcataaaatgggaaaggcatggccttggagtggtgtttcctctgatcactggcatcagaaacaccttagggaggatttttgtttgctcattttatataatgcagcttcttagactccacccccagagattttgcttcaacagtgtttgttcaacaagttgaggtgaggccaagggatccacattctaaacaagtatcttatgcaattctgacgcccattagactgaaaaacttgctctagtcaggacacctgggctgtgggaagggctctgacttttaccaaattcttcatccataaaatgggattgccaacaattgtcacggcctccctcatgggactgctgggaggaccagcatgagaaggtgaaaacatttgccaaagtgctctgtaaatcatacgtgtcgaaagaaaactgtaaagggccttcccccacactgtgctcactccatctggtcctccttgctgacagctcctcgttttccaggcgtttccatgttggtgagccccaggccctcctctcccacacactgggggatcccatccagccccacggccctaacaccacctacatgcagctacgttcaaactttcagcttccaccctgctttctcctctgggttccggcttcatctgtgcaaacatctgctctacacgtcgctgggatagtcccagacatcctgacagcacccccttgcctgtgaagccacctgaagtatccattcctcactttccagcacattgcacatgtcatttgggcaaagctgaaccccccagtcttaccctcataatcctgggcttccatagccctccctgctttggtaaatcacattaccatctgcccagttactcaagccaaacagatctccaagttattttgattttatttgttaagtttctatacttcatccatcagcaagtctatcttcaaaatatcttccatgggcatccgtttctttccatcttcactggaggtgaagtccaaggccaccactgtttctctcaacagaggcctcttagctggtcttcttgcttccattctccatgacccatagttctttcccttcacagtagccagatgtgttcataaaaataggaatgagatcatgtcacttccttgttcacagttctcctatggcatcccttctcagtagagaataaacccgttcactgacatgccattgttgacacagccccactgaatctgcgcttgatccctctctctcaccgtcatgtgctgctctcccatgcaggctgtgtccctgccacactggcctttctggtcctgcaacatggcatgcttgcttttgccctggggcctttgcgttggctgtttctgcttctgagatgctctgccccatctcttcacccctaactcttgtcacttgtattttagcccaactggtgtctcctctgaggcctgaagtagccatccctcactttccagcacattctgcgtacattcaccacataatacttatcactcttagatactgtcctctcttctcatctagctccctccttccctccttcccttcctccctccttcgctccttccttcctagtctttccccactattccttgcctgccttggtcactgttctgaccctagagcggtgcctgcacacaacgactactctgtgaatacgggtgggatgaaagctgtaataaccagggggccatgtctgtggcacccaatcgacgagtaggccccctgggaaagctcagtcccggtctccccaccccgccctgttctgcttccagaggccggcgtgggcctgggcatcggcctgtgcagcgttccctacttccaatgcatctctggcattttcgtccacacgctgtcaccaggatccgtggcgcacctggacggacgtctccggtatgtcctcacttctgtttctgaatatacccccgacttacaaccaggaaagaaataccttagaatgtcgggagattgatttggacatgagctataaagaatgatcttgtggtggagatcagccgctccgcccgccaggacaccccctgttgtgggcactggctggggaggggcaggcctccttcctgccccccaggacactcttgggagatgcatttgcaatctggctcagagggagggagtgaggctttgcaccccagcccctctccaggccactgggagggtgggtgctggctgagcccccagggctagcaggagcggggtggacagggtctttgttctcagctcccacagcagagccaggtgtgggtcctgccaggaccagaccgaggtggggcggcctaaataccacatcccgctgtggccagcacacccctgaccctgcacacatttgtaaccctgagaaattccagggctgggccgggaggcagagaagctggaggggatgtctgaggccatacccagtgggctggttcaagcctgtggctggagctggggtctgtttatctaataaagccccacaggtgcctcaaaaaaaaaaccccaaaaaccaaacaaacaaaaaaaagagaatgatctgggcatagctcagagccgtgttcctcaaagtgtggtctggaccagcagaatcaatgtcaactgggaacttgttagaaatgtggaatctcagacgcccggacccagacctgctgaacgaggacctgcattctaacaaaatccccatgaatgtgtatgcatgttacagcttaagaagcatcgtctcagagaatgccagtccaacatagaaaacacactttaattaagatttaactaatattgaatttacaatgacataaataggagctttgatgaggttaatctatgaattctatatggaaatggtggcttaatgacaaaaatattagtaagttgggcaccatggttcacacctataatcccagcgctttgggaggctgaggcgagtgaatggcctgagctcaggagttcaagaccagcctgggcaacatggcaaaacccatctctactaaacataaaaattagccaagtgtggtggcaccttcctgtaatcccagttacttgggaggctgaggcaggaggctcacttgagccagggaggcagaggttgcagtaagccaagatcgcaccattgcacttcagcctgggcaacagagcaagaccctgtctcagaaaaaaaaaaaaaaaaaaagagagagagaagatatcagtaagagaaatacaggttctttctcccataaacaatatatttctgggtactccagatatattttttataaataatttctaagagaagttcaaatctaatttctttcaataactgatctggatttgatttaaaaatttatcctatttaatttgttacaatactttgcactctaacatttgtgtatagtgcaaatatatcatctctcactggttttgggttttcctaaatcaggagagttttgccatccttttaaagggtttcctacaattgcagtgtatggaaaagccatccctgcttatgatgctgtctctctggagcttctgaattagaaagggatttgctgttatctgcgggagggtggcaggtgatttgctgagctgctctgctggtttgtggcacatactgcaggttccatgtggttgtcttggtcctagtaccctcggacagagagtacctccttcttagatctgcagtggagtagggattgttctggaagcttctgctttccttagcatctggtgctatacaaccatggccttcagttacagcagtaaaaaggaagcaagggtgaaggaggatgaactcagcagaaggaagtcacagaacacagcaggggacacagggaaatcagcctcaggaggctagagttccaatcctggacctgctgatgaccaactaggccaggggtctgcaaactggggcctatcactgttttggttttgttgttgttgttgttttaataaaattatattggaacaaagccatgctcatttgtttatgcctcgtctatggccacagctgtcatgctattaatataacagcagagttgaatagtttcgataaagacagtatggcaaagcatgcaacaccaaaaatatttactctctggccctttgcagaaaaagtttgtcaattcctgagcagacctagatcagggaaatctattcaacctctgcaactcaatttccctatctaggtcgggaaggggactggattatacaaatcttccatgtatctatgtgaccccgtgtttcctaccttttttttttttaaggtttaggttgctattaactcccttcccacctcacaactagaatgaatgccatcaccttttctccttatttctttttgcaagaatctcaactgctctcctgttgagttattttttctctgccttttagcacatgtaggatgttaggtccgatattcaacatcctgtgtgtgctatgttagatccaatccttccttctaactagtctacttatgggaacacagaggcccaaggagaggatgtggtggattaaatcctggttaattgttatttagttgaattggctaacccacaccctcagtctttaatgggcatagttaaatgtgaaaagaaggaggaaagttacagatgaacttttgttaatgttgacccactgtaaataggaaatgtctgctgctttgtggttgtacggtaagggggtatgggatatgctactttggtctgccctgttctgagttttggtctggtggctagtggggtctacttattcatgtgatttttatatctcatcaaacagcccagccaggagtgggcccctggggcagtgactgttcaaatgtctcattgattcacttactgatggcttcttattgatgcttgcacaggtgtggggacgagattgtggaaatcagtgattcccctgtgcactgcctgacgctcaatgaagtctacacgatcctgagtcactgtgatcccggtccagtccccatcattgttagccgacatccagacccacaggtaacacccactgggttatcctcttcttctcaggctcactcgttcagtaccaaaattggaacaagaaatagatgaaaacagagatgttgctggctgggtttgtacctgaattcccaagaatcccttccaagtttctgtagtaagaattgtctgcagcagaggtccactaacaaactcctagatatcagaggcaattgacattaacttagggaagctcttacagctgagttataagctctggggcaggaaagtagagacccagggtcccagctagtagaccaagaaatttattcatttatgcgtctagtaggtacccactgtgggaatgtctggaggtaggtactgaagatacagaggcaagttcatagcacacagtcctgccctgcagaagctcacagtatcaataaagagcctgacatacaaataattgcaaaacagagatggtaagtcctatgagaatacaggaatatagcagggaatggttgataaagtaaaaaaataccagaggttagttttctccaggcagagaatataaggaagatcattccaggaggtgggaacacaaaattcaatgtcacagagtcaaaaagggacctgacatggaaggagaggagtgggttctgtggggctggaatgtagggtactaggtaagagtgactgagaacagatgttggcagggcattggggttacactgcagagggctttcaacaggatactaaagagtttgcattttattctacatagtgaggagctatgggaggtctgtagctgtagaaggagcatgttcatattttaatttttaaacctttgattgcactgtagaagacaggatagagtgggtggagtgtggggtttgtaagaggaaggaagctgatggtgagagcctgaactacacagcagccatgagaagagaaaagagaaggggcaatgtattagtctgttctcccgctgttgatagacacatacctgagactgggtagtttataaagaaaaagagatttaatagacttacagttccatgtggctggggaggcctcacaatcacagcagaaggtgaaaggcatgtcttacatgatggcagacaagagagaataagagccaagtgaaaggggaaaccccttataaaatcgtcagatcttgtgagacttattcactatcatgagaacagaatgggggaaactgcccctatgactcaattatctcccaccaggtccctcccacaacatgtgggaattatgggagctaaaactcaagataagatttgggtagggacacagacaaaccatatcaggcaacatgaggcaatgcttgggaagactcaacaagagctgctgggcaagtggctctggggtaagagagggaggaaccgaagatatctcgaatatttttagattggaagactgagcaatggtcttccaccagaagagagaagaggaaaaggtagcaggcttgggagggagagaagagcatgatcttactgtgggacatagtgaggtggaggtaccacggggtgtccaggtaaagatgcccagtaggcaagttagacttagggctgatagcaactataacaggaacccaggctggagctagacttgggggttgaatccctgctgttggtgagagctctggggaacctggaataatcaccacaaagaattatttaatcttaatatgcaccaggcatgtttttcaaagatgtgacccacacaactgcatttagttgttgtgcagcctcctgaaatcagtgtgatatttcccccccaactcacagatgaggaaactgaggcttagaaaggacaaataagtttcccaatggtgaagctactaagtaaagaagctaagatttaaatccagcaaagcctgtgctttgaactcactgactcccaaactcccagtgacacttggacagagtggagtaatgagggaaatcaatatataatggtgtggtggaattcaaacccagccccattctgtggattgcacactggagctaaacacaatcagagacaagcaaacttcttaattaaggcaaacaaataattggcctaaatctctggacaatacaagaaaagaaagaggtcccaattaatttgtcatttcctcctgctgcttttaggactacggcagaaaatcagtggagtagggcgtcaggttgtgggcaaatgctgtagccctgggcttaaggaatgtgcattctcccagagacatgggacacacacagagaggccacagaggtgagggccttgagagtgagggagctggagttccagctgctcagataagggagccaggccagaaaggacaggtaaggtttagagcagcagaaagacgaagacaccctaggccgtggagatccaggggcacaggcatagggcagagagaagagagccaggcccagcagcagaatgcctggcatgtgtccagtctgctgcttgcttatggttaatttgggcaactcatctaacctccaagagcctctggttcctcaactctgacataggggagtggtctttaccttacaggactgttgtggatggtaactctcctctagtaagagtttaccatctgccaggcattgtgccgcagactttaaatgatttatttattgttgtttattgtggtaaaatacacataacataaaatttaccatcttaaccattttttaagtgtacagttcagtggcattaaggacattctcattgttgtgcaaccattgccaccatccgtctccagaactctttccatctttcagaatttaaactctaccagttaaacaagtccctatgttctcctaccagcaaatcctgggaaccaccattttactttctgtctctgtgattttgactactctacgttcatcgaagtggaatcatataaaatgggtccttttgtgtctgccttatttgacttcgcgtaatgtcctcaaggttcatttatgttgtagcacgggccagaatttccttcctttttaaggtcgaataatcttctagtatgtgtatgtgtgtgtgtgtgtgtgtgcgtgtgtgtgtatcacatgctgtttatcatctgtttttgggtacttgggttgtttccaccttttgactattgtgaataatgctacaatgaacgtggagtacagattcctctgagatactgacttcccttcttttagggtatatacccagaagtggaattgctgggtcatatggtaattctatttttaagtttttgaggagccttcaaactattttccacagtggctacaccattttacattcttatcaacagagcccaagggtcccgatttctccatatccttgccaatactttgttattttcttttctttttttgagactgagtctcactctgtcacccaggctcgagcgcagtggcacgatcttggctcactgcactgggttcaagtgattctcccacctcagcctccctagtagcagggattataggtgtgtaccactgcacaggctaatttttgtatttttagtagcgatgggctttcaccatgttggtcagcctggtctcgaactcctgacctcaagtgatctgcctgcctcagcctcccagagtgctgggattagaagcatgagctaccatgcccagcctcttttctttttgtttatagtagccatcctaatgtcctaatgtgtgtgaggtggtaactcagtgtggttgtgatttgcatttacctaatcattagtgatgttgagcattttttcatttgctttttggctgtttgtatatcttctttgaagaaatgtctattcaggttctgtgcccagtttttaatcaggttgttttgttgttgttgttgttgctgagttgtaggagttctttatataatctgcaactcaactatttatctgaaatatgatttgcgaatattttctccaattctatgagttgccttttcaatctgttgatgatgtccttttgatgcacagaagtttttgattttcacatagtccaatttatctatttttttgtttcctgtacttttgatgtcaaataatttatttttaaaaaacctgtcctcattttgaagtgggttttattattgttattattttacagaaggaagaaatggaggctcaggaggttaagtaacttgtctaggtgttcacacctagacagtagaggaaccgggactagaacacaagcctttttgactctaggactcatactcttaactattactccaaagtgataataaactgtgagtcacagctcagacagtataatagtgattgtgattattacgatattgttgataatgatgatgtcatgacagcattgccaagaacggactagctcatagagataacctatgaagtggtaactttgcctagaattttccagcaagtagtggggagaaggttggagagttgagggggcctccttgggaacccctgcattgatagactttggactttatctagaagatactgaggaaccattgattcccggggtatttctggaaatggaattcatcagctatttgcagagtgggttgaaataaaataatttagaatccagtggcccagctttggagctggtacggggctgggagcctgatgcaggagcttctactgtttgtttgaggagatgactgatattttctaggtctctgaacagcaactcaaagaagctgtggcccaggctgtggaaaacaccaagtttggaaaggagaggcatcagtggagtctggaaggtaagacaaatggtgaactttgatgtaaaatatctttgccttcttagaaagcttaggatttatccattaactcatcctctatccaaggaatagtaacagcatttaccatagaccagcatagtatgtagacaaaggctgaaaactagcagcccaccagctaaatttagcttatatttttgctttgtttggaagacacaagattttaaaagcatctgaatttaaattgctacaaatgtgccaggctctctccagctcccggtggtctccaccgttccctttatcctgtaccaagttgccattcacacaatagcccctgcaggcacttgagtttgcagcccctagtttataataatagaatattagaaaaactaacatttgggaatataattctgacatttatttaattcttataattcttataataaatcagagactatgctaattcatgcattcacacataatttttatgcaaattttataagaaaaagtgaggccctcagagactctcttactcaaagtcataccactagagcacagaggctctggaatggagatccagctggcttgactcccatgcctagccattgggcattaatcacgtctaccatggaacatccttatgaaagaacaacatgcaaccattggcactgatattgacaagaaattaaatgatctggggaaatgttcagagaaaagaacagaacacaatttatttcagctctggtttattatttctacccacccaacatgcatatatgctcgggaaagcatgacagagaaactcaccaaaattttgacagtagttatttctggctgataggaacacaggtgaagtgaatttttactttcattccttcctccttgtggctgagttttctctaaggaggatgcattatttcatgatcaggaaaaaaaaaaagaaaactttttatttaaagagaaagtgagttaggagcttggctggccttggttctctctcatggggctcctctggctttcttggtctctcagaatgagctggaatttgagcaagagactagatttcaatcctctcccaccccttcaagctgtgattttaggaaaggggcacccttgacagcttaccactagagagaagggcctctcaaggatgtgtgggtagccctagtgctggaaactagggtagggggtactgagaaccaggaagggctaatggggagggagggaggaaggtgcagtggctaagaaatagcggctttctgccctcacctcaccctcaactggaaagaaatagtgacttcttcgtgtaagattcaaagtgccttgacaggtagtttctctgtctttgttattgagcctcaaaataaccccagtgactttaaaattatcatcctcattttacagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggtaagaggatgggtccacaggttgagtgtttccaggaccagactcaaatcttgagcatgggcaaattagcaagttagtgttagcagggccagaatgaaagtttctcctgctccaccagagagaaactgttgcctaggactcagctgaggactgaccatgaaaagatgggtttgaaggttgacagataattgaagtcccagtcctgcttgctggcatctgggttcccacccataacacactggaatttaaggttcctttcttgtgtcatttttcactcaccatgaaggaaaaataccagggcccctgcagggtctcagtctttgcatgtggatctttgagtgtcctgcttgtagggagaatagtggcttaaataactaaaaaggggcctggcacggtggctcatgcctgtaatcccagcactttgggaggctgagccgggtggatcatgagctcaggagttcaagaccagcctggccaagatggtgaaaccctgtctctactaacaatacaaaaattagccgggtatggtggcaggtgcctgtaatcccagctacgcaggaggctgaggcagggaattgcttaaacccgggaggagtggctccttccaagggctattgtgaggattaaaggtaaccacttaaggcaagtacctgacagcatctcaggcatattagcattcattgccatgatctttccccatcaggccccttaaagccctcctttccaccccttgcataaaaggcagactgactgacagacagctgctgtgtctagaaccattttatgcgcaggctaaccacactgagtactttcatgtacattgtgtcaattaaatcttacaaccacctgatggtgagagtcccagttgtgcaaagagggaactgagaaactcgctcaagttcacattgctagtgggtcacagttacccactatgcaatgctgagtttcccatccttacccagaagctgtctcccccatcacggaatggccctgcaggggccctggcccttcccttaagcacaccgtgggcaggtgggagggggcctctggaaatcccctaaaacaatctacagtgagggttggcaagcttcaggaggggtagcggtggagacgggatgttgagtaggaggggtgaaagtgaaggagggaggaggaagccaggttactaaaaaggaagtgcagttttgcagagcgctggcaggatgtggctggttagcaacacatgatggagttatcagatggatctgttctcccaccccctcttttaagcccatatttcattttcccttgggcctgagacctatgagtccagaagggcaaatcaggagcagccagctgagaagccagtcattttgccttcctcctggaggcccagaaaaggagtgcagttgccacagcaggtctgtcccagtgatgcccttggcagagccacatagggtcagggaatattcccgagtaaggcgtctggagaaggaactggggtgtcctcagggaagcccaggcaaggaacttcccacaggtcatctttcatgccctgtgtgcctcagcagaatacagggctccctcctgtacctgcccccaacagcaccgtctcctggagacaaggccgttctgcagctgccctcctctgtttgctctggtctgtcccacgtggccagcagatccttctcccacaaacatttccataaaagcaatcagcacgacataattttattgggcactggagaggcgggggtcacagagaaaggatcatagcacgcaatagaaaacaggaagcaatttgcttgaggtcactctcaaaatttccttgaccattcctggggatttctcactggatgttttcttccgtggccacagtgtccactgtctcactctcccacttttccctccctgcagtcttttctctacagggtcccaagactgttgtcaagctgctatggatgacccccaagtctttcccatctactctaattcaaggggacttaactctcacaaccaatatgaactttgggatattttcttcaacaaaaaactaacatccctcttataaaaaatcagcctaaactctcccccgtgctttaaaaaacttgcttaaaaaaacacaacaggattttcgaagaatcctttcttagaaaacaaacaaaaaaaccaaacaaaaacgtactttctccccactatgctgaatctgctctctccctctttccttctttctcttctccctccctcatccaccaagcatggttccaggaaacactagtaagagaaaaatttgtgtaaaatcaaatttatttcaggggctaattctgaagtctcccatgaagaggatgcaatattggatgtgttgatgaaaagacaaaacacatttgtgctgttctaagttgtaaagctgcattgactgcagttggtatcacatgtggctgcctgtaaaagagctaacaattcatgaatgtcaacagatgtcaacttacagagctcccaaccaggtgaaattaaatttcatccccatgtaatttctcttgtggacaagagacttagagatcatcaggccaatatttggagcttctaatgccatgactcagccttactttttttaagggctagttcgagaagctcaatgattcctttgaaattggttgatctctcagtatttcataatgctctcctaaagctcagttctacagtagggaactcgagctgaggcaatgctctgtgaatacacttctaacttttgtagacctttgcttcctccaaaatgtttattgtcaatgtagatcttaaatttcaggtcatggatatttgccattgcttttttagtcccaaaggatgcatttgttccttcctctttccttcctctctggaaggaagcctgcagccatgtcaaatggcccatcattacacaaatctggaatgaaccggacgtggaggccaccgcagtatagcaaagcatttctcttgcagacaatcaaatacaggtggcatcattttgatgatgtctgctttctcaatctttttttccagatgggtattatgtttggttgggctatgtctctggaacactatttttctgcctctctgcctgcaaaattcttactctgtttatgaagcagacagaaagtacttctctaggaagccttctccacctctgggatggaactggtctctctgtttcctctgggccctgacagtaccttaagcacactgtgtgataatccaaactcttcaagtattgcatagctattcagagcctggttcatcttgtccctaggctgttttgggaggaccccaaggctgcatccaggctcagtggtggaaacaattctgcaacagattgaggatgtcaccctaggtgccacagaggggagcaatggcacaggtgctgagtatctgtcatcttttgcagaacacttactaaatatttgaagagtgcttaacaagtgacagcaattgacaagcattttcctgagtgctctaaccttagggaacactagctgccaggtttttttgctgccttgtttctacgctgccctataccctcccggggtgggtagttcaccagatgcagttgtaactgaagcaatgccagtccctccacactcaaagccttttgttcctatcataaagagtcagggtcttcaagtatgtcaacagtatgagcccatgacctggataccaggttgctggaagtcaagggatgctctgcatgtctaggaggtgctggctctgccacgtcagcaccaaggagaaaagaatcctctttacatggctgctgatgaacttctcactgaaagcagctcaatatccgtttttccgtcccaatcaaagcgtgtctcgccttctcacagcttgaggctaccgttttgacatggtctcgcttcctgtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccaggtaagctttcattgagatcttccaaaaggaagggtcttttgaaaaaaggtgcagggataagataagagcacaaattggcctgaggatcagagtgctctgcattgacatcaccactggacctggctgatcaacagtcaagggttccaggtgctgggcagcagcaccgtggaggtgctgtccagggtggggagcctcctgggtggacgggtgatgctgtgggggtggcagcaggaatgcaggccattctggataattgggaggatggagcccttggaagaggtccaaagacacacccacccagccatcctgggcagctacctctagggtgccaacattccagttgcaacagtcctgctgcattcaggatttctgagtcagagaatgcaacgccagaaaagtataaatagcatctaccagtggtcacctcctccatgaggtggatagcaagggtgtgtccacatggtacacctgacaatgctaagacatgacttgaatatttatttgcttgctagagagagcataggacttgaagtcagggaatcctggatctgtctgtcattagtatgattctgagcaacctactttgcctttctgagcccagattcactcatcagcaatgtgtggaagagcacgtagaccccaagcatatgatgcattcagcaagcacacattgaatgctggcttcgtgaggccctgtgctagatgctggggggagagagagaaagggatgagaccaggtagtcaggtcctgcctccaaggagcaactagtagtggcaggaaataaacatatagactataaaacatatgactgtttgagtaacactacagaaaagctcatgaaagacttttggagggctaagggacattttggaaagatctagcacatctcacccagagcagaggccctgtgggtggaggctcctctcccttagtcaccctaattgaggaacattctagcaaaagcaaacgcctcagtgtttaactgacaggaggttgtcactccaatctgcaaagggcttgcctgtggaacctctgcctcctgattctcacaacagcaccttacagccaagccattcaaaaatgcagaaacaggctggaggcctgggctcacttgcccaaggccagtctcttagattgtgcagaatttctctttgatatcatcaaggtgtaatgctccatgattcacttcttttgaaacctggcattgagacaagggacaggagggatcagagttccttcaactgggttgcgttccagtagcaagcatcccccaaggcacacaggccagcctccctctgcccctgggaaagagagccaggacaccctctcccttacccatgcagatatgatgctggttcaatgctggcttctgagaaagactcctatgtgctccagggcatgcctgaggtcctggctggcacagagcaggttgcacattgcaatcccctgctcatcacattcccaacacccaggctgcatcccaggtatcttcagtcagtacctaggggtgggcgtcagtatttttcagggccctccagattccagtatgtagccaaggtggagaatcctacttcacagattcctttctacctggaaccttttcatcagcttttgagggagggaaaacactcctttgccgagagcaagctgatcaatgacctgtgtataggcagagcagcaaacacacggcttcagggccaggcaggtacatacatgggaaatgctggctgggtgagagggagcgtgaagagctgtgggaagccgaagtggccccatcagaagctgtgcacaggcaccttgtttttaatgacacgggtaggtcaaagcacaaacagctgccaactcatgacctttgtcttaaaagtttaaacggcaggagaactgctttggcttttacacatttaacatggtatcttggaggctccttagtgcagtagaaaggacatgaacttcaagagtcaggagacacagggtcttgcctgagcactgccatcagatggccccttacccttcttgaaatgtaatatgccagaggtcggcccagatattctctgagcacccttccaggcctaaaacactaggatactgtgagattaactcctacttctggtccttcactcctgcctgttggcagctcagtcaggtaatagcacctggagttcacccacctgggtgtcccccacttctgctaatctcctcctcttgaatccttcttgctgttcagcttggaaactagaatttaggaagaaaagtcactgtatgatgtaatgcacagctttggccttgtttctgcactgtagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaagtgagtttctacacccggtgtttctctttacctttctcatctttttctttctcatctttatttttaaaaataatcctatatataatttaaaaaattcccagatatattgattaaagaattgttctgcctctttctttccatgtgtgtgcagatgtctgagtgtgtgtgtgtctgtctgtaggtattacacctctgcctttcacattaaggaggagttttcacaacatctggcttcaggagggctgggaggtaggaggtgggactggctccctggtgaattgctcatgagggctgacatacgcctgtggagatttggaaggttgatgcacatctgaaatgtcctgcggttactcagaaagaccagaatgaggccaggaaattatccatcaggaattcttactctccaaatggaatccacttgtactctgcacgtgggttcaactccctcgtcagggagttaggatgtctgggtcctagtctcagcttaggcactgattctgactatgagcaggttctttccatgctcaccctcagattccttgtcagttgaaattaggagatggatgagaccttctatgcagaaccaagaggatgtcagacgtgccatagggtccctgctgtagggctggggcttggtcttccctctgatcaaagtagctctgcatttattagttttatttattattcttacactgctgggaaatatctgtagagtgaaggtatgctagtatctactcatagatttgttgcatcaaataatatgcacataagtgcttggcaccacacctgggacatagtaattatacaatcactgttacctctttttaatattgttgttcatactgtgtgttgtttctccttatgaaagcctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaaggtaggtttcctttgtaagcatctgcagtaaccaatggcttattatggctgtgtggccaccttagttgggccagaggggaagtagcttgagtagcctgctcacatcagacccaggttgcgtcctgtgatggtgggacactgtagcacttgaccacagtaagaccttccatttgaagagagccttttagcttgtgaaccactttcagtagattgacttcttgcatcttcttttgtcattttataaatgagaaaggtaaggctcaatcaaggttacagaacctgggttttctgtctccaagttcaagttcagtgctgtttccacattccatgtgctgctgtcctggcatgtgtctgttgtgggatgctgtccattgtaaacaatgtgggttacaagagctctcacctggagctttcattatttccactgtgcatggagaggtggctgatcccagggctcacaagtcccccacgcttcagtcaagtcattctgaaagtctcacttcccatatgttttctgagcatgacccaaaggggtgtggggaggaagtggccaggctgagctggggccagcagtcaaatgagctcaggctcatgggtcctgcaccctctaggtgctgccccaggcctccgtaggcttttggcactagaatgatccaggctaggatgagaggataaggaggttctcgttttccatacaaggaggcctcatagctgcaatttccacatcaagagtgtaggtgagtctgatgagcccaaggtgctgctgtgctgagattctttcgctgtggctttcacttgtcacctgggaccatcatcccccaggatcttactcagtgcaaatgaaataacagaggcagagcgtgtaaaacacaaagagccatcctgcctgagctgctctggggagagtatttgctttctaacatgagaagagccttctacaaggcaagtaacctgatacttgggtaaaagttgagagagttgggctagtgttggggcttggaggtgagggtgcagtgaggtacattcatccttccatgcctttgggtcttaggggctccaagtcttaggatcatagggacagctgcaagtcaggtgctctagtgacgctgagcaagtgaattctttgacataagtttactccttagtgccaaggtacaaacaggtgccccaagaacctgtaggtgtactttatttggtctgcatggtgatgaaaaaaatattgaattctatacatgataaaacctgaattgaaacctggactttagggaagtgatctggtagcgctagttctgtatgcctacgtagagctgaccctttgagcagatgtactcgttggcgctctgcagttcctatcacacatctgcccatttggctcattttagggacctgcctgactcctataggcatctgagtttgagacccctgctctagactggaataggagtctctgactgtgtcctggctccatgggagtccccgtctaggctaggaagtaccgtagtaatgtgtgtgtgtgtgtgtgtgtgtgtgtgtcacacttgcacactgtgcattggggcaggatgttagctgggcttccttagtgctgctgctgtgacccatggagaagtagaagggaagaaggagcaaccaattcctgcagaacagcactgacccctgttttgttttttgttgttttttttttttgttttgttttacctgaagtcctacaacctgacttcatctcacactgtccaatatgctgatttctggctgacttcatggcactccccctgcccggctgtggacagggtgaatgagagaggaaaataattatgcttgctgctttacatacattttttttttcttctaagcttcccatgactcctgaaggtccattctttacagatgaggaaactgaggtttgaggaggtgatgtaacttggaggctggccaagctggggtttgagataacaaatcagtctgatgtcagtccgatgttaaattgttcatcctcttgcagtaaaatgtttttgaatgtatgtatttcctctgcagcaattagacggcatccatgtcaccatcttacacaaggaggaaggtgctggtcttgggttcagcttggcaggaggagcagatctagaaaacaaggtgattacggtgagtggccaagtgaaggggcatgtcacagccagaggcaatggttctgggggagggggacacacttgccaggaaggggccctgtgctggggaaatgaagaatgcatgacactaggccactgggcaggtcctgtccactcagcacatcccagagcctggggctgcgtggagagggtagcaggcctggccatgggcatcttttcctgtgggtcccactattctggctcatccaatctgatcagcattggctgctgccttcaggtcacctgtacctgacccagatggtttctggttctgccagttttgtggagccatgctgcggctgctcgctctctaaagccgagtgcattgctgtcatcccagggctgtgttgtctcagggtatcctttgtgtaggctgtgctgggctcatttgaatttccatgcccaactgaaaacaaatcctccagttcacagcatcagccagcattcaacataccacacccccttgcagtggcaatctggcatgttcctgcgtgtcacttcagagtcaatcatgtcagtggtgacttccttgatttcctgataagttttctatcacataaaaaacacttaaaacctgtaagtctctatttctctcactgagtgcagctgagtattacaaaaagattcctgaccgtgtagtttactttctacttgaagaggaggaaagagagcttgcctgtgggaatggcactttgggtatttttctctgtccatgagtagcaacttctgtccacgtcatctggccagtcacccttgagacactgcagacaacaggaaactaggaggaaggcgcacatgttggctgagcacatgcacaaaagcttctttctccttctgtgtttgagcatttctcttcctttccagatgattaaaagggaactaacgtagagcaccatccacggccatgctgagcactcactgacctgttgtctaaattcatcctacccacactttggattgataaattggtggcatttatgcttcttttatagaggaggaacctgaggttcctcctttaattaactttaatcttcgttggcctaaaaatcctctagcattgaggaacctgaggctcagaggagaggttctgcttcatgcttggatgttacagcctggggattctaaccatgtaacagaatttttctaacaccaaaacaatttagagaagcaaagagctttgctcctatcataaaagcaaaactacaggtaccacattttagtggtttccatgcatgctatcactcagtcctcttaattataatggacctcattaaagaggctgaggcagagacatgagatatttttgtgtgtttgtttatcccacatatcttgcagaaaggggaccaagaggtgactggaggtaaagagtcagaatttctaggggaggagctataaaaatgtctagactgcctaggagagtgtttctcaaaatgcattctgccaaatgagaccgagaatttctctatgagaaaagaattctttgttgaaacactttgggaatccccataataccctgccaatacttagaaatctgccatgcagatttgcattgtagaccctctaaatgccttttgcttagaaatctgctgccatgcaaatttgcattgtagaccctctaatgccttttgctttttaaaagtagacaatgtcagagcttttgtttcacccagtattcctcaagtttctttgattttaaaaaatttttcttggccgggtgtggtggctcatacctgtaattccaacactgtgcggggccaaggtgagaggattgcttgagcccaggagtttgagaccatcctgggcaacactgggagaccctgtctctattttttaaaaaataataggaaaagcctttttcttacacaatacccgttaatatgccatagaatcagtgccttgagaaaactactctggggacttctgacctagggcaggtgaagcaaaagattttatatggaatcccaactagaatcgtggtggtacactataggacgttgtgttgggatggattctgagggcttacctggtcattactgctggtgatctctgctctggatggagaaggagggaatgctggcctctgtgccagcagctccaatctaggacacaattatctttaatctttgttggcctaaaaatcctctagcattgactaaccggttcaatcctcctccagcaagtatgtggactggacttgtgtgatttctggtcctgacttcctttggtttgctcaggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctagtaagttctcccaactcagtggaagccacatgggccacatcctctttggccatttggggccagacctgatggggctactcagtaatttgtgaccccaagaatgtgtggctgcctagtacactgcctgagacgtgtttacatgtgcctgtgtgcaaacacgggggctgtatcaccccgggctcacttgaagcccagggcatctgtggcctgggagaggagaggatccctaacagagaccttgtgtttttctcagcagcagaggccacagtctgcacggtgacactggagaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgttgtttcccacaactccatgtcctcttcataggcatgctggtccttttagggctcaattctgctttttctactttttctcctttgctcagacatcccctcaatcccccctctgttttgatgggtcttcaaaaatacctaagtcctgggcttggttcgggttggcagggccaggactctagagtggggcagtgaggcactggcctgtggggcagaattttaaaggggtgccaaaacactcagtaactcagatcgatactattttaatgcagcgtgttttttaaaattaattttaaaaaaacatgttggacaaaatatccaagtttaaatcaagacagagtctgactttgtactgcacacttggcctcatttgccttaccctagtcctggacacgtcagctcctgcctttatttaaaatgttgatagatattttgttcatcagggattggagtacaaaccagtctgatatgggggtcacttggatttccctgtgaaaatcatgaatgactgtggctaccatgtaaaaccatccctgattctttggtgttcctcaaattggaggtctccaagccacagagcaaggggttgtagagagaggagtactggacagggaggcaggtgggccaggttctagtcccagctctgcctgtaatgtgctgagtgacccttcccttctgggcctgaggctcttcatccataaaaggaggtaaagaggtacaggtgtgtgtctgagggctcttaggactgagacccaaagggactcttagctctgtccctcacccactatgagctcctgctgctgactggtttcgttagaggaagttctgctgcggctgcagaaacccagaaggtagagtgaggcttacatggcattccccccagaatccatgttaaccccaattctgggaaagatatttctaatttttgaaggtcaatttggaaggagcattgggttcaatgtcaagaggactagattccagtgttagttctgccacatgaccttggtagcatgatcttggacaagtcacttcaccaccatgggcccatttgcttaaatgtttaggatgagactgccagctgcagggtgatgttggaaggagagatgcagattctggagccagaaagtctgggttccagcccagggcccaccactagcagctatgaagctctgggccagttacttgagttcttggtttcctcagctgttaaaaggaaacacaaataatacacccctcataggattactgtcataaatgcaaaacattagcacaacgcctgttaaaataattgcccaatacactttagctatattttcattactatcattagtattatcttctactcttatcaggatttgtgaagatcactgtgtcaaatggatgggaaattttattttaatataaacagtaaaatagcattgttttcacttgcagctttgaaatagtgggggccatatatggttgtttccttttttatgtggacacagaggacttcgtgccagaggcaagatccctgtaaatattgttgcacaaaaatctcactagctctcttcccataccacccaatgctgatgtcctcaccacatgcggagaacaaatgtgaagggagtaggatattgggtcagtgtccaaagcagggtctgggcaggactcagctccccagagtcctctatgaactatggacggtgctccaggcaggctaaggcgtggagctgcctgatatttccctcccctggggacagcaagggctatccctttccaaaggccatggagagctggagcctggtgccctaacctctgagtcaccatcttaagagatgcctcattttagaaccaccaacaagcaagctcccaagggatggtgccctgttctctaccaagctatcctggctctttggagatcaaggagaggaggcaactttccttgttccccatcatctgtggaacccattaccttctccctcatttcaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccaagcactgtgctcagggctaaacgggcattgcctttagtgatcacagcagcttctacggtgtatggttctgtgccaatgtattgataagagggcacacactgtgtacagtaaatggcttatccagctggtgagtgatgcggcagattgagttttcttctgtgattcggtggagactatcagcccaagatgctttaagtgcacaacattacagggaatgcctgagtgcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaatgaatgaatgaattctaagtcaatccaagagtctgatgatttcttgaaaagggtgttagctaaaggatcttaggcatgactgtagaatttgtagttgcaatagaacagagaaagaggaagctttctgtctccttaacactgagctgtcatgttttaaagcttgctcacatcttggcacatttaagagacagtcaccccaggactcaaaaatagggaagtaacagtaacgcaggggaaacgttttctgtttggaggagcaaaggctgagaacactgtgaaaacattttgcgcgcacaatagtaacctgggtaaatgcagcgtgaagggattttagtcacacgtggtctttcttacaaggaaggtggtgggggtgcagatgaggttgctagagaatgttagaggatccctctctggattggagatagggaaagaaagttgcacggctgctgaggccccttctaggtggcaaggctgtgctccctggttctgatgatgtgcctgggtggacatggcccctgtgagtttgtacagtcttgcagcaggatctagaggggggatttccagccagggctgctagacggaggcctactcttccatctttcctgatggcaggatggcctggccagggcctggaagacagagacctcctgcctccgcctcagtaagacgacaaggaaaggcaaatgcccaagggaaagaaaaggaaggctcttctccccagagttccccatgcagacatgagtgcgtgctcagttcagaatcacttctgagaactcatccctaatgctgcagatttgggctggaacagattcacactgtctggtttcaccgaggacatgaaactccaccttgcggggataaagagagaaaaacaaattcatcaaatggaagacacattgaaagtgtttttccttaatgcttatcctgtttttaaaccattatttccaagttgacaccttttttaaggaaaaataaatattttgcggcattaaagccatatacaaggtctatatcagaaaaatatatttggggggctgcagcacaggactgagggagcggtacatgcttaaaaggcaacagggcctggttttcagtggcgatgatgattctctatgacagtcagggaaacgtggtctctgagagtgatgggcacataaagccttggtgccagagtgcatcgcatggtgtccaggccgagtctctgtcagatggttagaggcctgggtctaccctgccaggagaggcgtgtttgggtaacaggcagatggagtttggaacacatgaatggctcatcacacgccaaccctgagtggggcaggaggcaggaagggtgggctgccgcctctggttggcattctcagagatgcgcagtccatcagcttgttccaaagagtgaacacaggcctctgcgtgctcccaggctccttggtgtcccaacagctggagctcctcgatgagtcacgggagttctttgccaagaagtaacgatagcattactcatggaattgcttcactgctttctgaaggttggcataaaaccgggtcatgctgcgggggaagaaggagtccaccacgttctgtgggaggtaaccgctgaggtcggtatggaagaatgtgaccaggttggtcttggtgggttccctgtgaaggcaacagcagagctgtgttatgatctgcagcagaggtgctggggacgagcgccaggcaggtgagcagagcccagcccagtggaaatggccatgatacagtgatcgcgtctcatcccttgctgtgccctccacccaggagtcctctctggacctgctgattttcaggatggaaacccatcctgtcggggatgcattccacagcctctcccggcctccagggaggaagaagtccctactcccagcccaaaaacccagtaccctgctgcccgattcactcagcaaatgctttcagagaactcactttgtgccaggccctgagaggaacgaagagatgctgcccttcactatttagggtctgcaacctcctgggggctcctgggaccctttcaaggggtctacaaagttaacactatttttataacaacacgaacatgtgattcgccttctctcacatgcatacagtggggttttccggaggttacatgatatgtgatattgcaacagactacacgcacaagcaggtatgagtttctgttaagcctggcatgaaagagatgggcaaaaatataaaaacaatgccactcttttcacagtattttttgttttaaaaaaatagttttttaaaataaaaatgttatctatgttaacatgcagtgcatttttatgttaaaatatttttaacatttctcaaatttaccagttacaatttcaaatacatcaaataatgatagctataacccccaagaacaaaggccctatgaagccctcaaatatatgtaagggtataataatgccttatgccaaaattttgagaactgctatttagagaactggcgaataatttgagcacctatgaagggattttggccaaggggtggcagaagctcagaggacggcaggtggcacagatgctgactggaagtccagaatcaaaggggcacacgatgtggagatggaacacaacttggtagggacaggaagcgatcttcactgtgacaaacttctcaacggccaggacaacaaaggtggtataggctttgtggtgtgcatttggcattttacttgaatgcaactgtccactcagcctcaccaggaaccccaggtagcactatgcctgcccatcagatgtttcctgacatcatgcaggctacaggtttggaactggagaccttttagaatcccactccccagggccaagcacggtggctcatgcctgtaatcccagcacctttgggaggtcgaggcaggtggatcacctgaggtcaggagttcgagaccaatctggacaacaaggggaaaccccatctctactaaacatacaaaagttagccaggcatagtggcaggtgcctataatcccagctactcaggaggctgaggcaggagaatcgcttgaacctgggaggcggaggttgcagtgagccgagattacaccattgcactccagcctgggtgacaagagcaaaaccccacctcaaaaaagaaaaaaaaaaaaaaaaaaaaaagaatctcactcttcaagtcatacagaaggacaactggggcatggaacaggatggggccagcagatccacaaggtgggagagcatgtgctcctctgggctgtggcttttctcctctgcttgtgccctgcttccccaaagagggtgaactccaggggacagagacttccttccatctcaaagtcctagcatcatccgcactccacctttccctcacccaccaacccctgcccatcccgcctctgctagagccttctctctcctccctgctcctcctcccaatgggcttcctctggcccgcatcacctctcagcagcatcctctttggaaacatgaacaggtgagtgagaaatgagactccgtgatcatgtttccctctgggtgaggaatgggctttgtggtgggcggaacgtgtgagaggccatgtgggatgggacaaactctcttcgtcacagtggccttggtgagtggtagctcttgcatgtacaccattatgtgacaacaacagaaagggcaaaagggggcacagaggaattgtaggtcacccagtctcccctcagaaaaggctgggatgaaggcatccactacggttgctagaaggatttaatgagagtaggtgtgacgcacttagcatccttcctgtgcacagtgcaagtgctccagaaatgacactgtaatgctgcctcgaccacagatacaggctcctccaccttaagaacacctttcccccgccccccgcgccacttggagctcaaccaccaccacctctggcctcaacaccacctcacccccaatgagtcctcttgccctcttgctcacagcctcttactcaagagagcaagaggagagagaaggccctagcaaaggcgggatgggcaggggttggtgggtgagggagagggtggagtgcagacgatgctaaggctttgagatggaaggaagtccctgtcccctggagttcaccctctttggggaagcagggcatcatagcagttaagaccaaagtcagaccatgtcctgctcaggcctccccagtggcttcccattttattcagaggaaagtccccaacaggctgcggcccctgctacctcatgggccgaatgtcctagcctctcctcttgctaacacaacacctccctctgtgctgttcctcaaaggccccgctcttgctccggctcctgctcccacttctgggactttgcatctgctcatccccctgccagaatgctcgctccaccaacacgcccaagactccctgcatttgtgccttgctcaaacgtcttattagggaaaccccctagataacccactcacacctttccctggcacctttatctgggtttagttttccccaaggcacttaacgtctgatacttactagcacatccacgagatagaactacttacatttgtgttttgtctgtctcctcctgccttcattggaatctaagttctaagagggcagacactctagctgttttgagacatcaatatctgggttaagagcccagattctggagccagatggccagaatgagactgtggctctcttacttgctggctgtgtgaccttgggttagttactaaacctctctgtgcacccaccattcttattttaaaaatgaggatcacaacagtgccttacggttgttataaaaacagttaatttatatgaagtgcttacaatagtggctgacacacagtaatgctgtataaatgtttgctgctgctgctgctgttattattgtctgctgaatctagggtccagaataggcctatcttcacagaataataagagaataatcattgtcacagatttcagatccacagcctcatgagaataactgcacacagcaggctctggaagaaagctttacagagaacacgtgatgtttttaatcaagtggagaggagttggaagagtcaacacttgagttaaaaccttcatatgggcagggttttgtgggaccccaaccaccctctcagcaaaatccatgcaatcgggccaggcgcggtgactcacgcctgtaatcacagcactttgggaggccaagacggggatcatttgaggtcaggagttcaagaccagcctggacaacatggtgaaaccccggctctactaaaaatacaaaaattagccaggcatggtggcaggcacctgtaatcccagctactcgggaggctgaggcaggagaatcgcttgagcctgggaggcagaggttgcagtgagccaagattgcaccactgcactccggcctgggtgacagccaaactccgtctcaaaaaaaaaaaaaaaaaatccatgtgatacctttgctacctggcatgagggcgtgatgctacccattatattgtgcattccaccaaaaagaagacagcaatgggattcagcccctcagaaggaaggactctgcctcttattctgaaaattcctctctgtcagacccggcaccactgaaaggtgagtcttagcatctgactaccaggtgggagaggacaaggaaatgagcccaggccaggggatccagggcacctatatattgggagaactgaaactgagtgcaggtgtgtatgtctgtgtgtggtagagcacagctgtgctattttcaaactcaaaattttgttacatctaagaaaagtcttcacatgatgtctgaaaagccagcttagcaaagagggtaacataaaggtgctaggtctgggcttggtataatcccacgacaccgaggcccacctcctgggacaatgtggtagaaggacagaccccttccctccgggtgtctgtatggagactgcagggaacaccgggacacacctgcaaggcacagtttcttttgctgtcaacatgcatgattcccagggtaaacaagggaccttcaggtaattcattacacagaaatttcctggcaagagcctggccatgacctgtggcaaaatgggaacagagagtccccggggtcaattctgaggctgacttacagtgtggtctcagaactgccctttaggcctgagttccgccacattccttgccgaggagagatgatcactgagtgaaatgtggggtggggactgctatcctcaaagctgctcctgcctggcggagggtattcagggaggactcggagcacagaccctgccctgccaacctcctagcctttgagtcaggacacatcactgaacctccccaaacctcagtttcctcatttgctaaatggaccatgacatttgcttaacctggaggctgcagggaaaatttcctgcatcaaaaataagagtaacgcctcccctcaattctttcccacatgccaggtactctcaggaggttctgcttatgcagatgtgtgtgaaagtattttgtatcgtcacaatctaaagagctataaggcatttttcttcttttgaatcgtagtcaaagtgccccttttcacagaaggtccacagggaagtcacagttaggtctgagccatgtacctcaatgcaggaaattatccttaccctggaagaggttcacagaagcaaccacaaggatggttaaatcctctcacaaaacctggcttcgggggacataacggatgctccacatgggtggctggaagacagtgcagaatctcggtgagttacaacttcagacggtcaggtcactgccattggggtgccatagagcacacagaccagactacctgcagccctggagtctgtgagggactcctgcctcttggcgtgagttccccctactcccaccctactgccccttacactcacacatacaaatacactctcacatgcgtgtacacaaactcacacacagacacacacacacttgcactcacacacactcactcatccacattcacacataaacatgcacatagctttcccaagcttgtcaagaatatcagagaaaagaacattctagaacacaaggtttggtcatgggaggaggcaggtgcctctctcaaatctcagccaggagaggcatggatgcatccaactctcccgcgtagaagaattggaggaatggcaggggctgtgcagaggcaggagccctgctcctcactgggcattaagggagtggacagcatccaaaccctcaagaagacacggccatagattttgcacacaagttttttgccacccaactaacccacatgtgtacagcacacaccatgagcttccgcaggaaaaaaaaaaaaggggcactggcaaaaccgtgacttgaacatagaattactggcatatggactgtcttgcgtcagacccccatggccctgagtccccccaaacccaaccagatgaggtaggggactcagagtgtgagtttctggtgatttctggttgcttggctttccttaaggaactgtggggtgcagaagagaaagctcgatatcgcaggaaggcatggcagctcctccgggcatcactcaccgttggaactgatggtcccatcctcatatctcttgactagcaccaagtccacaaaatctctgggagaaatgagcttcatggcagcggagggagtggaggttctgcttacacacagggtctgccaaaccaaagaagcatgtagctgtgactgctggccagacatcttctcccaactcccaccccatccctcaaggtctgggaaaggtactagggctgacagtagggtggcactataaacagttaagatccagagcgagtcttcccaggaactgggtgtcatggaaatacacccagtttgtaagacgagggctgtgacacaggctgcccacagctgtctagctgcagaccagtgccatgctgaggtcacgtctcatgtgaccataagaggtaccatttattgagcacctagtaagagcctggctggacaaagctctcagctgtcccttacctttagaaataggaatcattaatccctcctacaggtgaggaaactgacacttagagagactaaggaactcagcacgaagctcatggtggagataggatttgaacagggccagagctagggagagggaagagaggccactcttttttagggctgaccctgcacttgctcagcctcctatgttgtgcctggggcaactctttggtttaccctagtcccagccccaggagggaataccttgaacctcactcaatctcagcatatcccagtagtccacactctcattttataaaccaaggatgctgggctttctcccattcatcccatcctgcaagagagtggggcccaggctctctcgaggtcacagtggagaagtacaggccaggcctgtgatggaacagtcctggagagaagtctcggggtaggtgagaggggctggtaaaggtctccatctctgtgtctttcccctcaggtattaagacttggggcatcgtgtgttgctgcagaacttttcatcagggacactttcggcctcaggaaattaatcttcgaatggcatgagatgcatgggggcacttgagcactttgcaatgggtgcaatgagaataaatttccaggaaactactccgtgtttccttcatcccctaatgacctgcctgggaacaggctgcacctgcacacagggtctcctttcccacttgaagaaaagcacagcatatgcccattcatctagaatcatcctatcatgaattgtcccagtgtgtaaaatcctccagggtggcaaagggacaattaggagtgcgggcggcaatatgtaatcaaggcagtacacactggtattagaatttcatgtttttccctttcttaagcatattccaaaacttggtgttaaaaactaggcaattttgccatttctaaattctggtattttgtaacagtaatggcagaagtgatgaaaattttgaaaaaaaaatcatactgcttccacccctgatgactgcctccaagtgcatcattcctgaggtacagtgtctggaaactaagatgaggaggactttggaaagaaattttgaagacagcagcagcacatgtcataaatgcgacaaactcatggcatggccctgtatcctatccatccatccacctatcatcgatcatctatctattttagaattaggatatttgagagttgccaaaagcatgctgagaaatgtcagtctgcaaggaagagccctttctccacattttcattgtttcactaaatgataaagagctaccacttggcaattctccacttttttgtaaacctgagctcaccagtagcctgtgcttcccctctactttgcagttgtctattgaaaagtttgtatcttttcatgggcttatgagttaattagaaaaaagagagctcccattcatctcatctaaagacgcaaaatgttttacttgtcacgtttaatatttatcagaatttataatataatcatgttattttaatgaattacactcgtacctcaatccaattttttaaaaaacaattagtcttggccaggcgcagtggcttacacctgtaatcccagcactttggggggtcgaggtggggggatcatgaggtcaagagatcgagaccatcccagccaatatggtgaaactccgtctctaccaaaaatacaaaaattagctgggcatggtggcgtgcccctgtagtcccagctacttaggaggctgaggcaggagaatcacttgaacccaggaggcagaggctgcagtgagccaagatcacgccactgtactccagcctagcgacagagtgagattccgtctcaaaaaaaaaaaaaattagtctcatgattacatgaaatatatgattaaaaaaacttctatttctatgcatatttatgatgcaagatgatgacttccaagaataaacatgtattgtattaggataaaattcagagggctatgtggaatggaaatttgagttccaggaaaacagctatataccatttctgatgatttaaaaaaccttgttcatgtattttaagtaaaaatttatatattatttagacacatctaaaagaatgatgtcattgctttgttcaaaactgagatttacatgtcaaaaatgacatgctttgcaacttatgaaaatttagttgtaaactaaatgttattaatagacatcaactggatgtgtgaggatgatgcataatttctcaaaaatctgttggatgcatgtaagcaaaaagcgtgaagaccctcataccagagggtaactggggtcatgcaggtacgtggagctgctactggcccaggcttcagggaagtgggtgccaggggctgaggatcctgtgttgcctagtgcagcagccccacacaaggaacaggtatgctccccgcagagactctgtttggggcttctctccctctctgagtcatgaggtttcccaccgggaaactgggctgaggcaggcctccaatgctgcaagcagtgggcagcctgtgcttgcaggacacacccccttaacaaaaggtatcacggaccccttccagaagaaatgggagggggttactatagcctggcccagacactatctagagataacatgcttggaaagacttacgtcagtgatgctttggataatttcaaaaccggtcacattctcatcccacttcactcgtaggcctccaacagctggcttcacacagtcccacacctcctctagtgtcccatatacaatgccttctcctcggtacctggagcacgaaaaggaatttgaccccaacgcatcaatcaaacttgttatcttgagattgtatctaaggactagaaggtggaccatgccatgtctgtcactactctttaggacagacttgcagagaaggggctgaaagtcactagccccgcctcccttcaggcctgcagaaatggacagtaagctttcacaagaatacagtttgctggaaatgatttcatt

SEQ ID NO: 290 - DNA, 157411 bp, Homo sapiens
ctcttgaataaccagatctcactagaactcactatcacaaagacagcaccaagctatgagggatctgactccatgattcaaacacctcccatcagacccgacctccagcattgaggaatacaaattcaacatgaaatttgggtggggaaaaatattcaaagtatatcatcctggaagaccactaaggaatcagcaagtctagtcattccctctatcaaatttcagttttaagagtcatgatagggattgggcacctctattattaaatacaaaactaaccatacaaaaacctataaaaggaaatttgaaaaacagaggtgacttggatgtttagcaacggctgatgactactgttctaggacaatactgcagttcagaccattttaaaggttaggaagcagaagctcagaaagcagaaatgattgtgtcgagaacagacagggattctgcagccaaacctagactggaactgaggccatctagcagcagttaggtgaattagcagttagacagacccctttgttctctatatctccacccctatttaccatctccagggttctatatctgggctatctgaatggctattttaacttttacaggttacaattataaatatattacaaactagtatgttaattatagatcatcttaaaaattcgatgcagaagtctcactgctgcttttcttttgctgcttggaattcagtcagccaaatttgcctcaggcccaataatctcaaggtttacctcaagtgctcttacttaataaagacaacctctcagttgagggagcacacatgttccccaaagagaagctatcattcaccaacaagctcattttctaggcaagttatgactcaatagctcatgagtttccaggaatagtgcgtgcatgaataaaagctacaaggggaagtatttaatgccaacaggaataaagatattgactattatattaagtcaaaagtatgcagcctgtagcagtatgattttcttgatctgaatgctagttacatggttgtacttcctttgttaaaaggcatcaagctctacatatatgattagtgcagttttatgtattcatgttacacctcaataaaatgttgatttaatataataaaaaataataataacatagcactgccttactttgtcatttagaacaaggcagagagtggcaagtaattacaagaaattatacctgacaaccacgtcaaataatttaatgttgtcacactttaaaatccagttttctgaattcctagctctgcaatgttgggcaagccatattaccttctggagcctcagatttttctatatctcctaaatagaaaaaataaatactcagttcatgaagatcctatggtgtgataacataatattggttaaacaaaaagcacagacttaaaaagcacctgtctctcagcagaaatcagtaactcatttatttgttctcatttgtttgttcaagcattctttctgtcaaacaccattctggaacacaaaggcaaatagataagctacagttttgctttttgagtagcataagtaatatcttccctcaccccaccccttttcttccgatgcctgattcaagtatagttttctaaccatttcttccaacatctgccacatgttctctggttagagtaggaaaattgaccctgcttcactcttccctcctctcagtggtgtgtgaaacaccttccaatgggcttacatggagtaccataccatctttcataaagcactcaccacattattctgcagttattttatttttataacaaatagtacctgagtggatgaatggatgcatactcttcccctgccccattacgtctcacaccttcctccttggtcaccataaaccttaattcgatctctccttctaatttcttctagtgataccctctctctttctttccttgatacgctctaaatagaagtactccttctggccgggcgtggtggctcacagctgtaatcccagcactttgggaggccgagttggacaaatcacctgaggtcaggagttagagaccagcctggccaacatggtgaaccccgtctctcctaaaaatacaaaattagccaggcatgatggcaggcacctgtaatcccacctactagggaggctgaagaaggaggattgcttgaacccaggaggtggaggttgcagtgagccgagatcacggcattccactccagcctgggcgacagagcaagactccctcaaaaaaaagaatactccttcctcaataccccgatgttactatattttaactttcttactgaccttagtgtagcataggaaaagtatggcctttagactctgttagacctgggatttgctcctggctttaacattaactagtggtgtggccttagataaatcagcttctctgactccattttctcattgctaaaagtagagaaacaatttctactttttaaggatattgtgaggtttagaagtaattgatgtttaaagggcttgtcacatgctcaatgccaattgctcaatgaagaggaaatattatttcaaccttgtattgacaaccatgtagacattttatcttcttctcttctctcctcttctggcctataatgaaggaaccgtggctactgtatctcagcaatgctcacactgtccatgtagagcaaatgttcaacacgtttgaaaagatgtatgaataaaagataaaataaatttctcaatgttggtggcagagaaagaatatcatacaaagtctctgcatctcatatgagtacttgaaaattattctccaaaggtgaataatataagtgcctctctgctagtggatcattcagtcttcctgttgctgcacaaaaaaaatagaactgaatggcacagttcactcatcctgctgtgagaacaagcacatattagcacaattttaactggcaccaattggctgttattcaccagattgtgaccaatttagattaggtctgcccttaaatactgtagtggtttagcttatggaataatacaggtgatagtatctctatgaagaacattctttccatttagatcagatgttggaggctagaagctgataaatgtcttaactacttacaaggccaagttagaaccataaaggcaagtttccctttttgcatgcaaagttcttgcctttgaatttcctgatgtagtaaagtgtcaataatgcataataaccatcctccaagactttattaaaatcctgacctttgcttcaaagcttctgtttggaagaagaaaaacgaggaaagaaaagtaggtcctttctaacagcctccaggagctttaggccataggccaggaagacaggctgtcttttggaaaacatgcctttgcctgtcaccttcactgatattgccctgtggtggcactggaggagcatcaccaggaagtcagacattaaaggagaagcaactcagacaataggattctgattctgctactacaagtatctactgacctctgagaactgcagaactctcagaacatattaactttttttttttttgagacggagtctggctctgtcgcccaggctggagtgcagtggcgcgatctaggctcactgcaagctccgcctcccgggttcacgccattctcctgcctcagcctcccgagtagctgggactacagtcgcccgccaccacgcccggctaattttttgtatttttagtagagacggggtttcacggtgttagccaggaagaacatattaactttatccaaagccctgcactaaatgatttgaccaaactctagcatagcttctagcagcatgaggtcatgtccctaggacgaccccagctccatattaaaacgcctgcttgagaaagctcaactctcccaggaggttgctgtttgctctagccaatacctgattataggctcttgacctcctcttcttagagaatcaacttagaaatgcttacttttgtgaatgcttatattttacaactcagtagtgtctctctcagggacctgtgcaccattcctttaaatgtaataaccaggaaagatggggcctctgtctcccaatctctgtgggagaatagaattctaacttcaataagtgtcaggcagcagtcacagttagcacagctagtcatttgcactgatcaaacccttagtaatatttcacttctcaggctctactgagatcctgctctgctacctccctcattctccatttaaaaggccaaacaacctctacacaaataggaatgaagctcagctgtttcctctgctatcaatagttactaaataaaatctgttttcatggctttaactaacgtcaggcagtgtttctctttgacacctccacgtgggagtagtgccctgtgatgggagtcagcttcaaccctatgcagataaatagagattggaagggttccagaagttcccctttcccctcttgtctttcaggactgcatgtaacccaggtagtgagtctgaaggatagaaatgagtgaagctggctaggcgcggtggctcacgcctgtaatcccagcactttgagaggccgaggtgggtggatcacctgatgtcaggaattcgagaccagcctggccaacatggtgaaacctcatctctactaaaaatagaaaaattagctgggagtggtggtgggcacctgtagtcccaggtactctggaggctgagggaggagaatcacttgaacctgggaagcgcaggttgcagtgagccaagatcacaccactgcactctagcctgggcgacagagcgagactcagtctaaaaaaaaacaaaaaaggaaaagaaaagaaatgagtgaagcctcccactgcacagtcaaatttccaatttcctcttccaaacgacttgaatttcaatagttgggtatatgtgtttgaacaaattagcatatctcttcaacaaggtagagttgagctcttagtaatcaacaccttatcattactgtttaatctgcttatttccctacacctagccgaatcaaactgaaggaagagaggcttttgtcagaaacagatgcaataaaaaggaagagggatacctgacttggaaacccagggcaccacagaggaagtgggggcaggcataactaagtgctgcgaggggaaatgtgaacacccagagaacaggtacaagggtcagctggggatggaggagaaaagagctgaggggtataaaaggtggaaacgtaaaagggtttggaaggtgatataattactttttccttttttcactttttttttcttttctcttggctcctgcccttcaccttccttccaaaagctcaaaataaaatgtctctataatgtgctttctttactctgtacccagccaaatatatacacatatatatacgtgtatatatatatacgtatatatatgtatatatattaaacatatatacgtatatatatagacacacacacacacacacacatatatatatatataatttgttgttttagtttttgtcttccaatgattctgatctcccaaaaaaatgtaaatcaaaggaagagggcgatatataagtcacttaatatctttgtatcaaagtttaaccatgagagttttggactgaattgtaactcaacaaatgtttattcaatgagtactacgtgcaaaatattgtctgtttgccagggaaacattatattaccctcccggagttagcattctagtgaaaacagcattcaataagtaaattaattaaaatgttacgtaatgtattatttgacttggttgtcaggaaaagctttgctgggaaggttatagtggagcagggacattaatgaagatgtgagtaagaggagagaacaagcaacaggggaacagcggtccagcaagggggaacagcaggtgcaaacaccctagtatgggaacatgttagtgtgtttggtcgacagcaaggagcatgctatgggagattgaaagaagcaactcagtgctggatcatgtagggccacacaaggacttttaggccataaatgactatggaaatttatctgatcatgataagaaatcactatttgaaagcagagaatgacatatttcttgtaaaagaataatgaatatttatattgcatttctacatgccaatccccatgccaagtgttttacttatataatctcatttaatttaaaaacagcactataatgtatattattgtcattgttattcatatttttcagagaataaaactgtgaaaaaaagaaattaagtaacttgaccacattatgtaaacttgatcccaggtagtcgggcttcagattccttgacctcaatcactagcctgtatttattctattttcatttataagggtctctgaagtaagggcaatagactctttgggtaagagtttaagcagggacaccagtgaggggagagatggcaatgacttgaaccatggtggttgtgatggagaagaggaatagcgtggttggatttgagatgtgttttgaatgtagaggaagcagaaggtttgtggatataatgtgtacaggcaatgagagagagtgataactccaactttttgacctgagcaactgggtaaaagacagtgttgcttacaaagctctggtttggtgtggggcagaaataaagtttgaatttgaacatgtaaagtttgagatgtatttaaaacatccaagaaggagatatgaaggaggtaatatggtatacaaagtctggtttgggctttagatttagatttgcaagttattatcatattgatattttagaaggccatgtgtctgtctgagttcccctaggtagagaatataaccacttcaaggattgagctctaggacactggaaccttcagagatcatgaagaggtagaggattcaataagaatctgataaggaacagcagatgaaatacatgaaaaacaaagagtcaagtacgagagagtgtgaaagagcaacagattatctgtgtctaatgctgctgatacatgtacaatgaagacagagaattgatcaccacatttggcaaagtgaagatcattacagatgctgactgtggagtggtagagataaatgtctgaatggattgggttcaagagactagcaaactcctgatgcgtcttacagctacagcaagataattaaagataacctaaaaaaaaggtggagggtaaaagctgggagaagaagagaataataatacctttccaaatacatcaatcaattgcaaaatattttattgtgcatcttctatacatccagcagtattagtcactgacatcaatgaatttgtagcttcatttattcatttaggcaactattattcatcaaatgtttagtatgtgatggatatttaatgggtatagctttaaaatatttttctcaattgttagcataacattttttcatttttaattattacgggtacataataggtgtatatatgtatgggtgacatgtgatgttttgatacatgcatacaatgtgtaataatcacatcagggtaatgacaacagggtgtcatcaccttgaccatttgtcacttctttgaggaacattccaatttcactcttacttattttaaaatgcataattaattattgttgactgtagtcactctgttgtgctatcaagtgctgggtcttatacattccagctaattatatttttgcaaccgttaaccatcctcccttccccacaactcccttgcctctgctactcttcccagcctctggtaaccatcattctactctcatatctcagttcctttgtttaatttttagctcccacgtgtgagtgagaatttgcaaaatttgtctttctgtgcttggtttatttcacttaaatgtaaaaggaaaaagagatgtttctatttctgtaatcctaacatatcaacattttttcacattcctttcaattggtgttcatctctccacaacttttactcaaccttattttgtaagcctttttctttgtagacatatttccataatatgatagttatgatgcaaatattttattctgtgcgtagacagcgttggttaactaatcattttcatttccaaccatttatattgtgttcaaactacaatatactatgaatatttgtctatatgattattcatcttaatgttatcttccttaagctatgagtagcccttcaatgtccgggaatatacatctggttcaattctgaattactagcatctgtttggcttctaggtagtacatgagactgagtagcggctgagagcatgaacgtcgagtgtctctagtctcattttgtattctccacttgtaggcctgtagccttggtcaagttatttaaattccctttatctcctttatgaactggagataataatagcaccctccaggttgtattgagggttacctgaattaatatacacaaagtccttatgattgcacctttttattttgtaagcactgtgtaaatgcttcagtgtactatatatatataaaagtctgtgcccagaatatatttaaggaatgaataataaatcagaaaatgttttattgttgcttcatacaggtaacattttaaattcttttggattattttctctttggttcagtgacaatgttgtgagcaggtgctgggtcccaggtatcctgagataaataaaaattttgagcaattaattttcataagtgatgtcaagaagtaaagtatcatgaacatttctatggctccaattacactgatatttcaccttaggaactgaagctccgccagggcaggggcagcctctgagtttcgtactgctgtgcacctttagcagcacgggcacctgctggtttcatttccttcccactcacctgggcccttttcttatttcacatcttttttctccttttccttaaatgctttctctgaatcttgattcttgaaaataaattagtaggattcagttaggtaggaggaggagaaaagaagatgtgatgagcaagaagatgtgcgaagactcgtcagtctggtaggtggctttggttagggggtttcagaaatggggacaggtcatgaagggccttgccagtcaggaaaaatcatgaggcactagcagtaggaacacagcagaaggtgcctgaacaagagagatgacttaatgaaagcctttataacgcttcccgggatatattacagactaccatctacagtggcagagggcagctgaaggaaggctcttgcaaaaacttggggaaatggaaatgaatgaaggcaaatatttgttttgagattatttccttctatgtaacctattagttcttttattcgttccccatacatgtattgagtgcctactttgtgccaggcactgtgctaggcaatgggtatattaccagtggacaatacagatttagtcttgctgtcatgtcctgttgcttgctcatatgaatgtcagttcaagacagcaagagctcaggactgcggagatcgcatctacatcctgccgcgctctgtgccggcacagggtggttgcgaaaatcgtgcagtctgaattgattcaaggccttgcagcatgattgctaaatacgtcgagacaggaagaaagggcagggtggcaccgatctcaactgcgagagcacgatcttgcaatgagcgcatgtgtgcgcctcggtgtgtagtgaggggcgtagcttcccacagcgcctggcagcgtgccgagctgcgctgcaggactaaccctctcctttccccgcgcgctcaagcccgcacaggcggtggcagggagccgaaggggccgagcgcagccttgcatccgtccgcaggcgggcccggcgccgcgcctcctggcggcgggcgggaccgtccaggacgccgccccgcggccgcagctcctggaagcccagagcgccggtggatcgcgagccaaggcggcgggtggagcctgagccgtgaggccgtggccaatcgcgccgctccgggggaggagccccaaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggtgagtctcgcgccgccgtgagggctcagaagtcaccaagccgcagaatctcagggtagacggattcttagagatcctatcgttaaaccctcctactttacagaagaggaaactgaggcacagaacgaggcagcggctgggataggtcatactgctagttaggactggagcccggattcgaacccaaacgttcagagacccatctttgctttgcagggatttaagtaacgcggttgtgggacgtctgctcgttgccgcccccatcctcagccctttgaggggtctacccttgttttcctcctcaccgccccctccccgctaccaccccccgcccccatctcctccttggtttctccagaccgctgctggaagcgccgaggacagaaggaagcggtgtgtcccagcacgcccactcggtatcacgtcgctctcagcgcagagctgtgacagcctgggaaaatgctgcttgcagcctcactccctcttcccctgacctgctttctcagaaagatgccccttcagagggtgtcggaccagcttctggaggagcgcggggagagaggagcgaggcccgggcgccagtgacctcctatggtactgtttcttcccagccccggaggaagcggagctagtggccctgtggggcacagggtgcccctcacttgggaagagctgacttcatggaaccatagagccccttccctcttctaaatactgagagggagcaaggaagctgagttaaagagaaaatcacaaacataaaagcaaacttcggctgtttcctttaagagctagcccacagcctgtcttccctccaccttctggttgtgaaattgtgaaccagggcgccacgcgaagcattctgctgctctgctgtacagatccctggtttagctactggatgagaaagaggacttgagttttgactccagctcttccatgtattagcagtgtgaacttgggcaagttatctcacctttccgatactgggtttttcttttctttctttcttccttttttttttttccagccaaaaaatggagatttataatggtcacaatgagccctttgggtagttggaaggatgaaatgggatcattcaagtagcatgtttagcacagtgcctggcctggcatctggttggttcaaaaccaatggcaactattgtaaatattgttacatagtaaccttgcagacagtgggttttcagaaaggtgatttcataccatcttacagaggcattttaaaaaaatctgtaaatgtggtgtctttcttcttttgaatttgagcaactcttttataataagaattttctgaatgttgtccatatgtgatgtggatcatggatgcttagctcgaaatgtaaaattgatgtttctcggtgatatgaatttcctactagtttttaggtcaaacctcaggcctgtgaactgccctgatctgagacatcctttattgacaaagagggtcttgaaatgggtgagaggcagaaagacaagaagacaaagttggaagttgcagctgtgttacagattattctaagccttctatccttgctctcttaggtcagtcgagcaaccttacatttttcatctagtatcagaaaacaaacaaaattctcatatatttcttttggattgtacagagatgctgctaaatgcaaacctttctggacacaaacttgccttatttaaacacgaacacacagacattcacatgcccacactagtcttcctgtattattggtattttaaagttaaatggattccctcccacacccttaacccttctcatgacaattgattttattctgatgaacttcatgcaataatttactactatctactggctttgccatgcgtccttaaattgagtgtccagcatttgtagttggctgcctccttcacaggccatagcatttgtatgcagtattggtaagtgcttgagaacagagtgtgatacatcttgatggaagataagagcccagtggtgcccacttaagtacctcccgcaccaagcattagtaaaggatgggatcacctgcttctatcagcttgttccatgtacatgcattgtggtgagctggctgggatatgactgaatgtgtgcctgagagacaggggccttgtgggggaaaaggaaaatgttcaaaataaggtcagatcatgaggatggaagggagattaaaagctaattcctttggttctgattcttcaaagaaaggttggtcaattatacccatatcttcatacagattattacttgttaccaaaaccatatatatgtatagaactttaaaatttccaaagtgcattctgtatatatgatactccttgttactcacaatagccctgggaggacatggcaagaatattaatagaggaaggagcccaggttttgtggtcagacctacttgatttcaaattccagctctcatgcctgagtagttgggtgatattgagcagtttatttaatcatttgaagtttctgttttatccagttctaaaatggaaaaaaaaaatgcttactttaaaaatctgtataacgaataaattcaatagaataatgtcaagtacatgtagtgaataggtgctcattaaatgatatctcttcttagctagtctcaatttatttagaacataactggaatgagactcagagaaatgaaaagttgctagaggtcatgtgttagtatgtttcaactctgggaatacagttcacaccttttcatgtctagtttagggcatttcccatcacactctgtttcctcgccaatgagatatttaacaatttacttcagttataaagttgaccttatttgtctggttatttcaggatatcctttttgttgaaaagcaggtattttcttgcaaagagaacaatccttaagcacagttctgtagagtttagtggagccaactgtcataagagggtatttaaagcaatggtctctaagacaaccttcctactctcctgtgttggatgtaatacacctttgattcctaagagaaagggtactaactaagaagacataaagtacagaattatatcactcttttcttcctgttgtgagtggtttcttccctctgccatcctcatgctagttcaaaggctgggaagaagattgaacaacaaatgttatgagtgtccatggcattattcaacttttttttttgacaattttgtgggtactgagtagagtagacagaataatgtgcaaaggtggcatttgcagaaagagaccactgcttcctggtggtgctgattacttgtctggagtttcactcctccttgtggaaagtgatggctggaggctcatgttggaagatgaagggatctgtttctggcccaggcagtggggctgttcatctgctgagacttctcataggccattagatttctcttctttgtagcaagcacacaggcttgcaaacgcagatgtagaaggaacattttgctccttgcttttggcattttggagcatatgtttgctcctataggtaagcagttagcatcatcttacctggcacggttaggaaagcagaatgtggcttgaggaaatcagaggacgtagaaaaaaacaaagattatctccagcctatacacagcttcatttgttgctcaacttcatcaggcttttgctggtgacacagatgtaggatctggtgagtcactgttgccttgcccatgaaatattaaagagagccacctactgtgctctttgcccattttggaaattgttctgcatggaaaaaaaagaagaagaaaagaaaaaagaaacaccaaagaataggaaggttacagaacatttggtaagtgatatttcggtggataaattcaggttagccattcatttgctgccttttttttttttttaaatgataatgcatggtttacactgatagggttgttaggagacatccctttggtctgactttattctaactctctgtagcagctgtggtagtgtggattttgagagtctggctgaaatctgaggcaagttattctatagagatgatcttttggctctgcagctaggaaatagggacactgatgcctgcttagaagcttaagtccctatttatttcaacatcttattcatagaaaacatttaataaacactgattctgtcctctgctaacaactccttcaatgtattagtctgttaaattacgatcatcataatttaacaggtactctttacttgtctccatcattatttgtgctgagtatcttaaatatatcatctcattcaatcctcacaataatcctgtatatttttttaggaaaccgaggctcatagagttacgtagcatggcctatgtattagtctgtgttcatgctgctgataaagacagacccaagactgggcagtttgcaaaagaaagaggttcattggacttatagttccacatggctggggaggcctgacaatcatggcggaagtcaaggaggagcaagtcacatcttacgtggatggcagcaggccaaaaaagagaacttgtgcagagaaactctcattttgaaaactatctgatcttgtgagacccattcactatcacgagaatagcatgggacagacctaccccacatgattcaatcatctcccactgggtccctcccacaacatgtgggaattatgggagctacaagatgagatttgggtggggacacagagccaaaccatatcagcctgtgtaacagcacaaagcaagacatgatgctgagactcatctacgcattttattctagagttaggaagaacttccaattgtcccacctctggactagaactgaggacttagactaagaccaatgacctacccaatcatcatcctacatcctcatcccggtactaccttgcctgtgactgagaaatatctttacctttggacctaaaatgtgggagagctgaactagatgatctctaaatttcttctgctataacgcattgtgtatctttaagattcctttcaactttgagattctgtaatcacatctatttgcaaaagttaaagctaaaatggagaaaggggagtaaaaagaaaatactcttattgttttattccctggagatgtatttttctgaacaaacaaagatgagcaagagaaatcagcatttcatcggcacatgtacttttgtcatttcatttaaacataaaaataactctcagatatatattattatttgccttttacaaatgaaagaactgaggctcagagagacttatagacttgcccaaggtttcctaattagtaaagattggaacctgcgtgtgcctgagtgcaaagccttttggtccactacagcatatttactagataccacaccatgaaatttggaaactcatataaccagattcgtaaatgccccatctctgtatcctcacatcacactacctcagcttctgtcttctcctcttcttctactctttcctttccaaacatactgctccaatcctttcttgattctctccagctcacaaaaccccttttaaatgcatataacatcttctatctctattgttattattattattttttttactgtggtcctggaatttgtaatttgtgcttttgtttttgttcatccccattgggcacaggacagaataagctatgccatcagctgagagacttacaaatgtctctatctaatctgtgtgtcaatcatctttctatctagctctatttattagtgaaattaaagaaagatagagcatattaagcccctggctcttaatagttggcacctagaagggacttggtaaatattcattccttcctcatcattcagcactgctgtttacccaaatcattactcatttaatgaatctcagatggagagggggagtatattgagtagatgccccagctggtctaagagaatgtgccacagtttggcaagcaattgggatggtaaaggataggaaatgaatgtgatatttaccttaaaatatctgctgaggatatggtttattctgccctgtgcctagcacagtgactcatacataagaagggcaaaattgaacggatgatgggttcatattatgtcagtgggcccaaaattgactttctggatttctcgtgctttatcaatagtattagttgtgtcaaagtttgcctctacagactaataaagtagttttaatttcctttaattttgtggtcacaaaatcagacaatgataaggagtcataggctccaagaaagttagacattactagctcaatgatgggaaaacccatttctgtcctaataataaagggcattttgcagaaaacacggtgaaggatgatgctgaagtgcccgtttgcatatattgacagcaagaccagtgtcaagtatcataaataaattgccagagagaaagtaggaagtttccattgaagtgggcagctgcaatgagcttcgatctcaagatttctaaaagcattgaagaatttacatcacttcaactattattttctgttgaacatgagaacaggtaaccttttatgtctagtttatatccagcagatgcttgtgatttctacctttctggcacaaaagtcctcatgattacacggcttcctcctctgccaatcaatgctaatggcaagagaaatgagaagcagtcattttataagcattatgtctggaaatgttcctttcgttgatagcagtttcttaacgccagtatggttagatgctatggcaacttaaaattgtgtttccataatatagtggacattgatgtcaaactgatctgcctgggtttgactttggccgaattatttggtctatctttgccttatttttatgatctgtaaaatggggataataaaacccatcttgtcaggcctttggtaagtgtcaatcatatgccatgacatttgtcaagaggcttatgcatagggattttaacctctattacaattaacaacagcaatgagaattgttccattgcatgcccagatggatactaaattagaaaaagaaagatccaggttgaaataataacagcttttttttaatatagaactttaagtcgtcaaaatgcttgttattgtatatgcaaatgtatacacatgtaacattttttttttgcaataattctgaggtaatcagggcaggtgttgctaatgttttacatcatgagtctcaaaggggctacatatttactacagccaagcagctaataaatagtagaactgggacttggaccctagttttctaactccaagattatgtcattttttttttttttcctcagtcaatcagccctggtcctggttagttgcgtttccttctccagactccttgctttcaccccgaaaatgagcaatttggaaaatattatgtctaaggtagagtgttttataaatctgtgactgtagaacaatgtcttaggaggtatctcattggcctcggtgagaattacaaccgggtactgcacggagagtcagatccataaagaaccctttatgtccttaaggatgtgattctgccacattactctgacctacagatcattccccatctgccccatccccttcaggacccaggtttggggatgggaagaaaaagtagatgactcggttaggcacatggacatttaatatttgggaaatgataatagagcctttcttaaaaaaaaagcaagttctgtatcaccgttaatctccatagttttctacaacaaaataaaggagaaaatattttgctttagtttggattctagcgttgagtacacattttctgctttcttcttttgagctcttagtgcccacagaagaggcttgactctcattaaaatgtgagttctttctgtttatagaaatgatggagacttgagaatggtaatacacactaagtagcacttttctggaagattatacttcagtttcccaattacagagtgagacagtggtgggggcagcagattgaatgaatagagtagatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttcctccctccctcccttcgttcctcttccttccttcctattatctatgtatctttctatgtatctatctatgtatctatgtatctatctatctatctatctatctatctatctatctatctatctctatttattaataaggttcaagtaagaaaaaatatattaagcctctagcttttaatagctggcacctagaaggcactcagtaaatattcattccttcctcttcattcagtgctgctgtttacccaaagcctctctcatttgatgaatctcagatggagagggggagtatatcaagtagatgccccagctggtctaagaatgtgccacaatttggcaaacaattgggatggcaaaggataggaaatgaatgtaatatttaccttaaaatatctcagaatctttcatgtgtaggaggaattagaccagtgataaattgcagtgcatggatctttcacaacagaatcatgtggataccttctgaaatgagcagatatctaggatatctgcactgaaatctaagaatcactggattagaattttcagtactcagaggcaggatattgtaggggtttgaatttggattcaaattctgctccctcagtgtaaacctaaggaagttatttaacttttctatgttactcattgggttgtggggagaagtaagtaatttgatacatatgaagtgcctaaaacacagttttacttactgtataagccagtctttgaaataccttgcatgactttgtttaacttacattttatttcctctctaactaaatgtcctagataactacttggctaactctttcatttgcttaaagtctttttcaatatctcctcagggaagcctacttggattgcttgaatttgcatgggttggggtaggggaagcaggaatagggctgcttgctctctgaaatcctgatctcccttaccctactcttatttttcctttattctgtggcatttggtaccttataagcttacacatactattttattattttatttagtctatttttaaaatttaacttttattttaaattcaggggtacatgtgcaggtttgttacataggtaaccttgtgtcgtggggatttgttatacagattatttcattgcccaggtattaagcctagcacccattagtaatttttcctgattctctccctcctcccacctatcaccctccaatgggccccagtgtgtgttgttttcctttatgtgttcatgtgttctcatttagctcccaattctaagtgagaacatgcaggattaggttttctgttcctctcttagtttgctaaggataatggtccccagctctatccatgtttcggtaaaggacataatctcattcctttttatggctgcatagtattccacggtgtatatgtaccatattttctttatccagtgtaccaatgacgggcatttaggttgatttcatgtctttgctattgtgaatagtgctcagtgaacatacacatgcatatgtctttataatagaataatttatattcctttgggtgtatacccagtaatgagattgctgggttgagtggtatttctttttgtaggtctttgaggaattgccacactgtcttccacaatggttgaactgatttgtactcccagcaacagtgtatagtgttcctttttctctgcaaccttgccagcatctgttattttctgactttttaatagtagccattctgactggtgtgagatggtatctcgttgtagttttgatttgaatttctctaatgattagtgatgttttattcatatgcttgctggtttcatgtatgtctttggaaagggtctgttcatgtcctttgctcattttttctaaataggttgttttttcttgtaaatttgtttaggttccttctagatgctggatattagacctttgtcagaagcatagtttgcaaaatttttctcccattctgtaggttttctctttgctctgttgatcatttcttttgttgtgcacaagctctttaattagatcctatttgtcaatatttgcttttgttgcaactgcttttcgtgtcttcattatgaaaaatctttgcccattcctatgtccagaatggcactgcctaggttgtcttccagggttttaagtctttaatccatcctgagttaatttttacgtatgatgtaaggaaggggttcaatttcaatcttcttcatatggctagccagttaccccagcattatttattgaataggaaatcctttcctcatttcttattttttatttcacctccagtagattataaagtccacaaggacagggacacttgatttgcttattgctgtatcccaagtgcctagaatagtttctagcaaatagcaaatggccaataaggaggcaatgatacataaataagtatatggatagatgttagtgtgattatttgtccccaagaagtagaaagagatagaaccggataagacagtaaattatacatgtaatattcaaataaaatttgacatacatatatgcgcatatacacacatatatatacacatttacacacatacatatacatatgtatatataagtgtatgtgtgtatttttggagtgttgagtatatatttaaatattgaagtaataatttatgtctatgtacatatatatatgtgtgtacatgtatatatgtgtatgtaaaaataagtgtctatttatctatatatttaggagtttttcaaagctacctgaggaaacagaggtgttgaagtgtttacttgttaggttgctatagtgataggaagaaagatgaaaatatgtacatatgagtcaagagacaacagacaaacagaagaaatagaagtgatttcaggacaagaaatgaaaggctaagattaaaacagcaaccaacattggagggacatagaagagggacagtttttaagtagactagtcagagaagtgatctccgagaaactgacatttgaactaagacaaaagcctgagaaggacccacgataggcctgaggtcgtcactgaggtggtgggccaagtaagagacagtgaagagctggaaataaggttctaagataggcaaggcctaggtcagactggtcttgcaggctatggtgaggagtttggattttacgcaaagtgtagcaggaagtcactgaacagacagaagcaggatgatgagcaggtcaaaggtgtttagagccttgaacagagagtgaaggaaaatggaagaacttatttataagatgagaagaccaactgctctgatttcatcatgtaggctgttatgaacagatgagaaagacaatttggtttcattgatgtttcattcataggctctcgttcccattagaacatttcaaaagggaaaacaaaaacccagctaaaatagggaaaacctatatattctagatgtggctttgctttttctcaaatgataccattcttatttccaaatgcattaagtaatggatggaaatgtatgcactattgctcaattcaattcagctggaaattttacagttcttgtgtaggtgttttatgtaatcaattccccaaaacactgaacctagagctatttccttaggaaactttagctaccagtttctgaaatctgtcgtagtgaagagtaagcatgtgaaaggcaaattaaattccatacaagatcaatttcttctttctgactctacaaatttaaatggtacctaactcttgaagaagtagcttacaggtcatctcttccgtgatgtgtttactgggcccgtgcacatataatctcatacatgcctcttcataatatgagtttaaaatagcttgataacatatgccagactccatttcaaattttctataaataatttctttttgaagtctcggaataaccgtatgtggcaggtgaagttataatcaccattttacacaagacaaaactgagacccggaatcacagagttgatcagtggtagtgtcaatattggaaattgagcaagcttaatcattatactattctgctctttgattgtaaaaagtaaacctgcacatttattcacctctatttgtcccacttactttgtggtgccttatatgaaggaatagttcaataagcgtattgaatcagtgaattaatctgtgacctattctttcaagttgtatcatttcattagcaaatagtgataaaaacgtgggttttagactgaggcaacctaggtagcagaaggtactcactacctctgtgatatggtaaaattactaacatctctaaacctctttcttcatctatgttgttggcacaaatgtagggccattgtgaggattacatgaagtgtgcatgtaaagcacttagcacagttcctggaacataattagagctgagtctatctgaactgtttttattattttttgaactaaaataacctcctcaaacatgattacaattatgtaccaggcagttttttagttgtgcttgttttattaactttcttttaaaaatcaaagccaaagattcaatcatataatcagtgatgttaattttgttccagggctcatcctggcatcctgccctcagcagggcatgcagtgtggattctgaaaggccctcttataggaaggaaggccagttctggagaacagcatgagagcaaaaggtgctgtgtgaccacgcttttttcctccatacatctgacatagctaaaggcagcacttccaaccttgcctgtctatctccctagcctggatctaccttgctggaaagttactttgtattccagcgatgatcccagagcattttgggtgacaaggaaaaaacagcagaagactaaagttttgccccagataacacttaatgaggttaatttacagaacttgctggaggtttaggacctaatattgatcctgtgcctcttgtgtaccaggagctgtgctgaatgtcttagtttcattatctcattcaatccttactgcagccatgtacaaattttagtcgtaaaccaaatttacaactaaaaaataaaaataaaaagtgacatgcttgacatgcttgcctctacgtgtgttttgcagggctgtggtgataaaatcaaatatttcttgtgttttgccacatttttctttgaaagcaaattttgcagcgttgcaacacctctggagtctccagggacctcccctgcagtgaagacacatttggcagagaaatgaggcaaaggttgcatgtggaaggcaggaagtttcattccagttgacagtttactttgacctggaagaagctggtaccaatgagctgagttctattttgtggattacatttgtttgcttctttgtagggaaccaatatggtgcttgtttacatttttttttttttttttttgcttttggtcttgttatgggatgtttaaaaggtgtaacttttatccttctacattttccaagtaaagttcagatgtttcgatattcctgacactatttgataaattattttaaggaaaggtctacacacacacacacacacacacacacacacacacacacacacacgagaatggtgcctgattcataattggcactcactatatatttgctgaatgaatacataagaaaataaatgcatttcctttttcatctttctctctctgagaatgggaactgctgcaggatttttttaaatggcaagtttcaatatatacctttcttcttaaatgtttgctttaagaataatttcagaaggagattattctaaaatatggagcattacttaatcttagttatgcagcacagctaattggagtggactgtaattcctttggaatttattgaggtgagatcatttacttgtatactaaatggtcccagactgatatactgttaaatttgtgtagtctgattttcataaatttgctggcctttctctctcttattgtctgctaattctcattgcttttggcatgtctggctctccattccccatacaattaacagtttctactttactgcagactaggaagctgggtaatgaatttgttggaccgggcatataataagaatacatagctttgaatgtggactagagagactcttttccaaggtaaggaagttaaaagttatggctgctatagaaacagtcttcatataaggtgataccacacatagtaacactgggtttcagttgcctgcgttaataaaaagggaggcttggtagggataattcatttactcttttggacaataagcattttctgagaaacttctgtaggcaagacactggtgagatatagagaattaaaaaagcaaatacacaaacacaactgaaagataaaacatacacaggggtttataatacaatttatacagtatttcaaatagcatgagaatacataatgtactttgaaaagatatataaggtaataaaacatttttgtatttcagaggaaagacaattgtgtaactcaggaagggctttataaggaagttgtatttaaagtgagtcttgaagtgatggacaggttggacagagagagattggtaaggagaagtggtaaatgaattatggtctgaccggggtgagtgaatgatatggattgtgcgatttatcagagagagctacaattgtgggagagactgggcaactgaaggcctagggcaggatatttgggagatgagagaacagttaagaaatcctgagaaggcactggttaggaagtctgttgagggctgttgcctctgcctgtggcaggcagacagtcagaaatgaaatctggatgtgacgtggaaaaggacagattggagcccctgagtctctagtttgatgatataggtgttctgcagaagagattggtgctcttagccacggaatttcacatctgcctggcttcagacggaggagtttaaagggaagatctggcaggaattgaaagagcagtgggcagccaggcgcagtggctcagcctgtaatccccgcactttgggagggccgaggcaggtggatcatgaagtcaggagttcgagaccagcctggtcaagagaccagcctggccaacgtggtgaaaccccttctctactaaaaatacaaaaatggccgggcgtggtggctcatgcctgtaatcccagcactttgggaggccgaggcgggcagatcacgaggtcaagagatcaagaccatctggccaacatggtgaaaccccatctctactaaaaatacaaaaattagctgggtgtggtgacgcacgcctgtactcccagctccttgggaggctgaggcaggagaatcacttgaacccgggaggcggaggttgcagtgagccgagatcgcgccactgcactccagcctggcgacagagctagactgtctcaaaagaaaaaaaaaaaaaaaaatttagccgggcgtggtggcagtcacctgtaatcccagctactcgggaggctgaggcaggagaattgcttgaatccgggaggcggaggttgcagtgagccgaagatcacagcgccactgcactccagagtgggcaacagagcgagactctgactcaaaaaaaaaaaaaaaaagaaaagaaaaagaaagagcagtgggcctggctgctgccccatctaggaggtgagccagtgatcagcaacaacgtatgtgagttgcagtactacctagaggcctagacagaccctctgaataaagttctctatgggcagccctaacttggaaccataaagagtaaggaattctaggaaacatcattccagtttaactatttttgcacagttaggaaacagaagtgacttttatcttagagaaagggaagataatgaaaacataaagtgaaggagggaaacaggaacctgccctggagagagcccagtctgaccgggagataatatgtgaatacatcatcattgaatgcaaggaggcactattttttggggaccttaaatgctctgttaagaaattcatacttaatcctataagacatggagacacaatgaatattctcgagtaagggaggggcattatcagatctgtattttagatctggcttagagagggaataagtggggcaattaatgaggattctattataataatcaaggtggaaaatttgcattcccagaactttcttctgttctcactaaaggaggtgacccagagtcatcataagatgttctggaccattctgggaattaaaaatgctagtgtacattacaagccaaagtgatttcacctatggctgctattgtcaactccgatgcccttatggtatgcctagataactcttcttaaaaactccctgataagtttgcttctagtaggtgaagaacaaggagaagtgtatacacaattagaacatcggcttaaatgaaattggcttatgcaatcatgtcagtatcattttgagaggagagatcctataaaaacaaatacttattacgtagtaaattaagactttggggctttactgagtggtaacaacagtattctcttatgtgtatccaagtgcccaacaagttacagaccacttacatgttcattatctcatttgatttgataacagctctgcaaggtcagttttatctgaattattacaagtgaaaaaactgaagctcagaggttgtgatgaccatcaagtggccacttagccccgatgattcaagagctcattggtgttctatatattcaaagggcaccattctattgctcaactttccatttcgctctatgcaccactgcctgataatcttgggacatatctttgttcatgctgtgtccttgttctaaatccattcatcgctgggccctgttgctcacacctgcgatcttagcactttggggaactgaggtgggagggtcccttgagcctggaagtttgaggttacagtgagtctggactgtgccaccgtactctagcctgagcaacagagcaagaacctgtctgtaacaataataataataattaaaaaaaatccacccatagttcttggacattctcactttaaagatctctttccacccaaagaacaggctttttgtaacccaggtgttacaatttcagctgttctgtttcctcactttcctgaagtatttttactgcctttcctcaaagcacaggacaccaaacacagggtaaagaggaaagggttctttacaaaagcatacctgagtggataccttaacaccctcaggaaatctacacatctttgaattagggcattccataagtcttccctgtcagcacttcccggcacatactcctgaatgtttaaaaaccaaccatatctcttggcttcctacttgtcaagacacagctgaacttactcacttgtcttgacttatgtaaaacacacacttacagtcagtgctgtatcacctaagacttcaacagccagcagcaagtgaattaagaaaccgtaatatatcctccattcaatgcacccttgcagggttttgcacccctaaagagatccctagggcacatgaaatcgggtgactaccccagcttcttgctgtggggaatctagggtttttgtagttaatgatattgagacatggacttaggggaacaggaggaggcatatagaaatcaagctttcgcagcagccattaaatggaatacgtgtaatcgttctcaaagaatactagattgctggggccaaagaggctaaacctctggctttgcagaaaggcctcagaggaatatgttgtgtttataaagtcagccaaacctacctgtaactggctttctagttctggcatagtgcactttctggtatcatgctgcttctcttgtcttggttctcacacatgagttttggcctaattgctctagtttgagagagtcaaaggcaagtcttctagtaatgaggggaaaaaaggataatagctaacaagttgaagtgcttactgtgtgccaggtgctttacaaaattacctcatataatcatctttctttttttttttttttttttgagatggagccttgctctgtcgcccaggctggagtgcagtggcaccatctcggctcactgcaagcttcgcctcctgggttcacgccattctcctgcctcagcctcccgagtagctgggactacaggtgcccgccaccacgccctgctaattttttgtatttttagtagagacggggtttcaccgtgttagccaggatgttctcgatctcctgacctcgtgatctgcccgcctcggcctcccaaagtgctgggataatcatcttgtctaattccatgtgaggtgctttactgaccctgtccaccaataaggaaattgagagtcaatgtggttaagtagcttgtacagctgtggagaaggacctgaacccaggtctatatggctgtaaagctcatgatgaaaccccgtgctttgcctccctgtgctgaggcgtgccgtgcatcccatggcccctatccagtttgcttgcacgtacagctgaacatcttataacaggcgtttagttagtactctgatgtgtctgacagttccctagaagctcagcttggactgagccagcccatttgcgtttctggcctcttcttgcttccttttctcctttttcaatttcctttttcggctcaggcagcatgggagatgccttaatcaattgatgatagttccttctgttttaatgacattctcatttcctcagtatgtttttctcactttgagggttggagaggggagtaagggaacaaatactttcaaaaacccctagtctcctagttttgaaagtaagttccatgacgttatggaaatgctgctttgaaatactggaactgctgtattgaatgcccataggtgtctgtgaaagagggaaccgtaggcccaacatggctcgaaagacttcatccaggataagtaggttgacatgacaagggatttgggtccagctcaacataaagagacatttattacaattagggccatatgaaaactacattagtaatgagttcaccatcactagagatattaaaagagggcctagacatctagttggcaaggatgtcacagggagatttgaatattggaaaaaggagtttgaatcaaaatgacatttaaaggcctttccggccttgagattctgtcttgaattcacttagaaactttatattgggaataaaggtttccccttgttataattaacaccaactagtgatgtctcctcctccctcccccctgtgcttcccctgtctgaacaactactcgatttaagaaggggacttaggatgaggaaggatgtggttccttcccacttggcagcactccgtgtcagaatggaagacttgtgtctgggcctggcacggttccgtcaggccctcttaccagcccagtcgtgtctgtgaccagagcacgtgggaggtgcacatccgtgtagaaaaacctcccactggctgccagctctggatttttgaaataattcctaatgaatgcagtcttgcccaggccaaacctcttacaggaatgatgacacaccctgaaacaagtccgagtcaggccagacaagcatcccctgaaaaatactccctttgcggttggcagcatatgagaaagtatctttgagagccgtttcttcttgccgtttcaaaggaaagctgcttgcaggccaggaggtcaggagtgaaaaactcctttttttttttcttctattttttcttttcttttaattggcttactactcatctgaaagctctgctagtcaaatatgataatcctttgatttaatgtcaggattgagacagttctctggttcttgaaggaaagagtgttgcaatgctaggaagtctccagcagctgattaacagctttgatttgaaagaataaaaagaaagatacaaaaactggcagtgggtcctaccgatcggtgctgcaactaagaatggacagtatttaaataagatgatctttcccctcaggatttacagagacttccataatctccagcccacttcattttttttttttaatgtaatgttacagctcggtatgctttgctcaaatctatcatgtttggatatttcaaactaggaagtttcattccttgtagaaaagcttcagaaactcaccagatattttaagtcaggtcagtccagctcttcccaggaaataaagatgttaagaacttcatagctgtagggactccttagagatccgatccagtgctgcctataggaccttgggccgagatttcccatgtacaccataaatcttcacaaagtcgtgggaaaagaacagcaacttcagctccttttgcagcctgatcattgcttctgggcccgagtagctgtcttcttttgatataggaccattgcctgttcagacatgactctttttcctggatacaaatggtatgttatttttagggggcagttatatttcttaatagttttcagagttggtagacaggcctgaactgggaatcaaaagccatcttctcacatttccactagtgagttattgacctcatgaaagtcacctctcctccctgggcctttacttcccaaatagtgttccaaataacattagtgacttctgaggtcctgtctaattttctagatgtcatccggataagaagataaagtgtaagagaattaaaaaaaaaaaaaaaaaaaaagaaaaccagcaaagtgaagtgtggggcttaggaaaatgagagtcctctgtttaaaatatgtctcagagagccttggtagcaacaaaggtcccaaatataggaatcttagtctgtactgtgtattgcagggtatatggatttcctgtatttgcctaagttctatttgctaagagctgactagaaacatgaatagtagtcctgaggaagcttaaagatgctatcacattcagtttactcatttgacatatcaaccctgcggcctttgttctggaggtacactgaaacttgaactcaagtctcctgcctgcttgtgcaatgtgctttcaagtacactgcctattcagtttatttagcagtgatgaacgcttacagaaaccatcaagctatgttttgaaagttagttgattcaaaacaatagagtttagtggtcagccaaacagaagcaaggagatttgctagttttgcatatgtgtgtgacttagtttccctattatccacgtgttaaacataagttctttgtacagctctattcctggccaacaattagtgctattttttttctctcgggttttagaagatctacctcctccaaacaacagcaattaactacgacttataactcactctcagctccccaccagggccacttacattcacatttctgatcacaatatttcttaaggtaaatcttcagttctctgagaatgctgaacaatgagtgtcttctagctcaagttacagtttgtaatgaccaattttgtaattgtggaacagccacaaacacggtggcataagattcatgtatcctggcttaatagctcagattatttccaaaaacccactgacgttggatcaatcatgctacctttgtccttttgtttttctgtctattaagtgctgtgtttggcccagtcttcctcaggtctcctatggtcaaggatcgtgttttaactgttttgataggttgtctttctcaggtgtattccatgctacactgctatcatatagcaaagatcctgagaaattatactttcatgaacaattcagggctgtgattttgaacatgaattatttttcactgtgcataatgatgttcccagaacctattgaaatacgtaagactctaacgtgaaatggccccagacccccatattaccagtttttgcttgttgggtttcttttcttgttgggtgttagtagctcaactttcacacctgccatcaacatgcctccttataaaagccatttgtccttcatgcaagtttgtgacttcttctctgcctaggcataaggactcagataaccaagttgttatctgaagatctgtactataaataaagttgattctttttttaatttttttttaagttgatgcatcttagttaccgtttgcagctctggtttgtctagctgttggctactggtatttacttgataattgacactgtctagtaattgagttaccagctgttgaggtatgactgcatgcctctgattctgtgggtctcacttttctcttctttggatgttttcactggccaatagattcgttttgtatttttactgtgatcttctgggtagatgctagggaccctaatgatttttaagtaatcctgaagaaaattaccgtaagcctaaaggtggttgaaaatgacagttttttgcaaataatcaaaatgccatccatagggacatggttaaatacactatcataagctagacaatgtaatcatatttagccattaaaaatgatgtataatagatcataatgctacataagtgtgaattagggtgacaaccatggtctatgctttgcctaataaagtataatttaaaaaacaaacagacaaaaagaaatgtaattacataagctaatctggaaaaaatgtgaaagacacattactaaataaaataagcatcttttatatacacatatgattcaatttttgtaaaaagaaaaacagttatatgtgaaaaaatgaaagagtctgagtctagtagttatatatggttatattaagagagagactggatgaatgccaaagggagaggagaaggggccacagtgtttacacttcctacctaatatagatattttttttaacttttagacatttacttatttaaaaaattaacttggaacctcttactaagtgagactcgtagcctatctcaaagagcgataatgtgatatttaaagattttgctgatttggacagaaacagaaacaagaagtgatagagaatttattagatgctttactttagatacattttctcttctttttttttattattaataatgttggcagggaggcagtgaacttgcccattagagtttggcaacctgcttgagtttcctaggcatcccatgagtcctctctgtttcttgccacacagcattgactcagatctattcctttacatgcaggcagctgtacgaaaacctatgcactcttatagcctcatctggtttcctttgtcaagatattacattatgaaacattttgggaaattagcagcttttgacagtaaatacgaatgatttgtgattccactaagccactgcttaattttaggctgctgaatggtgaacactttaaggagcgtgggaacaggccatattttgttttgatcttacacagtctcatttgaaggaaggttatccatttgaagatgggctataatttacagaaaggcaattatattgaagactaataatgagcatttagtaatacatatcaaaatgtagaatatgaataacttcagaatttcaagatcttttattctacataattaatttttacagctgaaatgtgcctatctttttggcgatcagataccccctgccctccaaaatacagggttaaatctacataagacgtatacgatttctccatggcatatcattctaggcctgttttctgtaattccttgcctactcacctgcaggttatattctagtcttactagatttcttgttttcctctaaatatctcatgtacttttctgttttgagaactttactcagattatttttgctttttggaataccttctcttttcttcccttcttttctctttgctctccactgtctctgtgattctttctggtccctaagtacccacacagaagcacacacctctgttcctcttcctgtttagatgcaagatcttccccatgaaccctccctaccactattagctagcaagaatcactgctcacttggcatccacagccctttatttacactttatgccttacactgttgcttctcaatgtatggtctaaggagcagcagcaatagcagcctctgggggttgactagaaatgcagaatcttgagtcttgtcctagacttatggaatgtgtgaatctccattttacccagttttccagattctccttatgcatgctaccatttgagaagcactgtcttagagcagatatccaactttgccttcacttggttgcttttgtgtgagtgggttctgatagaatctggcttgtgatcacagactgtatcttcagcattcatctgcaaggcaggatggagtgctttgcacacagcaggagctcttaactgtgtgttgttgaataaaagcttgcattttcaatgaagaggggtgtttgagggaaaaaacaaatacagggtatttccatgattcttgtcggcacgatgtctttcagattgtctggtttccatcattgctgtggttgggttttatagaccctagtacaaagggactgatatggtttggctgtatcccacctaaatttcatcttgtagttcccataatccctatgtgtcatgggagggacccagtggcaggtaattgaatcatggggacggttacccccatgatgcctttcttgtgatagcaagtgagttctcacgagatctgatggctttataaggggctctcccctgttttgctcagtacttattcctaccaccatgtgaagaaggacgtgtttgctttcccttcctccatgattgtaagtttcctgaagcctccccagccatgctgatttgtgagtcaattaaacatctttcctttaaaaattacccagttttggatatgtctttgttagcagtgtaagaatagactaatacagagacttaccaccttatcaaatctctttcctcctctcacctctttgagaaagagttacagtggtgtggaggattacagctttcagaaagaagctcaggtgagttcattgtccaggggattgtatttaaagcatagggaaatactttgtattaatattttatgaataggactatatctgtgtatctgtgatgattgtatatttgtccaagaattggaagcctgatcacaaggtcagagtaagatccagaatcagaatttggtgcctctgaacttaggaaaataacattgttttagtttattatatttccttttgcaaaatttgacaaggaaaagcttcataatttcaaaaatgcttttctatcttgtgatacagattgtaacagacttatattcagatttgttctccaagtatctccatcttccccacttcccctggtattgctgtttttcttagtgtcacttttgccttctcctctcatctgtacatatttcttttgcggttttcttagttattctactcgtattccaatacttaaaacatctgtatcatataactctggtgatattcctgatccttcacaaaatgttgtgtataattaataaaattacagtgtgtataaatatgtaaaaataaataaggataaattaaaaataaaaataaaatgaaatatataattataaataaaataaaatgaagataaaatgtaaaaaataacctaacaggtgatttttttgacatagataagaacaaccctagtagggacttgccatttttatttctgtttttaaagcagatcttgaatatgtaatgcccgttacatccatttcttttagattattaagattaagacattgtttaaatacttctttctacttttattggctattttttttaaaaaatatattttatggttccgtgctctccctctggcatttgaatgatacaaaaatgaattataggaaccaaaacataatgctacttgtttcatcttaaaaccttaagttgcttacaatgaaatgaaggaggtaagatgttaccacataaagagaaaacactgtcatagagtttttgtttagagagatctaggacatcttggatatgcaaaaatgacaaggttggtagaacattgagggacagattagatgaattctcgttacttgtttttcccattcacatatccctctctctcttctctcttccgtcctctctgccttcctccctccttcccaaggtgtcttattacctttccctccctttgtccttctgtttttttctttggtggatgaatgtttgtaagatgtccattttgaagctgaaagcctcaaaggctcaaaggcagataattctctttttggaagtcattttacaaaatcctttttatgaacctgtctatagggaaatttcttcctgtcctggctgtgcaatgaaccatttatttgttctcatggataccaatacttattcattattttaaactttgtattttcttttttttttcctcctaagaagttcattttgctctttcttctgattttcctacctgtttgtaataacaggaattagtctttccatgtgtctgtgttgatttttttaatattactttagtgaaaattatagaggttacaggtttaggagctgttggggaaataaaatttaaaaccaaagtctcccaactgagaaattctctctataaaagtaagagagaaagaaaacaaatctattttttattcttaaacaagcattaaatcagaatgtgatgtacatcacaggtaatccactaagagatggcaaagacagaaagaactctcactcttttatgaagccaaacagcccattacatacgtgttttcaagataaacaataacttgtcctcaagtaagcttgacagcaccatttgtcacacatagctcatcctaactttacctggtaattgaggtgaccatccatgttagctgattggttttggccagaggaaaaacaaacttcacatatctttatgacaggaggtagttttttaacttggtgcaagttgcctaccaaagttagggtccaactctcccatagaaactgggagataggggtgctatctaccaaagttagggcccaactctcccatagaaactgggagataggggtgctatctcctgtgatgttcacttttcaaagagatggcctccaggtcttcctagtaaaaggcatttctaggtcacaaagctgacaaaaggccttgcttagccttcaaaaggatttatatacatttcaaagagtacaaaaagtactcagtaattgcaagttggccaaagtaaatgctctgagaaaaagaaagaaggtgaagaatcttttcccttattttcaacaagaattatgcttcttagttttaatttgtacttaatctgacagaagataggtcctatttcattatgtttaactaagcagttcagaattaaagttttactttttctgagtttgacattcagctgacttttgtctttggccttgtggtaacaaattatacgcctccaagttggaatctgatttgacaattcattagcatttctttaatttgtatttttattgtaataaaattgaccattttaaccatttttaagtctactgttttgtggagttaagtacattttcattgtgcaactattgccaccattcatccccagaatttttcacattttgtactcaaactgtagcctttaaacattaacttctgagtctgtcctcccctcagcccctggcaacaaccatcattatcactttaaccaacctattcgaaatgcccatgaaatttcaatatcctgtctctggatgagaagtggagaattgtgtttgcccaggattttaaagataaagatgttttcttgggaaactgactgagaaaaacaactttaaaaccttgaatgtggtgcacccatttatacaagtgatgccacactaattataaataacttaagtctgtgcagttccccagaaatgtctcattcgtgccacttcattactttcaaactgataataaaataccctcctagtgaaatatttttttgcatgtaactcagggattttactattgtagatttggcatttttcacaacccttgctccagtgaatttttatctttcttaattgatcttttggacacagcaaacgaaatattgaacacttcatatattttgttttataaactgtcgtggatatgaaggagaatgatgtgaaagaatcagggcagacaatctgttgcagtcagagaaccttaattaaaatgaagctttgctatttgattgtcgtgatagcttgagttagacacttcacctttctgcacctaatttcatcatctgtaagacaggaaaattatattcctttttgagtaagttgtgtgaatatgaagtaaaataagacatgaaaagaagcactgtgtatagtgtcaaagcatgaattatttcaactgagtaatgtacttaacatatggcagaaatttggaaaatacttgttgagtgaatgaacagatgttattctcaaggttaatttttctagggttctctcttctacacacatactcctgtctttgcttaaaacctaccctctcttggctttcctctgattcctgattgtatcttcttctccttacccaaattatgcttccagtttaaaaactccagatctcagagtttgggtagtgatttgaaagggctcaaggaatttctgttatattatttcatagaaaactcttcctttctaaatggaactgcttcctgaaagcttttgggggttagaaatggccattcgagttatccactgtaacatacacaaagattaagggaattttttttttttttttttttggctagcatcaacaggctcaggggagttcaccctagccaaaaaaaaatgatgagctgcaataatgttaaatcagacatgtgaatccaaattaaacagaattcttggtgtaattccaggctgttccctcgatggtcattgggtgggggctcactaagcaactctgttgttcagtgtcaccatacacatgataaatgcaaatgtatgtattataaagcagcataaccaaggcttacactgacaaaggcagatgacaatccaaaggtattctgttgaacatgccttgcctgacatgttttagtggaaaaatcacccccacccatgatgatctgagaaagaaatgagtgttgagagactgaaggagcagaaaacacataaaggaattatagtattttcctggattgagaaacagcctgtagaatcactctgtttagaagaatgtaatcattcactcaataatccagagcgttttctatatgccaggcttcaatgctagaccctgggagtcaaaaatgaatcagaagtggaccctgtctgcaaacgtcttaagagagaagacatacacacttatttaatagtacaagataaaaaagcacattactgagactatatgggaagcatagctaacgttttaggaagaaggtagaaattacatctggcagagggaagcagggaggtttcatgaaagaagtggtttcggaaatatgtcctgaaggacaggtggtatgtgtacacttggagagggtaatgaagggcatcccaggcagaagagatgagtaaaggggaaggaaggcacggggtgatctgtagcaatatctctatttgtacctgtggtgggagtgcttgatatgtgagaagtagtggtacagcaaagggttggaaagagagcttgctgccagatcgtgggaggattcagaatgtcagtgacggacatcagggaagtagcactaggatatgatgtgtgagcaaattgctttgggctttgtcatcagtcggcctttacaggtgttcccatggcacccaacccttacctgaggcttttacagccttcttgtttgcagtgtggtaaatatctcttcctttggatttagagaaggagatttcaggctgttttttatatattagagaatggaaagaacatttgcatgcaaaaactctcagtttttaggtcaccctaatacatacatgcattttcttccctttttcagaaagagcagaacaattgaaaataatagcccttttaatttttctaacattaaggtcacacaggtgaaagggttatttgctgggtctcataggtgcttactccttttatcattggaaaaataaaggctcccctctgttttctgactttttctggatggtgtcttatgttctgatttggcaacagtctttaagaatccagaattctggaagtagtgaaattataatcaactccaattagctacactggtggagcatagcattatcatacttaaatccaccagcatgtcttacatctcattttagctagtcattatgccattgttcctccatcagcttgccacaggagtggtttagcaaattagaaaattgatttgaatttcctacttttttcccaattaaaagttcatgagccttactctaaaactacctccagtaggagtaatacacccagtgagagaattcctaggaattcctcaaagcttggtctactgtttgggggcccttacacagtcaaactccacctccaccgtgtttttctgaaagaacttcattcagcatttccaaactgtggcaaggaacctgatgattgcagatgttactaaacaagaattactaaagtcaattagatttgagaaacactgtatattattactaagtaattgagtttcacaacatgcattagcatcctgaaaggccctgaaagaagtcctgtgggaaaagataacttttgaacctctttcacctaatattaataacctaatgtttctctaaactgagggtgaattactaaagcatagcctttcaaaatcattctgtaaaagcctaagctgaacaatgtggttcaatatgtggccttcagagggtctaagataatttaagaatgaaatttaaaatatcaggagactcgaattaagtaggtacatttattaggactctgcattgtatccatcctctatttacctaccaggatttacgtgaatattttttcatagcctggagatcctttcaaaccctgtctgtgttaacagagctgctacatctgatattattttccggaatctgaagaaacaccaaagaggactgaaataataagacattaatttcagctgtagaatgccgatgttgctgaccctgcagggttattgcagagggagattaattatgcatatctgccaccctaggctttggagttgaagtaccctgctgtaattcactgccggatcattcatgtagccagcatactgatatgattattattccaccaaggtttttatctgcccctagacaattacagaagcacttaccagcatctctcattgacttcttatttaaaattcccagggccacagcaggcattcgcatccttttatcggagacagctacagatcaatgacatgaagcaacatgggattttctgtaggacatgacaaatgctgagattgttgctaagcagaagatagacattcagattccagtagaaaatagtgttgcagtggctctctaacacaaacttttaaggcaatgacaagaacatacaatggaaatattatgagatttggtgtcaaggtatttgagtttgaacactggcttcactatttggtgtccaggaagctatagttcttctgtaaaatgggattgaaattaaatgacaaactcttggcagcttgaggatctggagatctctttaggttgtgagatgaaatgtatatatgtgtgaaatccctgctagggtatgtatatatgtgtgaatccctacgaggttgtgaagttttaatgtatacatgtgtgaaaaaaaactttgtgagtgacagagtgttttaaaaatatttttgtgctaatgggaatggctttcattccccgcgtagtcataatggaacatccttttcgtggccccactgcttgggtgatgacctatcgatgcctgtagtcacctcacacagaatgtagtgactatgcatcggtatgattagcagctgcatgcagtgtacatccttgaaatgatgcacagaataaaattcctatttcctattgctgttctcagcccagggttttaagggacttcgaacctgcaagataacattcatctgatttgcatttttttcagttaagttttcctctctgttctatagatcagtggcaaaaagtatggcttgttttgttttaattttcccctaagaggctttctcccttatgcgtggctgcatcacagaacgctacctgtcttcagagaccagctgtagtgccagctccaaggaatctttccaccctcactcctcagtctaaaccccttttctctccccacaactcctactctctaccacattaaaatgcaagtaattccttccccacagcatgctggcatgttgcttggactgatttgtatacttaataatagcatgagcaaacacagctacatagctttgtagagttaaagaaataataagagcagatacacttttaggtattttatatatgttaactcatataatcccctcagcaatcctaggaagtagaaattattattctccccattttgcagatgggagaagtaagtcaccaagagattaagtaactggcccaatatttcatgggtaccatgggggcagagccaggaattggtaattaaaataataggcttttaaactatgaggttacaatgagccctatgcaaattggagatttctataggttgtgagttcctggatgtctgaggcaatgaaaatctgtgtcatctattcacatttagcgtaagggctccgcatagtaggtatccagttacacgaaatagctttgcattgagaaaatcgccccttgaaagcttaggatgtggccacaaaatgccccccttgtcctctgtcaatatgtttttagtatacgttctgcattcctgctcaatatgcttgtcagagcattttaaaacctcacataagcactgcttgagcacctctctgtgagggaggccagtgttctgtttttttgtaagtagctgtgtggtaaagataaggcatacttgttgaaattagggttacttgagtctttagtggtttatggatcagtagataatagcactataacattccagctcattcgcattctgatgaaaggggaattgcatggtgttactttattttcaataaagtcaccaaatgtcaatgcatatgaaaagaactctggccatagtcctccgccccttccccccatccagtgtgatctggtggactgaggtcacagcccagactatgggactggtgggtgcgcattgccatctgtcaggatgatcctggtgcccaaaaattagtgaaagaagccatagaattttctcaacagggacacagactcacacagacctcctcagtgttagttcataaggggattttctttaacactttagatacagaaacatgatatttctttagggcttacttttttggcttatatgagttcccaggaaaacctggaatattatctttgtgtttcagggacaaaagtggggattggagcagtgaggatgcataataggctgttttctcctataggctgagaatacctgaaggtaaaggctgcactgaagcccctgtgctttctcccaggtggcgaagtgttggcctggtgcactgtaagtctgctgtgaatgttctaatttaactcttgactttaactcttcctaataaaactagttgtggaaactgaggcatagggacaatgaaatatgtggccaatgttatagcacttgttaatgccagagtcagaactaggagagggctcgtcctgcccatctctctgtgtaatggagaatgaggagcccctgggtgttgcagggtctgatggagtaaggggggcctctccgaggcttctgggcacctgaacaggaggggaactgaggccctcttctgctggatgctttctattgagccaatcatttttctgaaagaattgggggaatgatactaggaagtgctctgtgaagggacaactgactgttttgtgaggccaaggatgccttggatccattcaagtctaatttctgaagacaggttcatttcagaggcagtggatcttgatggctgtcacagaacttacggtggcatctgtttgaaccaaccttttgagaatattccattcttaggatgacctgtggcctgactagataatgcagcgtgcctgtgaatccatatgtaaaataaaagtatcaatgtctcatatttgtatcatatttcaccatttattaagctttatcataaacatgatctattgtgatccttatatcatcctatgaggtaatccttattttattgataaggattccagggttcagaggggttaagtacattatccaaggccacacagttaaaaagtaatcaacagcaaactagaacagaggttgactgtgtcctagagaaatgttattcctactacccagaaattgccttgtatttatatgtacttattgcataacaaaattggactatacactgtggacacaaacttagattcccagtcaaaaaaggagagtagtaagaaaaaatctaaacaaaacagatcagggcagaagtttctcaggcctctaagacaggtgtaggtatctacccagaggttttagaaaaggaatagtttatttttagacaaaggcaagatgagagagactctggagaagctgcagaagggacctgagtcttgaattaggctgtgggaaagttaagacttatttcctttcagtgatagacaatttggtctcaagtggagttttaaaaatcatctgtatcttgtggattgaggattgatttgggaattatggcttgggctcccccttctgcaattagagttttcactatggcagtattttccatgagaccttaataggtatattgcataaaaagaggttcatggtcaaattgttgtgagacattctccttagggttcttttcacgtgactaggaaagattaggctcacagacacgtagaagggtgagaaaaatgggatttatttggcaaaaaggaaaaaaagggaaacagggactctcaacaaagcaagagtcctgttaggaggcttcccgcctcacagattgaacccctggttcccacccaggaacaagaggaaccaggctcctccctcttgcaaacggtgtgaacctctgtagctccaccccattctcccagtgcgcaggctggtcagaggttctctagggacccctttacacttgactgtctcattccccctgaaagaagtacatctagctgccattagaataaggataaggataaagatggagaccaatcttaactgcttcctgctgacagggggtgctgttttgggaaaaatgacagtcagagctccctcagaggcctatgtaagggtccccagcagaaggggccatcatccaaagctccggttgcaagaccatttggagtttgatggcctgaatgtgagaagagacagactgggttattagaaaacatgtatttaaatgaaacaagtcgggggtgaggacagctcaaaaatcctgaggccttttaccagtttgcacagagagaggccaaaagcctgattggtaaaacaacttttacccttttaccatcatgtcaggcttctgggttgccttctcccgagcccaatactaagtcaactggtttaaggtttgggaaattaactttcccagtttggagcctgcatccaaggggagtgttctgtagtatagagacaaaattacctatcagtgaagagagggcagaggaggagaaaggaaaaaataagctgcttttttcaaaggagttccaggggttcaggatgcatttaaaggggtacggagtgaagatggatggctactcatctagaaagaggggagcaggcatccctggttcccttctcttcctagcaaatacctggggtgcgtgagggagagaaggaagagtgtcctctttccctcttccatccttgcatctctgagtcctggcagccttggcacgtgccgcccatggttgccaaagcaggcacccatgaaacagggggggcttagagaataggaagtatcttctctcacctatgcctctattccccctactgtcagtagccttggagttccctagacctcatttgtgccagggatactagcatgacctttatccatgaaatgggaggcttggcttaattggcaggaattagccattctcacctcaactgtgccttttaacctctgttatcatggcctctggatcccttagatccaattttctttcctagggctttgacctgaagcttgaaattgagtttgggacaataatgtgtctcatggggaattgcatggactccttatcataagccaaatgctgaggtaaagctgcggaattgagtcgtcctccaagaagggagagaaaatgatgtcttgtgacatttccagataactggtgggtatagttatgcttgctaagatttgggtgcatggcgcttggctttggttagctcccttggtcttactttcccaaaaaggaaacctccagctgatggatatactatttattcccatcacctggcagaatttgcacgataattgctcagaactagaatattgatccagatttctacattacccatcccatttgctctttctgagctgcagccagagattgctggttggttcacaggaacaagcaggattagtctaaaatgtaggcaaaaacttaaaaataactaatgaatttagaatttaatgacaaaggtgtgagaagttttcaagcatagtttctctccagtccttatttttgttaaaaagaaaaatcgtggtaggactgacttgtttgcaaaatagactttagtcttatatttggcctgattatttgcataaagtacagcaagaatatctgtttctacatacaccttttagattggttttggtggaactctattccacaaggaatttcagataagaccttttaaagctgagcctaaccatgggtttgtatcttcaaatacctatgagttgggtgatcctctcctcttaaggtcccaagataaatttggagctcttgggcctgttagaaagtgacattctctactgaccacaggtcaggaaccctgtacaaggactgtgtagacaagagtatgaagccagtttttttccccagagctttcattggctctgcaagttgagcttgactccttaaaggggagcatattcttcagtcaaacccttggtaaaacaaacagtttctgcaattgtgtcctgttgcaaaagaaaaatggatgcttattgtactgatgcaaacgactatattgccgtaagttaaaaatactcacagatagcttccaaattctagaggaaccaggcagagagaaacaaacatgcttcaaattttcttcacaggaggatacttactcaattattaaaggctgtaaatagttcaaaataagtttctttgactctgaaaaacaaaacaaagatcagcaatattccaagtaaaagttggaaagattgtttcagttttctcagttcagtctgtttagttcttgttttgcttgatatttgtgaacactacagctctttgagtcctgtacatttttcttttattccactgttacaatctccaaagttatcaaaaacctgtatttaagagcccctgtcaaagttctatagctcattataaacaatcttttgaaaaggattaaaacaagtcaacaattgtctgtgaataacaaaatgtccagggtagttacagttagaaacacaattgacaaagtttggttatctctgtggtttacaataacttaatataacaagcttgttatgattgatagcatatactcagatattagaattttagaaattccatacaattttggaacatatattagcattattcaccaaaatatttcctaaagaagattgaacatcattttggcaatccaacgtacctaaacatgttaaataatcctgtttacctctcttttctggacactccaggggccctttgaagtatccaaaaagccaggtgtcaggaaagacaattttgtaactaaagtttgattttgggaagcctgataagtatgtaagaagtttaaaacatttgatgttctgaaatagaattccagattatgataaattattttacaaaaatgatgactcaggaacttaacaagcaaaaatccttttatagccctttacaaattttgctaaagaataaattagtgccttaacagtcccttgttgtgctttgatttcaatcctcaatttacagaaaaaccatataatacctttttgaatttagtcaatatgttcacacagggaatttttgcaagattaatttttacactccttctactgcttgtttgaagttttagctttcttatctaatttaaaataattctttaatcctgggcaagaatttacatttttctcaaagattaaagtcacgtgaactgaaaggtaccacagcttttgtcttcccttttaaaaacatttgatccaagtgcttatcttcctttaggacaattaattagagctttttttatagacatcacacacaaaacacatatacaactacacccagtccccacaagatccttcatttggcaatctcatatttggattattagcctctgagtgctttaattttgggggttccatgagaaaaacagaggtctttcccctctcatgcatgcattaaaagtggtgaggcaaaatggagaaaaataatttggttgactgaaaaaaagaaaaaagcactttttccagaaaaacaaggtccaagaaaaggaaaacataaaggccttttaaatataactataacttggatatccacttttaattaagctgagcggtccttaagaaaatccttttaactcccttaatactcgacaagtggccaatatttctggctttcagattttactaaaggctcagagcaaggaaaatccaatgcagtttgtggaggggaagggaatcaacaaatagcaaaagcaaaaaagtcatacagatatcaaaccctgaagaactcatttcctaagccaggattgaatcccggccataggtaagctaaacaaagccttgccatgtggttacatgccacgcccccgaggacgtacaacaagatggaggcccgcaaggaagtattttacagaccatacagaaagactgcaaagcacaccagactggctacaacttaagaccagcctcacaaatcctttttcataattaaaactttacagagaatataaacattgatccttatcattcctagcctagtaaaatgtcttctaaaaggaaaacacaaacaaaaaataaataaacaaccaccacgcttaaaagtcaactcctgacctgatggagaaaaggaaagaaaaaaattttttttaatgcctgggaagaacctcttattcttatgcaaatgcgttcctccaccggggagagaaacttaattgctctccaatggggttgaaccccttggccaagggaggtgaagaggccatggatgcatagcattccccagccccagccgggatgggacggggaacggggagctgccgtttgcccgtccatccggaaaaaagaaggaaaaggccaaggaaaggctgggttggactgaggccgtcttttctgacccctgagcgtgacagtggtgggggcacagtttcctctagcctcagaagtctgaggttgagaaggtttagaaatgagagggaaaggccgggcgcggtggctcacgcctgtaatcccagcactttgggaggccgaggcgggcggatcacgaggtcaggagatcgagaccatcccggctaaaaacggtgaaaccccgcctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaatgagagggaaagagatttcttgttttgcatctcactcaccctttctcaaaccccatgttctgggcaccaaagatgttgtaggactttctccttaggattcttgttacacaaccaggaaagattaggctcacagacacacagaagggtgagaaaaatggaatttattgggcaaaaaggaaaaaaaaaggaaacgggctctcagcaaagtgagagagtcctgctagcaggcttcccgcctcacagattgaaaccctggttactacccaggaacaggagaggcaggctcctcccccctgcaaatggtgcaaactttcatggctccaccccgttcaaccagtgtgcagaccagccggaggttctcctggggaccctttatatttggctgtctcaaaataactttgcttaatgttgtgttaagccaagcggaccacagtattcactgggcagattactccaaacctttaaaatgccagtgtgtattgtgaatctccaagagatacgtgatatgttacttttcaaatttattttttggccatgcagtccttttgcagattgctcagcacaggacatgataattttcatctcggattttggaggaattgtatcctttttggccatttgctttcttgttgtttagtgtgtgtgtgtgtgtgtgtgtgtgtgtgtgtgtgtctctaactttgctccctacctgtgagatccctgattaaataaatgaacagtgtgtttatttctatatattgcacaacttctattaaagtgtataaagtaggggcttaataaatacattgatttgaatcaaatttgatgctgtagattcagaagctagggaattacaggttttgtagagaaatctatgaaaactcagccacaattttgttacttctgtcctttctaacagcttgtagaaaatgcctttctctcgagagtctcatagacaggatcgtgatcttcagaccatccttttgaattagagaggttattagtggcaatgtcgttaagtgaaatttaaggggagaaaacctcagatggctaagaaacttttctatgctgggaaaagtaattaatttcctaacctggaggtgactggatcttagtccacaggtgatatgtctgttttgggcctgtggtggtgataatttcacctaattccctacttgaacttcaaatggcgtcacattgcccaagtgatgtgctccttcctccctcctctctactccgcttccttctctactccctactctcaggtgctttgaaatgcctctgctgcagcactgttctctatactgtgtggggggaggtttggatgagaagagaaacatataatctcaaacatacagaaaaagttacagtacagcagaaagagcatttttttcctgatccataatcccaaacatgtttttatagccaaaagattcatttcacgatcaggcattgcatttagttctcttgccttgcttccttcagcctggaacagcctttccattttgcattaacttcctaccttgatacttttgaaatttacacagcagttgttttgtagaatgttcccctatgggtttgtctaatgttttttcattgttataattaaaagtatgtggtttgaatacctccaaaaattgcaagcttcatgaggaaggggatagtttctctccctcttcctccagactgtccagagcatgatacatatttgctgagtgaattaaaagtagtgtttgaccatctcatcataaattactcctccttccagccttgaagttccctgtcacattctgtgttggatttaatttgcttcctcggtttaaaattatatatatagatagatagagatctgtctatctatctatctatctatctatctatctatctatctatctatctatcttctatagttagttctgtatctttctgtaacctcttcctgttgtcttaaatacgctttaaccaacgaaaaagtttttccacattttttacagaagcacaacatattgacagtacataaatattgtgttcaactttttcattttgtttacataggcatcgtcatgtgatcatcacctaagaactagaacatcagcaggccctagaagcctcactcttgcccctccctttaatatctcaaaggtaattcattttctgatttaaattaagcaatttataaaacatttccttatcgactttaagttctctaccccttcagtttctttcaaatttaaacaaaaccaagcaaaaactttagcttatttcataataaacactaattgtcataatatatagcattttttatatatatatatgtatgtatacacacacacacacatatgtatgttttcacatgtcacatcctttgatcctctccatctaccctatcagatagtcagcacagggatttttactgctattttaaaaatgaggatatgaggcctagagaagggaaacctcctgagccacgattttccaatttccaatttcatcatagaggctatcacagtaatcttggcttttctgtaatttgtcaaggccagacttgacaactaaaactatcttctttgaaatattttgacaatagagcactaaacttggacctagtacacacaaagtgtagggcatggcaagttttgccaaatactcaatggtcaacttgaaccacgtaatttgggctcttttttgtaaataatattagtggtagctcacattgtctactactccatagttcctcaattatttcacatctattatctcacttaataagagttgatgataaacagcatttgctgagagcaatttgtgttcctggatggtgctaagcactttacagcaattgttaagactttcctctcaacaaatggtgaggtagttgtattagtttctatcattccccagcctcagtgtccctaagtagagaaatacttaatcatcaaattgtcctctggagagagggtacaatggaacaattccttaccttgtttagaaggatccatgaacccctagcacatcagtcttgaattaaccatcaagacagtgagctagttacagatcttcctaagaggtcagtatgaatattcctcacctcttctctcaggctctccagtatcacacagtcaaacaaactaggaactgcaagttcagtgctctttttaaattgctctttcaccttccactcactgaaaacccagttctagttctcccttgtgagggacaggacttcatgatggtatttcttacctcaccccacagagcatgttgctattcaaaatattaaagcacaaaagggaatcaatctgctcacattctattccaagcttctaaagatggcaggtggtatattatgtatatatgtcctctcagagtgctgagcactttgaagctatttcctaaaaagggagaaggcagtatctaagaggagtgtgctaatgttttcttatgaactttgactctgctgttatatcagtaaaggttagcagtactggcttggtaagctgaaagttggggcatttcattgatctctccatgtacctccactgctaggcatttctggaatattcagtgcttaatgacaaggctgtgttattttcaaagtaaatgttgaaaatagaaaccatatttaggttaaaacacctttctttaaactgtcaaaaaggctccataaatcatttgttgagtttttaaaaagaaaaatcataccacttaaaatatatttctaattaatgcactgtaacattaacttttttgggagtacagctctttgaatattaactcatgtatcgaatcaagtaaccactgtgacaaacaggatacaaaactgttctgtttctccaaacaactctcatgtgcccttcttttgcagtcatactctcccattatccctaaccccttgatctgttctcggtcactccagttctgtctttttgagagtgttatttaaatggaatcatacaataggcatcctattaaggttggtttatttaattcagcacaatgcctttgagattcatccaagttattatatcaacatatataatgctcattgcttagtattgctgagtattattctatttttttggatgccacagaatttgttgatccattcacttgtagaatgacaattgaattgtttccagctttaggcaattaataatagggcttctacaaacatgcaggtatagctttttgtatgaaagtaagttttcatttcccttggacaaatatccaagagtgagattactgggttgtatggcaagtttatgtttaactttattaagaaactgctgttttccagagagggtatatggacatttcatattccaccagtatgagagttccaattgctttgcatcctcttcatcacttggtattgtcagtatttattttttaattttagtcattctgaaaggtgtattgtggtatctccttgtggttttaatttgcatttccctgatggctaatgacattgaatgactcttcatgtgtttatttgacttttgcatatcgttttggtaaagtgtttctttatgacttaaacattttaaaattgagttgtttcttgtatgattcctccaactttattcttctttttcaaaatttttctcaatgtcttagggctttctattttcatataaatatcagaatcagtttctctatagctagaaaaaatctttctgggattttgattggaattaactaaatctttaggccatcttggagaaaattgacttctctatgttgagtttctcagttcatgaatatggtatgtctcttctattattttctagtaccattttaacaaattaccaaaaacttagttgcttaaaaagcacccatttattgttgcacagtttctgtgggtcagaaggccaagaacaatgtggcttagctggttccctgcttagggtttcgtaaggctgaaatgatggtgtcagcagtattgtgttcctttctggtgactctggagatgaatatatttctattcctttaatagttattggactattcaggtcgtctgtttcatcttagctgagctttagtagtttgtagtttttgagatgttagtccattttatctaagttgtggaatgtatgagcctggagtttgtaatattgccttattaccatttgaatatctccgtgatcactagtcatgtcccatcattcatttctatttttagtgatagtaccttttttccttacttaacgtatcacctggcttgaggtttatgttttattgttcttttcaaagaactaacttttggtttctttatttttctatatgtatatatttcctgttttgaaattatttgatttctactctataaaatttcctttattatgcttgtttcatttattcttctttctgtagtttcttaaagtggaagattagattatgggcttgctatctttcttcttttctaagataagcctttagtgctacaaattatcctctaatcactacattagctgcatcccacacacttggtatgttttattttatttttgtcaagttagaaatattttctaatttcccttacaactttcttttcaacccatatatactttattttaaggcatgtattttaattttgaagtgtttggagattttcctattatctttctgttattgatttctagtttaattctatggggagagaacatactttgaattcttttaaatttgttaaaatttgatttatgatacatgatacggtgtatctggtgaatgtcctattgaaaagaatgccttattttttacttttagaatcctcaaacagttgttccatcaaatatgcccgcgttttataactgcaaagacaggatgaagaatatttacttcattttaccccaaatcagagtcttccatgtcactttgccaaaactttcatttgctgataaatattagatttgaaatattctgcacaaggatcctattttcaaaaaaagccctgtaaactccacaaaagactgatgatgaaaataactctcatgtcttactaaatgctatcccttttgtgtagaatggaataattagtagcttttcctgttttcttcaaaggcttgttcattgtatcttaggtaaccacagaaatgccagacctactcagactttttgcagtaacttagagaaaataaaaggaaagatctgaatgggattagggcaggattgggactcaaggaagtgatttgactacagggttgaccttttatggggatggccttctggggtgtattccttggcgtgaatggccaagttttcaaaagtgcgaatggtcgtagttttcagtgggcaggtcatagaaaagggtgtcagtcaaccatggcagaatgaagcaggtttagcagtttcatggttataggaggtttatctagctgactgcaagtctttacagggacataaggtaggctcctggaagagggtgctgacgagcaccaggctgaaggcctaagtgggtgttttctgagtatagagctatatatgggatcaggaaactgagggacaaatccagtcctgtgatctggtgaagtgctgctgagcggaaggcaggcagaacaaatggtgattcatggcaaatcccacccttggcacagcaaacctagtttcagcctgtcacctgcgggctaggtgagagaattcagtggtcagagtgatgcagataaggagatgctaatgattaccaagtctagagaatgcagacgataaaaagtttcatatgcggaagtagatgttaaggtgctgagcacgtgaagacccatctttaacattgtcgtcgattacagagaactaagtacattttaaatcttcttgctaaatgatatagtcattaaagttgatatactgggaaacaataggattaaatatgagagatgtaccaaaagataagggagggagcatgaggattatcatgcagtaaattacacggataatgcaggaaaggctgggaagatattatatgtaggttagaatcatctgaagcaacagcagggtctgttaggccccattgcaataatctaaagctaagctctaatttagacactgagaatctgtgtttattacccacgtccctttgctttctgacagttcctccatctctgacccagcaccctctcactctaagacgcaacaaccaaaagtgtattactctttacgataataaaattctaaggctgaatacaagacaatgctaaatgacccagcattctctgagaggtttcagatcagccaggcgcctcccaataacattggtacctttaatctgtcaaaaccagcctgttcaatcacgtttccttttcagtctgctttattctaattcatcacagggcaggactggccctggatgtgtgttcgcagacaggttatctttagattagctttgccttggtgacctgactctttgctgccttcagcataatccagttactcttgggaatatcaattaaggccctcaatcacactaattagaatgtcttataaatgttgccttaggaattcagcagcttataaacaggcaaactgggaaaatctagaggtatgtgggggtttttaaatagctgacagcaatttgggagggcgtattgctttagcatagctgagaagtggggctgaaattacggttccctgaatgcagtgaaatctctagttgctctttgctggcaagtttaatgcagaattattaattacatttattaatgacttggatgaagatataggttgcatgctgatcaagtctgtagatgtcacaaagctaggaagatagcaattattgtgataacagattcaggagccaaaatgacttcaagacagaatttagcagccatctatctaatacgcgcctggcagtgctctataaagtacaatttgagggtcatgttgctcccctactcagaaaactttggtgactccctatttgctctttaaatcccaagcctttggcctgttatttaaggctttgccatattatgattctaccactgtctgctttccaacaaaatcttctgtagttctttttctaaaaccttgtgcttgagcaaaactcagttctttatatactattttccatttgtgttctatgctttcactacctttgagcattattctccactgaaagtttctttttctcacatgttccttctgtctcaagtctaaatatccataccagttcaaatgtcacctcttgtgtttcgtcttcttttattgtcttggctggagtgacctctttcctttgctaatcttcaataacacttatctgttcctctctatttttatcactttttacttcatattgcagggggttttttttttggtgcacattttaagtttctgttagaccctgcctagtgctagaatttctgtctggtaactctttttatctcttaagtgtctctagatgtgtgttctatacatagttgatgatactaaagtgtcttgctgggggttcatctttactgtggaaaagtgcctttagagaagaccctacattttgcccatgagaggcttcgtagctgtatcatagcaacttggaaactcaaaggataaatccttgaggggacggatattccattttccatgatgtgcttatttcacattgcttgcctgtatcaaaacatatctcgtccacacacacacacacacacacacacacacacacacacacacatctgctacataaccacacacacacacaaactaaaaaatttggaaaagaaggagaaaatgctcaatacatgttttattgaataaatgaaagactgatggagagaaaaagatttccccaaggtcataatataagagctggaaggaagaggtgctgggaagaaaacatcatttaatttatcagatgaaacaacagcttgtgatatgacgagctcacctgtgatttgtgtacaaccaggctaaaaaaggaagcatgaaccagagatttttggagaggtgtggtcaagagaggtgacgggagttggaaacttgcatagtcctttagggtggccacacctcttggattccttgtgtagtttatatcttttgttataatttaatgctcttaaaattggcccattttaaatgatgttatatggtcatcttatttatcaaatacctctttgatctgtttaagctgctgcatacctgtggttgtgaaacttgtggcataggctatttgagataataatctttgtagttagcctaatgtggatataaatagcatctttgtcacttactggaaatatgagctggacaagttatcaagacctctgcaagcattcttatatggctgttaccttcgacacagaaagcagagttcttgagcatggaatttctgcatcatcttcaggtttcagtatttataacccacagaggttttaccagtggccagatatttcttgggtagtagaaaaagaaatacttcacagagctgtcaaatctccacatcttcagcattaaatatcatgcaaccaaatgtaagggtatggttcacagcagttggctgtttcagctggttattaataggaaggcgaaagatcatagaaagttgactcctccctcatcatttctgtcttccagtgagaagaggagagcacgaacagcaggaattagatttatatattttccttaatataaattcacagtatggtagattgcagacaaagtctgaatccaggatttctagactttctatgtgtctatgtgtcactaaaagggaaaagtacctggattgtaaagtattccaactagaaatagaccaagggaatgcaaagaggggtaagaaggttgaatttatctgccagaaatgtaaatcctggtcaaaaaatccagatgaatattttttaagtaggcagttatagttcagtgaaaaagagagttgtggagccagaaagctggagtttgatcatagctctaccactctctagccaaaggatcgtggtgatgttattgaaacttgtctctagccaaaggatcttagttatgttatttaaacctgtgtattaaacttctttatctgcatgtaatatgggaattgaaaaacaaacaacaaaaaaacagaaacaaaataaaacctgtcttattggttggttctgacaatgaaatttgttaatattgtaaaattcttagaacagtccctagtctatagtcagcaggcatgaatgctagttattattatttaagcccttgaaagtagtaagtgatttcccttacctttgtatttatggttacaggatgacacttctgtggtgtgtagtgagtctctacttttatggaatcctgcaaagtgatgcctcaggtaagtgaatggcttttgacaatgtattaaaatgcaagtcatgcgtagggtaatgagtccactcttcctgaaaatgaatttaaataaacataatgttattcatgtccattgtcttctgcggtagcaaataatcataaagcagaataatagaattttgatgatggaaagaaccattgctgtctctagtcttcatgggatagagtacacagggggcagtgggccgctgtgtttaaacacaggtatttttcattaccttcacactcagccaactagaatattgcttttttcccttacctcaggtcctatgggggaaaaatgggagtgataatagcacaatctgtttttcaaatttgagccagtggtggaaaagttatcagtggtaataatccattgagatgttaaataaaataatgagtttttgtcatattgtttctatataggaaaaagaaaggatctgtctttagactcattctttctctggatgttgctttataagaggaaccagctaagacctttatagagtttgaaaaccaaactcagtcatcatgggcctggatcacgtgaaattagatatggaagagacttgctatttgaaagtccatcttttcagatctcctcttcttcccagaattatgcccagaatcactctctatctctgactattaatcattacatttcagcctatgtttttggactaatcaaattcttagaaagtttttagtacataaaactgaaatttgtctctttgattttagtatctaaaactgaaatttgtctctttccaaacatttacttggttcaactgtaggactgaaaaaaaaaaaagaaacaaacaaacaaacaaacaaaacaaccaaaacctaatgcaatggttctctaattgtaatgaagggaacctagaggtcctcattttataaagcttttcatgtaaaattcccctgaacaccataaaccatactttacatatcgttgctttaattccttttctttgtgagagggcttctgcaatgttaagttagctaccatataaccatgacctcagtgttctgcaatatatgccttcaactgtttttcatatgacatggatttgagctctcctaccatcctgatcatcttttctgggtgcgtttcagcttttctatgccacataaaacattgtattagaaaccaaaaatagtactaaaggagtggtataagtaggacagagtacagctcagtgctgaaactagcagtaacttctagccttgttggccctttggggcttcacagaggaatggctgtagataaccggagatgttattcggctgggatgcgctaggagacagctccttggctgtttagtccagcatctgtcctgcttggttaggtgtcgcgtttgataggtgagtttcttgatgtcctgattttcaaatatgttaaatataattcttgattttagtttgttcttatttgatttagttctatgtttgaatgctatctgctcacagaggcttccttgaccatcttaactaaaaatccctaccagtcactctctctccctccatcctgttttagttttctttgtaacactcacattccctgatattatattagccttctttctcttctctcctcctcctccctcttcctcttctcttgtttcctcctccttttccttcctttttttcttcctgaactccctgtccttcctccttttctgcctcccttctttcctttctctccatctctttttcttcctccttccctccctctgtcttggattttaagctgcctgagggcaggaacttgttcaggaacttttgtttgttatccaaacactcagaataatactgacacatagacacatagcagatgctcaatacataggtgttaaatggttgaatacatgtccctttacatcctttcccctgcccccagactgtccagttttataatggaacgtgtttgggttcatgccagtaattcatcatgtggttttatgtcctccctcatcctgaaggaagagggacaggtgactgtgttaccattgctgaaggatcatggaggttccagaagctaatgagtgctggtgccttcccagcagtcctgaccatgttacttttctgaatgacctttactgtaatccatccaaggagtccccagcccccacctcaagtgctgttggtaagagagctttctatccaggaactgtgactcataattctgccaggggaagctaacttcttgaataagataagttctcataccagccacattgcgtcaccgtgggagcaggaaacatgttgtaatcccctcagcccatctggcacgtactcatttgccttccttatgaagaggtgtattgtgtctgacagtgatgccacttcctagttggagggagaggaacaaaaaggacatgttgttgacaaaaacgaaaagagcaactggctctgggctagtgggggaagaaagaaatcattgcgcatcttgagggatcaaccaacctctctgcacatgaaagtattgccttttacaaggcatctgtggatgctgacagatttgttggtctttcatgaggctctccctgtgctcaggttcccatctcaacggaaacacaggttgatgtgaggaacaaagcagaaatgttctgaaaaccctaaagcaatctacatgcgtatcatattagtaagacatttattttgttctgagtccttccatgtgggccttttaagagaatcctcaaatataaaaaagaaaccataaaagcataagaacttagcgccatgcaatgtgttttcacacgcagtgaactggccgtgaagtcatacgattctgacttccgatcatgatttttctggtagcagtactgtgatccccttatcccctcaggaatgggggagcaacattttcatcttaggtgatgataaaagcaaatgattttttaagaaagctttatttccctttaaggaattaaagcttggataattataatagcgattctataattataatgtgctagttatagtaataataataaagctccctttgcttaaaaaagcagtttgcattgtacatattcaatgtcagtctcacacccaaaccatggggtagtcagagctgttgtaactacctttgttgggtaagacaagttaggatcaaagtatttaattgtattactcgaagtcacacagctatacttagcatgcttgtgacttcaacgagtttctggattcctgacatccatattatttttacgaaatatgctccagttggggtctattagaatataaattactaagaaaaaagattaagatctaagggatcacaggtaatcattttgcaaactgttgaagaaccactctgtgataggtttctatgctttgtaggtaaggtatatccttacacgcttatcctgccccctcacagcactgaaacattttcttcaggaggaaaatgattgtaatacaaaattcaaacccaatattcctttttttgcttattatagtattaaatattttcactaataaactcgaagaagttctgtttgtaagacttcgaaatggaaacttcagctcaatacacgtctcttttgctgtgcctcattggcagtgtgtcaggaagctgaactgttaaaagctgcctttggagtagacataaattttggaacctgtgatcccaagttgaggaggtaataaaaatagcaccatatagaatatagtgaatttaaaaaatattaccatatcaaaattatttgctggacaaatcacatgaaaaagagagtacactgccaccccaaaatgcaggcacacacacggatctttgagaaagattttatttcaaagtcaacagttgactgtgtgccaggtgcagggctggatttcacacacattatcaggaacttcgcaggaaccattgtacaggggtaggggctggagactcttctacctgtttgatagtttaggaaatgaagatccagggaggtggcccaagtgctcatgatagcctggcttgcctgatagagccaggctgccttgactccagaaacagtgctcttttttatttttccatactataattgcctttctttaggactgtgctctgctactagaagtaagatcctctgattccttttccattatattttacaaaattggtagagaatggaaatcatctatccaatgattgggagtgaattatacaatgcaaaataaataaatagtaaaaaacactgtggtttcctagtaattgagagattcaagttctgttttactctgtgacttgtttgatgacagtaaaggggtcatttcatcactttttgtcattgcatccttatttataaaccaagccaaccaaccaaacaattaacaaacaatagcagcagatcccagtcaattccagtttcttgatttttatgaaggaacactatgcatcatggacacacacagggtatactcctattagctacttaaattctttctaataacaatgttaacaatgatttcactttattctaaagatcatgcgtttgaccattttagattgtagaatccagggttagtaagaggaatttcttattttaagaggaatacagtaaagtttgagagaaggaagaggaaataattaccaaatagaattccgtgagagcagagaaagttaccaatcctatcaggagatattggggaagacttaatcattgctccttcctaggaagaaacgcatctcttatttgggaatgaaatagttcagggcaactcaaaagatagtgcaaaggcatttagaagccaagctggaaaggtaggttgggaacaaattatgcaggacgggaattacttcaggtaaagagaatgtccacatttaatgtattttggttatagttggctaggtttcttttcctttttttaaattctgtcgtatttttgcaaggacatacactattattaattctatgtgatggttctttcaccttttggtaagaattcagtttgttaccagccccagtggcctcattttatttgaatatccttgctttaataactccgtgctcagatatacttgtgacattgtgtcctgtcccagttgcccatggctggtcatcctgaacactcttcatttctatgtaatttagtccaaacatttggaaaatgtatgaagaatactgtttcattttattcttagtcctaaaggtcattggaattacagaatttcaccctgttgtcatttaaatgatgcctctcggaagcagatctcttcacttttttttttttctttagctgtgtttatagcttgaagcacacttatattttagttacttatatttcccaagggtggatttactgtagcctgattgaaaagaaatttaagtaccacataattggcttgatactgagtttgcaaatacacagcttcttgtatcacagtgataattctaagtttagaaaaatgacctggttctttttcacatggctgtgttagttaaaggaaaccagtatttttgtaggaactcctgcataccgttgtaggaaaaaatgtttgttttacaagaatttattctaccctttgaattacctttgtttttgctatcctttccctcactcccccaaccctgaatattcatttctaccatattttagggaccagattgccaccttagcagtgactcactaccaagaccagtttctacccacttttctttcaccacttaaaaagtttcttttctgtttaactgattaactttttagaaaataaaatatatacccacccaggataacaacacaatgattgctttatttttaaatccactgagtgctgccatctctcatttatttttgaggaacagtgagaaaatggatacatttaacaaataatttgggaacctcagtcaccttcaagttacctgctatccaaacctataaaagctgatgtacaaaattttctggctttgcctttgcgtgttttagagatagtgggaataatgaaaatgcaagatgactacgacaatgagagaaaataaataaaataatcacttcctcagcaacctagaccatattctgttgtgttttatgacattcatttctccttctaccataggaaccaaaatgcttggtatagctatacattactgggaaataaatagcacttttctgcagtgtttgtagggtctgaaatagtttaaggctcttatccatcagcccatttttttttacttctgagatactttcatatttatttatttatttatttatttattttttgagacggagcttcgctcttgttgccaggctggagtgcaatggtgcgatctcagctcacctcaacctccacctcccaagttcaagtgattctcctgcctcagcctccctagtagctgggattacaggcatttgccaccatgcccaactaattctgtatttttttgtagagatggggtttctccatgttggtcgggttggtctggaactcctgacctcaggtgatctgcctgcctcagcctcccaaagtgctggaatggcaggctactttcatattttttttaaagtgctctttaaggtttatagtagtgttcattttgatatgtgcaccaagatactggtgtttgcgtttcccccttcccttatgtaagaaaatgttatggtctctttgagatttggacttgccacccagtgctaccaagactgaccaatttagtctatttgccaattacgtttcctcagtggaaccttctccaggacctactgcatacgtgtagatactcaagaggaaagaaaaagaaaacaggcacatcgatcatgattttttttatgtgtgattttttctgttaactattgctttttattaatttattatggtgggttttattttttcctaattacttacccttgcataagaagtataactatgggccaggcacactggctcatgcctataatgccagtactttgggaggctgaggtggggagattgcttgaggccagaagtttgagaccagcctgcacaaaataataagaccctgactccacaaaaaaaaaattaaaaaaatagctgagtatggtgatgcacacctgtagtcccagctaatcaggaggctgaggtgggaggatcacttgagactggccggtaaaggctaaaatgagctgtgatcacgccactgcactccagcctgggcgacagaacaagaccctgtctctctctttctcaaaaaaaagtacaactatagttgaaatatagacctttattattattactagatgagagattaaattgtatttatcatatgtaaaatgacatttcgaagtatttatacattgtggaatgactaaatctagctaattaacatatgtattacctaacatagttaccatttttggagtgagaagactttagattcactgttatcactttaaagcaagcttgtccaacccgtggcccgcgggccacatgaagcccaaaacggccttgaatatggcccaacacaaattttgaaactttcttaaaacattatggactttttgtgattttcatttttagatcatcagttattgttagtgttagcttattttatgtgtggcccaagacaattcttcttcttccaaagtggcacaggagagccggaagattggacacatctgctttaaggcaaacagatatacaaattattgttcccaagtggataccaaccattattaattattatttactgtagttttgtttgccctttttttcaagggggagaaatctttaattgtttgccatagacttatctgatgaccagatgcaaaaacctactagctttaaattgatgcacctgagttaacctgaatgccctatccttctctagcgtttgggacttcagactatcccaaaattgcttaatggactgatgtttgatttttagagtgaaaacattaattttattcttatattttcaatgttttttgaatttttaaatttatctggtcatctagagaaaactgaatttcttatatgacagatattttgacattcacagcttgattctacatgtctttttgtcattttctggtgtccactcaaggtaaaggcaaataagaaaaaagagaagaaggagagaaaagaggaataatgagggagagaggaagagagagagagacctttttttgaaaaagagagatagtaggaaaaagagagagagaggcataaaatgcaaagagaaaaatagagataaaatattcctacacgggtttcctggatctgatgtaaacccggctatatacttttttcagattaccaaagaagctaaaccatttttaataccacatttaaatactcccccctttttttcctgagctttgcattgaatggtttcctttttgaacagttaatgttttctaggtttttttgtttgtttattttacattcttactctttccctccttccgagtatattaaaatggtgagagaaaatagaaaccttaaatattccagaagtttccttacatctagtgcccctacagccatgagagtggtcagcatgtccagggttaatgctttgttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcgtgatccgcccgcctcggcctcccaaagttctgggattacaggcgtgagaatgctttgttaatcaggatacttttattctgaaaaaaagtgtacagcagagatggtggagacttaaagctttgcatgcccctcaggataatgaaggaagaagagatggcgggcaaaagtgtaagactctggacccccttttgcaagtttatacgttctaaggcagaaacaatctgctgtttgcaattgacactgagctgtgaaatgtttttgctagtagcagtgtatttcttgaggcacagtagaaacccaaccaatctatattcaagtctaagaggagggtgtagctttacttggaggttgattgaaatcatggaaattgtgaatggagtaattagtaatcggaagtgttggaggactttctccctcccgctgcatgcagtattcttagtgaaatgctaaggggaatttcaggaagaaagtgaagacggggttggttgttttattaaggcaaacttttagctctctcacctttattactctaaatatcctgttcttaaaaaggattcttcctctcatttataatgcagtaataattgatgactacaataatagccatgaagcattttacagtattgggtttttaatcactaaaagaagaccatgttaagctaaacatggctttaaatctattttattttaattctctgtaaattgataattactatatagtggtgggtaggtatgtaataggaaggaaggtgaggaaactcacattctttgaatcaaggattatattcatataatattatattcatttctgaaaagcctcataattcagaaatacatgttttcttccatcgttacaagtgagggactccaaattcaaaaaattgaatgaacttacctaatatcactatagaagtaagtggtaaaatttgtattgctctttgactttaagatgcactgtcatttaaaatacaccatgctgccactgagttatttataattaaaacttcattttaaaacatgccaaccaaatctgtcaataattgatgatacggaacacacatatttgaaaagaaacgtttaaccagttaccaaaacagaatctagtatgtgatttttcgtgttgcaaataaaatttcaaggtgatttgcttcagtcttcctgaaacatatacagtacattttaattgtgtatatttagataatatacatctttccaagtttatacaaattttctcaaaggaaagcagttctatacaggaagaagattgcagatgaatgaaggaaaggtggcttggtacaggtgcagtgggtttgagtgcagtgggaagctgttaactttagtattctgcaaggttgctttggcattattcatatggcttcccctgtggctaactcagagatactaactctaactccctagcttttgctccttttccaatgactgactgcaggctctgtccctccacttaggtgttaagggactcagtcaaggatgtttacatgtgcctcagagatttttttgggtacccagcagtgtagagttctagaaagttcttttcagtttacaaatgccagttcttttctgctagtctttggcagtgattgaatgtgaattgtgaaatttgattgtggtctcactccaagttctattttatttctggtggagctggaatgttttatctttctcggaaacgatcactttttgtgtgtatggcaacaaaacagctagaataactgtcacttgggctcagcaagtacacaaaagtatgggctgggggcattttaaccaatccatattcatacacaggtaagctattccacttactgcaaactctccagaattgaaatcccagcagatttaatacacaaagcctcttcagtcctagggaaatgagtttttttttaacagactgattattcatttcaaaacatggaatatttttgtcataaaaggatgataagtattgccctcctattttaaatatgtacctttgtgatttaatagaaactggtcaaagatctatataacctccacatttagggaggttggtccttcatgattagatgtgaaacccagttcagcatatgtctcctgggcacctgttatgtgcagacctttgtacgtagggtaggcaaagatgaagacattgtgcgtgtattcattcattcattcatctgtagtgtgtatgtgctggacactgtgcttgcctgtattggtaaccaaaacaaaaattatctttgccctcatgaaattcacagtcttggggatggcttcaagtcttttcttacttgaagaacgtaagtaaacaaatttttataagaagttctctatagttataaataaggcattatattgatggaaagtaatgggatattcctttccttatcccatagttaaggaaaatctattaaagaatatgctatttaattgagaattgagggatgagaaagagccaccttcaaaggcagtggcatgagatgtaggccttgggttgcaggagctttgagaactatggggaaagaaacatgcgacgaagaggaagccgtggtcagagtgcagcacatactgagggtgttgttacatttacttgaactgcagtaaaaggccattgaaaggatttgggcaggactgttacattatccagctaaggtattaaatgatcttgtgagctgctatgtaggaataagattggaaaagatttctgtttttcccagtatggcggacaaggtcctctaaacaccccttttgctgtaaagcagctagaaatgctgcatttaaaaataaatgtcatttaaaatgaattgctgagttggtaagaaatccttagaggccaaaattgaagtgaaaacaggaatccagaaaagaaaggaagccagctctgcagctggcggctacccagggtaacatccagagtcagaggaaggagatatatttaaatgcgaggacatttggataatttttagaaaaaaaaaatagttaaattcctaccttgtactttacctcaaaacaaatcgcagttgaattaaatatttaaatgtaaaaaaccctaagagtagtagaaaaaatacatgcaaatatttattataatgttgggatggatacatttgtagatatgtcatcaaaggtaagggtcagcaaagaaagtctgacataattgactacataaagattttaaaaattagtatagcacagaatattgtaagttaaaggacaaatgaaaaattgggaaaacatatggcaaagggttaatgtcatcagaatgcaaggagctattatatatatatacacacacacacacgcacattttaatggaaaaattggcaaagatttgaaactagcagttcaggcagtcaaaaacagatcaacacaaattgatcagtctaaaaagaagctcaagttaacgagtgacaaaatagattcaaactaaaccaacatgcgatgccattttttttcactcatcagtctggcagagattaaagaacaatccagcctagcattggtcaggatatggtgatctaataaccaggtatgctggtctctcacacacagtggttgagagctcacctggaataggctttgtggaggggacctgggctatttgtttcaaagataccaccaaaatgcctccctttaatcttgtaatgaaccatacatgctatattctaagaaaatactcggagaaatgcatcaagacatgctcaaaaactatatttttcataggattgttacaatggccgggcgcggtggctcacgcctgtaatcccagcactttgggaggctgaggtgggcggatcacgaggtcaggagatcgagagcacggtgaaaccccgtctctactaaaaatacaaaaaattagccgggcgcggtggcgggcgcctgtagtcccagctactcgggaggctgaggcaggagaatggcgtgaacccgggaggcggagcttgcagggagccgagatcgcgccaccgcactcccgcctgggcgacagagcgagactccgtctcaaaaaaaaaaaaaaaaaaaaaggattgttacaataagtaacattggaaacaatataaatattcatgataaagggagcttaaatctatatatatatgtgtatatcaatacaatggaatatgatggattcatttatggtagatgtttctgtataaaaacaaataccatatagcagaactagtgtgaaacctttaccaactgtggcagttgtttgccggagctaggtggtatgggcttgtaagaaccaactattcaatttttaggaagcttttgagtcatttgtcaaattagtcatttgaagttggctttggtaagagtttttaccacatgaaaattggtaaaccgatgctagaaattagctttgtcatcatcaacccccggctgtttaccagcacgccactctggtcatgcatgtgtaagcatgtggaaaacctttctggcagaagatacatgccttttctttcccccctgcaggatcttgctctgttacctaggctagagtgctcactgcagcctcaaattcctgtgctcaagaggttctcttgcctcagccttccaagtagctgggactataggggcatgccaccaggctcagctaattttttaatttttttgtggagatggggtctcgctatgttgcccaggttggtcttgaattcctggcctcaggagatcctcctgagtgatcttcttgtgttggcctaccaaagtactgggattacaggtgtgagccaccatgtccagcctacacccaacccttaacagtgattatctttgaaaagtggaattatgtttgggtttatttctgccccttttaaaataactttattttctgttactacattaattcatttaggattatggcctccaactgcatcggtgtttctgcaaagggagctaagcattgggcacacatgggcataaacatgggaacaatagactctgcagagaactaccagagggaggtgggaggaggacacaggttgaaaaactacctatcgggtatctataccccaaacttcagcattatgcaatattcccatgttactaacctgcgtatgtacccccatatctaaaatgaaagttgaaatgaaaaataattcaaaaatgaaattacttattgtctgactgtatttcaatctaattaaatttataattggaagtaaagggtaacttaatttttagaagtaagaaagtatatagatctgagctgttgtattcctcgggatggcaagcaagaggcaattgtgacaggtatgatagtttaagccttggctctttgtttctgtctgtaaattggtatgttaataacttctctagcacagaggtaacttcaatattcatgaaatgacctcagtagaatactaaattagaaactttgtaatggaaaatagatattaccatagattttcctgcattataaccatggcttgtgtttgtgtatttgttagcatgttgtgtcaagaaaataagcattagctacccaaatacttggaatttgaaattagcaactccccactttcctccatcagtctactaatattggatactgtattagtctgttcccaagttgctaataaagacatacccaagactgggtcatttataaagcaagagaggtttaatgaactcacagctccacatggttggggaggcctcaaaatcatggaggaaggtagaaaaggaggagcaaaggcatgtcctacatggcagcaggccagagagcgtgtgcaggggaactgccctttataaaaccatcagatctcatgagactatcatgacaacagcatgggaaaaacccgcacctgtgattcaattacctcacactaggtccctcccatggtatgtggggagtatgggagctacaattcaagatgatatttgggtggggacacagccaaaccatatcagatacttagccctaaacctatctatacaccctgattcttaccaactttatctactcatttaaacatatctctttgttacaggcagctttctgttttgtttgtttttggttttgtttttaaaagctcagtactacagaacatagtaagctagttatcaacatttccgtatctgtaggcatggttatgcatgtgttaaattaatacttcttccttcaaccatcagcctttcttcatttctctatgcaataaacatatgttgtattgggcttacactgtgtgctagatacagttcacattatcattatattcactaaccattacagggatgaatgatatcatacagtatttacagtattaaaatggttatattatttgatcttagaatagcattgtaaaatatattattattgtcacttcacaaataaggaaatagaggcccggagagattaggtggtttagacgtagttttgcatataggaagtagaaccaggactcaaggttttgtcctctgttcccaagcccattattctttttcctggcagacccaagggattcctacctttttattactgaggacatcttttattttatattttttctaaagattccttttattgcaagcaataaaaccagacacattagtcgtgctgccatcacaacaatctaattttagaacatttcatcaccccaaaacgaagccctgaggattagcagccaatccacaacccattctcccccacccaagccctaggcaaccagtagtctacttcctgtctctatagatttgcctattccggatatttcatacaagtgggatgatattatatgtggcatattgtgattgatttagttttcacttaatgcaatgttttcaaggtacagctatgatatagcatgtatcactacatcattttttagtgatgaataatattcatcattgaatcataattgagaaatattcttcatccctgatgcacctgtgtgtgatttccaaattttgactatcatgaataatgctactatgaacatatgtgtacaagtttttgtgtggacatatgttttcatttttcttgggtatatagctgtaagttgaattactggatcaaggtaactctatgcttaacattttgaagaactgccaactacgttccaacgtaactgtgccattgtaaatgtctttttgaagtattttgaagtatatacctatttgaggtatttgcactctcatattcaactgagaacatctcctgtgagtatctcatgttcaactgatttcagctcttgtgtatctcgtgttcaactcttatgctcaactgatttcaactccaatgaatatctaccaagaagtgggactgctggatgaaatgctactctcatttttaattatttggcaaaacttccatagtgtttttccagaatggataaagagaatgcattatatcatacaattgagtgtcagtcagccctaagaaaggaggaaatcctgccatatgcatagacctggaggacattatgctaagttaaataagccaggcacagaaggacagacactacatgatgctatttacatgaggaatctaaaatagtcaaactcatagaagctgggagtagaatggtggttgccagaggctgagaagggggagaaatggagaggtgttaatcaaagggtgcaaagtttcagttacgcaaggtaagtcctagaaatctactctacagcttagtgcctatggttaacaattctgtattgtatacttaagaactcgctaggaaattaaatgttacataaagtgttcttatcactaaaataattaatacataaatgaatacataaatagggcaggaggaaacttttagaggttatgtgtatgtttatggcatagattgtgatgatggtttcttgcccgtgtatatatctccaaactcctcactttaggcacatcaaatatatacagctttctgtatgtcaatcatacctcagtaaagtggtttttaaaaaagaaacagcagaagaggtcattgtgaattcagaggtcttcagaggactcagccctttaatctctgattcagtaaagtggcattcgagtgtttccttttttgttagtgtaacaaatataaatctcagtgctatgggagctcagaaagtgttctggatcagaacatgccctgggtaattcacagtgtataaggcagagaagaaaaacctggactcaagtcaaatcctggtttccgtatgactctcagtgtccttatctataaaatgaagctgatagtatcagccctgcataccccacagagctgttttggagatccagtgagagaatgaatctaaagttttctgtaaccagtaaaagcaaatcaggaagcagaagctcagtcaaatgagcctagaaaccacacacttggcaggtaggtaagcaccagttggtgctctgtattatgagattaggactgagaccttttacattcgaagctgggtgcttgccgacaagaatccgtatttccaaatgtgagcaaacccttgcccagcagagttttcacaaaatccagatgttgagttttgtgtcaattgtttaagaattcaaaagcagatagtagcatatttttcaaaatcagttgcttgacaaccagtttatggtcctatgattctctgccaccttccctggttttgacgactctaaatcagttgaaacttgtattatttttctattgtatttttcaatatatttgccaaagaatatgggaaaagaaactttattcattcaacagccattgtttgaggtatttccatgagccaggtatttgataggcattaggatatggtgaagaacaaatagtccctgttcctttcttcatgctcgtttgtgtctcatatgtctaactgtttcagggtccctgctattcaccgtgactcacagatggcaccaatactgtgttttaaaaatgaaaagcaaagtggaggtcaaagttaggttctaaaaaaaataaaaatgaggaataacataaggaggataaaagatgttgaggctgcagttcagttctgttgctaatttactgggtgatttgggcaagctacttaacctctcagaatctgtttccacatctgttaatttgcttagttcttgactctaacaagctagcattctgtagtttgagatttaagagcctctgaaacaagtttcctttctatttctttacatttttgatcaatccatctttgctcattttccatgtggctcttatctgctcctctccatcttaagtattatcctagtccaagccacatcatctcattcttgaacttttcttttcttttttttttttttcatttgagatggagtttcactgtttttgcccaggctggagttcagtggcacgatctcggctcactgcaacctccacctcccgggatcaagtaagtctcctgcctcagcctcacacatggctgggattacacgcgtgcgccaccacccaggctaattttgtatttttagtagagataaggtttcaccatgttggtcaggctggtctcaaactcctgacctcaggtgatccacccgcctcggcctcccaaagtgctgggattataggctgagccaccctgcctggcacattcttaaatttttctgcagtagcctcataattagctgtttctccttcacttttactctctacagtccattcttcacacagtaaccagtgttacctatttcaaattgtaaattaaatcaggtgtctcctctgtggaaaaccctggaatatgtcccattattcttagaattaaatttaagttccttacagcggcctatatgctcttatatgttcaaattcctacctgttgcttcagcttcttcatattccactgttttccttgcccctggcagtgaagttttctgagattcttcaggaacttcacatgtactattccctttctcacctaagttcttccttcacacactctcctctcaactttgtccctcacatcttcattctatttcactcagctcaaaagtccatttctcagggaacatcccatctcctgccctaatcagcgacctctcaggctaagtaagatccctgttaatatatccactttatacgctgtacgtctttttcatgataatcactccaatagcaattgttgttaattgggtaattatttatttaactacttaattaatgtctgtgaccttctctagaatgaaagctccatgacaacaggcagatttatttgcctctgtatgttttatgtgtagcaaagcctttgcagttagtaggtgctcagtaaatactcagcgaatgaatgaaaggatataataaataggtaacacttaattctttaaatcagctatgagattattttgtatgagataacaaggtatatatgccagagagttctgaagaagcatagacgtttctttctatgtagttactgatctctgtttttactgtgagtgcaaacaatactcatgccaccccattagaaacaaatatccaccaaactctgtgtgctgggcactaagctggatgagcaggactaaagctctctctttgagctcacaatctagcagcaaattagcctcaaataacagttacgcaaggtacgaagtggttagtatcataagagaggttcagagaaacagctatggtggtttcaaactgagagaaattgcttcaaactgagagcagccatctatatatccagaggtgtagtgttcaatttaggccttaaaaaatttgtgtgatgtgactacttggagataggtgagaaatggcaatgaagaatggagctatgattaaataattgcctctgcccggttgttacaagtaaagccaagtctctaaacaagaggcaggaacttaaccttttaaaatttatttttatttttattcactcttatttacatatggtcaaattgagttttttggtgtaagaagtctgtgaattttgacaaatgcatacaaccatgtaaaaaccaccacagtttaggtacagaaagtcccattatcctcccaaatttctctcatgctgccactgtgccgtccccccacacccagtcactagcaaccactgatcgttttctgctcctataattctgccttttccagaatatcagatagatagaattgtactggtctggcttccttcacttagcataacacatttgaggtacatccatattatcatatgtttgagaagtccattccttgttaccaagtaacattccattgtatggatataccactgttgtttattcattcattagttgtaggatatgtgattgcttcaagtttttggctattatgattaaggctgctgtaaacgtctatatacaggctttgtctcaacacaagtttttgttacctaggactgatattgctaggtcatatggtaaggtcattaggtatgtttaacctaataagaggctgccaaactcttttccaaagtagctatactcaattctgtattcccgtcttcaatgaatgagagtccagctgctgcacatttcatgaacacttgctattttccattttttaaaatgctaaccattctaatagttttacagtagtatcttgtgtgatttttaatttacatttatataatgactaataatttggaccattttgtcatatgtatatctcctttggtgaagtgtctgttaaaatattttgtccctttttaattaagttcctgatatttttctttgacttttgagagttctctatatattctgaaaatgagttcttcattgaatagctgatttgtggcttgtctttgctaacctttaattttcttgttattttaaaaatcttgctcccaggcccatcactggatctcctatagtctcttaggtctactcagtatgtttatagaacttctaggttttttcagacacagtggggatctaggaagatgaaaatgaccattgccctgttaacaaggagcttttgagtagctggaaagagaattcaggtatccaaatatttataacccacgaaataatgtcccgagtgccatagggatgtatagatggtgtgctatactgcagagtgttgtcactcattgaggtttctggttactaaaatactttgaggccccgaagagagaaacaataaagactgtggatgattacatcctacaaactgtaacaaagtggcttccctctttacagcctcatgtattatctttgatgatgatgggcattaggggatgaaaaaggggccgtgccaggcaatgcagtctttctcaacttgatcagtcacagtgcccactctaaccattgtcaagcaaaaggaccacatcagaagccattagcctcactgcatctccccaccccctcagcccgtttgctgtaattgtcccatttgacttcgtttaataacaaatgggtaaagaaattccatgcttgacacatgtggagttgcatgtgtgtgtgacccatcagacagcttcagggcacaagtatactgcccagcctatcttttgcttctgctcatactaatcattaacatgtgtcactttaggctgggcatggtggctcacgcctgcaatcctaacactttgggaggccgaggcgggtggattgcctgacctcaggagtttgagaccagcctgggcaacagggtgaaaccctgtctctactaaaatacaaaaaattagccgggcatggtggtgtgtgcctgcagtcccagctacttgggagggtgaggtaggagaattgcttgaacccgggaggctgaggttgcagtgagccaagattgcatcactgcactccagcctgggtgacagagtgagactccaactccaaaaaaaaagaaaaaaagaaaaaaaagtcactttattcattaagtaccattagtgactctcagttgctacaaggataaagtttgttcttaccctgattgaccctagtctcattgaccctttaccattctcatgctttgtgaaatcatcccacaccctgtgatctaaccccggctgactcatggactaactcatcatggctcacatcagcctggactcctccccttggaggaggagtcagtgcacattctatgcattttttccagacttaaatcagatgccatctcttctgtgaaggcaccgatgagtgtcacccatcttgaagtccgaattaaaagtgccttctgccctcctatgacacgttgcatctttattttttccttttagcatttgcttcattttgctttgtgttgtggttgtttgcctgactctccacccagtcttgacagtgagatctttgagagcacagtctatatcttccttgtatctttatccctcgttggagcctaacataaactgttgcatgtggtaagttttcactgagggtttattgattgaaggacatgccataagccacagttcaccttgctttgtgacccagacagaagaggtgtctcagtggctgatagttgtaactggaggtgacagggggctctgatgtgttctaagcaaagacagccctgtttccctattggccgtgattatgccctcctatctagaataggaaaagggtgatttgattttgagcaataagcaacctgactctaattgtctaccttaaatgccttccattgttctgcttaaggtgattttctaccagcatgaaatgttctccttcccagacagttgatggaggagctgagtcatgcctgactatacttaataagacagaggcagctaatgccccagggagctgccttcgaggacagcttgacatttctgactcctctgctttttaaaagtgggtgttgtgagggaaagttaagcatgaaggtagcttcggagtctccactggaaacaggactatatagtgacactctctaatttagacagatgtgatctaccccgctgcctcttggctgtgatatgtgccttccgatgctgggaggtgctaatcaaggatgtcatgtttttcatgaaagagtctcacttgcttactcactttgttctactttctattaatgagtgcccacccacttccgttcttttctctgaaaaactggcttgatttatatttttcagagtcaggctagaaaatactcttgaagttagcatggattataaacccatcatattatagagatggacagggttacagatcatctggttttaccttcttatacgtgataaaactgaatcccaaagcaggaaagtgacttggtcacagtcagcattaaatttcagactctagagagtgacagatctgcgttagaatccccgtctcctactgacttgctgtgtaattgtgtgggtatcttttaacttatctatgcttcatgctcgtcatttgttaaatgagggccataataaagctatctgaaagaggcattatgaagagtgaaaatgataataaatgtaaaacacttaatacctggcgtatagaaaacactcacaattaagtgaatggtactggtagttcctatggtggtggcagttttataatggtggtcacactggcagaattaggacaagaaaccaggtcttctgaccctatgtctttgttctccatagggtatactacaagatgtatctcaggaactatatttagctatgaggaagtttaaagtgatctgtctgaagatgaattcctatattcaaagaaaggatcagtagcgagtttgctgtagcacagaaggaaaagaaaacatggtttgagatgtttgtcaacatgaagaatcaaattgggcggagtgtttgagggaagaaattatatgtaaaatctccaaaataaaaaccaaggggctgagtaagacctgagaacctgaggtcagtggatagaggactgactctggaatcagaaaaactgctgcccaatagctctgtgagcttcccaattcactctctgaacctctctttcaaaccccaaaatggggcaatatcctctatatctgggatcaaaggatataatatgtctaaaacttccatctaaactatacattactatggattatgtcaacaatgttggatttgcagtctttggtgggatgtggtggaagaaataaggcaatgatttctaagtgatgcatttgaaacattttcctacctcaaagcatacggagataaaaaggtctcttacatctttttttctttctttctttttttgagatggcatctcactctgttgccaggctggagtgcagtggtgcaatctcagctcactgcaacctctgcctcctgggttcaagcgattctcctgcctcagcctcctgagtagctgggactacaggcatgcgccaccacgcccagctaatttttgtatttttagtagagatggagtttcaccatgttggccaggttggtcttgatctcttgacctcgtgatccgcccgcctgggcctcccaaagtgctgggattacaggcgtgagccaccatgcccggcctacatctttctaagcaaccatcttcattattcattttccactaggcagggaatcacatgcagcattgggagtccaaaagtcctcagggatgagtgtcttggacttgacagtgttgtcctggaatatatacctggacacacatgcacacacacacaagatgtttgtgtgtgtagttgtagttgtaccatgcagttcctaaaagccctcttcaaatgactgtgagttattttcctggtctttcatctatttttctaaatttgatttttctagaatgtttgttttcttcacatatgaaaagtacattctcttgttttgcttcctttgttctagattttagagaagttggtttgtagttttctctttcccaataaacgtatgaggcaaatgttctcaaccttagcactatagtaagtcaataagctcaacataaaagtacgtataaaaatttaacccctgacataccaagagaaaagagaaacaaagattgatataagtccagtataaactcttatttttgcagttggttttatatgcagaagtaatgttcatgatatggttatcagagagacttttatcctgcctctgctactaacccagtctttcacctcaggcattccctagcccctctggtgtcagagcctgatctgtataatgtgtcatggggctggatgatttttgaatccaccttccagctctaacatgcagtggttttctaagatgcacggtggattataggggacttcagtgttcagaaacttagaccaggattttatcttagcatttactcttcccaagaccctgcttctttccttgggaggagatactgttctctaggtgagtgaccactaaaaacctagccactcagcacccccacctcttgaattcttcctgtcaccccatcatattcactgccagacatttctccaaaccccatttctcatgctctcagcttttgttgcttgcttcacccaattttctctcagaatcttttgttttctgcttgtcactaccagccatcaagaaaaatctacacgcttgacacattattaagatagaatgagactgcaccggcgtttcgcaggtgatgcctctgttaaacacagtggcaggattgtcgcctgtgtctcttcctctggcaggtgatgaagatcataaatgttcttttactccaggcagtttcctgagaattgctggggaggttgctgacaaggtttgctagatgcactttcctttgactttgtaattttgcgtggaatattggctgcacatcttgaggcggggaagttagaaagctcctaattgaaagttgaaggccccgatgtacttttatggaatgagtctctctgagcccccaactgggaagtgtaagacatggtgttgaaaggtacagagacccattaaatacatgatgggctttaaattccaatcatgctgttgagtggaaaggtgttcactgacgtatccttggtaattaagaagagagttcatgctcagactgccttctgcattttaccactcaaatccaagctttgagtttcctgcccttggctctggtaaaaggcaataaaaactcaaaatcaaacacacataataattcctttctctgctgattctctttccagatctcaattttctcatctgtaataatccacatcatgatagctaaaacatattcatattaagttcttactgtgtcagagtccatgtggcattttcgtgtatcatcttatttaccgctaacaacagctctatgggattggcactgattaacttcatattttgtgacatatatttgtgacatgtactgttacctatgtggcaactgtggacaggattcttcttcttctttttttttttttggtgagacggagtcttgctctgttgcccaggctggagcgcagtggcaccatcttggctcactgcaacctctacctcccgggttcaagcaattctcctgcctcaccctcccaagtagctgggactacaggtgcccaccacattcccggctaattttttgtattttagtagagatggggtttcaccatattgcccaagccggtcgcgaactcctgagctctggcaatctgcccgcctcggcctcccaaaatgctgggattacaaggtgtgagccaccgtgcctggccaggattcttctttccaggtgccacacttatgggcagcgatgccatttagcttgttttcagcctcaaggacaaacccacatatcagctttttcacttgtaaaatgggaagggtgaaaatagtaattttatgacttgaccatatagaacacatgcagcgttatcttttttggctcagtattaacgttgtctgttccagtcttcctgggtttgattcttagcctgcttcatcctctgttttgaagaggagtgtactgttgtactatttacattcaaagtgccaagtgggaatgtctgtgcagatatttatttggaatatatatttcactgggacaatgtagtagaacacagaatttggattggagaggaatgattttatacttgctacaagtaaactcttgtgttactcaagttatctttctgggtatagtttgtaaaatcttctcatttgcagaatgagaagaattttttaaaatgttgtaaaatctcccttgtcgtccaacactctcagacactttgtcacaggtgaatctccagagcttaaacatcaacaacatttgttgagcacaattcagtttgaaatgggctatactcagtttgaaagtgaaaaagagagaaatataatcataacaacagcaaagattatgtgaccagctctccgctaaacacattaccagtgttgcctcatttaatcttcaaaccagtttttgtttacacatgggaatatttaatttatttgcacatagtcacgtggataggaagtggcagaacgaggtttagaacggggttgttggagacttaccattgcatactccctagggaaagcagttgttttgggacattagagccctggtttggcccctccccaccactatcatatattgtttacccatctctcagacgtgttttttgtcctctctcgactgcattcacttcatgtatggaatgggggtattttcagctatcttactggaattcagggctgcaactagacctgaggcctgtattttctgggactctaatgataacatgtgaaataactttatttcatgcgctgtcagtcttgaatggaaatttcaacacagagactgtatattttctagatattcttcatagcccctagcactcacaggatcctgaataaatattatctaataataagaataaagagagcaaaagctgtttgattattatattaaaataatcattgaatttttacatcttaatcatggattagaaaagatagcttggagggaaaaaaacccccacaaaaacaagctaatgactgcttagcgtttctccagtgtactgtgtcacacttgacacagcctgtttatttattgtcacaacagccctgcaaaaaaaatcattcccttcagcagcatgaggttgctcattacagtaattttttttaaagaaaaccatgaaccatggtacagaagaagcatactcagaattcgttcttttggtttgtttgtttgttttgagatggaatctcgctctgtctcccaggctggagtgcagtggtgcgatctcggctcactgaaacatctgcctcccggggtcaagtgattctcttacctcagcttcccaagtagctggaattacaggcacgcgccaccacacccagctaatgtttctatttttagtagagacagggtttcgccatgttggccagactggtctcgaactcgacctcaggtgatctgtcctgccttggcccagaattcattatgtgggcttctatcccctggtgccactttgatgagagaagcagagcttgttacaggtggctattagatgatgttactgtattaccttccttattctgcacaacagcaggaagggtggctgctggaaccttctgggacataaacacatgataattcagggtctttttgctggtaatccaaaacccagttatgaaatgatttgagatatggaaacagcctggagaccttcagcagcttcgttagaccaggaagctttaaaattatctagaaaacccagggtttttattcaggtgctctcccacaaggaaaactttgtagaaagtgacgcttgtatttacaaactaagagtgaaactccagcatggcagatactgactgcaaactgctcggaggtgctaaaatattcatcctttaataatgctagactctgaaagaccccagctcttttagatttgattttataactctaagtattgcctattataattctgaatttaaacttcgtaggattggttgttttcatccgtcagggttcactttcctttcttacctctttcttttcttcttttttcctttgttcaggtttactttgtaatgatttgtccatactttttattttttaactggatggaactgccacttcaaattgatatgaaatgacagtctttagggcagtgtaaatacctggtgccataaacaggagtagtacactattcggaataaaaattattctaggagcaaactctaatgaaactgaaaccgtggcttgtggatttctccctcaccaaaccctttttttttttgaatttggcattctttcctaatctgacaaatgttatcatcccttgtatctgtcagagctattttccatttttttttcaaattattcaatcaagaaaacttccttttgttggtgggagtaaggtatgtctaattatctggtcctggaaagcagccatctgcccagtgatgaacacgggtttgtatgcagtgccagcaacatgaggatgcgtgatggatgctcacagacactccagctctccctcctccactcctgacttcttgctctcctcttgatgacttagtcagtgaatgtgaattttcagaaacattttctagactttgtttgggtagctctaccctgaataaacatatctaagttttaatattgtgttagttttctctcatactgctaataaagacataactgagactgggcaatttataaaggaaagaggtttagttgactccagttccacatggctagggagccctcacaatcatggcagaaggcaaatgaggagcaaagtcacgtcttacatgtcagcaggcaagagagactgtgtgcaggggtactctcctttataaaaccgtcagatctcgtgagacgtattcatattatgagaacagcacaggaaagacccacccccatgattcaattacctcccaccatgtccctcccacgacatttgggaattatgggagctacaattcaagatgagatttgggtggggacacagtcaaaccatatcaaatatcttccactataatataaattatactctaggtgaatggtgtttgcagatatttttggaaaccagtggtatattataggatactgctagaaaaatgtctagatatttaaaataatttgtcattgaggaacaaaaagaatataagtcaaagagacatagactcataaggtggttaaaatctcaggaattgttcatctagccacttatttgaacagaggaaataaaaccattgttatcagtgaagacaatgatcagccataagtagacatgtaaaataacagctgtttaaactaattcctttccaagtttagtgagcatagggattacctggggattgttaaaatgcagatcgtgattcaatacatcaggatgggttctgaaaatctgcagttctgacaaggtggcaaggaatactgatgatgctggtgggttgaggaccagactccaagtaatgaggatataaaaagcttatttatcacataaaatgtagaggtggaaagttcagggctggtaaggcaactccgcaagttattcaaggtcccacctcctttcactttcagatttcaccatctttagggtgtggtcctcattcttaccgttcattatgtagcgccagctatcatatctatctatgtcccacgcagcaggacagaagaaatgggatggtaggaggagcatgggaaccataggaacatgccagtgtctctcaaggaagatttctgggatctaccatatgacaaatttcaaaccttttctattagccagaacctagtcacctgaccacatccaggtgagaggcaagctgggaaatgttacttttaaactgagtggctatgtgcctaactgaaagtccccacactctattgggaaggggcgtgtgaggcatggaaatggggcatgtctagcagtccatgccacagatgcggatgtctgacacaagaagtggtttgccaaagatcacagaaaaattacagttcatagattaattataaccagtacatgtatggacattctcagtttatgtgtggtgctgttttatgtcataggcttatttcattttcataactattttacactattatgagcttcttttttggttgtggaaactgaggttcaaaatggttgagggacttcattgatcataaagcctacccttactactctctttataattgcatattcctgtctctcccttctctctccctccttcattcctgattcctcttaccagattctatattgttctttgttcccttcactcatcacctttcaacattctatatatttttcttatttagcatgtcaattgcttattgtcagtctccttgtgttagaaggtgagctccgtgagacctttgttttgtttgccagtgcatcccaagcacccatttagtatttggcacatgacggaatgctcagtacatagttttttaaatgaaggaataatgccactaggtatcaaagtccgccttggaattatgtctgttatcttcaaccctaatgctatacgccttctccatcagggcttctgctaatgttttagactctggaactcctgtgtttgcctcagaaatgtgctcacacttaaacatattgatttcctccttgtcttcgtgacattcatttaatgttgctagccaacttaaccagtttgctcttaccttcagttctctctttatctcagtcccaggttaatatttcctgaggacccaagcataccactagaaaaacaaactttagcaaaactaccaaaattaacgtcaaaccagcgttcctgtttgacttagtctctagcctcaggcttagataggactactagcacacgcagatgggacagtttctaagtggcctgatccgcattggtttctagtttggaatgtaaaaggggactggttctggtctcagccaaatctcaagactctcacctccaccctccgccctgtttacagtaatagaattaatataaaatgtagcacaatataatataatagcatttaatattattatgcttctgtttagaaacctgttatgacaattggttgatttcattcagttaactctatttctatgtctttcttttgtgaagattgttaattttctgatgggaattttctgatacaggttcagctaatacgtactgagctcgttttgcatgctaggacttttaactctcacacagcactgtaagataggcagggtgtacatgcagagactagtttaagagaagcattttgtccaaggccatatggcaactaagtggcacatggaaaataattaactatggaaagtaattccactttaggtctcctaaaattcaaatctttgctctttcttttctatacctgagtttcctgattttttatacttatatgtctgtctaccccagcacctagcatagtgctttgcgcatagcaggttctcaataaatatttaatgaatacaaatatatgaagagcttttctgtggaaaatattctgctttgaatgtgtgaggatacatttgggacaaacatcctagctctatagtcaggcagctttttttttttgtgctaccactcaggcaaaagtaagtcaattaatctctctgtctccgtttcctggcatgtaatgtgggaatgggcatgaaagccctagagtgtgttgtgagattaattagttaaaacgtataccctgctatataaatgctaattgctgtcaggagcgtgggttggatcttccagtgacttggctttgcaaagctttgcacatttccattagtcctctgtgccaccaagtctcagccttaagaaacccttttggctgagaggaatgatgactttgtggttctcccatgttgagaggccaatttagagaggacttccactgtggagtaaactgaataagaagggacattataaacaaaaaaggaattcttgtgctagtaatttgctaaattccctttgctgttattagagacaaatgtatttgcataacagccttttcctgtcttttctgaggctggtgcctgcagtgaatcatataattaatttggtattacatgacactccagcctgttgccatagattttatttttatttgttcattgaataatataaaaagctctgacaaaatgcgctcaggtggctgtctagagaacttaaaaactcacagaactaatttcaaatgggcaaatatcccaaagaaaaagctcaataataataatgtttatgaatgctaatacatatattttcaggctctgtggtacaggaggctgactcactttacacacatattcatttggtccatgaaacatcatgtaagggagatacatggcaggtataattatttcctttccctttaaaaatgtattgaatttaattgaagacatattaagccgatggattgggccagaaatcttggtgattgacttgtattcaaattttagtatgtaaggaacaaatgcttttttaaaaagtgtctggtcttgatttattaacttatgttatgaaaggaaaattctaccttcctttttttgttaatcaagataggcagtactagttgctatcacaaatctcagtgacttaagacaatagagatttatttttcactcatgtcacagccgcttgaaagtcaagtggcattcctgaacagctctgctctgagcagtggcaggaatccagattcctcccatcctgtgatgctaccttttcaacagtttctggacttcagggcctccatttcagggaaagagagcatcagagattatgctggggatttcaggctctacagcatttctgcccacatttcactggccagaggaaattcacatggccccaacccaattaccaaagagaagtagttttcacatgagtcaaggagaacagaattaatgagcatatagacagtctctaccatagtctgttctcgtgatcactaaaaatccattttataattcctcctaaattggtctgagtatatgcttgccgttaaaatgttatgttagctctccttttttatttcctctttcccaatcggcattctcctactttacaaaagaaaaatctacatgtcgctcatcatctatcttactattaattattgcccagggctataaagattttcagggtctaacatgacacttattttattggtgtcagaatgtctccttaataagggcactgttaaaccccagcaggccttcctttttctctccaatttaccaatgtttctattaagagtgaatcatgacatcagaatatgatctgtggcccaagttggagtgatctgaattgatacacattgtagagtgggttataggaaagatactaatttccatttaatagtctttcgtctaccatcatctaattgcagtccaaaaagtgcagtcttcagggagatgcttttgcaaaacacgtgaagaatatctgtaggaaataccaatggcagtgacatcttattttatctagacaacaaacagtataatgaaattgcagactccatttgctatccaactgttttcttcctctttttttttctatatactttatcattcaaagtgaaatgactgtcaagccaatacataacaacacaatttttggaaataaaatataaaatcaaaaatttttctaacagaaagtagttatgataaggatggtttgacatagaatgggtttgccaactgtattacctagtggatattttcttccttctttcctttcttccttttattctaattattattttaattaatttgaaagcaaattatgcacagatttttaaggtcaatatattaaaaaaaatcaaaataattatatactttctgccttaactatcctcacttttactaattacccttctcagagacaacaacttggatgtcttatttatctcttctaatatttcccatctatattttgctaacctatttgtatacattgttatcttttgtgtagtcaacccaaggcattatcttttcacttttttcattatagtaaatgaggataatctcactgaaactgctatcccttctacccattcttctctatatttcatatttggtcgagtcaataatcatttcattaatatgttttcacatatttatgaactataattctattacgtctcttagtttttgaagttattaactgcattgcttttcatatgcttattttaatttgtatgtttttgtaaccatttttatagctttcaattgcctttcagcataatttttcacatttttcacactgttaatgacatcagataatctgtcagttgtgattattttttcccttattggaggtttccaatccctactacctatactggttcgttaccaagccctggtgcataaattttatccttgggtctcgttcactgtcattctgaggatccctttcctctcttgaattagaatccctattcccaatcctaggttttctctattattgttttattctctcatttttgtggcacacatcccccgaagctccctgataaggaggacatggtaaataaattgtggagtctttacgtgtctgcatttgtcaccttcacacttgattgttttattatgtttaggttctaggttggaaatacttttccttcagatgcatcgcttcattatcttctagtttccagtcttgtgtttgggagttcccaaaccattctcattcctaatatttcgtaaagtgactttttttttttcctttcctttcttactccttggcagtttgcagaatcctctctttctctgcaattgttttgaaatatttatgtggtgtgagtctatttctatccattattctggggcaattgataggtccttagaaggttgtatacttcagttctcagattttgttttttttctgtgaattatttaattgagaactttcttggtattttgggtttttttttttttttgaaaggtgtggtgcagagagttctcttattgagtgattgagattcctgaagtgggcttctaactttcttatctattttctatttctttttctttctactctgctttttaggaaatctttaaatttaacatctaaaaaaaaatctattaaagttttttgttttagtgggcttttgttctctgaatattgcttggttatagcatttgttcctgcttcatggatgaaacaggttccttatcgctctgagaatgttgatagtattttttacatgtttacttttccttgaataatttgattttctccaagttccttttacttttttttttctgacattacattttgtggtagaggtttttctcagatgatctgctcagatttaagaagaagtgattaagaagctgattggaaattctaaatgtgagtgtgaagccgtgatgctcgttaaacttgagcttttctgttggatgatgtggctgcacaattttctaaagagcttctgatagtaagattgtcatatatttcttcttaaactggccagattttccacggaagattctttccttctcttctgtggagagtaaatgtctgactgccctcatccttggagctgagtgaagaaaactgttcagtgctagaagagtgggcttggaacaaagcatgtaacttttttatatagctgtcattctgtcttctttcttttaccattcttcccatatcttcggttttgagatacctgactgcatgtgccaggatagattattgatattggtaataagcaaatccaaatcatctctgccttcaaagaacaaagttgtgtggtatgccatccatcaaagtacccaacctaagggagcctctgtctctgtgctttcatatttgccaaggcagaagaaaagggaattttgtaaaatataccccatccaaaacatccacaagtaggactgactacatcttcttggtcaaagtaagtcacatggccgctccttacttcagaggtgtggaaatgtacaatcttatactcggaggagaacccataaatagtgggtgaacagcactaatgactctttatcttgatgctgataattcctgggtcttttcagcaccctgaactacagattggtttgttctccagttctctgctgctggtttaggatttgtctttttaggtgtgttaagtctgttaccacttgtccatgttggtatcactattgtcttttctcctactcttgcagttacttgggattatgtattaaacattattttaattttcttttcttttctttttttgaaacagagtcttgctctctcacccaggctggagtgcagtggcacgatctcagctcactgcaacctctgcctcccgggttcaagcaagtctcctgcctcagctttccgagcagctggaattacaggcctctgccaccatgcctggctaatttttgtatttttagtagagatggagtttcgccatgttggccaggctggtctcgaactcctgacctcaggtgatccgccccctcggcctcctaaagtgttggaattacaggcgtgagccaccatgcccagccaaaactttggttatacttttatataaactgaataagcgaactctgcaactttgcaaatattttcaaagaatgtgatactttataaaatacattgtgttacaagtgtgcattgatgtgaacaacactgatttttccaattatttctctgtatgttttttaaaagttgcttctaactaaaaacatagcaacaaatagtcatttgttgagtcttggaaaaactagttgttaaatttccccgagctttattacttacctgacaaatccttttgcaagtcagaaagcttcagattcttcacttttatcaaaattagaataatgacaagtgagttgttttgccagttatccactgctgcaaaaacggtgccttgcaaagaagcacaaatttaaatgaccaaacttcattttatttatttcacttgtatttttgcttctgagtctgtatcttgtgcggctcagctcgtccaggccggacttgctcttgtacctttggtcagttgtggaaagccagatagccatacttctggaggtgggccagctgccagctggggtgtctcagctgtcctctctgtggtctcttatttattaatatgcttttgtggacttgttctcatagtgacaacagagttccaagagaaaaagcaaaatcttttaactcttaagtttagatcgtcacacaccacacaatcacttttgctgcattttgtttgccagtagaactcacaaggacagcccagatttgatggctggtgagatagactcttgattggaaaacttacagtttcaaattgcagaggatgtggagataggggaaagggaaaactagggctgtttttgctgactctgtattccagagttttcaaatgatcgttaaaaataatgtttgatgataaaaatataaaatgggtatacagctcagaaagaatttaaagaattgagtgaccttgtggaactaagctcctttagttccttactgtaaacaaattttcccagttctcacgtgtaagcaaacaattttcaactagtacctaaaaactctcattcaaaaatagcccttctatattactaagaaatgatttccaatgcaagctttacattttataatcattaattacttataaaatgaaaacatattatttaaatttataagacatttcaaaaatcttttaacacttagcactttacatattacacaaaagaataaaatgatgaaaaataaagcataaactatcaaacataagaatatattccattaaagtaaatttgcatgtggagatagtggaattaatgtaagttcaaggaaaaaaagaaactatggaatttataatggttaaagaaagcttttttacatgtttttaggttggatattggtgtatggcaaatcactattccattggatgtaattaaaagaatgatgtaactcttttctttcaaaatggcattacttatgacactaaatatatcctttccaattatacttggcatgagaagttttagatgtcaatggaaacgtagggaagattacagagttaaaaaaatacatacataagcatgtgtatgtgcatatgttagggacatgaggaaaaaactactttaaggtgatggttttgtggtccgcaggactccatcaccctgacctctgttcactcttcatctggtgacttctagagccctccattcagatatcactctaaagaaaataaatattttcttgttttcttaaaataaagaaaaaattctttaaaagaagtttgtttttttttctgagtagatgagtgattacttttcattataaagaataaattatagaagccattacgcacaaggacagtgcagattggaggggtggtaagatagactcttgattggaaaactcacagtttcaaattgcagaggatgtggatacaggggaaagagaaaactagggctgtttttgcagactgtattccagacttttcaagtgatcgttaaaaataatgtttgatgataaaaatataaaatgggtatgcagctcagaaggaatttaaagaattgagtgaccttgtagaactaagctccttttttatttgactctgtcattgaaactgtagcacctttagttctgaatgagtattccaccaaggagtattactgagatctcttgatttcttgaggtctactgtcctgctgtccaataaagtagacagtagacatatgtggctagtccagattgagatgtaagtgaaaaatacattgaattttgaagatgtaccacagaaaaagaatgtaaatgtaaaatagctcatttttttatattttggatatattgggtttaacaaaatattaaaattaatttcgtctgctttgttttacttttttagtgtggtaactgaaatgtctaaaatcacgtatgtgtgttgcattataatttctattggacattgcagatctagcccatgaatcagaagatctagagcaaactgggagtcctttctcccatttgcccaaggattgtctttttcagttacaatttcctccttaaaccattctctgttccacaaagtgaaaaaacacttgatgtctttcttaggtgaaactttctcccataccttgcagggcttaacagggtcaagctatcagatcaaatcattattcaagagatactcagaaaataataaataatggggaacagcagtttcttcacaccaaaggtgcctactgtatgcaattattagagggaggctggaagatgaccagagaaagaggttctggaaaagaccgggtgaactgaggagaaggtgtgttcttttgaggcctttgttgtaaaatgactcatctgcccctttctttcttttttgattattccagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggtagcctgattcttggcagtggctttctcttttccctttagtttctgggctcttttccggatgatccgtgtgctaggaagctggggagaagtcggaagcatttagatagagtttagtgaggtaattgtctgcagcttagctgaaggggtctgaaggaggtatgcagagaaattggttgtggcccttagaatgttctccagaggtagttccttcccagaccctgagacatatcaaagttgtccgaaagtggagccttgttattaatcccctctcaccacaccggttcctgcctgcctttatgccccacctggagacatccatttctccagacattgaacagggcagagaatagagcccatttgtatctgtttttcttggcatctttcaaagtacttggcacagaagagaaactcaggtgcattgtgtgatgcacaatgcctcccaaatatgtgtgatgtgatgcctcccaaatattattttactttttgagtgtggcaactgaaatgtcgaaaattacatatgtggttcgcattatcatttctgtcagacactgcacatctagcccccaaatcagaagacctagaacgaactgggagtcctctctcccatttgtccaaggtttgccttttcagttacaatttcctccttagaattttgtctgtcataatattctcccaaatattattttgggaggcatgacatatatgtatgacaatgctttttaaacttctaccaactttcccctaagaagcaagagaataccatatctctggcaatctaaggatataatccaaacaatttaccatgactgtaaaatttcttttcaatccacttttttttcccttgaaagttttgtagattttatattttactcttcagtattcctcttttttttttctgcattaatgttgtttttggggaaaaaaacaaaaaaacaaaacaaaacaaaacaaacaacttctaaaaactgaggcctctccacagaatagcccttttcagggttaattatttggttactttttactcacagtcactttttagctgccaggcttgcctttgttttctaaactcccatccgggttatttttttttcttttaacgacttcctgctatttaaccggtgtgtggctttgctagggctgcaatgacaaaataccacagtgtgggtgactttaacaaacaaaattaccttctcacagttctggaggctggaagtccaagatcagggtgttggcagggttgatttcattcttgatgcctctctccttggcttgtatatggccatcttctctccttgtctttacatggtcttcctctgtgtgtttgtgtcttaatctcgtcttctgataaggatgctagtcatatgggattaaagaccccctttatgacctcatttgagctcagttatgtctttaaatgttctgttttcaaataaagtcacattctaatgtactgtgaattaggaccttagcatataaattggggttgggtgacacaactcagtccataacaataaataatcacaaatgttttttctctcatggagagtaactactccctgatggaaaactatgactatgctttggtaaatgtaagctatgttatgattatgtgaaaaaagatctcttttctatcacagaaaagcctttggatcactgtgttcttgggggttgcaggtaagggggatccctgtagcctctgaaggtccttctgaggctttcattggacacttgaattttaatggagtggactttagactggtatatgggtttctgaggatcctgaaatactcatgttgtcattatttatgttctaatacaacttggtagaagttaaagcagattatagtggaaagagcattaggagaagacagagaaaccaggccatcacttccactctgccactacttagctggtgaccttaggcaagtcctgtccatgtctgagagctgtggtatctacgtccacataggaagagagttggcatacatgcttgatgagctcctttttttctttgataactgttcatctgttaacatttcccaacgggaagaagtcatcaggagctttctgtttaactatggtctccactgtgtatcttagtgcttcaatatcagttttactttttccttaattacttactacttgcctgtagatcttccacaaacttttctaatcttcttttacattataggagtagagctgcatgactattaagacctgcatatacctttaatgttatttatcaactttcagattgtcacctcttcagtttacttctctatcttccatgttcctaaagcaaatctagaattgaaattgtctggtaggagcactactaggtttcctgttttactgaggaaatgtcgaatctgagaatgaccttaaactgaaacatgtagaaccataggcctgaatgtctttaaggccataaagttagtttcgtctttcagtattttatttatattcttgccccaatactgttcaactttgggagctaaaaaaaagtcggttgaaccactgttcttcatattttttaaaatcagaaaatatatccttaaacttaaatttactttctataacttccacctatagaatctgtcttccacgtggcagatgttttgttatttgtaggtaggggtcatgcctaccactcccccttgccaccttctgagcgttgtcacaagtcatctttaacacccctccctccctctttgagagtgcataccccaccccttccactatatttagtctttattcataagtcattttggtaccagataagccaaataggtgttatgtgatgcctcccaaatgttatttagacaaaaatcacagaaatggctacacatagactccttatcccatcactgtaaaaaattagttgtttttattattgtatgttctttttcatgttttcctatatttagacacaagttttacatccattccatttatttaataacaaatatttatttagcagttactgaaagttaagacactgtactagatgcaatttatgtaataaaaaacataaatagcgttgtgggacttatattttacagaggataagcgtacgtatctataacataacaatctaattttgagctataacaaatttaataaaggaaatgtccaaggtgctcaataaatgacagatcaaatttagatatgaggtgggaaaagataacagagaaggcctgcatgtgaaatggagggggtgggggaagtaagccctccaggcagacggaacaacgtgtgtgaacattatagcaccaatgtaattccccagtcatcctaaggaattgttatgtgtttgtttttttccttcatgcctgattgtttgtatacattctcacaacaacttggaatgattgtaccacaggtttcttgataatattccatttgtcacattttcttctattgattttaatgttttccttgccgatatggctctggatgggccattttgactatttgctgtctctattcctccttttctatcgttctatcatgtgacaaaatatccagacataggattgctagggcaaaaacaaaggcgttttatgatcctgaaaacatagtttttcccaaaggttgcttataccattattgactctgcataaatatgccattcatgcctctgccttaccagcactgagcattattgagaatgttttaggtgttacatatatacacagttatattttgctgtgttgaacagcagaacaggggatatgttctgagaaatatttgttagctgatttttgtcattgtatgaccatcatagagtatagttacatgaacttggatggtagagcctactacacacctaggctatatggtatagtctgttactcctaggctaccaacctgtatagcaggttgtggtactgaatactgtaggcaattatcacacagtggtaaggatttgtgtacctaatctgtctaaatatagaaaagacacagttaacatacaatataaaagatgataaaaacggtacacctatgtagggcacttatcatggatagagcttgtaggactggaagttgttctgggagagtaggtgagtgagcagtgaatgaatgtgaaagcccaggacattactatacacttttatttgtctgacggtgcataggtttgtttataccagcatcaccaaaaacgtgaataatatgttgccctatgacattacaatgacgattacatcaataaacaatagaaattcttgagctctattaaaattttatgaaaccaccatcacatatgtaatccatcattaactgaaatgtcatcgtgtgacacatgactatttatatacactgacaaacacacacaggatcacatctgaaaatatactttagtacattaatagtagttaattaattgtgcctgtttttttattctgtgatgtcaattcgtgtaggaaatgcctccactaccattttatctcttacatgaacttacatgtataaatgatgtctccgtatgtagcctggcttcacttagttcatttgaatgtggttgctctatgaaatcaaatgcaaatactacccattcattgtatatttcttttttcaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatggtaaggaaaattagactacattttattctctctaatggcttataaaatgataatgcttatttgctgagttatatttataagcaaaggtgtttctcttcagattatctgatctattccgtaatagctttatggaagtatttcagcacgtcctcattttgtaccattttaaaggaagtggtgcacagtactttgtctcaggccactatttctgaaattattctaactagaataccaaaactaccttatttctgttaacttcatgtgaaatacattttaagaaatgctgcccacttctagttcctgcttagtgaagtcataagctgttaattcttgtggtgaatttcaattccttgattaatcagtactgcattttattatttatgtgtgtttttttctttgccctcatttgtgagcactgtccatctatggtcttttccacatccaagggatttggaaaatgtttcatcaaaatataaaagtgttggaaggtagcgcttgtagcagcagcatagcttttgtatcacttcaagtctccacatacaccaaagccgaaaccccacggccagaatttgcaacataactcagtgactagttatccataggaaccacctttgataaagttaactgagacaagccaccaacagcctaagcccatatgggatcagtgtttgtggggaaggaagcagatggaagtaacgtggtgtctgtcagacttgacaacaggagaacgccaaaagagccaacaggtactcactggaaagtgtgatgagccaacgtgagaccaggagctgaaattgggagaggttttgctctctaataaggggtagtgcaagagacctataagaagaagctctgaaggggtgggaaaagttgtagttcctcacaactctgaaatatgaccagccacgttgaggagaagctactgtgagtagaatcaaaagtaaactggatgaggacaatatataggaaggaaagagaaggactggtgaaaaatggatcaggagaacaaagccaggacgtcttaagaccaagacaccattgttttcaaaagatatcttggtgaagttagaaaatccttttctattttaaaattcagaaaaaactactatttcctaagtgagctaaatgacattttaaaatgatacaagctgtgaaagaataataagaattagaaatatccaaaaattatatatattatataactccatacaaacttagaagaaaataaatcattttagaaatgaagataatctaagaggaagatcacagaataaaaaacacaatagataataccttaagattagtagaaggtgaaagggagaaaaaattaaaattaaaaaaatgacaaatacaataagaaaattagaatggctgtaagaatatcagataaagtagacagtgaggattaccagagataaagatgacctttcataataataaaaggatcactttatcagcgaaacataaaaataacaaaagcttgtgtgcttaataacaatgcttcaaaaacatgcagcaaaatttggcagaactcccgagagaaataaaaaattccacaaacacaatttgttgtaaatttcaaaagctgaacattttaaattctgtctctgcttaagttgttaatgatacaatttgggagtcaacttgaagagtcttctgttggccaaagatgaacaatttgaaccgaaataatttgaacctaattgcaatggtttaaatcctatgaagtcagtttaaatttataagtttataatgacatttcacaaaatttaatgggttacatttggatgatgataggaaatcagtttattatcttgaaaactggtaaaggagaataatcaagtattcattctggttttcctagaagacatgtaacattgggtaatgaagtgttgtagagaagtgtgttttgtaaagtgtttctaatagtaaatgaaaatttaatgatccaattagaattatcatcaccttgcaactctcaatagattaataaatctaggcatctaagcatcaatgactgctaacatcacaagaggaaaaaccatcagacatgtttcttctgataaaagaagaaaatattacatattgattcatattaccaaattaattaaacctgagtcggattaagcctttggatcccactgtcattttgcaggagatatataaataacatagaaatacattgaactgcagcatgaatatgtcatccataaaatccagactatgtgaaactctatgggccagatgtgctgggtttttcaaaagataaattgtaagaaaaggaatgtcatgaagagggactgtatagattaaaagaaacatataagacatttaaaaagtagatagcactgtagcatctaagcatgcatatataggtgaaaagtatataaataaaaacaaggaagtgattttactataaaagtatagatagtgcctactttggagggtagtaaaggaggtgtgattgacatgggccgtgacgaaggccttcaggagggactggcaaagttcctggacctgactgatggttacaaaggcctttgctttataataactcattaactcttagatgtgttttgcatggtttttttgtatgtgctttattttacaataaaatgactaagagggatggagggagagagagaagaaaggtagaaaaggagtgaggaagagaaagagatgcagagactgatttaagagatttaaccaccaattgcaatgaatcaactttagttggatctttttcatttgaaaaaaactataaagcaaattatgaaaagatcagggaatttggaacatacaatactaatgttactaataaattattactttttaaacttgataatggtactgtagttatgcttgcagaaggagttttcttttttggagatactcaaatattgtttaaaataaaattatatgatgtctgtgatttgcctcaaaataatcttggggtgcagtgagtagctgtgcatgaaataagacatagtctcaattaatacttgttgaggctagtaaagatacaggagctcgttgtcctctctctgattataatttttcatggtaaaaaacctaaaagatggttaaaaaataatattaacagttttacatcaataagtgtaatataccttccagttaaaaaaaaaagtttatttaccgtgcaatctaggttttaatctcgaaccttatttgattttttagttttgttcccatacacatcctgccgttttctcatctccttttttcctcatgcatttcctctgcctagaatgtcctccctttagaacagaccaaattgtaccacctttattaattgttccttgttccctccagctggaaatcatatttctctcatgtattcctgtttatttatacctgtttcaatattatttttcacttctttatttttttagtcattcattcatgactacagatagtcctcgatttactatggtttgacttaagatttttcaacttgatcatgggtttattgggataaaacctcatggtatgtcaagtagcttcttatgatttatgatggggctatggtttctactgaatttttatcactttcacattatcataaagtggaaaaatcataaataaaaccgtcataagttggggaccgtctgctgtgttgtgagaattaaatgcatttttgacttaaccatatttttgacttatgataggtttgttggtatgtaactttcatcataagttaaggaatatctgtatactagctgaagattaactgtgatcagtgcaatatgccagggggttgagggaacaccataatgaataaaatatatgcccagagctgtgtagtcccaaatgacctcataatttaatacaaataactttgtaaatacaaagaatttctactcttatcaaaatgtaaacttctaagtttcataagagtgacaaggagaaaatactgttggttttaaggagagagagatatgtatcctagaagacagcatatttcttgagggcaaagctatgtaatgtcttactctgcatctccagatttctggttttcacgaaaggatgacatggtgctattaaccaaggtatgaagtaacagaggagaagcaggtttagggagtaagtaatgggttaggtaatgccatattaagttagttgctgatgtctgtgagacatctagctggcgggtggcagtgactagcaggtagtggttacgtgattatgagtctggagcttaggagaaaaatcagagctaaagacagaaaattgggtgcattcatgtgatagttgaagcacttaagaagactaaataaagtgagaagagaactgagctaatgccatactctggagatactattcatgggtaaatggagacataaattctgagaaggagacagaaaaagtcacagctgtaaaacaattaccatggccaatatccaaccatgcacaggtgactaaaaaaggcaaacaacatggccaatatggtgaaacccccatctctactaaaaatacaaaaactagccgggcatggtggcgcacacctgtagtcccagctactccggaggctgaggcaggagaatagcttgaacctacaaggtggaggttgcagtgagctgagatcgtgccactgcactccagcctgggcaatggagggagactccatttcaaaaaaaaaaagacaacaaccagtcatgttttctcttatttgattaagaagattgctaataatttctgatatattgcttcctgttcctctacctttgggtaatcaactgacacctttaatcctaagacttctgccatcttggaaacaaaacaaaggttcttggtcactgcatcctcctgtctctgtacagcagtgctaactttgccttctattttctgccttttacaatcatccccaagcatctacccggatgtcttggtccttcttcagcaattcttttttagttgttaccaacagaggttcctacatctgttggttcctacctctatggatctatcttttaatcctcatagacttatttgcattactaaaagagacatggtaaagatgttctcttttagtaatgcaactaagtctatgaggattaaaagatagatccataataataagtttcaggaaatttgctttcccgttatctgaaagatgaaagctgctaatcttaagaaagaaagaggaaactaatatttcttacatttcagtaatcacacggcagcgtgctgtgtgctttatgttcatatgtaacaccagctctgcaagggagataccatattttgacagattaggaaatggcgattcagagagataaacaataacagctaacatttactgaacacacgtattgttccaaacgcttgattttacttaattctgtcaacatccttatgaaataggctgtcatgttttccccatgttatcgttgaggaaccaaggtatagcgtggttgagaaatatttccaaggccacagaactaggagctaagattctaacctatgtaatgtaatgtgtcaggaaaccacacttttacactttcatatataatttactcaaaacaatgcagctactgatgggagagtctgggatttcaggccagttctgtgtgattacaaaaactctactctctagaactgatgtaaggagggtggtccagcctttacttttggagcttaggacattttggaagggcagggtgatctttgaacacatactggggtgtggactggaccgtgggacgtaggtgaacctgtggatagagggccctgagaaatcggaggcatctcagacaaactgagattacaggaaacagaaaaccaaatgtttacatttcagaattgctgaagaaatgggataggattggattgtcctcctccacatgccttctctttctcctcttttttttttctgcatggcggaaaaaaattctgccatgaattcacaattctctaattcaacattaggtattctagtttaactcctgtgagttaaactgatgttcagcaaatatttgttgaataagccaggttttgtaactagtctggaaagcaaaccatagtttgtaagtgatttacagaatttcaaacagctggcttataaaacaaattctgaaatataccatgtgtataaatgggagactgccttgtttattcacataggaacctccaaacatatagaagtaaagacacaggtaatgcagtccttttgttgttgcttttgttactgatgagattaatttagagtctttggcaggccatcctaactttcatattactgtattaattctcttccttatagtttgatatttaaaactttatcttttagagatgcttataaaagcatagacaattttctcaccgaggatcaaaagaaccattttattgggtgttttgtagattacatttatgacagctgctgaactactctcacctgctatttatcagaatagataatgacttttctattatctttgtggttgtaactttccacaaagctagttttccttgtagccacagtgattactaaaattgatatattacctccacttttcatttttattgtggtcaagcattttttataactatctcttagaaaataggaaaatatttgctcttccagactaagtgctattaggaaagaacatttctgaaaacgtgcctggcttggccttcttgttggcatagagatattgttgagaagttagttcaaggtctgtgtagtaagccttattttttaaatgcctgcttctatttgatttgacaacatagattggttctttaactcttttctttacctacacttcctatatagtgattggattttcaacctttagtgtgagagagtatgtaccatattttctttcagagctatacacatataattctatatgtgtacatatatgcatatacagataacatttgacgtaaggtttagggcctctgaggactcaagattcatgacttaaacacaaagccaaattcaaatagctatgaagtcttgaagccacttcaggccatataaatcacctactctgtacttcgatagcacttcattcatatcttgtctttattattctagagattttctcttttttctgtagtaagtagtgaccactcttttcctgtctctttctctttcccttcaataccaagcacacagcataaaactgagctaactatattgtacttagaaattgattaaataattgaatgaattagcctgccctgtaaaattccagagaataagcaccatttgtggtttttttttttctggcaattgtatagccagctcctaacccagtgcctggcccataggagggactttgtaaatatttgttgtgtaatcattgcatgacttaattctgttaattggaagtgactagtttatctaactcttctaagacttcatagcaaagtatgtgttttataccaactttatcttgaatgcaaaaacttcagtagatactactaacagttcaaaccttgtatctcaattaaactctttgtatctttacatctactttccctttccatcctacaacccaccatccaatgtcttatattccaaatactcatcagcacttatacactcgatgagccctcagctccatgccttttgggtcttggcttctctcattcatacctttgatcaggcaacactaacgtgtcgagcatttaccaagcaccaagtattgagcaagtttccgaccacgcagatatggaacttaaaaaccccactgtccctcatacaagttaattttccaaaggaggaactctgcatgaaaacagagcattataataatgtagtttaagtactaacagtcagggaaaaaaattaagacaatacaggtgagttcttcacgctttttcctgtgcctgaagtgtctacttcccatgtctaccttcttcctcaacagatgttaatattcttatcatttaagaaccagcccaaatctttcttcattaagtttttctaagttgttttgtttttatttcatactcccttgaccctaaatgccttttattgtgtttgttgcaatccttcattagaccatgaataactataagttagaattgtatcatttccattttggtgccttcacacagttctttacacattgttggtttcttgaatggaaacacttgttcttacttcatcatgacattcctccactgcacccttcccctccccacatgattcgtttcagttgaaagatcccaaagtcatttcttgtgttgttctttacctatatgttgtggtcggttgccacagcaaccatagcatggttgaaaaatcgctcttctatttaacttctctcttttgaattcagaatgaggaactaatgggtcaactaggattgtttgtcttctagtcagacaagtgtttgctttattgtggaaattcacttactgttcactcatttcttatattttaaagcaagtttcctattcttggagaatctaaatctttttttatgtttgttttcttctggattccaaataaatggttttgaaatcattataacattttcaggttttatttttatcaacagtttattatgtttaaaattatcctatgtgtctcaggtacatgtgttgtgaagggtctagagacagagttgctgataagaaagagagagctaaccagacacacagcaggttaatgttcatagacatttgtagtgtaacaatgccctgaattaccctcacacacgtattagaatgtaaaatattccctttatttctaaaatgttttaggcctaatagctttgaaacagctataaaaagtttctttcatcacattcttaaggaaatactgttgacaagttcagtaaaaataattgacttctcatcctcaaaagtgtgcttcctcagtttaccactgattgcaggaattagcctgttttaagtgatagagccacatcacgcttttcactcaggctggctccagggatggcacaggttcagggctgctatatggaatgaagagacactatcaggtgaaattaaaagcaaggactttgaaacaagtagatctgaattcaaattccagctttaacactgtctggtggtatgacattgacagttacttaacgtttctaggccttgttcattcatctataaaacggaggtaaaagcattacaaactttacatgtttggaataaggatcagacgagacagagtatatgttaagtgcatgtctcagtataattttttatagcctcaactcactgctgaggagaggtattcattcttagttaagaagctgatgaaagaccgttattcggctttctggaaaactgaatttcagctctctactgtgttatctagaatatctctgtctcattttttccgtctataaaattacagcgtatttagtctgatctgtctacttcacaggagtttcagaatagctaagctaacaaatgagggggaaatacctttgaactgtttaaatgaaaagtaccacaaaaataaaatagttctattgatactgtaaactcaattcaaaccaaatctgacataaacttataagaatacaggcctttgagaccttatcctttgtgatatcctaaggatattgaaatcgtttgctgacctgacaagtgtctacaagtattgcttatcttacaggagaagctgcgttgaaaaaaatacgttacccaagcttatagtagcttcctcttgatgatcttttccatgaaatggaagttcaatgctgttcttaaaatacacatttcctgtgacaaagcattacaaaatgtgcctcaatgtaactgtcatatttcaaagtacatgctccaggaattgaagaaaaccttaatcatacaaacattaaagatgaaatatgtgaataaaaaaaattgaagttacaagctagtagtagactcccagaaatttaaagatgtaaaaagccttagagataacctaatctttttgtcataggtgacttattgatatttaaaagaaaaacaaaagcttttctaaaagtaaatgttcaacatatatttttgtcacagatagtgtattgattttttttctcaaaaacagcaaaaagtaataatttagccaaatagtgagactgagaatttgaaacaggattctagatatgttgaatgagatagttgtggactgagatagttcaatttctcaattttaaatgtcaacagttatatgcaaatgtgaattaggagcagaaatacattcctagatcttgatcaggcccatgaagatattttatttttagtttctgaaatctgtgatactcagttataaaaatgggataaagttggtggctcatgcctgtaatgctaacactttgggaggcccaggcaggcggatcacgaggtcaggagttcaagaccagcctggacaggatggtgtaaccccatctgtaccaaaattacaaaaattagccaggcatggtggcgcgcacctgtactcccagcttctcaggagactgaggcaggagaagtgcttgaacccagaagactgaggttgcaatgagctgagatcacgccactgcactccagcctgggtcacagactgatgagaccctatctcaaaaaaaaaaaaaagtaataaaagaaaaatgcaaaacagtttggaaatatctgatacagggaaacaacagggtgattaaaaatgccaatcagacatctaaattggggcctagattatcagacggagtgactggagtcccaaattaatataatcagtgaagaaatattataaaaagaaaaagaattgctttctaaatagcaggtcttgcagttgctcaagtttccttagtcattatttcaaaactgtaactttgctttactatcaacataggatgcccagaatttgatcctgagacaggaagcctgtgtttttgaagtcacactttagtttagaattttaatttctcatgatcagaaaagataatgacaggtgtttcatttattcttcgcagaaatcttgtcaaatacttgaccaaaatagttttataaaaactgcagcatgaatatttcggtgttctgtgcaaaattagatgtgagtgtgcgtgtgtttgtatgttttctatgcatgtatctaaaaagtaaactttttttttttttactttttctagggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggtaagcatgattagtgtccagtacacacaacaagcatgtgatcatcttgttatggtttttaatagtttattacacactagtatgtaaattgtataagaaaagtgattcatgttttttgtttacagtactgtctctagagccttcaacaattccatgcacatcgtaagcattcagtaactgttggtcaactgaatgaatatgtgaataaatgaatgaagtaaaggtagtttggggagggaaaggagcaccagacagatctgtgttcaaattctgtcactgccacttattagaaacatgacgttgaacaaggtccctgtctttatctgtactctggaactgcaattgattgagaatatttaaaaaaatattcatattgtattaatgcagtttcaggcaagcaatagagactcagtgcaacacttttgtcaaaagaatgttttacttggattaagtaaactctatttttctacatactgaaactgctgtacctattgctgaaggtatttgctggcaataatgttcaaccattattttgcactaagagaatagggggtgagaaactaggaaagtgggaaaggcaattcttagacagagttgacaaactcctagcaaacccagaaatagagaagtagtgtcaggatatatggcttttggggattacccctaaataccactgtgtccagtgtattaaaaaagatagcatctctgggtattgttttgtcataccccatcttttaatagatggaaacattaggctcactgacaagaagtaacctgtttagagacactcagtgagttacttgaagaagtaattctagatcccaggtctctgctcagggctttttctactggtctgacatgatttagtataagttagctacaaacagcctttcatatagtgcaaatagtattcaaacaatgtcgtaatcacttctgttctttttctgcttactttctaaataatgctgagttggggattaattcataagaaaaaaacagactaaattttaaaagtcaaatgaataatgtaaccttatattcatcttagcagttgtttctaatatatgtgcttaaaagtatgcattttggggaagttgggaataagcatactttgtcactctgattaacagatttaaaaattcacagacagatctgggcactgggggcttctttctcaaatttcaagcaacacaagtttgttgttttaaagctgcaaagtgttgagtatttattatatgccagtagcatatccttaatatatattccttagtttatttctcatagtgaaactgcgatatgagttttaattatcctcattttagagttatgaaaaattagcttttcaaaaattaggaaaaaccaagtaactttgcttttgcatttttatatggttaatatatggccaaatcaggattagaacttggttattaaatctttggagctcatacttttgaagacaatactaaaaactctactcaatgtattatttttaaaaaattaggagtactgaatattataaagagcagcaatctcataaacaaacattcaactggtaactagtcatcaagtagactaatgtgccggccttaacatcatgattgtgaattttccattgatttactcattaatgtaatacttatttaaccagcttccatactagacactttcggtaatgttgtgaagaaatacagagagaagaaacaactgactaaggcatgaaagcaattaggtattatgcaacataagacatctatctcatgtaagctttggaaagctttgctaagcaatccgaccttaagcatggagggtatttagtatgttttatttttttctttgtaaagcaaaaactatttttttctatgctcaaaacacttttgtcactaaatgtgtggctcttctatacaaagtaattctcaccttttctgaggacattaactgcatgtcctaaagtttaattcaatttgacaccagttatccagagttagcactgaccccacaggtgaaggactccttcctaaaagactgccccaccccctactttagattccagtcacaagcaataggttcccgcgttacccacaactctgcctgagttggctacaaacttaagattcctactacttcttcctcaggttctgtgatttggtataactgctcacaaaactcaggaaaaccttttacttacccttactttgttattatagaaaatattataaaggattcaaatgaacatccagctgaagagatacatagggggagttctggaagggtcctgagttcagagctccaccctctcagcttgtggatgtccttaccaacctagaagctctccgaacctcattgtttagggtttttatggaggttccgtcacacaggcattattgagtaaaaggactggaaatttcagccacactcccaaacttccagggatgggtgagaggctggagattgtgttaatcatctatggtctttctggctactagcgctcatccagaagctatataggaaccctagccaccaatcatttcattagcatataaaatccactcgttactccagagattccaaaggtcttagaagctgttgtgttaggaatttgggactagaacaatattaaaacaatagatgctcctattacccctgtcacacaggaaatcacaggggatttaggagcccatgtcaggaactgggagcagtcatcaaacctgtatttcctttattttatgctttgcttgttttaaatgactgaagtgcagtaattgagtatatcttggactataggccttctctaaaacaactgacaaactatgccaggaagttaggcaagattcagagaagagcagaatttttaataaggctgcctgatttaacatcatctcccttttttatttcctctaacacaggctctccaaaaaatgcagtgccccctgtgatccattcacctaatgatcatgtggtctatgagaaagaaccaggtaattacagctatgtctctgaatttcacttagattctcttaattacaaggaataaaatgtcatttaagttaatgcaagaaaatagacgactgttgtagagaaacacatgaattgaaactgaaatgtcagaaaccaaagcagctgtggagatcagttacttccctgatcccatgggcaactctagaattttttgcttcactctcggtatctgctcccttctccctctgctagccgtcttcctctgctgatgagtgatttctgtttgatgcaaactttagcttgcacagggctttggtttgccaaggctgcaacatgggcacaagatttagacatccttcaagctcctgctccattatgaaaggtcagtggtggatcttgaaggcaagactgtgaatataatagctaacaactgataaaactagtagacattgacgcagaacactattgaatgcttactgtggctcttcggttcttcttttagtttccataatttttcattatagccaaaaatcattgataactgaccaaatacgggataacatgttactcttttgactcaaagcctcccacagttaagtgaacaggaaactatagaaaattttaacattttctatgttgtatcacttacaatacatccagtccaaacccagtgagaggtgttaacctaaataacaacaaagacaatagctctccaaaaagaaaaggatttattcaggaatgaattgcagatagcaatccaggaatatgagtgctatggcatcccatgcgggaaccatagccatacccagaaagcataggaacataacagttttgaaaggcaaagtgaggaagattacataaagttgttctgaaataattatccttggttataagaaccaataacagggtaacatccgtccaggcttgactggcatttggtggtcagacctcctcacagaaatattatttgtttaagaatcgcgctggcctttgtgcaagatagtggtgctcagagtctttgtactagtttttataataggcatgtgtgtgtgagggccctttttatatgacctcccaactgtttttctttggagtgtgacacgagtgactccattttgactctgacagctttcacagaggtataaaagagcatctgtttaaaatgtgctaaagataatagtcagttgttaatgggtgaaagcaacggagaggatgccattcaataaaaaaaaaaggtggaaaaagaggtatgtagttgttcatggaaagctgacaaacacaggaactgtcaaaatgcatcctccacttgacacacctcttgtttcaggcagtgcctgttttgtggtcagtggggagtatgtaggatatgtatcagagaatgaaaaaaattaaaaagtttatggagtgggtgcaagacacatacagccctgatgcgtatctctgggccctatctaaagggtccctgaagtcttcagctcactttccttaagccataagtacaacttgtcggacatgcacgcagttgccaggcgggtcaagtggcagtaacttgagggtgatgtttccgagggtgctccctacccacactgcagcggggtcctcgtgtgctcgcggtgcatttttgcagctggcgacttgaactgggttgtgcacaagcaccattggtttgccaataagtttaacctggatgtggaacatagatgtggacctcttcgccatccagtgtttgggtgagcaccggaggcataaagctttatagaccttaaaacactgaccattataggcaatcttagggtgcattttgtgcatccttcttattatttctatttagttcctcttgccaataagcatcagaaaaattgtatggagtcctctttggggtagggatgctaagtcttcatgcagaaaagctgcatggtttctgcagagcacaattggctagaaaggctgtaacattaaatgtttatctagaattaacatgagtaggagtaaaagtggctgtggcatcagggcgggcagcaaagcattctggagcgagggggctagggtgactggggaagaggctgatgaaaaaaataaatcaattaaaagagttcagggacttaacaaaatgagatttgacctgtgccaaaactattttgagaattttaaatatgacatttttcctggtatgaataaatttatagcaacaaacaataataaagatacaattgatcttgtatgttatgtatgttgacagagaaatttgattttgctctaaaaaagataatagtgatcaacatagatggagaacaatgccaaaaaaaatcaagataagtttgaaaatatgacttgctttgtgaaacacagagaacatggtaagaggctgaatttcctagaattaggtatggctttatatagtcatatgaatactcttcctgctgtcagggtaaacccttattaataacataaatatatttgtctacctgtcaaactatgctgacagaaggattgttgaatccgtgttccctttatctttcttagtgacatacagatagggaaaactggagggaaaagacttaaggacgttgcaatgggagggtagatagagtatggccacgcagtcaggtaagcctaagttcaaattagggtgacgatataatttatcatctaaaccaggacactttctgtgagtaaacatagccactacctattaatataggtaaccaggaaagcaggcataaaacagaactgttctgggcaaactgggatggaaggtcagtctaggtcaaatcctggcccttcacttattactgatttaacttaggaatatcatttagcatccttaagcttcaccttttacatttgggaaacatagattttaaaaaataccttatggtgcttttgtaagattaaataagaccattaataaatataaatatttagcataataacttgtacaaagttcttagtaagtatgttgctactgctgctgttactactgttttctgcctagggatctccctaacctcatgttccatctcagagggatagcatagagttttctatttttaagttatcttaaaatttattgaatgcaccctgataggtggagcatttcaaggtgggcctcctcagccagatctctctgtgatggtatttccccatctttcctggccaaggactgaagatatggagaacctgtcctcagtcacccttcttgaggaaaataacaaaggagaagagcagtctctggaggtctagggctaaaaagaatattgtcagagacctttttttttttttttttttttttggagatggagtctcactctgttgcccaggctggagtgcagtggcacagtcttggctcactgcaacctccacctcctgagttcaagcaattctcctacctcagccccccaagtagctgggattacaggcggtgccaccatgcccggctaatttttgtatttttagtagagacggggtttcaccatgttggccaggctggtcttgaactcctcacctcaagtgatccacctgcctcggcctcccaaagtgctgggattacaggtgtgagccactatgcctagccttgtcagagactttttaaacaaatatcatcattttagaatttatttagattacattaaaaatggtcactctggtaattttatacaaagttgatggccttctttatttggtttcgcttgtttgttttggaatgaagtatggtgcattaccttatgggagtcgactagagaattactcataagcagggtttcaggtacacataactcgtagcttctgattagccagagagtagaaccaatatagccatgtgaaggataaacactaatgggctaactttgtctttgttttttgttttgttttgttttgttttgttttgttttttgttttttttgtttttttggttttttttttcaggagaggagctactcattccctgtacggtctattttagttttctgatggattctcgcaatgaggtttggtggaccattgatggaaaaaaacctgatgacatcactattgatgtcaccattaacgaaaggtatcatgggggccagcaagggagtgattaacctttgtttctcaacttaatgatctctgatgtgtgttctagtcaatgaaaataaaaattctcatttttccctatcactaacaaaaatcggcaagattttcaaatctttggtgattgcatcccaaaccagggttactgggctagcaatgcaaggaatagatgctgcctgatgaccagtggagagctgaattagaatgttctgaggctgagcatcttcatcagattgtccagaggacatgcaccctattgtcttaagcccagcaagattcacacatttatgatacccacatggaagtagagagaatacatatcttacatgaataaaaaggtcacaatcaagggttgtgggtacgtggaaacctacagtgtagttgtgttttttccttttctcaatcctagtgtctggccctatgtatttgtgccttaggtaattgtgttttgtttttttttgcattgcagtgagcatgcattttctctctcctcctctttcttatctcatataacctatagttacatttataattagtaatttttaatattaactaaatacgtttgtgtaatttaaattttattttaaaggtagatgggtagtaatataactcacttttaaaataaaataacattttattcctaaataaacctgattttttaaagcgttggcaaagtggaaagtgtgcgtccttgaagacagaaggttccactgcaaatgaagcataccattaccgaacagcagttggctcactgcaccaattaaaaatttgcagctggtcagctatatgacaaagtaatgtagctggaggctcacagggagaattattgatcttttttaggaatttttaacactttgtagcccatccttataataataatgaataaataacaaggaaagtcatgttgttccaccttgctgctgttgaaacgtactcagtgttcataggatagcagtggcgttaagcttaagcaaaaccaatcagagcccttaaccaaattctcatacctgacagtaagcctagttaaaaagagaacctagatggcagtcagctgtagcagagagatttttctctgcgataagtaaaggagttcaaagggattttaaattctgatcttggacccaaaacacttgatctctgattcactgagagttggatatatttatttttacaaagtttacgtgttcataacagctttctctttttatatgttaggatttaaccatgagatttcagatttctgaccacagtattctagctgtgttcagaatccatgctttgggaatcactgaaatgcatcagctattcctatgggataacagtaatacctacatgaatatttattaagcattattctaatattcatgccttagcatattcagtcctcagaattcctgaataaattaatgcatgtaatgcactgtgtgggcattatgacttccctcttttccaaaagaggaacctgagacctggaaagattagttatctcacccaaagtatatagccaggaattgacaaatcctggataaaaacccaaaaggacctggccccagaagcttctctctaaactgatacagcatcctggctcagaagtttaagcaaaagagacattttgttttgaagagagatctataaaaagaagccagtattgggatttggtctagacaatgggatagtgtgtagcgtagatggtatagtatagtgttagaatcttaccattaatactttgtaatcactgcattataggtggctcagcttatcaaccttcctcgccctcacctgtagtgggggtctgtggttgcttacttgtctgattcctacacagtccatagctcttgagtcactctcaaatgctttgattttcttctctctatttctagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaatcagactgtgtctaaaactttctttgtgtctctcacctaacacagaatcccagaaaatcccttcaaggatgttttcaatggtcttgagaaaagtaatgatgagttatcacacatgaaatcatgaaatcaggtcattcagaatcctcctggctcctagtctatagagtgtgtaatatttcttcaaaagtgaataacatagcacataattgttacattttacagagacttaatgcttttttaaagctgatgaaaaacaggattcacctcaaactttcattacaactttaaaactaaatagcaaaggcctgaaatgtatatgctgcgtatgaagtactagtgaatcagttcagggtaattcattgcttctgctcctcagaagccagtgtgaaaaggaaagactgaagtacatgatgtaaggcagtttcccaaattgagttctcgggaacactactaagaatcagtattgtcctgcaatgcattattgtactctagaatcagagcacctgtgttgaaattctggtttctgcacatcctaactctgtgaaaagtaaatctctctgagccttaatttccttatatttaaagtagacacaataataccactaccttataaggttgttttaaagtgctcagcacagttattggcatatatacctatatatgaaatgctcaataaatatgaactcattatttccttaagattttcataggtgttatttgacaaaggcttttatcatcaaataagtatcatttatgtctggattttaaaaaatcaatcaagttactttagttaggacccattcaagtatttaatatgtgaacatttgatgggaatatctgcgggaagttggattatagtggcaggatgttttcatatgtatttgactccagatttcttaagtatggagctttttgtggggatcatcttctgagggatgtatcctggggaataattatggaaggtgacataaattaataacttattgtcaaatgaataggatcagaacaatcaaagcaaggtgtaatgtaggagtgaagcacaagtttgcctcccagagcgaccagagtagctccccttttacagaagcccctgctctaaatggtgtaataaggacagtgtcaggaatgtgaagtgacaggtggatcctctagactagatgatctgtgctgaaagctgatataaaatcactgtttggtcacacctgtgtatttccggtggtaccagaggagttgtggttttcttcacttggcttctattctgggccagctaatgctgaaattcagaggttatatctgagttcacattcatacattacatgtatgggactactctaaatttattagcaaagcattatatgaacttcctcaaaaggacatcaagaaaagactaaggcctggaatgagagaaagacactggtgtaggtcttattgacagcaaaatttcattatagtcagttaaagctaagtattaaagaggaggcagttgttttatttatattttatgtatttatttttatttattttttatttttgagacacagttttactcttgtcacctaggctgaagtgcagtggcatgatctcggctcactgcaaccactgcctcctgggttcaagtgattctcctgcctcagcctcccaagtagctgggactacacaggcatgtgccaccacgcctggctaatttttgtatttttgctagagacaggatttcaccatgttggccaggctggtctcaaactcctgacctcaggtgatcctcctgcctcagcctcccaaagtgctgggattacaggtgtgagccaccacgcccagctcattgttttataataacagcatgaaaaggactaaggcaaggtatctgtttaactttgtgagaaactgccaaacctgtttccaaagagattgtaccattttacctgtcctctagcaatgttcacaaattccaggcgctctatttcctcaccaatttttggagctgtcaaactttcaaattttagccatactgatggatgcatagttttattacattgtgctttaaatttgcatttattggatactaatgatgttggacaatttttcatagccttatttgtcattagctaatatatctttttgtgaagtatctgttaaaatgtttagctcatttttgttactggtcatttgtttttaaatttaatgtatgttaggatatagacacagacgcatatatatctcaaataaaagtcctgtgtcagatatatgaattgttaatattatcacccagtttgtgaattcattttcttttaaacagaatctttaaaactttgatggcatttattgtatcaatttattctatgcttagtggtttctaaattcagtattagcaatctttgcctaaagttagaaaggtattcaggttagaaaggtatccttctgtgttttcttctggaagactggtagatttttcttttagagttaggcctatgatccatttttttaatactctgaggtactgggttaatgtttagtgttttgtttttccacatagataaccagttgttctcatatcatattgaaaaatctttcctttgtttgttgaattgttcagaaaagagcccaaaaaattaattctatgaatatagatctatttctgcattccctgctctgttcatctgtttatctatctttagtccaatgccactttatcctggttaacatagttttaaaatttaaagtaagtcatgaaatcacatactatatgtcttcccccttttttctttttgaagattgattcaactattttaggaaccatatattttttttcgtatagatcatagtatcagtttgtccatttctacataaaggcctgatgatattttgattgtatttaatttataaatcagtctggagaaaattgaaatcttaacaatactgtattttccagtccatggatataatatatctctccatttatttagatcttaacttttttcagcattttttcttttagatttgagtgtacaggccttgcatatatattgttaaatgtatgcctaaatattttgtttttgatgctattgtaatagtacttttatttaaatttatttttgagacagagtctcactgtcacttaggctgcagtgcagtggcgtgatctcggctcactgcaatctccacctcctgagttcaagcaattctcctgcctcagcctccagagtagctgcgattacaggtccccactaccatacccggctaatttttatagttttagtagagacggggtttctccatgttggccaggcttgtctcaaactcctgacctcagatgatccaccctcctcagcctccctcccaaagtgctgggattatagtcgtgagccaccatgcccggcctgtaatagtactttttaaattttcattttccagttgttcattgaaaatgcaattaattgatttgtatatattgatcttgaccttttgaactttagggtggggtttgtttgtttagtttgttaggattttccatatgcttgattgtgtcacccatcatcaaacagatttttacttcttcctttctaaatttcataactttaataactttttactgtccgtttcactcttttggacctccagtacaatgttctgtagaagttttgagagcagccatctttgcattgtttccaaatttagagggcaagccttcaggtttttatatacaggatttttttgtagatgacctttattttcatgagcaattttttcattttcagtttgccgagaatttttttgtgtgagtatgttgagttttgttgaatacttaactggatctattgagagaattatatgtttttatttttaatctgtcagtgtgatgatttatacttactgattttgaaatgttcatccaattttgcatgtccagaataaaccctcatattgtcatgatttattgtcctttttatatattactggatttgatttactaatattttgtcacagatttttgttcatgttaagaatttttttttttttttttttgagacagagtttccctcttgttgcccaggctggagtacagtggcgcgatctcggctcagtgcaacctccacctcctgggttcaaatgattctcctgcctcagcctcctgagtagctgggattagaggcacccgccaccataccagcgaattttttttttcttttcagtagagattgggtttcaccaaattttgttcatatctttgttcatgaaggatattggtttgtttggtttgtagtattcttttcttgtaatgctgtgactaatgtgagggttatgctggtctcattacatgagctgggtaatgttccctcttttgtgattatgtgaaagcctatgggtaaaactggtattatttcttgctcaaaagaattactcatataactatctgggcctgttgtgtttttttttttgttgttgttttttttgagaaggagtctcgctctttcgcccaggctggagtgcagtggcgcgatctcggctcactgcaagctcggcctcccgggttcacgccattctcctgcctcagcctcccgagtagctgggactacaggcgtccgcctccacggccggctaattttttgtattttcagtagagacggggtttcactgtgttaaccaggatggtctcgatctcctgaccttgtgatccgcccgcctaggcctcccaaagtgctgggattacaggcgtgagccaccgtgcccggccgttgttttctttttgggaaagcttttaattatgaattcagtgtcctttttagttattgagattttctgtttcttcttgtggcagttttggctttcaaggcatttttttccatttcatctaagttgtcacattattggcatacttttctttagattatttcctattatccttttaatgtctgcaggatttttagtgatgttccactgtcactcctgatattagtaattggtgttttgcctttttttgtccttcatcagtcaagataagggtttctcaattttgctaattttttcaatgaacatatttttattgatttttctctgttgtttatatatttatttactttattcatatacttattttcctctttttgcatactttgcacttcattttctttttgtcagtcatcctaaaatgtaagctgtatcactgatttttaagtaattcttcttttccaatataagtattctgagctatgtgttttcctcataggattagtttaactaaatccaacaaatgttgaaatgtcgagtttttgttattattaagttcaaaatactttctaatttctgttttcatttctttttgacctaagggttatttcagtgtgtgttttttaatttaaacatgcttggaattttccagatcgttttactacattatatatgaaaattcatttgaattttagagttggctttatgttcactcttgatagttatttgtaacatttcatattgtcatttaagtttagctaatgtaaaaaattagaaaaaaagtctgggagcaggtatctccaacttagaactacctgagagaactacattacggagtggagaaacataggtttttgttctagatagacctgggttcaagttccggactcagtgctggctgtgtatatgaactagtacaagccttccttttcttatccttcaggttcaatttccagggtatctgtgaaaaccgagggaatggggaatgagagctttgccacagtgctgcacacttgattctaatttctaatcttttatttaattctgatgtgtccaaagaacatactttgcatgattttattctttttaagcttattggtacttaaaaaaaaagtatttgcagactgcctatcttggtaaatgtttgatatgcatttgaaaaagacatatattttgtagtttcgagtggtgtccagtaaatgtcaactaagaaaattggtgtcagtgttgttcatgtcttcaatatccttctgatttttccaatatactttgttattcagttattaaaagagagaatggtgttgaaatctttacatataatatggatttttccaattctctcttcagttctgccagtatttgtctcatgtattttggaactgtgatatttaatacatgcttatttaggattgacaagtctttttcatgaattgactcttaaattgtgaaatgtccgttttttctctgttaatactctgtgtctaatatgaatgtagccattccagctttctttttttttacttttttaattaattaatttttttttggtagagggacggagtcttgctctgtcgcccaggctggagtgcagtggtgcgatctcagctcactgccagctttcttataattagtatatgttttttccattattttattttacctatcagcatctttatgcttttatacttatactttatacttaatgtatgtatcttatttacagcatattattgggtattggatccaatctgatcatttctggcttttaacttgaatgtttaatccatttttctttaattattaatatgactgcctttaagtttaccatcttgctatttgttgtccacctgtctttatttttatctcctctagactaattggtattttcattgtattttattttatcacttttttgagcttttggctcttcctttttgtttggggcttgttttgttttgtttcctctagagtttataatatttttcctaaacttatcagttgatcttgaattaatcactttacatattttatgagaaacttactatggcgtatttccatttcttccctcccatcctttgtgttgtgctataatacattttggttttgcatgaattacagtgtaccaacatgtattgtgaaagtttggctttaaataactgtcttctattaagttaagaactgatctttttttaaatttatttgcttattttttatttctgacactatccattcttggtaacattttaatctgaagaactatttaatgtttctggtacatctgctggtgacaaattctctcagctttgttttaatctgaaaatgtcctatttcattttaatttttatatttcaaaactttactaagaaagttttcaaatatatggaagattttaaggaattacacagtgagcagtaatacagcctacctagatcctaccattaacattggttatctttgctttatcacatgtctattcattcttctgccagtatatcaatccatcttattttctgatacatttcaaagtagatgcagacatcagtaaacatttaagctccttatcattatcagtgttttaatatttatttgtaggtttcttttctaggtaaaatttgcataaagtaacaaattgcataattcaagtgtaccatttgataatttttgagaaatgcatatatatatgcattacctaatatcctattaagatatagaatattaccatcaccagaaagtaacattcttccccttatcagtcaatcctttctacccccaccttccccacctccccaaacaatacaactgtttttatttccttttttagaatagttttttttttatatattctagaactctgtgtatgtggacccatacagaatgcgctactgtataactgtaccttcactcagcaaatgttcttgatattcacccatgctgttgtgtgtatcaggcattttctccttttgtttgccatggagtggttttgttttgtttttgttttgtttaagaatgcagaatgatttgtttattcattctctgggtggtgaacatttgggttgttatcagttttggggtcttttgaataaagcttctgtgaactttcttatccaagtttcttaatggactaccgcttttacttctctgagatgaatacctatgagtggaattactgacttagttttatcagaaactgttagacctttttttttccccaagtggctgtatcattccatattccaccatcaacatatttacatcttaaggatttggtgttgtcagccttctttgttttagcaattataggtgagtgtatggtggtatcttactgtagtttaattcttcatttccctgatgtctcaaaatactgagcacttacacctcatgtgcttattggccatctgtatgtattttttgatgtgactgttcaaacattttgttcattttataaatagtttgtattttattattgaatcttagctgttcttcatctgtcctggataccagtcctttgtcagacacatgttttgcaaatacttttccccagtctgttgcatgacaatttgttttttcgtgaagtgttttaatgagcagaggttctcattttttatgagatgtaatttattaacttcttctttaatgattattaatttctgtgttctaagaaagctttgcttacccatagtcaggaaggttcacctttgtttaggcctatagtccatctcttttcttttttttcatgaatggtgtgtagtagaaattgaagttcagttttcctttcataccgatatccagttgttccagcacaattaattggaaagatttttactttctcattatgtttctctggtgcctttgtcaatattttcacaggatatgttgaaagtgtatctatttcttttctttcagccctttaaggtattccattgtctcctggctaatattatttaaaatgcaaacggggcagtttttgttgctgctgttgttcttgtttatttttgtgccctttatgtatttgttatgtttttctttggcagattttaagatcaccttttctttattgattttgaaaatcaaattatgatggcctgtggtgtcctttgtgtgtgtgtgtttcttacttagagtttattaaacttctcagttctatgtgtttatatttttcctttactgtgaacaattttcagccattttcttttcaaatatgtctagctttccccctcactctttctcttcttttagtactccagctgaaattaggatagaccactgctatccaattagtagtgccccacagatcactgatctcgttatttttatttcttcctttttcatccttttccctgctctgtgtttgtgtagtttccaatgtatgctggccattttctttgtgatgtctaatcgatagcattttctttatttcagaattgtatcttttagcttttgaatttccatatcttcattgaaaggtccctattgatattttctatttgctgttcacaatgttcatggttttaaaaaaattgaacaaatacacatagaatactcatttttaggtgtttatctgataattccaccacttttgtcaatttttgttctgttttgattagctatctttttattagctaatatagacttttttgcttttttatatagctttttaaaaattatatgctggatattatggatgttacaattttgagttctgaatttcgtaagacagtgttaaattttgttctagagggtaattaaattacttgcataactgcttgcttttaaaaaagcatcttatctttgttaaagcaggtctaaaatagccttttctgtaaggttagattggacctacttctaaagcatgtcatacctgaagtctctaattaatactggggagctaaacacagtctcttcactctgagtggcctgtacccaactgtctcacagcccttcatgtgctcctagagttgatctgttcccagctattctttgcctaaccttttaaagtattcccccaaatatgtgtagctttgtatttggccgaagactcgagataatcctgtgcagatttctagagttccatctctaaatagttctcttctctataaatgcaatctgactcaacagcagccttgaactctcatttctatctctttagctcagtgtgaccactttctcattttggctttcccttctctgtgccacagtttaaaaggtgcctttaatcgaaaagccagagtgatcgtagcatttacctcttttttgtcttttctctcacagatcacattcctgtgttaccagttgtccaactttttacaaactgtattttagatatggaaggaaggctagtccaggactagttactcctttaagaacagaagctgaagtccaaagtgcacatgttttaacacactataatagccaaatcagtaacatctgcgagttaatttagtcataggtctctgatttatcataattttaataaagcattccctttgtttacaactcaggagaatggtcattaccacagttccaaaaattatccatcagtcccaataatttagaacggagtagccatgggttctgtggcagggaacacttggaggtgcaagcagctggcatttagttgggacatgcagtggatggcaaggctccaactgcaataataaagatgacggaaatcactcagatttcctagagaaacgtgattgtagagcaagaactcaaaacagggaaaatgccaagagctaaccaaggtggttacctggaaatttgggctttgaagccagttatttacattgaactacaaaagggatggaaaaaatactgatttaaggactaacaaccatcaaggagctaaatctggctacatcctgaatcagaatattagtaaaatcaatgagagaagtttaggagtccagtttggtcgtactacatcatgtctttctgataggaaattctttttttatttttatttttatttttttgagacagagttttgctcttgttgccaaggctggagtgcaatggtgcaatcttggctcactgcaacctccgcctcccaggttcaagcgattctcctgcctcagcctcccgagtagctgggattacaggcatgcgccaccacacccggctaattttgtatttttagttgagacagggtttctccatgttggtcaggctggtctcaaactcccgacctcaggtgatccaccggtcttggcctcccaaagtgttggggttacaggcgtgagccactgcgcccggcctctgataggaaattctttagtctggcattgcatcagagtgaaatctttttgtcaaaacacctgagggtccagctaggcagtcagcaaatgtagtctgagggtcactctttccctgtaagccagcactgctttacctgaaagccctgtagagaacctcttgcatgtgacttaagctatttagaaaatccagctagtagattatttaagagttcgatacgttaagtagcattaatgactcctttttatcaagattgctctacaaaatacagtctgtaaatatgacaaatgactgtatgacacaaaacagaattaaaatgccccattagaaataaaatgggcagtagtaaaatgaatgaggcaggggaaatttatgagggtaattgatctctcggtcattaagcaggctctctattggcatttaacaaaaatccatttcaggtacgtgcagccagcaacaacctccacccccattacaaaatgttcatccagagagagccaaaataactgagcaaataatgaaaataacagtggaaattaccctgttgtactgttaacataacgtactcagaaataccaaggacacagtgattttcatgccagctatccaaatagatcttagtaaactttcagcaactgcactaacacagcttctggaatttatgatggagttttcttgttttaaggtgccattattcatggaaggagtagaagagtacctggtaataattttgcactgctaagtcccaggctatacctgtggcaggattaatatccccagtttaggataataaaatcaaaactctatgattcaccctttaataagagaacttcaggttcagctccaggctgcttaccattttctgctttgaatagatgcctttttaaaaagtgatttcctggatgtgaagctgatctgcctgcaacatctgtcaccccattgatcaccagggtagattcagcttatctggctggctaagcgggtgtccccttcctccctcactgtttcacgtgactccttcccgaagctgcgcactcagtggaagaggacgaccatctgcaatagagggggactggtcttttgtcaagggtataggagtagctgtgctcccctgctagaacctccaaacaagctctcaaggttcataaacgtgattctatttcaactgttgtatgatcaataattgagcttcatcgtgatggtgttcaaagatccccgcactttggagtcagggagcctctacagcaattccagcttggaatgagattcttctaagctgtgtctcagcaaacatttaacatctacaatgttctaggtgcttacagaagccttccctcaccaccttatgcagtacaccgcccttgccccagtcccacccttcaatcacctctatcacattaccatggtttatttctcttatagcactaatcactatttaaaattaaccagctgatttatttctttacatatttactgccctgaattagaatattagccacaaaagggcagagaccctttccgtcttattcaccattgtatccccagaagcttctggcaaatggtagatgtcaatagataataatcaaattgactaatacacaatttaagccactcctgcttcagacccagtaaatatactgttcctccttcaaacacttaaacttcattatcacaagctaataaagcaactaaataaaattgtgaaacataatttagtaatagacttctaaatatcccagaagtgtaaaatcttatatgtggaaatgttcattgagatactaggcattctagggatatcatggaagaaaaagacataatctctacctgaaagactgtaaaggtatagttaatgagagggagtgaagaagctgacctgtagacaaattacaatataataagtaatgctgtaatcaaatgataaacaaagggaagagtaaaaatttctacacgggagagccaggtttcaataaaaattttattctataaaagcttatataaaataatgatattcgagcatagacttggaaactaaaaagagaaaggacttccagccagaagtcacagcatgagaaacgggcatcatattaaatcttcctgatgtttttgatgaaaaagcaatggtaaatgagaaaggaaggaaggtggttagtaatttggttgtgacagaccttgattatagggctaatgagttaagatctggtttttaagtactggagaattacctcactctatttctgatacttccaaagaaactgcaaaggtgcctaaaatataaaaaataagtagataatgcagaaatctgttcacaatcagatattgcaagttcacctctagaatatgtactgaagaactgtgaacatgggaaataacttccagaaccaagcatattcagcatctggtggatgtcctttgcttttgcacagtgaaaataatgtttttgaggccgatttccaagtagaaaggaaagacaattaaattcctttcatactacactagacaagagaatgaaactatagtggaaaaatattgagatttttactcaaatcagctgcatcaacaattaaaattctaccaataccgtggacttcttcaggtagcaatgagaactccatcccaagatatggaccgaggatggaatgataattttcaaaaatatttgtaaggaggtttaggtgtcaaattgtgacttgaatttgatgaccttctaagcccttcctgatgttatgattctgttttaatttatatattgtcaaagactattcaaataaaaaacaccttctatgccaggtgctggaaacaaaaagataaacataacacagtctagtattttaaaatagtgctaaactctacaatgttatctctgattgttcatacataggcaggtgcatagctaagctgcttggcttatccagctatttgccgggatggtgggtcactgtggtcaccacacagaaatcaattctgtttctttgttgttcattccagtgccagctccaagatacacagtggaactggcttgtggttttggagccacagtcctgctagtggtgattctcattgttgtttaccatgtttactggctagagatggtcctattttaccgggctcattttggaacagatgaaaccattttaggtaagtaacagaaatttgacataaacctcttctactgtcatctttagaacatatgttgtaaaaaaaagaaaaaagaaaacatgttgatttgaaaaacctagattaactggaagatttaagcagattaactttaatttcaaccgttgctattagaaatctttccgaagattattattctattttcttggattaattagtgagtcggtctaaattaacaccctccaaatagaaatataatgcgagccacttacctacttaaaatttcccagtgaccacattagtaaaagtaaaaagaaacaagtaaaaataacgaattgactaaatatatttataatactattttttagcatgcaattaatattaaaaagctaatgagatattttagtgttttctttggtactaaaaatgttcaaaatgtaaaatgtattctactttatccttatagcacatctcaattcaaaccagccacatttcgagtgagcaatagactcgtgactcgtggctgctgtattggacagtgctgatccacactccttgtactcagatagagatctgtgaaccagcagcaacatatcacgtgtagcttattagaagaagaatcttagacctagcccctactgactcagaatctacatttaaaccatattcccaagtgattcatgtgtacgttaacatctgaaaagcacagctctagtgcaaatttgcttagtgaaaagaatagagcatttaaacatacaaattcataggtccaccccataaagattttaattcagtaggcttatggaagaaacacggaatcgatagtttttaatgagatgtgatttttctaattaagcaacttcgtgaaagattggtccattaaatctaattatatttttaattttagttcttttcagatataaataattcaggcagtttcacaaggttttactcaatttgtaattttaagatattaatgagtgataggcttggacaggaagttgaaattttctctacagtgttaattgccagtacctatgatttaccttctggctttgttaatttacagttgaatgggacaaacctcactctttttccactgtaaagcaacctgtaagatgagagttgaggatatatcagataacattcaaaattacatcttcaaatagtcgttttgcgtggagacttgttgcaagtagaaaatcgcactggaatctgtcacataatgaaaatgtctaatatgcagaagttagatttaagaaaaatgtaatggtattgagaaactttcctaatttacattgtatctgtgttccttttgctagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaagtaggtatttcagaggagtacaaatgatgctaccttgaaaggcagacagaatcattagttttgcattatgggagagagtcatggcacagcatctttggatatttaatgtccgatgctctttgatgtaacagactcctctagaaataaaactacgttggaaatgtatactattcaactcagtttatggtattaaaatattttcccttgcaatctttcagagatgcatgtcagaaaagcatggaggcacagtggattagagctctgttaaagggccatagctgtaaacatcctgtttattcacatttagatttttcggtttaggctaatctacactggttggtctagaactgttttacaagactgagaatttttttttaaagcagttttattttggttttagaaagacagaggtttacttggttttactaaaagtgagtggcggaagagtgtgggtagaatttttccttatgtgattcactgataataattacagtattttcctgtggcatttgctcttttttttccccctcacttttcttttcaagcaaaatagtgctactcaaattccccttttccttgggtctatttcttcttcctgtcagcttatacatttgagggttactttaaaattttataatagccagtgtaactagaaggtttaaaaagaaaggaaatgcctaaattcttgaatgtgttaaaataaaagtacaactcctttttagatccgcacagtaacacacaaagtaatttttcattggtgtctttttaataaatatataagttacattcccaaacccactgttaaactttatcctgttgaaatgcttgtaatatatctaatcataagcaagacaaaccaattttactcctctaaaatcctgtctacattcatcatttaacagtttttttttaaatattgcatggataattgagatagacttgaaattttattctcattttgatttagttggatcagttattttatcttcccaatcatcaaccaaaagtccatcataagatgtttctttcagtataatttttccaggaagttatgacttaattatacagttaaaggataaattccactcattttaatacttaatttccccagtcatttattcacccatttatttgttcgtacagccattcaataaatacttatctaccacggaactgggtaagaccctccaataggggttgataattctttgaagaattcacattctgcataattactcttgcatcttgcatttgttagttagcttttgcttccttttttattctccctgccgctcttacccaatcttctttgactctgggtctcttgccatgcttgcacatgctcagcctccagtgccactgcttggaacacacaatcattcctggattctcccccaggctgtgcatgctagattttaatcacaaggctttccctactgtttctgaacctgtgaagattaaggggcaaaatgacttcataaaggaatatatcaagacatgatataagtttccacaattctagtaagttacctagagttggcaaccatctgaaacacaggtaaaggactatgcaatcctcgataagcaactgtgaggagatggattggttccaagaatttagtgacagaaactaatcagggcccttgacagcagaataaaattacatggcatttccagttttcctgctttttcttcttttttcgttgaagaaagcatttgcctgttagtgcaagtagacacatcatctagcagctgccgaaacacatagctttatagtaatggtcggagtttgaggagaaagatccagcgattaatttaggctccaggggagaaagaagtagaaagcccaccgaggatgtgttaccagccaaaatgccattcagttggctagattttgttaagcttctagtctaaggacatagtgatgttagagtcagagaggtatccaacaatagagagggactttcagaagatgaaggtctctaactttgttgtcctgtcctagcaaaagataaaattctatttttttgattatataacatatacctttttgagtgtccattggtactagagagtttatgcatggtgcatgggtttctttggtgaagaaagggctcatgagctgacgtggctagaccataagatgccacacactttaaagaaactgctttcagtataatgtgtctactccttgtgtctcaagtgttgtttttgaagatcaaggtcacaacactatactaccttttggcttcatgcctgtttggaattctttttagaaatatgtgtatatagtttctgttttccctgaagacagtggtatttaacaaagagagtttgcaggtataaggattaagttgttcacatttttgctggtaaaatgtttcacctcaattcttaggctggtaccctaagttccctacatttgctcctcaagcctcaatgcttttggggagtttttggccaacactaatccccatggttgttttctttcccagttgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaattttattttgtgcatgtgttttatgtcatttggtcatttggtcatttcacatttggtcataagtgaaaacagaaagaatttattatattcacaaagaaatataataagttacattagttaagtgtctttctgagataaatctgagtaaaatgggaacttcttatcaagaacattttctttacatggaagtaaaagttacttaagtaaaatgaattgttccagaatactaggacatattttatgggtgtatatgtgtttatgtgtgtatgtgtatgtgtatgtgtatgtgtatgtgtgtatgcagagagacagaaagactgtcaaaaagatggaaagatacagagagacagagaaaaaggagagaaagattattttaatacaaaggaaaacaagcttattcctttttactcaacttggaacttaggtcgtttacaggaatatttttcatctaataggctttaacgcaaccacacggtagttgctttggaaatagataaaactaatgccatgactttagttaattgatgatcatttgaatcaaagatgcatttctgttacaaattttgaataaatcagtgattaatatttggaaacatattttattttcggttaataatacaagtccatagtgacagggatgcctttttgctttaaaaaaaaaaatccctggccaggcgcggtggctcacgctgtaatcccagcactttgggaggctgaagcggatggatcaagaggtcaggagatcgagaccatcctggccaacatggtgaaaccctgtctctattaaaatacaaaaaattagctgggcatagtggtgcacgcctgtagtcccagctactcgggaggctaaggcaggggaatcgcttgaacccgggaggcggagattgcagtgagctgagattgcaccactggactccagcctggcgacagagcgagacttcagaaaaaaaaaaaaaatcctatttgttcattttactgagccctgtaacatgctcagaattggttagcttagtaaaggttcttctactgaagaattaattttccttttgcaaaccagccccaaaagtgtaggcttaggatcaacggatcgaagttacaaggcaacagatttctgctcagttagaaaatagctgtaaagcagagttcgacactaatggaattcactatctttggaaatactaggcctgccattaccagaggtatataagcatttatttgatagattttcattgagattttgtatatgagttttttgcactggataagtggttttgagtctgaagttgtttccaaccctgaacgtgttaagtgacctactagaacatactggtgactctttggaagattcaacttcagcattttgcatatgatctacctggctgtgattaaccttccttaaactctcaagatttttttttccagtatatactgatgtcactagctctttaacgcaagtaaatacacagtatggtatgagagacgggtttagcaactagtctatcttatttctctgtttctactcaaggaatataaagtaaccttagtaatgagttaggagatggagtgttttagtagtaattttaatctacatctatttaaaactgaatagacagaacttttacacactattactcttataaatccacatagtaagatgatattttaaagttagcattaataattgatacagattcaataaacattagtccatatatgattttactattgtgttcactagacgttgagcaacagtaatttaatcaaagtgatttatgcaatgtgtactgtgtgctagaaattcacatgtaggcatctaatttgtttatcagccctacgagtttactttatcatatgcattttatagatggatgaactaggactcaaaagatattaagatacaaatagggataaatggagaaagcaatatttgaaaccacattcgtcttccaagttaaatatttccttttttctatacttcaagttttaatagagaaaatgaaagagacagaggtttgctgttcttttatctactaataactcatccagaggagaaaaaaaaaaatgaccatcctagttttcttctaagtgaactccatggaagttatgacttttacaggcaagagtattcttgagtattgaagagttctcagtcatacaacatgacttcaaagccaatttagtaccacacaagaaaacaaatctcattattatatggccatacctcattttttgagccaaacagaataaatgagctaaattactactcctccaagtaaactttagcattaaaaataatagctcctgtcctcaaatatgaagttttggcaatatagaaggtattttaaaaatatgcaataaagcatgcaactccctttacagtattaagtgaagatccttcggtatagcccaggacctttctgagaagcatctcctacatgtgtttctcaacgtctaaaattccgccactcttacctgcatttagcattgtcctctttcaaatctaaacttcctcactttctggatggagtaccaataaaaaaattaaagagcaacagactcaaaagtcattttttaagaagatctggaacagtgtttgttgtattttaaacaacaatattcctattggcaaaaacatacattttcctaaggtgactgttttgaagtgaaacatcatatcacacacacacacacacacacacacacacacacacacacaatttgcatgagttctctttgttgacaagctagccatgttgccttaaggttatttcacatttctcaggagccaggagaagcagtagacttcccactttcatattctctgatttatgagaggcagcctcttaagattctgagtaggactagaggggactgaggagttgctaaaacacatgcacatgtgcacacactcgtacacacagaagggttttaatgataaacgagaatttaaatttatctcttaagaatgaatgaaacaaaatgtctctaaaaacatttttgcactcctgcttaaaccaatcaaaagttctcaaaacttgagcacgtgtctctccaatttcccttcaaattcatgttaaatccactgattgaaaaaaacaaaactataatctgtaagaagcacagctcccttattccctgtcaagttcacaatgaccaatgcaaactttcagtctgtcttccaaggctgaaaactctctccgttactgtttcgtccctggaccaaaagcagaggtgttcaccctcacacggtgactctggcacatgttttcaaagttataaatggctaggatttacaattttgaacctttttccttcaggatatggcatgttctaagctcctaaatctcacagtgagttaagcattacatttatttgaagaactttcccttgggatctgtccaaatccactttgataccattagaatcgaatggtttgccagaagtcttagctacttgactaattcttacccattttcattgtttttgcccctttaattccaattcttcacacacagacgcacacacacacgcaccacacacacagaaaaaagaatttaattgataacaagataaatactatgaactactatgaactgtccgatgttgtgtccaaaaatgttaagtatcaaaggatataactgagaatcttaggaggtgataattcctgttgctctttgctgatcagactatgtcaggagcattatgttcactcctgttcataatactactcttagaagacacatctataaactgaacattatccagaggaaaatggtaaacatgcagaggagacatgaggccatgtcatttatggaataagagaaatatcctgaaaatatttaatccagacataagaagaaaatactacaaagatataaaaatggttttcaaatattctaaacatttaaagactcaagatctgaccaccagataacatttgcgaggaagaagatttcaaaacaagaaataatttgtaaacagagctgaaatgacttgcttttgatggtggctaatattttgagggtagttactcaattgcccaccgtgtgtgtgtgtgtgtgtgtgtgtgtgtgtgtgtgtgtgtgtgtgtgttttaagaaagacttattgaagaaggagactactgcaatgagggttttgcagtaggagagagagactgagctcaactaccataccatccttgaaggcagtaaattcttagcaaccattgacaagagtggtgtagatttttttgactgggtaaattattcagcactgagattctgtcatctcaagtgtttgttcattccctgtcctctggaggatggacaataacgaactggaatatatgtaagttttcactatacattgtcctatatttccattttcctatagatacagtggaagcagtttttgatttcattcagagaagcagaaggatgattgttgttctgagccctgactatgtgacagaaaagagcatcagcatgctggagtttaaactgggtgtcatgtgccagaactccattgccaccaagctcattgtggttgagtaccgtccccttgagcacccgcacccaggcattcttcagctcaaagagtctgtgtcttttgtgagctggaagggagaaaagtccaaacattctggctctaaattctggaaagctttgcggttggctcttcccctgagaagtctgagtgccagttctggctggaatgagagctgctcttcccagtctgacatcagtctggatcacgttcaaaggaggagaagtcgtttgaaagagcccccagaacttcagagctcagagagggctgcaggtagccctccagccccaggcacaatgtccaagcaccgagggaagtcctccgccacctgccgctgttgtgtcacctactgtgaaggagagaatcaccttaggaacaagagccgggcagagattcataaccagccccagtgggagacacacctctgtaagcctgttccccaagagtcagaaactcaatggatacaaaatggcaccagattggaaccccctgctccccagatctcagcccttgctcttcatcatttcacggacttatccaataacaacgacttttatatcctataattactgtgtgtggtgggtggtggctactatctctaccaaccctctgtatgtcatgaacctgtgggaaaatctgacatttttatcatctaatggactatcagatttctgtcccctttattgatttttaaaaactatttatttctaggagacaaaagacctgaaggacctgaatccagaattattgcctctaaaggcctcagaagagcacactcttcttgggccctagaaggtcagtatgtgaaagttgcctaaagtctgatcctctatcttgtccaatggtttaaaactgagctaagaatttaaatgtgtttcttttcagtgagttgatcaacctcacattataagtcagtcaggtgtacttgggctatgatgcttacagggtgtatgcattcccagggagcagcatggaaaggagctggttctggtggaagctgtaggacgaagctcaacagaaaacctacagcacatttttcctcaaagaaccaaacatacccacccagggatacatggcgttctctgtctcactgtaaactagtgttctctaaactgcctaacattgttagcatcaataaaattctatttttacgtcattttatttgtactaacaaatttttacatctctctcacccttctacttcctatgattgttgtattcttatctggagagtattccatttcagaaaatggagatttggtttaggtaccagaaaaactaagatgccttttttgtttctctctgatatgtaatgggagagatgtggaaaataaccaaaagagagggagaatgtgacttaaatgaaatggaagtttacaacaatctcatatttttagaactgacagatgaaaaattccgtattgtaagtgatgtagcgtagaaataggtgccttcgtcccattcaggcttctgagaagggataataaattcaagtgcctacaaggatcagaaggtaagagaaaagagaaaatatggccagataccagcttattttacatgctctccatctagaactgatgtgaatagggacataggcacagatagttatttcttctctgtaaacattttcataaactcatataaggcacatggcatttgatttccaagtcaggtagatcattggccctctaagcaactgaagaacacatatttcttaaaaagggtcagcttcaggccgggtgtggtggctcatgcctataatcccagcactttgggaagtcaagacttgtggatcaactgaggtcagttgttcaagagcagcctggccaacattgtgaaaccccatctctacaaaaatacaaaattagccaggtatggtggtgggcacctgtaatcccagctactcaggaggctgaggcaggagaaactcttgaacctaggaggtggaggttgcagtgagccgagatcgtgccactgcactccagacttggtgacagagcaagactccatcttaaaaaaaaaaaaaaaaatgggtagcttctactcagttccatttgatttttgtcactaattgagccccaatgttgccatattgtccatttttttctaaagaatctaaaaaattcagatttttatgtataatgtcaattatgggatggcttaaagttaagaaggaaaaaacaaagagccaaacaaattatatctgtgggacatagttagcctgagggcaactagtttgtaatttcataactaaagtattcagccaaagaacatatctccaaatggaattttagtgtccctgataataccagaactggaagacacaggttggctctaaggacatagtggagcatgtttatcctctcctcaaattgaagacatctgggctgttacaattgagctgatctgacctaaccctccattagaaaagaaaaatctggaaaattcggtgccttccatttactctttagaggtttcttgcctgcttactgtcagaaaataagaagaacgaagtctgctactcctgaacatgagcagaaccaaaaaagcaagagaccacaccttacatgagaagtcacctttaatacattagctgtggctgttagtgagttgtggcccaatgagtgtcagtggctcccggtcagtaacagtgaatgggcagtggggaaagaaagaaagcagtttcatctcactacccctcttgaaaatgttctcagaagatcctttctttgtcgaaacaaacaaacaaacaaaaaactagaagattcctactccaaagatgggggaacaagggccccctagagtaaatgtgaactcaccctgaaacttgtaatcagaaaacgacaggccaccctaactaaatatccagtagaaaatgacttagcacaacccaaaggccttgtcctctattaaatcccttcttgtaaagaataatccatccttgatgtatattcaagaaccttcagttggaagacagatagcagtttctctccaaatctattaataatgggtaatgtaagcggctccgaagctcaaggagggagaagattctctgacccactatcagtgttatgccttattaacacagcatctcaaagtgtaaaatatctttggaagaaaatgagaaattaaatttttcatttatacattattttctgttttagtgaagacaaagaaatgaaagaactattggcagagtcatggaaaattaaatatgagctcatattatatgagtagctagaaaattttggtgctctcaaaactacattttggcaagtatcaatttccttggacaatataagtgtagtggaagcagtaaaagtcttagttttcagtattagttatacagcggtcagaaagataatagactatacttctactgtatggagaaaggatcagaggttatattattatttcttgacctgacatgccaaattgaatgtgatgttcagtaccatacatttcaatgaagcaaattataataagaaagaaatttttttcatgggccatgcatatccataatagaaataacaggattgtagggtaaatggatatatcattgcataagaaatattgtctacttagttgcatgagttttaaatcaaatagagatggatgtgagtcctacttctctcctatctgtttgaacatggtctctctgagcctcaatttcctactagctaaaataaagatactattatcaacctcattggatgttgatggcattaaatgatatattatacatttatttcatatgcctcaccttttttaaactcttgtaaaatgtccaaaagcagtatagaacaggaccatattatccagcttaagtgactttcctagtgacactcagccaattatcaatagggttgagtctccaatccagactctgacacttgatccactgccaattctagaaccatccatgtaagattgaaggggaagtaattctattacaaagctacctcagtggaattatttaatctgggccataaaacattcaagtaaaaaaagcagttaatgtaaacccacacacagctaattaaatgttatattaagggtctgatatgtcatctgaccttgtcatattattattttacatggcttaattttaaaatattataaactttcttaaagcatttaaaagatagaatttttttaatgtcctctagactctatgataatgctatattttttgccttcaaaataaattatttgaatttttcttggtggaaaataaaaatatattcaccatttaccttgaaaaacaaattttctttggcagctcgataaaaactgaatttcagagttaccttctcctgtaactattaagaactctagtaacaatgtattcactcccagattgaagatttgaaggggctgggaaaactaatgttttggttcagaaaaagtcatgaataataaattgaactaatcataaagatatgcacagaaggataagcaatttatatggcattggtttaaaactttcgtgcatctaacttccgtgcacgtaacttgagggacatgttacagtgaaggtcccagggcaggcccttccccagagagaccaattcattaggtgctggacattgtctagaagtctgtatttttatattgtgtccttgataattaaatagagcatttcataggtcaatgttgaaaaactgctacctatgagaactctttcaaactctttccatattttttgtattattgctcaggttgtaagggaaaagagccgcaattaggagcttgcccaagccttcttgatatgtattccttaatgtatccacattggaaccatttggggctcatattaagatgcatgttatttgactccatccaagattaactaaatgaggatccctgatgtagggcggatctgcacgtggaataactttcccaggtgattctaatgcacacaaaaaaacaagaaccattaatttttatctctctttaactcctcttttacccttgtaggctctgattttctccagccaaggactacaaatcatcctcttaacaaggtgtttgcaggcaatagatgaaaacgtagggcatgtttagccctcgaagttgcctcagcacaaggaaacagttgaatagatgattagtagaatgtatttataatatatgaaatatcaatcagtgatatttggaacctggtgggatcgctgtagtcatcatatgtattaaccagaataagatatgctatgccatgctaacaaagaaccccaatatttcagtagcttcatataacaagacctatttcttgtttatgctacacgtccagcataggagcttacattttttttttttttttgagacggagtctcactctgttgccaggctggagtgcagtggcgtgatcttacctcactgcaacctccacctctcgggttcaagtgatcctcctgcctcagcctcccgagtagctgggactacaggtgcgcgtcaccacacccagataa

SEQ ID NO: 291 - DNA, 49120 bp, Homo sapiens
ctcccaaagtgctgggattacaggcgtcagccaccatgcccagccgtaaggagtactttttaatgaaaatataaaatcagcatgatagatttcagctgttatttttaaactgctggttggctcattgaaggcttacaggcaaaaaattccaaattccttaatttggtattcatatctggccaaatccacttttcctgtctccaagtgcaccacttcccttcacatatcctgtaaccctgccacagagaacttcttgtaatccctggattaactagagccttcaacagttttgtactttcgtacatttaagtcctctgtctaaaacatgtgttccccttgtatgttcattgcagcgctattcagaataccgaagacatggaatcaacctacgtgcccaacaacagtggatctgataaagaaaatgtagctgggtactgtggatcatgcctgtaatctcggcactctgggaggctgaggcagaaggatttcaagagcaaacaatctaagaccaggctgggcaacatatggagaccccatctctacaaaaaattaaaaagttagcaaacacctatggtcacagctacccaggaggctgaggtgggacgactgcttgatcctaggaggtcgaggctgtagcaagccacgatggtgccactgcactccagcctgggtgaaagagcgagaccctgtctcaaagaaaaaaaggtggtacatatacaccatgaaatactacacagccactaaaaagaaaatcatgccctttgcagcaacatggatgcagctaaaggccgttatcctaagtgaattaacaaaggaacagaaaaccaaacacctcatgttctcacttataagtaggagctaaacactgggtacacatagacataaaaatggaaacaatagacactggggtctataagaggtaggagggaggaagggcataaggctgaaaaactacctgttgggtactatgctcactacctgggtgatgggttccatcgtaccccaaatctcagcatcacacaatatacccttgtaacaaacctgcacatgtaccccctgaaactaacataaaaattaaaaaataaaatgtgttccttccatttattatttgtcttacttctatgcattcttgaaggtccaacagcagcagccattcgccctaacaattttggacatgtcattcaaaaagctcagcaatttaaaagaaatccccagcttgtttatcagtttgttgctgatactagcctaggtggataagcattttttcacccataaagatttagaatttagtatagaaatatatttaacaaaatcaaatccatgatattgtattaatattaatctgtatctacataaaagtttatgcacttgaatgtttaagagaatgaaacttgtagttccaatttaaaatatttaattgatttaatttgtctttttacattgaatcttatttaagttagtaagcaatatgggaacatttacaaaatcttaagggtcactaaatttataagtttaatgtataagatttataacattttcttaattacttagaacaattacatatttaaaaacaaagtcaattacactgaattttaaaattcaattttagagacttccactttgagccctgttggaataactgacaccagatgacctcccactgtaaacaaatagaacactgaacaaaacatatgaaacagccatctttagagactggcaaataggtaccacaaaactgtaatctaaaagaaaagaaaaacaaatgaggggaatcctaaaatactctaattttctgcctagaagtacattctggaacatagcacagacagaatccaggtagagcacaggagttttgctgagttaggagggtagatattggaattcaggaaggctgagtgggctggaattcacagggagagtacctgataagacaaagctttgtagagaagaagttccagaaatctacataaatcgttccttgagtttgttgctgatcagtaatttatgcatgtctacggttaaatgctatgtattatttattgttgcgtaacaagtcacttcaaatcttagtggcttacaatattcatttatctcctgtagtttctgtggatcaggacttcaagaactctttggtttggtggttccagttcaggctctcctgaggttgcatgcagttagatgtggctagggctgcagttatttatttatttatttttaatttatatatatatattattatactttaagttctagggtacatgtgcacaacatgcaggtttgttacatatgtatacatgtgccatgttggtgtgctgcaaccattaacttgtcatttacattaagtatatctcctaaggctatccctcccccctccccccactccacaacaggacccagtgtgtgacgttccccttccggtgtccaggtgttctcattgttcaattcccacctatgagtgagaacatgcagtgtttggttttttgtccttgcgatagtttgctgagaatgatggtttccagcttcatccacgtccctacaaaggacatgaactcatcattttttatggctgcatagtattccatggtgtgtatgtgccacattttcttaatccagtctatcgttgttggacatttgggttggttccaagtctttgctattctgagtagtgctgcaataaacatacgtgtgcatgtgtctttatagcagcatgatttataatcctttgggtatatacccagtaatggtatggctgggtcaaatggtatttctagttctagatccctgaggaattgccacactgtcttccacaatggttgaactagtttacagtcccaccaacagtgtaaaagtgttcctatttctccacatcctctctagcacctgtcacctgtttcctgactttttaatgatcgccattctaactggtgtgagatgatatctcattgtggttttgatttgcatttctctgatggccagtgatgatgagcattttttcatgtgtctgttggctgcataaatgtctgcttttgagaagtgtctgttcatatcctttgcccactttttgatggggttgtttttttcttgtaaatttgtttgagttctttgtagattctggatattagccctttgtcagatgagtagattgcaaaaattttcttccattctgtaggttgcctgttcactctgatgggctgcagttatttaaaagcctgaaagaaactggaggatccattcccaaaggggctcatttacgtggctggaaggttggtactggctgttggcatgaagctctagttcctgtccaaagggctgttttgagtatcctcacagcatagcagctggctttccccagagtgagcaatccaagaacatgacaagaagtgtaatacttttatgacctagcctcagaagtcacctcacatccacattctccctcaaattctttccaagttccaaggctgaatgcttacaaagtaaatatcacgtgtgctttactgaccattatatcccatccactggcagacaaatgggtaagcaaaatgtggcatacacctaccatggggtattattcagccttaaaagggaaggaaattctaacacatgctacaacatagatgaatctcgacaacatactaagtgaaataagcccattacaaaaagacaaatactgtatgattccacttatatgagacacctagagttgtctaatccatagagacagaatgaaaaatggtggttcccatttttcagaactggagaggaggaagaattgtttaataaatatggagttttagtttgggatggtgaaaaaattctggagatgaatggtggtgagggatgtacaaccatgtgactgtcctcaatgccactgatacttaaaaatggttaagatggtacattttatgttatgtatattttaatgtaatttaaaattaaaaataaaaggttttttgaaccatcattcctccttttaacatatgcctccaactattcacaactttagaaaagtgaatttaaactaatatataaagttctataatttttttactcattaacccaaattaatattgttagaatttcaagtagtataagataaataagaattcctagagctgcttaaatcactcaccagcaattcctctttctacaagtaaagctagtattgtttttccttcaaaatggatatatctgttaacacttactatatgcctaatattaagtaactattacatagtaaacaatttcattatttcatttaatccttcgaatatcattgtgagtcaggctttcctattaccctatttttcaagtacaaccaaaagttatgaattattaagtaacttgcccaaggtattattcttcccatttttacatttgtgaaatcaaatcttaaacatgttaaaaatttcataagtctttttgtgaactaaaagtcataatatcaaatcaaacccacatagttccaaggtccaaactcttttcatttgcacctgtagtccctacatggcaccatcctatttctgtgtcactgtgcaaatttaggttcctggttttatcttaaaatatcttgctaaataaatttattaaatatgatcatctgaaacagttcccatccttcaagtagaattgaggccaattaaacctagtcagctggacttttacagtgagagttcatcagttccagccaccatgggaattaaacacagaccctaaaacagtgattctcaaaacatagcagaccaggaaaaaacactgcctggaaatctgtgaaagccccagaatcagaaactgagaatggagctctgaaatctgttttaacaagaacttttgatgattatatgcatgctaaagtttcagaacatcttgtctaaagaccagcaggaccaagttttcaggttccctaccttgggtagggaaatataatttgttttggattacagagtatctcttcactttcccaagcacagtaaatatattcttctagtctctaaaaacttaattttaattgagatgacttccaaaatatgaaatcaagatttaccttcaataaaacttattaaacacgaaccaactgcttcaactttatacatttgtgaataggctaatataaatgcctaggttatcagtaaggctaatttttaaattcagtgtaatttaaaaggttttatcatcttctagtaagtaacagaataaataagaattcctagagttgcttaaattgcttatcagcaattcctctccctaaaggtaaatcatatattctttccaatctctctagccaagtctgttcaattcattttcacaattttaaatttagctaagcttatccaagaaaatggatgatgatttattaaattacctgtatatataacttttccttcttggcattcagaaagaggccttttcccacgtttgtgtgctttttcccgaaatcttactgttaccaccacattcggattaccagcactgcaattcattttagaaaaagatttggtttccacaaggtttccaaactttttgttgacaaaatggtggacagcttttctgtggtctttgtttgtatcaggtttaaaggtaaatttggaattttctttctttgcatccaaatatttaaaaaagtcaaatgcttcctcttcagataccaaatgacaaagttctttatattcaagatttggttttacaacaatttcactgttttttcctacagttactaaaaatggaaatttctgcctaatggcactgtgtaaactagccctctggtttttgtcaaggattctgcctattgagaattcaggaggtagtccaattagctctgttttagaaagccacttctctcttacatcacaggcaaaattattcagtaactcatgagttttttcatccaaaaaggagcttaaaacatcagctttttcttcacatttggaagttccatcaacgatagtatcttccttttctgaaccagactgatgattttggtcaccatcagtgtacttaatcaaagtatgaacttcttggtttcttccatcttctaaggacagattttgaagatctagttttggttttttgggaaaattatttggctcaagttgtatttcactaatcttgaaaataggctcatcgatggtcttattaactaactgtccctgttcatcaatttcaataacaataaagtcacttggtgagctttttatagtgccatgaaatccaacgtgatcattaaagaaacacaaagaactaaacctgattctataatctgtatcttcttccattcttctataacagtgcctagaaaacaaaacaaagaggtggttagttaacagaaagagaagttatggatgaccaaataggaataggtttgcaggatttagttaattctgtctctcttttaattctgagtcttcttaaatggtatcattaacttaatttataactatatgtacttcctgtgtactttgactctcctataccaagctgaattaataggcaaactatttctggtatagctaaagatttgttaacttgtatcttcactcactccagatttgtacctattatccaggattaaaatgagtcaattttatcttaaaaatatcatttgtaggctcacaagaagaggtgagaacacaggactataaaacaaagatttgtccaaattccattcctggagcctaaaatttccagctaattccagagaacatgtggctaagttttcttatattattagtggttagtgacaggagaggtgacaaaaagacaataggaaaactgatgggtaaatgaagttctaaatacaaatttgtgatttgattatatttcaaggtaggattaagtcagtcctgggccttctctaatgcccccattaggacaaatagaagctttcaaggttgagccagaggaaagttctaactatatcattggcatcagacagaagaaacccttacagagcttcctggaaacactatgcaagagaatagtactctgatctctcacttttcacacaaacccatggctaccataccatatggagctgcaggaaagataaattgcccaggggccccatactagtgagttctgtgtttcccccacattctccaagtaacttatcatcatctggaccatcatctcatacctataatgtattctactaatctgaaccaatttagcaaatcacaccttctcaatcctttccatcatgccatatagaaatcactacaaattctccatatcctaatttcctaaggaatatataagatatacttactttccttaattacttaatttcctgtacagttccctcactttcttgccctaattgaaatctggctatttcttcaggctgcttcttcttcagtcctctcaagtaaaggctattttttctttcccacccatctaccttaggacctggaggctgtaaatattggtctatgtttgtcactgttcgttgcaagccatttcttcctctactacctccaaaaaccccaattcttttgaagagcctgccattgggctttaccatctgctgtcatcctctctcggatccccagacaactctgcttcattcactgatctctggctcactaccttcttatccaacatgatttttatgatcatctatatggatcatccattcaatgtcttggaccctcaagtcctcaatctcaacctcaacctcacacctctacttcatcttggtcatccactgtcacggtcataactttgactttctcatctccaaaaactgcattaaccttaagcatctgattcttatgactcccaatgtcctttatcacaccaactttaatacttccattccaaaaacttttagatattgtgaaggtccctaactcctgcttctataactagcccacaaaccagccagaatggtcttaaaaggtaaattaaatcatatcacaatccagtttaaaaccctctagtcacatttgcaataaaatccaaattactcaccctggcttccaaggacatctaagattagggaccctgcttattctccaaactcatttgtacctttaccccattacccactatactccagctactctggccttcttcaatagttttgtgctaactgttcctgttgtttaaattgttccctccccaatcatatagctgcatcttttaggattcatttcctcagagaagtttttcctgaccaataatctacaggaacctgcaagtgattctctttttttttgagacgaagtctcactctgtcgtccaggctggagtgcagtggcatgatctcggctcactgcaacctccgcctcccgagttcgagcgattctcctacttcagcctcccgagtagctgggaccacaggggcgcgccaccacgcccggctaattcttgtatttttttagtagagatggggtttcaccatattggccagggtggtcttgaactcctgacctcgtgatccacccgcctcggcctcccaaagtgctggggttacaggcgtgagccaccgtgcccagcaagtgattctctttcacaaaaccctatttaattttctgcatagcagttctaggtaaagtttttctttattatttattgtatatctcctccaaagagaatgttagttccacgtgaggagtaaccttgtctgccttatttactactgatgatcacacattttgaacagtgtcaagcacatggtaggtctgcaataaatactattgttaaataaatgaaataactagtacaaaataagagctgtaggaatgaagtggaagataattagaagaggcataatgcaagaagtggccatctaagtcctccatagttcaagagatagaaatgaggcagagacctcacaagtaatgtacaaacaaaacatgcaatgtgtgcaagaaaaacaagcagtccagatacagagcagtggggatgggaatgcagggagactacagtgctggaaaatgtagctgagttagtaccagattatggaagatgttgaatgccctgacaaggacttagaatctattgggtggtcaatggatggctactgttagtgtttgagtagaaaagtgacacaattccaaaacatgcttttggaattgtaagatgattctgatggaaatgagcaagatgtatccgatggagtaacagttagaggagttcaaaaacaaaacagcatggtcaagaacatagctgtagggattggccctgaaagaataatgatcttttctttctcccagaaaaaaggaggaagacagacattctaagcaagtgaaacaggtagggaaacttggggagaatgtaattccagcatcctggtagaagagtggaactgacctggaggacagcaaaggagcccacgtggcgttaagcctgaaggtgcagtattcccattcaacagagactgctgctgacagtgggcgggggagtagtttgcttggcccgtggttgaggaattcgttggcggaggagggatcctgagaaggtactagaaatactgaacccagtcctgcagaagctacttaacttcacagaaaactagggcgtcgttgccctccagcacgtccaaaggtgtccccgacaaggccagcagctctacctgtttcttctccctcctcttactctgcctgtccaaaggcacgacactagtccacgtcacctttctttgggcgcaaagggtatggatcctcaatgccaacctcgtcaccccccccccccacacacacacacacacacacacatacaagcccaccatcgcgcaagaaactcgaccccgtctacctcggttcagtggaaggcattcatttgcacaacgctgtgcgcatgcccggaagccttaagtgtttcagcctccgacaggggcgtaattaaaggggcaggcgcccacgtaaagacgcgccctacgcaatacgtggagtttctcactttgtggagccgcctggaggcgccaagatgaagcccatcggggaagtggggcggggccaacccggcaggccccgccccttcgcggcgcttcctagttcggctggttcttctgtcgccggcttcagcagcccgcgcccgggcaggtaaggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggataaaagcaaaccctgtccaggtgcggtggctcatgcttgtaatcccagcactttgggaggcccaggcgggcggatcgcttgaggtcaggagttcgagaccagcctggccaacatggtgaaacccctgtctctactaagatacaaaatttagctggcatagtggcgggcgcccgtaatgccagctactccgggggctgaggcaggagaatcgcttgaacccaggaggcagaggttgcagtgagccgagatcgtgccactacactccagcctgggcaacagagggagactccgtctcaaaagaaaaaaaaaaaaaaaaaagcaaaccctgagaaagcgagaaagcactttgagcatttagaatgggaacaaacggcgctattagtgcttcaaaaacgtaactgcccaaggcccctggtaagcagaggatactaaaatctgccttttccctttcttggagtggtccttgaagagggctatcgggaagttcaaatttcttctgttttcctgcagagcgttcatttgaagtttgctttctacctctccaaactgagcttctgatattccaggccaaacttgctccttcctcagccttctctatctcagtaaatatcggtaaacttggttatgctgtcttctcactctccacatcagcccatagctttctattggctccacctcagaatcctaggacttctgcacttgctctgctacgaccctggtcccagcctgcagcacgtcccacctggcttattggtaggctctcctaaatgcttctttcttgcttctctgtccttactccaacatcctttattcccagcagccccagtatccttctaagacatgagtacagagcatgtctcttttctcaaaacttccagcatctacatctcacccagaggataaacaaagtcaatacaaaaactctaaggcccttgaagacctggcccctttacctttctgacctcatctgctacttgcctgttccctcctctgcagtctcaccatgtccttgctgttgcccagtgggcccagttccaacctttgcatttacatttcgttttgtccacaaacttttcccacagatagtccagtggctggctttctccttctttttgacctttaatcaaatggcaccttcttattgaggcttcctgtgactaccatatttataattacaaccttttctctatttcgttttgttctttcatttcacttggcaccatctaacatactatagagtttatttatttgcttattgccttccttcctccattagaatataaactccatgaattcaggttttggttttgttttgttttttttctctaattttcctaatgcttcatctccaggggcctggagcagtatctagcacaaagtagacactcagtaaatatttggtgagtcaatggtattatattttgttttttaaatatatgcaaagcattttcaattacttactgttgtgttggatcaatgttcaagaaagatatgttaagtttaatttatggtacaccagcacatatcccagtttgtaataggcagccctatctaatttaatagctctggaagccctcaccagcttttgttcataatgatgatgttaaagtatctaaaaataaagattaatggttatacagcatattttgctaagaatatatggaagtaaatagtgtattttagaaaggatataaatacattaaaattaccatggttgatcaaataagacagccaccatctcaaaagcttagctattttctcagacttgttatttgtacgctttcagtagatcctcactactgttctggaaattgaacctaaatacagtctgcacatatctttaaaaataatgtgatataagaataatttctgccaggaaataataattgctcctttttttttttgaccacctattattatgtgacaagatttggccctttgcatgtgttgattttaattcttacagcaattcttaggtattactatctctgtttttcagataaagaaaagcaaggtgcagagaaatgtatttactagctctggtcacagttggctttggttagaacttaggcctgtgcaacctcaaagttcatcttccctccacccctgcacaatcttttcctctgatcaaagtgctaatgaagcagtcttaaaactttattaacacatttgacaagaatcttttgccctcctgttttgggcacagtactttgggaaggcattggattccataagcaggtgcttattttaatatatttctcaatcaccaccccaccttttacacttgtctgaattgtcttacttgaaaatatgaatgggttttctttactatgagagttagtggtatgaggaaacagtcatgaaggtatttacttatttgtaagcaacatatcctgttccacctgtgttaatcctaagtgtactaaagtaaatcttgaagaatttgaaagagatgacactttttaagtttttttttgcccagtctgttttcattattgaaaattcagaaaagcaaaatgaaaacaaaactatcataaaagtcatcaccaagggataaccacgttaatattttggcttatgttcttgtaagtatgtggttgggagtggtatatgaatatacatttaaagtaaaattttaatttctgggattttgaacttctgggcacatgtgtggaggagttgcagaaggccttctttttcctagtatccctacacttatcacctctgctggaagcctgggtgcaggagagctaccaaatttatccctggcctttagatagtctgggttttttcctcaattccttgtattttgctctaatttataagactactaagcagttctatcttgtctagctttgtcaatcatgttgtaccttacagtagagagaaatcttagtaaggaaaaataacttgaagagagcaactgcagagtctataggcaacctagatacaatttcttaattaaagttaaaaagtcatcagcctttcattcaacacaaatgttgtgagtcgttgctgaggtgaatttggttgggtcctagctcaggagagcacccatctaacagagaaagcaaacacataaacagtaaaacataataattattataacagaagaatgactaggtgacattttggagcaaaagagatgacaatcaggggaagctaacagtgccttttgaattgggcttgaaggaataataggcatttaccaggtggcctttaaggtatgtgggctattcttttacctggccctagatgacttcatttcctgtttcacagaaaaaataacagtatgtgggaactcttctcccttcaaatatatctgtatttaaacctctgcttccttctttctagattcaaaagaggtttctctctattcaaggctgatttcttcaccctatatgctattcattatcccatttgtattgccaaacagcttaagtcttaaacccttaacaccaacagttctcaaaagtctggttggagtccctaatgctctttcaggagatttgtaaggtcaaaatcatgtttagttaaaagattcattcagagtgcaatggattttaatgttccaagttaatttatacagcttcagattcctcattgcagcttacctttaggaagttatttcttgtcaaattttagtgtagtatcaaagagaaatatctactactttgtgaaaaggctattaaaatacacctttctttataactatatgtctgtgtgaagctggattttcttcatatacatcaaccaaaacaacatgctgcagtgggttgagtgcagaagcagatacaagaattcagctctcttctattaagttaaatattgaagagattagcaaaactttaaaacaatgttgttcttctgtttttgaggaaaaggtaattattttattaaaatatatatgctaacatctatatttatgattattttaaatgaattaataagtaatttttaagtttctcagcatcaatttattatggtaaatattggtagatataaccaacataaacaaaagccctttggggtctacaatagtttttaagagggtaaaaggtcctgagaccaaatttgaaaactgctactctcttgcatgctctcctccctctctttccctacccctccacccccattttccctcccctcatactcctctctctctctttctccttcccttcataaccagacttcttggaaaatctgtttttgccattcactcactttttcactatagctgttcccaagtcaccaatggccttctgatttcagagtctaacatatccatcagtgtctatttgacctctctgagtcttttataccaacctgccaccttttctagaagtctctggtatgctaccatcctggtttttttcttgccttcatgactaagcagtattttttaaaattcttctttcacatcattcctttccattctaagcattcctaataggcaacctcattttattgttgcttcaactgtatatgtgtatatgctcttaatttgtatgagggcatttcaaaaagtttgtggaaaaattgaattaaaagataaaaaatgtaaactttggctcagcactatggctcatacctgtaatcccagcactttgggaggccgaggtgggcagatcacctgaggtcaggagttcaagaccagcctggtcaacatggcgaaaccccatctctaccaaaaatacaagaattagctgggtgtggtggtgcacacctgtaatcccagctacttgggaggctgaggcaggagaatcgcttaaacctgggaggcagaggttgcagtaagccaaaattgcaccactgcactacagcctggatgatagagcaagactccaaaaacaaaaacaaaactgtaaactttatttctgaacataagcccatgaagttcaagacacttttgtaagcgataacaccagccatttgggccatccctaaagaactgagagtcctgggaatttaaccacatcaatgaagtcttttttacattattaactgaagaaaaatgggtgctctatgaagatttttcaagattgggaaacaaaaagaagtcagaaggagacaaatcaggactgtaaggtggatgcctaatgatttccagttgaaactcacagaattgcccttgtttgatgagagaaaagagcaggggcattgtgatggagaaggactctgtggtgaagctttcccaggtgtttttctgctaaacatttgactaaagctgtaacagaaaagctttagtttagaaacacttagaaaagctactgtttctcaaaaccctctctaataagcagatgttaccattctttttccctccagaaagtcagcaagcaaaataccttgagcatcccaaaaacctgcagccatgcccttgcttttgactgtctgcttttgctttaattggaccactgccactttgggggagccattgctttgattgtgctttaggatcatactcgtaaagtcatgtttcatctcctgttacaattttttgaggaaatggtttaggatcttcatcccacttgtttaaagtttccattgaaagctctgctcgcatctgcagctgatctgggtacaacagtttgggcagccatcaagtggaaagtttgctcaactttaattttcagtcagaattgtataggctgaactagttgtctatggtgttcactgttggttctgctgttaattataggtactcttcatttagggcacaaacgagatgaatgttttcctcgaaaatcgatgtggatggtctgccgcagcaggcttcatcttcaacatcatctcatcccttaaaatgagttactgatttgtacactgctgattttctgggggcattgtccccataaataaagcatcagtgatttcaccattcttccaaccaacctccaccataaatgtggtgtttgttcttgctttagttttagcagaattcatgttgctgtggtagaggttcttttcaaactgtcttattcttctcagtgtctcaactagatcctgtttagacatgaatgataagttagtatgagtttattttggaaatacattttgcaaaaaaaaaaaaattgaaatccatgcatggtttttgcacgatatgcattttccatgaactctttgaaaaccccttatatatgagaatacttacataatgagcattctttgctgaaacctctctcctaagctccagaccacatatataagtacttggtatgaaggctcctagatagtgccaaaggtagatatttcacatttaacatgagccaaaaaaaaaaaaaaaacttcattctatctccctttcttctaatcgctcatctctagtgaaattgttttgatttggcctcctaaatgttttgacgttttacctctccattcccctaccctatactttttccaagctctcctttctgctcacctggattattgcagaagttttcaaactaattttcttgcctcaatatacatccctttgatttttatccagaggaatccacttaaccatataagattatttaacatccctcctaaaaatcctaaagtggctctcctgtaacttttagtttataagttcaaactctttgtcttagcacatgaggtacatgatgatctggccctgctacctttccaccctcatctcttctcacttaatcacaggcatcctgtggtccagccatagcaagctctttgcctgagacacacatgctcttaccttttcccatgctattccctctgcctggaattttcttttgggcttatcctcattccctttcattcatccttccaacctcctactccaaccaaatctgtcttgatatccctattccagactgcctctgcttgatgccccttttctgggccccataacattcttgcagcatttatcactccctgtcactgtttgtatcccctggtatactgaacagcttggaaacaaagattttctcttctctgtgctcccacttgttagtacaaagactgacataaatattttctgaatgtattcatgaatgaaaggaaaggaatggtctttctgaaatagagaatggcatgaacaatgcattgtgttataaaagcagagttgtatggcatgacttttggagtcagacataattgtaagtcctggatctctcacttaccacctttgtaaaatagagatgataaaactgtactgggaaataatttagttgttccaaaagtaaatactgaacaataccattatctacagtatgcaagtcactaggtgtatattcatgaataaaattagcatggtcctgaactcatggatcttaaaatcgaatatgggagacagtaaacaggtaaacaaataagtatatgattacaaatacattgtgcagtgatgaaagataattaggtgaagggcagctagacctatttagatgtggtcaaagaagtccaaagagaagaagtgaatactaacatagaagcctctgatacagagaagcttttcgctttttactctttttgatagttttagaatgttgttccatatgaacacattatttactctaaaattgtatttttaaaatatatatagggaagcaaaaataattgacagaagaatatctgagtctatttgtcttaattggaaggaaagatcatttcctattgagaatgagggacacgcagaacaaataaaatccacatagaaagaagtaaaggtatgaaatagtcactaaggactatgagagaagacaagtggaaggattaacggcagtgttgaaggccctgtggaaagggggttaccataaatttgtattcacatcagcaaccctggtgtacaagtaaagttgttagatttatccctggctgcagctctccaggatggagtagcagaagtaaagggggattgcagaaataaagattctgtctagagagtagttgaagtggtgaagcacaggttttggcgtagtagcaaatgaattgtggtcaggcagatctcatggactcaaaaaatgtgcagaggtcaaggaagagcaaagtatgtgaaaagtgggtgggtggaccatatctgttaatgctacacaaatcatttcagtacgttttttttttttacttctaccaaagaatgttgcataaattttaattgtaaataagtactaattgagaaacataaattgaaaggtaaatgtttttattaatagatttgatttctgaatatgctaattctgatagtttgttgatattactcttaagaatttttctggtaagttttttgcccctttctataaattttactaggaaaatatcagtgtcagaaaaaagtcctccgatttttattgctattaatgggtggaaaaaggaagcaaacccagaggataattggacaaatgaattacaattttaatttcatcttaggatatcaatgacttgactttggaatgtttctttattatggtataatcagttgctgacatttcatatgatatagcaaagtgtgatatataagcttacagatgtcatctctaaaagtactgtaaaattttaatgagatttttccatattttaggaatagaagatgaacaaacccataacaccatcaacatatgtgcgctgcctcaatgttggactaattaggaagctgtcagattttattgatcctcaagaaggatggaagaagttagctgtagctattaaaaaaccatctggtgatgatagatacaatcagtttcacataaggtaacagataaaattctttgtatttttaaattcttacatcacaatatggaatgattaattggtataagtactgtctaatgtggcagtttagaaagtaaacctctccactatggaggagacattggtagtaggtaacctctttttgattgttccttttgcagttttgtcttctttgtcccatatgtcaatagggctaatactgtgatctctcaaataagttttttgggttagaatcaagattcccacctttgctgtggttccctgtttggcaagccaagtgaagttcactctgcctcacacttctcatttccagattgaaggaaaataagaatgttacaagaatgtctggtaaaaatctagagcttaaatttcaaagtgtgtgaatctctaacacactctaacaatgtattttgggactttttcaatttgacgttttaaagttgttgcttacaagtgtacacttctgtgcacagaattcttaaatcttagctaggatttctcagtgctgtcttcagataatttcaatttttcctttttactcatctctgctcaatttagtgtaaaatatgcatgcatattttatttttgtcagtcattgcagttaaaacctatgtcaaaatgtttctttggtagcaaaaggaaaagaagactatttgttattttcagcattaatctgggaaagaacctaaaagacttggctcccttgcaggaaatatttcctcataagaagagcgaacatgttaaattacttgaaagaagcttaagtttaaactgtgttaagccaatgtttaaagataattttttgatattactgttaaaaacttatggaagataattggggcagtggtggcaggaagataaagctcttctcttttttttttcttttttccaagactcattcctgtgacagaaaaagcttttctttacagaataatacctgcaaataattgtgaaaagaatggtagaatgagaaaaatacctatttgcaaccaccaatgagtaactgattcatgcaaggctcatcactgaacctaaaagcataaggtgaaaggtggttgttctcgtgcatgtgagcaggatatgcacaagattttaaagtattataggctgagcacagtggctcatgcctgtaatcctaacacttgtggagaccgaggtgggcagattgcttgagcccaggagttcaagaccagcctggacaacatggtaaaaccccatcactacaaaaaattagctgggtgtggtagtgcacgcctgtagtcccagctacttgggaggttgaggtgggaggatcacctgagcccaggaagtcaaggctgcagtgagccatgatcatgccactgcactccagcctgagtgacagagcaagaccccctcaatagatagagaaaaagtattgtacacaaattacttgtgaagtatgaaagagaagggtacatttttaatgaggaaatctgaagtacacttccttcaccaagtgatcaaactttagcaccaataataatggtacaaaatgctaatatgtacccctggatgtgatacaatgggaaaggcacattatacctatgtagtatttctaccaaaatgcttaatctgaatttaatcatgagaaagtagtcagataaatctaggctgttagacccattctataagacatctggcccgtattctaaaacacacacacccacagacacagattgaaagagagaatgcacaagagcccagatatggcacaattttatcaattattcaattggtgaatctaggtgaatggttgttcattctatcattttttcaacttttctgtaagtttgaaatttttaaaaataaaatctttagaggaaaaacagaaagaaacaatattggttaaatttttaaatgttacttttcaaaactaatttttgattttaaagaaatggaaagaaatgggttgaaagccgactttgtgatttttttcaatttaattgaattacagttaagatcaaaggaataatttcctaagtttttgtgtgttctgtttctttaattaagcaggtgcatttattaaaaattatatagctatcagagtcttaagtcatgtgggaagtaatattgctagtagattaagaatacactcttttgtcaaatgagatctgaatttgtacctcaacttggatacatcatattggctgtgtggctatgggctggttactctacctctccaagcctggctttttcactagtaaattcatatgataatcataatatctttgaacatgctcatgtgtgtgcatcctataacccactaagtaaatatccagtaagtacccagtaaattattatcatcatctttggcatcttttttcctcctatctttcctgtctctctgtaattcttgctggttctcttgttgtcccttttctttaatgttgtaggagatgctgtgggcaaaatgggcaggggagatcaacacctattttcatatgacctcagtttataaatgctattgtttgaatgtgtccccaaaagttcatgtgttagaaacttaatacccattgcaacagggttgataggtgggacctttaaagggtagttaggccatgagagctttgcccttatgagtggattaatgtcgtcatggcaggagtgggttagttatctagggagtgggtttctgataaaaggataagttaggccctatttttctttttctctctctctctttttttttctctttcacatgcacgtgtgcatgctcttttgcccttctgcccttccaccatgagatgatgtagcaagaaggccctaaccagatgcagcctctcgatcttggacttcccagcctccagaaccgtgagccaaattaactattatttataaattaccctgtctgtggtattctattattgcagcacaaaatggactaagacaatagactaattttgtttctttgttacttacttttaaggagatttgaagcattacttcaaactggaaaaagtcccacttctgaattactgtttgactggggcaccacaaattgcacagttggtgatcttgtggatcttttgatccaaaatgaattttttgctcctgcgagtcttttgctcccaggtaaactgattgtgaccagggtgtccacaattagggtggaaagacaaatggcagaaatataaatgtttcttcttactcttccttttttctcatagtagatgaagcttacatttgagagtccctttctttcagcactcctcaactctttaaaaagcagcacagacaaaggacactgtggactctgctgctaaggtgatagaagcttcgtaagagttagatagttttgtgccaacaggaagtttagaaggaaagacttcatacttctggcttaggctgtaagaaagtaattataattttgagttcttcctttttttcatcttcaacttctaccctgatgggactctataatcataattttaaaaaattgtattctgatgtggtagtgtctagttgccttccttataagctttctttttttcctttgatgcctttcacaccagtggttctcaacctttatcatgcataagaatcacttaggttctggttaaacatgtagtttcctagggtctgttccaaatctatgtaatcagaattctggaattgggtttaaggtctatattcttaaacaggtgcttcagtgcctctgatataggtggctcatggatcactgtttgaaaacactgccttactctctttacccatcttcattataacttacagattcttactaggcagcttcttgtgtgtgctgtgagaatatgagaccaacctgtagaaactggaatgatattaaatgaaccaagtttctagtttaactttttcacaaccactttttcttactgaaaaaccacttgtatcttacttcatttgttagatgctgttcccaaaactgctaatacactaccttctaaagaagctataacagttcagcaaaaacagatgcctttctgtgacaaagacaggacattgatgacacctgtgcagaatcttgaacaaagctatatgccacctgactcctcaagtccagaaaataaaagtttagaagttagtgatacacgtaagtaacattttcagtgctttccactagggatttgtcattaagactaccagtgctttaaaagaaagctcttgctcttttgtttgtgcagcaatcacaggcacactggcaatagctcttttgtgagttgtttcctcctgatatattaagaaccatcttcattgtattaatcagtgattagaggcaataggacatgcaaacaaccagagaagctatgaaaaaaaataagtaaatatttacataacttggaaaggtcactttttaaaataaaatatgtgactagagttttgggtaggtagactagacccactcaaatgtgtgactagaattttgggtgggtgactacagtgttcagagggtaggatcaccaaacagagttctcaagaaaaacttataatttgtattttagaaatggttttatcttctctcatcttgtctaattcaaaatcataaatatttgcatatatgtgaaatcttcaaatgagaaaatattataattattaaaacgaatttttaaaatttaagcatgtttttcttattttgacataggttttcacagtttttcattttatgaattgaagaatgtcacaaataactttgatgaacgacccatttctgttggtggtaataaaatgggagagggaggatttggagttgtatataaaggctacgtaaataacacaactgtggcagtgaagaagcttgcagcagtaagttatattttcaggaataaaaagaaagagttgcttcatagtgtgccctataataggttttaaagttaatctttaggaaatacattatttcagtatgtattttctttaaataaacatcattctaaatagtagttcttaaaattttaaaatctgttgaacactatggaccctacccctagaaaaatgtggttatgtccatgtacacaagatcatacatacaattttgggagattcacaaactaaagttgagaagccctgctccacatagtgcttcatgtgtaatcaagattaaaatggtaagataccaggaaaactatttttaaaaaaccttgtttgcattacttttcccatttaaaaataaaatttaggaagtatacattaagaaaaaacattaaaattttttttatctgtgtcctttgttgccatttctactgaggtgtttaccttttacttacttgttatattctaaatcttttgttagagcctaaaaatatcaatagaatgcatatgtatgtgataaagatagtcactctttgtcatatatgttgcagggcttttgtagggtttttttttccattttgcacctaaattgcttatgttttctgtttcctagaatttttttcaaatttttttgtgtagtgaaatttcgtgttatttcattttgtttccacaactcagtgaaatttatatatatttttcattccactaaccagccatgggccttgagcaaatcactagtatttctagatctcagttattctgtagaattgggagaataatacactattgttttaaagaaagggagatgagccagctgatctcttgatccctctgagcattaggaaccttagaattgtgtagtattacattgtatattttattttttcagatggttgacattactactgaagaactgaaacagcagtttgatcaagaaataaaagtaatggcaaagtaagtcttaatctggcagtgcggtgtagtggaaagaaaaaagacaaggagtaaagaacctggttcactctagagtatgccatgaactagtgatgtttgcacatatatgaaattaaaataaagtgtttagattagagaaattgaaagtacttttggctccataattctatgattacatatactcatatgcctggagattaaatagcagtcatttttatttatttattttttttgagacagagtctcgctcttttgcccaagctggagtgcagtggcatgatctcggctcactgcaacctctgcctcccaggttcaagcgattctcctgcctcagcctcccgagtagctggacctacaggcgtgtgccaccatgcctggctaatttttttctgtatttttagtagagacggggtttcaccgtgttagccaggatagtctcgatctcctgaccttgtgatccacctgcctcagcctcccaaagagctgggattacaggcgtgaccacgcctggccgcagtcattattttaagtcacaacaaagttacgtgaaatttcactatcatgtccttcattatcatgttttccacttccagaattcatgagagatcaattgtagagatacttaaaaacaactatctatagagtaataggcccttatatataaagtagcatctatagagcaactagagtcatgttatctgtaaggatgcttagaaggcattgatcctgtgtgctggaaaattgttggacatcatcaggaaaagtaggagggacaaagtaggaaatgtattctaattattatagtgattaatagtgattgatatttgagtgtgtgcaacatgccagacattgtgctatgtactttatgtgcattgtctgtctaacccttacaactgttacaactgcccattttgtttgttaactgagatttagaaacattaaatagcttgtccaagatcacatagccagtaagtgttagagatgggattgaaatccagatctgtttgattgcggagcctgaactttagatctgaatcgtaatgggatttaccaaattatacccattaaacccactgctgtaaatcaccaatcatagttacctaacctcaagtaagaagaatagactagaattgatttatgcacggtaaaaatgatacatgctgaaaaaagatcaaactttttttttcaggatttgtcttcttcactcctacccctactctccaattctaaaagtaacttgttcacagtaggtcatctggaaaatacaggaaaacatttttaaaatatacaagcctatatgcatgcaggacttaatacgtaggtgatgggttgataggtgcagcaaaccactatggtacacgtttacctgtatgacaaacctgcacattctgtacatgtatcccggaacttaataatacaaaccatctctcaaatatatcactcagagataaccactgctaatatttttatatacttgcttcatgatgtgtgtgtagcattttcccatgtcactaaaaataatttgaaaacattttaaattattgtacaacagtctagcatatgtgaaaatcatattttatttaaccatagctaggtttgtttctaattttcagtattaaaaataaagcttctttaaagttctttgcacataaatctttaaatgcagttatacttactttatcatctagggtaaagtcctagaaaaagaattactaggtaggaatgcatgaactttttaaagactttctaaatacacattcaaatggcttttgagataagttactaccagcaatgtattacaatttcaaactttactggttccttaccttcatttaatatcattactttttttttttttttttttttttttgagacggaatctcgctctgttgcccaggctggaatgcagtggtgcgatcttggctcactgcaagctccgcctcccaggttcacgccattctcccgcctcagcctccagagtagctgggactacaggcgaccgtcaccatgcccggctaattttgtttttgtatttttagtagagacggggtttcaccacgttagccaggatggtttagatctgacgtcgtgatctgcctgcctcggctgggaatacaggcgtgagtcactgcgcccggcctattattacaattttttaataagtgccagtctctggatcttactagcagaatgaacttggccaagttttttaactttctattcgttaattttctcatctataaaatgggacaatagtacttacttaagttattgtgaggattaaataaaacagataaatcacttgccacactgcctcgtttatagtataaattcagcaaacgttaactactcatgtttaaaatgtgccagtttggtggaaaatgggacacttactgttttaatttgcacttcttcaaatatttatgagactagaagaaattgatataatgaactgctagaattgtggatcattttgaatgaacaaaatgaataagcacttaaataataaaacacttatcatgtgccagatacgtttctaggctgtcatgtttacatttgctcatttaattgtctcagcatccatattacatactgttttctgcatttagcagataaaggagctgaggctcagtaaggctgttaacttgcggtaggtcacatatccaggagggggcagaactagactttaaatttaggatgtataactctgagccctgttttctttcgtcttaccacagatgctgccactttattagattgtaggtctctttagttttattactctcaagtatataaagacactcaaattaggttataaataatccagtgtgattaaagatcaaaaacatgtaaattagatgtgattcaagatcatgtctgtaaatcagtgctttgagtgtgttagaaaattcttgacagtattagcataaaaattcaacggacttcttgaaatcttatttgtgccatcattgaaaattgggctaaagaaagtgagcatcagcctagtccttaaccaaacttatcacaagttccaaaaatctgaattatttagcttttactgtaaaatagaaagaggtttggccagctgtagtggctcacacctgtaatcccaatactttgggaggccaaagtggtaggagcacttgaggccagcagtttgagaccagtctgggaaacacagtgagacctcatctttacaaaaaaatttaaaaagtagctgagtgtggtgtacaccagtagtccaagctacttgggaggatgagttaggaggatcacttgagtccagatggtcgaggccgcagtgagctatgattacaccactgcactccagcctgggcaacagagttagaccctgtctcaaaaaaaagaaaaagaggttttacttctaatgttgattaatactggctgaaaagagaagtatttgcagaaaattataaacagttacaataaacatatataaacataaacatcaagttagaaataatatataacatactatttttttgctctttttttctattaaaactttgaataacttccaacctatagctgaatatatatttattataataattttgcatgaaaaattatttgtcacaggtgtcaacatgaaaacttagtagaactacttggtttctcaagtgatggagatgacctctgcttagtatatgtttacatgcctaatggttcattgctagacagactctcttgcttggtaagctatttgttcatcagattgtttggctttttgtttatatgctggaatattaatattcattttgttactggattatttaaaccaaattcactttcatatttttcctgctctatgaaaattatacagttgatatgtcaacaaattatacagttgatatgtcaacaactgggttgccattttattaggtggtaatcttaaatgtagaattcagttaagactatactaggaagatgcttttatatatttttatcttcaaataacaaatgtaaacacccatttgagcttatttagatattatttttaataacttaaaaatgtagtcctaaattattaatgctataacatcatcttcagttgttgcctagaaaaatattctgtgttatatattctctgtagattttttattattctttctcatttttaatttggtttatttctttataaggatggtactccaccactttcttggcacatgagatgcaagattgctcagggtgcagctaatggcatcaattttctacatgaaaatcatcatattcatagagatattaaaaggtaaatgctactgtttaaaagtttttggaaagctgtctttaaagaataatttgctgtcactctattcacgattcatatgcaggtcttaacctagagcatctggacttttttcccatcactccatgaaagctcttctcaataaggacatctataatctcctttattccaagcccagtgacctacttccagtactcatcctacttgaccttttttgtttgttttaatagtagtttattctgttcttcttgacacttttgccttatggaaattagttgttttcttagtttatggatcactattcttttctgaatcaccttcatcctccatgagtacttttcagttctctttctttcttgtgtatttatctagttaaatatttacctactataagtaacatattcatatatagagctcaacatcaatcaaataagcacaaaataattatagaatgttaatatgtacagttcacatatatattatatgtattattattatatagtatagtacataggattaatataaagaagggtttccaagaaagtgacatttaagcagagattcaaagaatgggcaggaaataagtagacacaatttgagggtaactgtagaatggatgatggggagaagaacattctaggcagaaggaactgcatttgtaagaccagtggtgagacagaatatgggagcatgatgagttacaagaaatgaaatatgctttgggagccaagataggaggatcatttgaggccaggagtagcagacctgactatgttccctgaacaacatagcaagacctcatctctacaaaaaaactagtcaaacgtggtattgcatgcctacagttccagacactagggcagctgaggagggaggaggcttgagcccaggagttcaaggttgaagtgagctatgatcgtgccagtgctccccagcctgggtaataaagtaagactctgtctaaaaaaaaatgaagtaaatgcagtatgactgagatgcagaaagttatagggtggtggattggagataaaactacagagaagtgtaggaagctaagtcctataggacttaatagatcaaggtaaggcttttagttttatcacaagtgtaatgagatgccgttgaaaattttaagtaggaatatggcatcatatttaagttttgcaaagatgattttaactctagtgtagagaacagtttgtaagaagaggcagttagtaggctatcataggtggcagttcataagaagagaggggagcagattagaaagattaaaatggcaaaacttgttgataccttggctatgcaggggttcaggaagagcgaagtatcaggaatgactcctggaataatggcatccagacttgcattctggaatgattatggcatgattcacttatgtagaaaggactgaaaaaagacttggttaggttggggttagagagatggttagaaaatgtgaattctcttttgtacatgttgtgtttggggtgcttttaagatgtagtagtagagatggtagacagtgtgatatacagatttggagctggaggtctgagctgaagatataaatgtgtattacttgcatacaggtgataattgaagtgactgtattcacttgaggggagatgtagattaagaaaaggtcacaagattaagtcttggggaaccctaagacttaatggccaaatagaagagatgatcacaaaaaggaatctaaggaagtacacatacagagaagggtaagatgaaaacctggagagtgtggagtccctgaaaacgaggaaagaaagtgtttcccaagagggagtagtcaaaaagagtcaagggctttaatcattggattagcatcaccatggtctttggtgactttatggaaacccatttccaggtagtagttggtttagaaatcacattgtagttgagagagtgagagctagagaactgagataggagtatagacaagtcttttaagacattttactagtgaaggggacagctagaaatagataagtcattcaggaaactttttttaagctggcagagattaagctgtgcttatgtgcctataggaaggatccagattaaaagggagaggatagtatggaagagagaaatgagatgatgtgttcagtagggttactgagaatgtagaaagcagctcaagcagaggaactgaccctagatgagaaaagaaacgccatctcctatccttcatggattggtactttcttgtgttcttatatcattgtctcttttctccctgtatgttctttttttttttttttttgagacaagtttcactcttgttgcccaggctggagtgcgatggcgcggtcttggctcactgcaaccgtcgcctcccgggttcaagagattctcgagcctcagcctcctgagtagcttggattacaggcatccaccaccacgctctgctaattttgtatttttagtagagatggggtttctccatgttgatcaggttggtcttgaactcccgacctcaggtgatccgcccgccttggcctcccaaagtgctgggattacaggcattagccacccgcctggcctctctctgtatgtttttgctgagtgatattatgttaattttaactgctacttatatgtgagtgtcttttgaatctgtattattagcttccaatcctggatttttagtatccccgtaccaaaaacacttcatctgggtatcccacagtagcctttaagtcagaacattagaaatcaaactcatcagctcttcccaacctaaagtcttcccacatttcctttctgatccagtgaagtcactgttcattctgtctctcaaactgaacacgttctcattctctatatcatgctaattacaaaattctgttgtgtgagcctcaaaattttcactttccatttatcccatgttatgaccatttaaaccctcattatctcccatttgctttgttacaaaccttcgtagtcaacctaaatccagcctatcagttctcatctattcactaccacactactaggtcatggtcctaaaagttaagtctaataacatcagtttcctactgtgaaaactttagctggtatcctgttgctcacaggataaaatgcaaattatctccatgtttcttggacactcgttccttgaagttgaccatgtataccatatcatgtttttgtcactttgtacctgttactccatttgcctggagtgcctttctttccctcatataactattaacttctaataatccttcaatactaagcacacttttcaccctctgtttgaaatttttcctactttttccaggcacatggttgttctctcagcattttgtacctaatattaccattgttttaaaaaattatttatgcctttgtcacagacaagattttaagactccgccatgcccagcagtgagcttaaatactacacaacatagggagttctcaataagattgtgttgaattaaagtatgaaagcacataatgaattaattgagatattttggccatatttttttctcttcaaaagccagatagtacagaacaaaagaataaagaaattcataattgagatactttggttggaaatttgttttgaaatgaattgatacatactaagaaaggaattaataaaggtgccttggaagactttgtagtaatttaccctataataaatgatttgtggaataatgaaaatatctcttactaatgtagacagttttatttcatttttattctcctaaatgttttcctcaagaaacataaaaaaagaggacagttgcttctctttagctataatctgaattctaggtttatttctataaactttaggcttttatgatgcatactataaaacgttacactctgtaaatatgtatgtacatatgcatgtatgcatatacatatatacatgcatacatacgtacatctagctaaggaactgtttgacttttttggggtgggaaaaacatttttttcttcaaactttacatttttttcagtgcaaatatcttactggatgaagcttttactgctaaaatatctgactttggccttgcacgggcttctgagaagtttgcccagacagtcatgactagcagaattgtgggaacaacagcttatatggcaccagaagctttgcgtggagaaataacacccaaatctgatatttacagctttggtgtggtaagttccgtatacataattattaaaaataatcattctgctataattgtgaaaatgaagagaatattatttaatacacccatcttgtttatctctcttatgtaacaatataagtttttcacattaacctctacttataccagaaagtttataaaaacttcttccaatgtgtaaaacttttgagttgatttttgaaatgactacaagaaatgattttcttgccatctgtctttatgaattagcatgacacctaatgcattaaatgaatcatgtcatacagtatatactttagtctcacattttttgacatttactaatctacctctctattcccaataacttttaagatagagcaagagataggtgtgggtggttgaagaagccgggggctttttcttcattttattttttcatacgtgtttcatatatggaaatttaacttcatagcactgaaaataaggcatagggctatagaatatgcctaatgtttagaaaataatattctcctaagagccagagtaaattattcttgtgaagaatccccaagaggcaggaaaaggattgggagtccttagaacatatgttgagtggggctgactctttagtaagttgccaatagaaaagagctgcttatggtcatgttggggtccaagatgtccctgaaggagggatggtgagaaatgcccaaagctcatgttctttccactttaatatctaaaagacatagctttgtatagaatgattaatcaaattttgtaagcaagattcatattcattctagtttttgtcttgagtattatatatataatttattaatatcatgtataatatatatattttttagagagacaaggtctcactcagtcacccagactgaagtgcagtggtggaattatggctcgctgtagcctcaacctcccaggttctagtgatcctctcacttcagcctcccaagtagctgggactacaggtgtgtgccaccacacccagccaatgtttttttaaaattttttgtagagacagggtctcactgttgcccaggctggtcgtgaagtccggggctcaagttatcctcccacatctgtctcccaaagtgctgggattacaggcgttagccactgtgcccagcctatcttgtgtattatattaatgattttttttgtcttcataggttttactagaaataataactggacttccagctgtggatgaacaccgtgaacctcagttattggtaaatgaaatattcattttcctcaatccttttttctctgcttttgtagtctaaatttatatggataaatttgacatctaaaaataacattttctattggcaatctttccattggctattacacgacagcatatggaaaaagcattaaatattttcattctcagctctcccatgaagtatttgtgaagcctagaaaagtcacttatatattctttgttctgatttctttgtgggtaaaatgagaatagaactaaatgatttctgaggtcctctttagcttatgtttattttgtgtcacttttggggtggctactgttaataacagtgtttccagcattttcagaggggggaaaaaaaaggcttccattcaaatttctttcagaataaaattgctagtaaaagttatcacttatttctatcatggggtattttatttacaaagttacaataaaaaacataccaaatttgctattgttaggaaaaattcatatcatgtttttcctttgctctcacaccacaacaacaatcaacacagaagatttctgtgaccaaatgcgactgggaagggtttctccccaccaacaagcaggcaatctactttgcagcggaagtcagctggatctcctccaatttaattctgacactacattcctggacatagcatcagagtcagatcccacaggttaagagctcagtccccaagactgccatcccaccagacaccagttgtaagtttaggcctccagaacttctgaccaactgccttcaagttggagttcctatgacctcctctgtgggtatggagggctcaagattgaacccagattgattcactaagttgcagcatatactttacctaagttttccatcgttttgcctaagactttttccttcaaaatatataaaagcctcaaaactttggcttgagtaagaatgaaatgcagaaaaacataagctgtatctcagtcacaagttttgcatttcatcatataatagtgaaaatcataaatctttggagaaggttttactctttcacccattcttaaggtttgactgtgatgtgactctaaagtaataagattttcatacaagcacagtttttaaaaaagtgatcatctgaagaaccgttatgtcactagattctgccgttgtcaaacattttcagaatttatctttgaaagtggttttgaagagtttacatcctacctctcatgaatagtttttttcatctgtattagcttcctaggactgttataaaaatataccaaaaactgtgtgacttaaagcaacagaaatttatttgctcatagttctggaggccagagtctgaaatcaaggtatgggcaagactatgctctctctggagactccagagagaatcttgccttgctcattggatgtagggcttacctccaggattagccataatctggaatgatctcatctcaggatacttaattacacctaaaagggcccttcttttcctaataagatcacattcacaggttccaggaattatgacatagacatgttttgggggaccatgattcacccaactccacgatcttattcctacacttctctccctgttaatttttttttatcatggcctgctccctattttttcccctccttttttctctttgattcaacaaccttagtacccatagagaaatttgttgggtacagggaggaggagtcagggtccaaaagttggaattgcgctattagaagcacatcaagaagcagaccaccctgtgctgcccacctagtaaatgctgctaatgggaacatataagcaattagctcataacatagatataaaaattggaaggcaaatgggtggaagtatctaggaggtataaataattaaatatacatttgtatatatatatgtgtgtatatatatatatttatatatatatatatacacatacccagccatgtgttgcctaatgacaggaatacattccgagaaatgtgttgttaggcagtttcattgtgtgaacctcatagagtgtacttacacaaacctagatgatatgacctacgacatacctgggctatatggtattgctcctaggctacaaacgtatgctatacagcataatactctcctgaatactgtaagcaattgtaacacactggtaagtgtttgtgtatgtaaacataaaagaggtacagtaaaaatacggtattataattttatgggaccaccatctatatgtgatctgtcattgaccaattgaccaaaatgtcattttgtggtggatggctgtacttatttacataggatttgtcctgtatgtcttcaatttttttttttttttttgagacagagtctcgctgtgtcacctaggctggagtggcgtgatctcggctcagtgcaacctctgcctcctgggttcaaacgattctcctgccagccttccaagtagctaagattacaggcatgcaccaccatgcctggctaattttttgtatttttagtagaaacagggtttcaccatgttgcccaggctgggtcttcaattcttaataaggttttaagataagatagtaaaatgagagcacatgttattacaaagtagattaatttaaataattaaaatatatattctattttctttcactatgatttgaagctcttaaagttttaacactcattttaaagctagatattaaagaagaaattgaagatgaagaaaagacaattgaagattatattgataaaaagatgaatgatgctgattccacttcagttgaagctatgtactctgttgctagtcaatgtctgcatgaaaagaaaaataagagaccagacattaagaaggtatgcattttttatacttatttaaaaagtgaaaggggtggggttcatcatattttccagagtgtatattttaaagcaactgtataatgtggttcttttgtttttttctttctttttaaaaggttcaacagctgctgcaagagatgacagcttcttaaaactttattggaaaagactcttgactttttatatacacctatctcaaccatttttttaactgatttttttcctaaatattcttctttacctttaacaaggcataggctgttgcaggacagtggttattaaagcatgggttgaacttccaaaatataaaaatagagccaccatatcaacacttagccctacccattagtatcacccccagttcttacagtaatccctgagaaatctccttcaagcatcaccaaacacagtttgaaaattacagggttagcaaaaagagcctgggctgtatgtagggtggaaacactctgatctgaagcccagctgactccactactaatttgctgtaaagctttggacatacacttagctgctgtgagccactaataacattgggctaatatctgctgtgcttctctgacaggtagtcatgaaaatcaaatgatgcaaaatatatacaagcactttgtaaattgtaaaatgatacaaaatttaaagtttatagagccagttacaaaatcctattagtcatatatttatagattgtgttcacagcaatcatttaaccacaaataaaatatcccttgatgatactgccataatgatatgtccattattagattatgttacatgacaaagttgaaggaatttggcagatgcagttaaggttcctaaacaactcactttgagactgttgaaagggcctgacctaatcaagtgaacccttgcaagaagaattctccttgtaagccttgaagaagtatgtgagagggccacattggctaaaacctaaaggtggcctctaggagatgagacctaccttccagttgtcagcaagcaggaaaaaaaaattgggacctcagttgcaaccacaaggaactgaattctgccaaaaatctgagtcagcttagaagagtactccaagcttcagatgataaccacagcctgggctgacacctggatttcagctttgcatgatcctcagtatgagaatctatctgttctgtgctggacttctaatatatagaactgtgagataatgggtcacattggctggatgtggtggctcatacctgtaaatcccagcactttgggaggccgaggcaggcagatcacctgaggtcaagagttcaagaccggcctggccaacatggtgaaaccccgtctctactaaaaatacaaaaattagacgagcgtggtggtggacacctgtagtcccagctacttgggaggctgaggcaggagactagctggaaccagggaggtagaggttgcagtgagctgagatcgtgccactgcactccagcctgggtgacagagtgagactccatcataaataaataaataaataaatgggtcacattaagcctttaagtttgtggtaatttattattcagtaatagaaaacaaatacagatactctcccatgatgtttttcccatgatgatttcccatgatatttacaggttttgcccacatttgaggggtatgtggaaattatacagagcatgtacagcgggaggcttatagtgtacgtactgaaatgtggggttggagccccaacacagagaccccagcaggacactgcctagtagagctatgggaagggtgctgccaccctccagacttgagaattgtagagccaccagcagcttgcactctgagcttggaaaagccacaggcactcaacttcaaccatgagggaagccacgcaccctgcaaagccacaggagtggagctgcccacggcctcgagggcccaccccttgcaccagtgtgccaggatgtgggacatggaatcaaggaatatgttagggcttttttttttttttttttgagacggagtcttgctctgttgcccaggctggagtgcagtggcacgatctcggctcactgcaagctctgcctcccaggttcacgccattcccctgcctcagcctccccagtagctgggactacaggtgcccgccaccatgcccagctaattttttttgtatttttagtagagatggggtttcactgtgttagccaggatggtcttgatctcctgacctcgtgatcacccgcctcggcctcccaaagtgccagtatttaaagtttaatgtcttcccagctgggtttcagacttgccaggatcctgttgcccctttctttagccaatttctcccttttgggacaagaatgttttacttattgcctgtaccaccaactgtatcttggaaataaataacttatattttatttcagaggctcataggcggcaggaacttaccttgagtctcaaatgagacttaggacttttgagtgatgctagaatgagttaagactttgggaagggatgattatattttgcaatgtgagaaagacattagatttggggggctgggggtagaatgacattgtttagatgtttgtctccttcaaatttcatgtttaaatgtaatccccagtgttgggggtggaggtggggcctgatgggaagtgtttgggtcatggtggatgatccctcatgaatggcttagagccactggtgatgagtgagttctcactcagttcgtgtgagatctggtggcttaaaagagtctgctccccctttgccttccattgtgattgtaaccttcctggggccttcatcaaaggccaggcaaatattggtgccgtgctagtatggcctgcagaaccgtaagccaaaacaaaccttttttctttataaattacccagcctcagttattcctttatagtgatgcaaaacgggctaactatataaatttgtaatttttaagttatagattgtttttattaaacacttatgaatactgtttgaagtgctttaatttttataacaatcctatgaatttggtaataatcacattttacagatgaggaaattacccaagattatatagctaataagttgcgtggcagaaattagcatctggtatcagtttgcgatctttaccactaacacgatgtctgtgcatcatattaatcataatcattttctctgtcatatgttgaaagttattgtgccaaacattgtgctgagttttagaagcatgatctgatttgataaatctacaatgtaggttctattcttttacttcttgaggaaattttgagacccccaatgattaaataacttctttcccttgttcattgtattagactgcaattctccactcattatatttgatgccttttgcaatatggctttgtaatttttcccatcaggaagtaaagtctatttcctcaaccattaaatctgggctggccttgtaacttgcttacagaaaaagtgatggtcagttccaagcccaggtctcaaaagcactaatgcactacttctctcatttggaaccctgccactgacatgagaacaagccaagggtaacatgctgctgatgacagaccatgcaaaacagagacaaggcatctcagatgaggtcatccttaatcagcccacctgccagctgatcacaaacatacatgagacatgagaggtcagccaactgtagatttgtgagggagggtagctgttgttttaaactgctacttttttttttttttttttttttttggagagtctcacttggtcactcatgctggagtgcagcagtgtgatcatggcttactgctgccttgatctctcaggctcaagtgatcctcctgcctcagcaccttgagtagttggagtacaggtgtgtgctactgtgcccagctaattttttttttttaattttctgtagagacaggatctcactctgttgctgaggctggtcttgaacttctggattcaagcaattctcctgcctcagcttcccaaagtgtgagattagaggtataagctaccatgaaaatcacatctgggggctagtttgtgatgcattagtacggtatggtttgttattcgttagtatgaagattacaggtataagctaccatgaaaatcacattgaaaatcacctagtttgtgatgcattagtatggtatggtttgttattcgttagtatgaagattacaggtataagctaccatgaaaatcacattgaaaatcacctagtttgtgatgcattagtatggtatggtttgttattcgttagtatgaagattacaggtataagctaccatgaaaatcacattgaaaatcacctagtttgtgatgcattagtatggtatggtttgttattcgttagtatgaagattacaggtataagctaccatgaaaatcacattgaaaatcacctagtttgtgatgcattagtgtggtatggtttgttattcgttagtatgaagattacaggtataagctaccatgaaaatcacattgaaaatcacctagtttgtgatgcattagtatggtatggtttgttattcgttagtatgaagattacaggtataagctaccatgaaaatcacattgaaaatcacctagtttgtgatgcattagtatggtatggtttgttattcgttagtatgaagattacaggtataagctaccatgaagatcacattgaaaatcacctagtttgtgatgcattagtatggtatggtttgttattcgttagtatgaagattacaggtataagctaccatgaagatcacattgaaaatcacctagtttgtgatgcattagtatgactaaatcatgatttagtcatgtagccagtaagtggcagtcagaaacacacacacacacacaaggatgtggcccagtttgtcttattataaatacagcttggtaatagaaaactaagaaatgcaatctaacccctgttcatggcttgcctctttcccattaaccatccagagttcactaagaaactacagcctggctgaatcctagcaaatgagggtggtagtgcagcagcactgacagttgagtaggctggtatcaatctttttggagcacagaatcagctgaatgaagatccctactggaaggcatttgatgctcaggaatgggtcagtactgccattttgtgtggtagaacccatggctttcgcagggcaagagattttgccagtgctagtgagttttcctgtggccagaaagaaaatgatggaggccagatcctctggtgacctaccactgctggcatgtgctcctttcacagctgttcttcaaggaaaggcaaattcatttattcattcaataaattgaaaaatgcccactatatcatagaaacttctaggtgctaaggatgtagcagtgaatgaaactaagcttcttgtccccattgaacttgtattttagtggaagagacaatatgggcacagatatagaatacctaagtgccatgaggaggaataaagcaggattaaggtgagaggaacaaggagtacaatcagattgggaaattaggggagacttctctaaggagatgacactgacacctgagcagagacctgtaagtgaggaaggcatgtagataccgggttagagtgatccagcgtggggaacgcattcagtgcccttgaggctgtgcttggtctactagaggaacagagagctgtcaatgaactgaagcagactgaccaaggaaggtagagagccacgggcaaatcatgtagaagctactgggcaacagtgagacctaaactttcttctatgagatagtgccactatcataactagtacagtgtaaaacttcagtttgttggctgaattggggtgggggagagctacaatttatatgatttaaggtaaactgttcccagtcatggctagccatgaatcatttgtagaactatttgattcctggacccacctactgggtcaaaatctagtatgaagcccagaattagtattttatttaaaaaagaacattccaggccgggtgcagtggctcacacctgtaatccccacactttgggaggccgaggtgggtggatcacgaggtcaagagatcaagatcatcctggccaacatggtgaaaccccatctctactaaaaatacaaagattagctgggcgtggtggcgcacacctgtagtcctagctactggcgaggctgaggcaggagaatcacttgaacctgggaggtggaggttgcagtgagccaagattgcgccactgcattccagcctggtgacagagcaagatgccatctaaacaacaacaaaaattccatcctgaaacttatggctctatttgcaaagaaaatgtgaaaggatatacaccaaactgtttacagtacgtacctcaggcacattagtacattattttagctctgagtagaaatgccttagcttaaatgtttaaaagttttaataatgagccttttgttttttgagacagtctcgcactgtcgcccaggctggagtgcagtggcgcaatctcggctcactgcaagctccgcctcccaggttcgcgccattctcctgcccagcctgtagctgggactacaggggcccgccaccacacccggctaatttcttgtatttttagtagagacggggtttcactgtgttagccaggatggtctcgatctcctgacctccgcctcggcctcccaaagtgctgggattacaggcgtgagccaccgtgcccggcccaacgatgagcctttctaaagctatttcagcatcttttgtaaaactgctaccaaagacatccatcttgtcacatctctaataaaaaggatttgaaaccaaatcgcacacaggagtgcattcaacatttttcacatgaatgaatacagtggcaagtctgagtttagtgtcaagtaaatcagtactggggtgcttctgttacagaaaatgaataactcatggcatttttattattgctacaacagtggcaaatttttaatctaagcactctatagtcacaattattcttgcctaggtttaaagctacttaaaatcctttttggacttaggcagactaattaacaaataaatgaatgggattcctaacctaacaccaggtactgaattatgaaacattacacaaacaattaaaaaaactatagtagaaaaaccaacagaacatacacaacttaaagagaaaaaatttttattgtgatataaaatgcacttataaaatgtccaccagaaggcatgtaattcttcactgctatataaatttactgggaatatgttattcaccatctaggtatgatactgccaactaaaacatactgtaaacgatgagttatactctataacaaatgcatcactgattttcagcaatcattggtttaataataattagtttaagactataatcacatctatattctggaatgtccatttactttaatgtagtgtagtggaatttagagtataattgcacatagatggtacagaaaaacattcacttctaaattattttataccttcatgacaggtagtcttcctgactgaaaataacagcttcagctatggtctgctccaggattcttaatgcaataatttgggtgtatgtgtgtctgtctacgtgtacacccatggaacaacttatatctttagtaaacaagtgcaacattattgtcagttattttgcatgtttaaatattatagtctgattatttgtaaacaaacaaaaccccaaatactctaaattctattttaaaaatctgtcaacccacaattattctaatatgctttacttactcgaacacaaatttctgaaaggtgcatatattaccttagataataaggtttagaaatgagtgcttcacactatgaaatgtgcatttccgataagtgatttatgcagcataaagtttagatcaagaaattacaaatcctggatccccacagttcatttagaaaatgcctcaaagttatggctcttgcagcaggtttaacagattaaacattaagtgttctagctccctctatttcaagtatcaaagaaatatgaggctcaaaatctctctaggttgtaactgataatgcaaagcattagaaaacagttaaatgtgttttgaaatacagtattaactgagattattaaggtgtttatctacgttagcctgttaagtaccaggactttaaagtaattttaaatctgagtatttgctcggaagtgataaagaacacaatttgcccataaatgtatggttttggagaaaaaagtcaatcctgatttttaaaactcaacattttttgtttccttttgaatgatattaatttaaatttcaatctgaacataaatgtttggcctcacagagcattagaaagataatttactaaggctgtttaaagtctttcaatgtcatcagaaatcctgcagtatagaaaatatctggtacccttaaagtttcagagtgagctgatctgcaattttaatgctattaaaaaaaagtcaaatataaaagactgctgcaatataaagcactatttctaaaagttgcagacatgatcctacagtctgacagagctagcacagctactcggagtaagcaacttgcggccttttccaaggcacactaagtttccagcttagaaaatactctagcctggtccttaacatattcattaagtaatatgaatattttaaggtctttctgtcccacaagaaagtagtaagtttaccctttgagacatcagactttctagaactggcccaactgtataaaattttaagaagtatttgaagtgtggaatcaacgctatgaaaacagtgtgacaaaattaaacattatgttgaacccttttctagctttaactcaaaaatagaaatcatgagtcttctataacattaattttaaaaacacacagaagtgaaaagtgctattttccaaaaagtacaatttttttccctactttatatcaacatggaatgatttcagttctcctgtactaaaagctggacttttaaaaaactagtattacaatgtttaatgtgatgactttaatcagtagtagcttcagtttccgctgggcccctaattagtcttcgaattcctctttttcctgcaggaccttttggttttgcaaaactttgcttgtgtgcatgctgcttgggatgtacttcttcataaaggaagtctgcagtcaactcatccccattgtctatctcgatctgtaaaagataaaattagaagcacaacattcaaaacctaatacaagcaacaagctggttttcaggtatatgaatgctcacaaataataccctttccagtaaggcagaatcaaggaccatatgtaaacagtttcactttcttcttttgggggaaggggctaaatgagttacttgaatatataatcagctacattcacttccttcttggttctttcttagtgctccagtttaaataatgtttaaaagtagaagccaccactacattctcaagttgctatgatacactatttattcaaggaacatttactcatgaccctttcatcacttgggtcacttgaaagccctctacaagagaggtaaacaaaccatggcccgaaggccaaatcttgcccaaggtaagattgttttacattttttaagggttgttaaacaacaataagaatatatgacagagattatatgtggcttggcaaagcctttacttactatttggtcctctgtagaaagtcagctgatccctgctatagaaggtgctacccatgataaagtgattgattcttaggaacttaaaaagcatgaagggttcagaacctaaaaacactggtagtttttaaggacctgtatttttatgagtttaagggctcaagaatatatatctttccccatgccttatctgtacttaagaaaatttaagaaaattggtagcttagttcccaaaattcaaatgtttatgcttattccttccttcccccaaactggaaagactcccaaccatcccataattcagtcataatggagactgtaattccttattaatatgcagtagaaataatcacaagtatgcagctctggcagcgctgtccaataggactttttgcactgatggaaatgtcctataaattctgcactaaccaatacggtagccagtagccacatttagctaatgagaatttgacataaggctagtggaattaagaaacagaactttaaatcttatttaaagttaaatagccacatgtggcttactaggaagtacagatatatatagagatggggatcatgacaggtagttcccaggcacttagaggagatcctaaggatttaggatgataacaagaaaaataaatattttcatttataaatcacagtacatcataaactacatagaaatgaaaagaaaaatttagcaaaaactgaagattttaaaataggtgggctacctttctaattacatccatttgtagttgtctttctacaatttctagcagacggctcttgcagctagaatacagcatccgctctcttatactgcatgtgtatccaggcattgaataaataaaaactgtaagttcaaataataacaaatataattagcatatcaatacataaacttcataaaactacatatataaacttcataaaaacaagtacagaaacttcataaaactacagctaagccctctgggcaagaaataagtaagaatatagggctgatacaccaataaacaaactgaaagtaatgtgttaaaaacaatgtatcatatacctatggactctaaatagtctccttcatgggaatgtttatacagaaagaaatggtaacgagctgaatccttgggaatcctctttggcaaatctttcagttctgtatttgttgtgttggccaaaattataatttcattttttatatctatttcctgccaataagaaacaaaatatgttcattaaaaccagatataaggaaattaagttaaaacatataataaaaagaccaagagataaaggaggaacttagttctggatggtttgactttttcacaatgaacatttacaaaatgaattttagaaatcagaaagctatttaaaatgtaaaatccattaataataaaccctatatgagtcataaactaccaaaaagagcagccacttaataatcattatacatctcttaccaactgcacatagttgagctgtctattattcaatttttccaaagcctgaaaggcttctcgagaaatgggaaatgctactccttgtagtgtttgatgcttagtgtccacacccacgtcagtctgtacctaagtatgacagatttaatttacaagtttagcagttagcagtatcctatggcaaacataagaaaacccaacctctataaaatagtatcattcaaccctagcccaacctataattaaaattatttttcacatttgtttacggtcctgctagcattttgtcaacatgcagagtgcatgacacatctttacgacaatgttggaagtgaacatttgaatgagtgtacagttagtggggtttgggtgggtttgtttttatgtttggt
